(12) United States Patent
Hoge et al.

(10) Patent No.: US 11,708,396 B2
(45) Date of Patent: *Jul. 25, 2023

(54) SIGNAL-SENSOR POLYNUCLEOTIDES FOR THE ALTERATION OF CELLULAR PHENOTYPES

(71) Applicant: ModernaTX, Inc., Cambridge, MA (US)

(72) Inventors: Stephen G. Hoge, Brookline, MA (US); Tirtha Chakraborty, Medford, MA (US); Joshua P. Frederick, Charlestown, MA (US); Matthias John, Cambridge, MA (US); Antonin De Fougerolles, Waterloo (BE)

(73) Assignee: ModernaTX, Inc., Cambridge, MA (US)

( * ) Notice: Subject to any disclaimer, the term of this patent is extended or adjusted under 35 U.S.C. 154(b) by 46 days.

This patent is subject to a terminal disclaimer.

(21) Appl. No.: 17/162,061

(22) Filed: Jan. 29, 2021

(65) Prior Publication Data

US 2023/0013773 A1    Jan. 19, 2023

Related U.S. Application Data

(63) Continuation of application No. 16/036,170, filed on Jul. 16, 2018, now abandoned, which is a continuation of application No. 14/041,011, filed on Sep. 30, 2013, now abandoned.

(60) Provisional application No. 61/857,304, filed on Jul. 23, 2013, provisional application No. 61/842,733, filed on Jul. 3, 2013, provisional application No. 61/839,893, filed on Jun. 27, 2013, provisional application No. 61/829,334, filed on May 31, 2013, provisional application No. 61/781,097, filed on Mar. 14, 2013, provisional application No. 61/754,159, filed on Jan. 18, 2013, provisional application No. 61/753,661, filed on Jan. 17, 2013.

(51) Int. Cl.
| | |
|---|---|
| *A61K 48/00* | (2006.01) |
| *C07K 14/47* | (2006.01) |
| *C12N 15/85* | (2006.01) |
| *C12N 15/113* | (2010.01) |
| *A61K 31/7105* | (2006.01) |
| *A61K 31/711* | (2006.01) |
| *A61K 38/00* | (2006.01) |

(52) U.S. Cl.
CPC ............ *C07K 14/47* (2013.01); *A61K 31/711* (2013.01); *A61K 31/7105* (2013.01); *A61K 48/0058* (2013.01); *C12N 15/113* (2013.01); *C12N 15/85* (2013.01); *A61K 38/00* (2013.01); *C12N 2310/141* (2013.01)

(58) Field of Classification Search
CPC .. C07K 14/47; A61K 31/7105; A61K 31/711; A61K 48/0058; A61K 38/00; C12N 15/113; C12N 15/85
IPC ....................................................... A61K 48/00
See application file for complete search history.

(56) References Cited

U.S. PATENT DOCUMENTS

| | | |
|---|---|---|
| 9,597,380 B2 | 3/2017 | Chakraborty et al. |
| 9,751,925 B2 | 9/2017 | Hoge et al. |
| 10,143,723 B2 | 12/2018 | Frederick et al. |
| 10,155,029 B2 | 12/2018 | Chakraborty et al. |
| 10,925,935 B2 | 2/2021 | Chakraborty et al. |
| 2005/0032730 A1 | 2/2005 | Von Der Mulbe et al. |
| 2009/0286852 A1 | 11/2009 | Kariko et al. |
| 2011/0244026 A1 | 10/2011 | Guild et al. |
| 2012/0065252 A1 | 3/2012 | Schrum et al. |
| 2012/0195936 A1 | 8/2012 | Rudolph et al. |
| 2012/0251618 A1 | 10/2012 | Schrum et al. |
| 2014/0073687 A1 | 3/2014 | Chien et al. |
| 2014/0147454 A1 | 5/2014 | Chakraborty et al. |
| 2014/0200261 A1 | 7/2014 | Hoge et al. |
| 2014/0206852 A1 | 7/2014 | Hoge et al. |
| 2019/0016781 A1 | 1/2019 | Bolen et al. |
| 2019/0185529 A1 | 6/2019 | Hoge et al. |
| 2019/0290742 A1 | 9/2019 | Chakraborty et al. |

FOREIGN PATENT DOCUMENTS

| | | | |
|---|---|---|---|
| EP | 2 700 708 A2 | 2/2014 | |
| JP | 2016-504050 A | 2/2016 | |
| WO | WO-2004019866 A2 * | 3/2004 | ........... C07K 16/244 |
| WO | WO 2004/076622 A2 | 9/2004 | |
| WO | WO 2006/028245 A1 | 3/2006 | |
| WO | WO 2006/111512 A1 | 10/2006 | |
| WO | WO 2007/000668 A2 | 1/2007 | |
| WO | WO 2007/024708 A2 | 3/2007 | |
| WO | WO 2010/048228 A2 | 4/2010 | |
| WO | WO 2010/055413 A1 | 5/2010 | |
| WO | WO 2011/005786 A2 | 1/2011 | |
| WO | WO 2011/012316 A2 | 2/2011 | |

(Continued)

OTHER PUBLICATIONS

Anadarini, S. et al., "Adenovirus Vector-Mediated in Vivo Gene Transferor OX40 Ligand to Tumor Cells Enhances Antitumor Immunity of Tumor-Bearing Hosts," Cancer Research, vol. 64(9): 3281-3287 (2004).

(Continued)

*Primary Examiner* — J. E. Angell
(74) *Attorney, Agent, or Firm* — Cooley LLP; Amy Mandragouras; Ariana D. Harris

(57) ABSTRACT

The invention relates to compositions and methods for the preparation, manufacture and therapeutic use of signal-sensor polynucleotides, primary transcripts and mmRNA molecules.

33 Claims, 7 Drawing Sheets

Specification includes a Sequence Listing.

(56) References Cited

FOREIGN PATENT DOCUMENTS

| | | |
|---|---|---|
| WO | WO 2011/130624 A2 | 10/2011 |
| WO | WO 2012/009644 A2 | 1/2012 |
| WO | WO 2012/019168 A2 | 2/2012 |
| WO | WO 2012/019630 A1 | 2/2012 |
| WO | WO 2012/045075 A1 | 4/2012 |
| WO | WO 2012/135805 A2 | 10/2012 |
| WO | WO 2012/138453 A1 | 10/2012 |
| WO | WO 2013/090648 A1 | 6/2013 |
| WO | WO 2013/103659 A1 | 7/2013 |
| WO | WO 2013/151666 A2 | 10/2013 |
| WO | WO 2013/151669 A1 | 10/2013 |
| WO | WO 2013/151672 A2 | 10/2013 |
| WO | WO 2014/081507 A1 | 5/2014 |
| WO | WO 2014/113089 A2 | 7/2014 |
| WO | WO 2015/007871 A2 | 1/2015 |
| WO | WO 2015/048744 A2 | 4/2015 |
| WO | WO 2016/011306 A2 | 1/2016 |
| WO | WO 2016/170176 A1 | 10/2016 |
| WO | WO 2017/112943 A1 | 6/2017 |

OTHER PUBLICATIONS

Anderson, B.R. et al., "Incorporation of pseudouridine into mRNA enhances translation by diminishing PKR activation," Nucleic Acids Research, vol. 38(17):5884-5892 (2010).

Annoni, A. et al., "In vivo delivery of a microRNA-regulated transgene induces antigen-specific regulatory T cells and promotes immunologic tolerance," Blood, vol. 114: 5152-5161 (2009).

Brown, B.D. et al., "Endogenous microRNA can be broadly exploited to regulate transgene expression according to tissue, lineage and differentiation state", Nature Biotechnology, vol. 25:1457-1467 (2007).

Cawood, R. et al., "Use of tissue-specific microRNA to control pathology of wild-type adenovirus without attenuation of its ability to kill cancer cells," PLOS Pathogens, vol. 5 (5): e1000440: (2009).

Dannull, J. et al., "Enhancing the immunostimulatory function of dendritic cells by transfection with mRNA encoding OX40 ligand," Blood, vol. 105 (8):3206-3213 (2004).

Database Geneseq "Human TNFSF4 gene, SEQ ID 11," retrieved from EBI Accession No. GSN:BBT93694, Database accession No. BBT93694 sequence.

Extended European Search Report, European Application No. 18179340. 7, dated Nov. 9, 2018, 14 pages.

International Preliminary Report on Patentability, PCT/US2013/062943, dated May 26, 2015, 11 pages.

International Search Report and Written Opinion, PCT/US2013/062943, dated Jan. 7, 2014, 17 pages.

International Search Report and Written Opinion, PCT/US2016/068552, dated Mar. 21, 2017, 14 pages.

Kariko, K. et al., "Generating the optimal mRNA for therapy: HPLC 11-13, purification eliminates immune activation and improves translation of nucleoside-modified, protein-encoding mRNA," Nucleic Acids Research, vol. 39 (21):e142-1 (2011).

Kariko K. et al., "Incorporation of pseudouridine into mRNA yields superior nonimmunogenic vector with increased translational capacity and biological stability," Molecular Therapy, Nature Publishing Group, vol. 16 (11):1833-1840 (2008).

Kariko, K. et al., "Suppression of RNA Recognition by Toll-like Receptors: The Impact of Nucleoside Modification and the Evolutionary Origin of RNA," Immunity, vol. 23: 165-175 (2005).

Kormann, M.S. et al., "Expression of therapeutic proteins after delivery of chemically modified mRNA in mice," Nature Biotechnology, vol. 29(2):154-159 (2011).

Kron, M. et al., "miRNA-mediated silencing in hepatocytes can increase adaptive immune responses to adenovirus vector-delivered transgenic antigens," Molecular Therapy, vol. 19(8):1547-1557 (2011).

Lennox, KA, et al., "Chemical modification and design of anti-miRNA oligonucleotides," Gene Therapy, vol. 18 (12):1111-1120 (2011).

Nemani, M. et al., "Activation of the human homologue of the *Drosophila sina* gene in apoptosis and tumor suppression," Proc. Natl. Acad. Sci. USA, vol. 93 (17):9039-9042 (1996).

Pichard, V. et al., "Specific Micro RNA-Regulated TetR-KRAB Transcriptional Control of Transgene Expression in Viral Vector-Transduced Cells," PLOS ONE, vol. 7(12): e51952: (2012), 10 pages.

Rotondaro, L. et al., "Efficiency of different viral promoters in directing gene expression in mammalian cells: effect of 3'-untranslated sequences," Gene, vol. 168(2):195-198 (1996).

Sahin, U. et al., "mRNA-based therapeutics—developing a new class of drugs," Nature Reviews Drug Discovery, vol. 13(10)759-780 (2014).

Singh, R. et al., "Nanoengineering artificial lipid envelopes around adenovirus by self-assembly," ACS Nano, vol. 2(5):1040-1050 (2008).

Smirnov, D.A. et al., "ATM Gene mutations result in both recessive and dominant expression phenotypes of genes and microRNAs", The American Journal of Human Genetics, vol. 83: 243-253 (2008).

Su, X. et al., "In Vitro and in Vivo mRNA Delivery Using Lipid-Enveloped pH-Responsive Polymer Nanoparticles," Molecular Pharmaceutics, (2011) 8: 744-787.

Suzuki, T. et al., "miR-122a-Regulated Expression of a Suicide Gene Prevents Hepatotoxicity Without Altering Antitumor Effects in Suicide Gene Therapy," Molecular Therapy, vol. 16(10): 1719-1726 (2008).

Van Der Jeught, K. et al., "Targeting the tumor microenvironment to enhance antitumor immune responses," Oncotarget, vol. 6(3):1359-1381 (2014).

Vinuesa, C. et al., "Logic and Extent of miRNA-Mediated Control of Autoimmune Gene Expression", Int Rev Immunol., vol. 28(3-4): 112-138 (2009).

Yang, L. et al., "miR-146a controls the resolution of T cell responses in mice", The Journal of Experimental Medicine, vol. 209 (9):1655-1670, (2012).

Wang Y. et al., "Systemic delivery of modified mRNA encoding herpes simplex virus 1 thymidine kinase for targeted cancer gene therapy", Molecular Therapy, vol. 21(2):358-367 (2012).

Wolff, L. et al., "Effect of tissue-specific promoters and microRNA recognition elements on stability of transgene expression after hydrodynamic naked plasmid DNA delivery," Human Gene Therapy, vol. 20, pp. 374-388 (2009).

* cited by examiner

SIGNAL-SENSOR POLYNUCLEOTIDES FOR THE ALTERATION OF CELLULAR PHENOTYPES

CROSS REFERENCE TO RELATED APPLICATIONS

This application is a continuation of U.S. patent application Ser. No. 16/036,170 filed Jul. 16, 2018, which is a continuation of U.S. patent application Ser. No. 14/041,011 filed on Sep. 30, 2013, abandoned; which claims priority to U.S. Provisional Patent Application Ser. No. 61/753,661 filed Jan. 17, 2013; U.S. Provisional Patent Application Ser. No. 61/754,159 filed Jan. 18, 2013; U.S. Provisional Patent Application Ser. No. 61/781,097 filed Mar. 14, 2013; U.S. Provisional Patent Application Ser. No. 61/829,334 filed May 31, 2013; U.S. Provisional Patent Application Ser. No. 61/839,893 filed Jun. 27, 2013; U.S. Provisional Patent Application Ser. No. 61/842,733 filed Jul. 3, 2013; and U.S. Provisional Patent Application Ser. No. 61/857,304 filed Jul. 23, 2013. The contents of the aforementioned applications are hereby incorporated by reference in their entireties.

REFERENCE TO SEQUENCE LISTING

The instant application contains a Sequence Listing which has been submitted electronically in ASCII format and is hereby incorporated by reference in its entirety. Said ASCII copy, created on Jan. 29, 2021, is named MDN_037CN4_SL.txt and is 9748552 bytes in size.

FIELD OF THE INVENTION

The invention relates to compositions, methods, processes, kits and devices for the design, preparation, manufacture and/or formulation of signal-sensor polynucleotides, primary constructs and mRNA molecules for the alteration of cellular phenotypes and microenvironments.

BACKGROUND OF THE INVENTION

Cancer is a disease characterized by uncontrolled cell division and growth within the body. In the United States, roughly a third of all women and half of all men will experience cancer in their lifetime. Polypeptides are involved in every aspect of the disease including cancer cell biology (carcinogenesis, cell cycle suppression, DNA repair and angiogenesis), treatment (immunotherapy, hormone manipulation, enzymatic inhibition), diagnosis and determination of cancer type (molecular markers for breast, prostate, colon and cervical cancer for example). With the host of undesired consequences brought about by standard treatments such as chemotherapy and radiotherapy used today, genetic therapy for the manipulation of disease-related peptides and their functions provides a more targeted approach to disease diagnosis, treatment and management.

To this end, it has been previously shown that certain modified mRNA sequences have the potential as therapeutics with benefits beyond just evading, avoiding or diminishing the immune response. Such studies are detailed in published co-pending International Publication No WO2012019168 filed Aug. 5, 201, International Publication No WO2012045082 filed Oct. 3, 2011, International Publication No WO2012045075 filed Oct. 3, 2011, International Publication No WO2013052523 filed Oct. 3, 2012, and International Publication No WO2013090648 filed Dec. 14, 2012 the contents of which are incorporated herein by reference in their entirety.

The use of modified polynucleotides in the fields of antibodies, viruses, veterinary applications and a variety of in vivo settings have been explored and are disclosed in, for example, co-pending and co-owned U.S. Provisional Patent Application No. 61/618,862, filed Apr. 2, 2012, entitled Modified Polynucleotides for the Production of Biologics; U.S. Provisional Patent Application No. 61/681,645, filed Aug. 10, 2012, entitled Modified Polynucleotides for the Production of Biologics; U.S. Provisional Patent Application No. 61/737,130, filed Dec. 14, 2012, entitled Modified Polynucleotides for the Production of Biologics; U.S. Provisional Patent Application No. 61/618,866, filed Apr. 2, 2012, entitled Modified Polynucleotides for the Production of Antibodies; U.S. Provisional Patent Application No. 61/681,647, filed Aug. 10, 2012, entitled Modified Polynucleotides for the Production of Antibodies; U.S. Provisional Patent Application No. 61/737,134, filed Dec. 14, 2012, entitled Modified Polynucleotides for the Production of Antibodies; U.S. Provisional Patent Application No. 61/618,868, filed Apr. 2, 2012, entitled Modified Polynucleotides for the Production of Vaccines; U.S. Provisional Patent Application No. 61/681,648, filed Aug. 10, 2012, entitled Modified Polynucleotides for the Production of Vaccines; U.S. Provisional Patent Application No. 61/737,135, filed Dec. 14, 2012, entitled Modified Polynucleotides for the Production of Vaccines; U.S. Provisional Patent Application No. 61/618,870, filed Apr. 2, 2012, entitled Modified Polynucleotides for the Production of Therapeutic Proteins and Peptides; U.S. Provisional Patent Application No. 61/681,649, filed Aug. 10, 2012, entitled Modified Polynucleotides for the Production of Therapeutic Proteins and Peptides; U.S. Provisional Patent Application No. 61/737,139, filed Dec. 14, 2012, Modified Polynucleotides for the Production of Therapeutic Proteins and Peptides; U.S. Provisional Patent Application No. 61/618,873, filed Apr. 2, 2012, entitled Modified Polynucleotides for the Production of Secreted Proteins; U.S. Provisional Patent Application No. 61/681,650, filed Aug. 10, 2012, entitled Modified Polynucleotides for the Production of Secreted Proteins; U.S. Provisional Patent Application No. 61/737,147, filed Dec. 14, 2012, entitled Modified Polynucleotides for the Production of Secreted Proteins; U.S. Provisional Patent Application No. 61/618,878, filed Apr. 2, 2012, entitled Modified Polynucleotides for the Production of Plasma Membrane Proteins; U.S. Provisional Patent Application No. 61/681,654, filed Aug. 10, 2012, entitled Modified Polynucleotides for the Production of Plasma Membrane Proteins; U.S. Provisional Patent Application No. 61/737,152, filed Dec. 14, 2012, entitled Modified Polynucleotides for the Production of Plasma Membrane Proteins; U.S. Provisional Patent Application No. 61/618,885, filed Apr. 2, 2012, entitled Modified Polynucleotides for the Production of Cytoplasmic and Cytoskeletal Proteins; U.S. Provisional Patent Application No. 61/681,658, filed Aug. 10, 2012, entitled Modified Polynucleotides for the Production of Cytoplasmic and Cytoskeletal Proteins; U.S. Provisional Patent Application No. 61/737,155, filed Dec. 14, 2012, entitled Modified Polynucleotides for the Production of Cytoplasmic and Cytoskeletal Proteins; U.S. Provisional Patent Application No. 61/618,896, filed Apr. 2, 2012, entitled Modified Polynucleotides for the Production of Intracellular Membrane Bound Proteins; U.S. Provisional Patent Application No. 61/668,157, filed Jul. 5, 2012, entitled Modified Polynucleotides for the Production of Intracellular Membrane Bound Proteins; U.S. Provisional Patent Application No. 61/681,661, filed Aug. 10, 2012, entitled Modified Polynucleotides for the Production of Intracellular Membrane Bound Proteins; U.S. Provisional Patent Application No. 61/737,160, filed Dec. 14, 2012, entitled Modified Polynucleotides for the Production of Intracellular Membrane Bound Proteins; U.S. Provisional Patent Application No. 61/618,911, filed Apr. 2, 2012, entitled Modified Polynucleotides for the Production of Nuclear Proteins; U.S. Provisional Patent Application No. 61/681,667, filed Aug. 10, 2012, entitled Modified Polynucleotides for the Production of Nuclear Proteins; U.S. Provisional Patent Application No. 61/737,168, filed Dec. 14, 2012, entitled Modified Polynucleotides for the Production of Nuclear Proteins; U.S. Provisional Patent Application No. 61/618,922, filed Apr. 2, 2012, entitled Modified Polynucleotides for the Production of Proteins; U.S. Provisional Patent Application No. 61/681,675, filed Aug. 10, 2012, entitled Modified Polynucleotides for the Production of Proteins; U.S. Provisional Patent Application No. 61/737,174, filed Dec. 14, 2012, entitled Modified Polynucleotides for the Production of Proteins; U.S. Provisional Patent Application No. 61/618,935, filed Apr. 2, 2012, entitled Modified Polynucleotides for the Production of Proteins Associated with Human Disease; U.S. Provisional Patent Application No. 61/681,687, filed Aug. 10, 2012, entitled Modified Polynucleotides for the Production of Proteins Associated with Human Disease; U.S. Provisional Patent Application No. 61/737,184, filed Dec. 14, 2012, entitled Modified Polynucleotides for the Production of Proteins Associated with Human Disease; U.S. Provisional Patent Application No. 61/618,945, filed Apr. 2, 2012, entitled Modified Polynucleotides for the Production of Proteins Associated with Human Disease; U.S. Provisional Patent Application No. 61/681,696, filed Aug. 10, 2012, entitled Modified Polynucleotides for the Production of Proteins Associated with Human Disease; U.S. Provisional Patent Application No. 61/737,191, filed Dec. 14, 2012, entitled Modified Polynucleotides for the Production of Proteins Associated with Human Disease; U.S. Provisional Patent Application No. 61/618,953, filed Apr. 2, 2012, entitled Modified Polynucleotides for the Production of Proteins Associated with Human Disease; U.S. Provisional Patent Application No. 61/681,704, filed Aug. 10, 2012, entitled Modified Polynucleotides for the Production of Proteins Associated with Human Disease; U.S. Provisional Patent Application No. 61/737,203, filed Dec. 14, 2012, entitled Modified Polynucleotides for the Production of Proteins Associated with Human Disease; U.S. Provisional Patent Application No. 61/681,720, filed Aug. 10, 2012, entitled Modified Polynucleotides for the Production of Cosmetic Proteins and Peptides; U.S. Provisional Patent Application No. 61/737,213, filed Dec. 14, 2012, entitled Modified Polynucleotides for the Production of Cosmetic Proteins and Peptides; U.S. Provisional Patent Application No. 61/681,742, filed Aug. 10, 2012, entitled Modified Polynucleotides for the Production of Oncology-Related Proteins and Peptides; International Application No PCT/US2013/030062, filed Mar. 9, 2013, entitled Modified Polynucleotides for the Production of Biologics and Proteins Associated with Human Disease; U.S. patent application Ser. No. 13/791,922, filed Mar. 9, 2013, entitled Modified Polynucleotides for the Production of Biologics and Proteins Associated with Human Disease; International Application No PCT/US2013/030063, filed Mar. 9, 2013, entitled Modified Polynucleotides; International Application No PCT/US2013/030064, entitled Modified Polynucleotides for the Production of Secreted Proteins; U.S. patent application Ser. No. 13/791,921, filed Mar. 9, 2013, entitled Modified Polynucleotides for the Production of Secreted Proteins; International Application No PCT/US2013/030059, filed Mar. 9, 2013, entitled Modified Polynucleotides for the Production of Membrane Proteins; International Application No. PCT/US2013/030066, filed Mar. 9, 2013, entitled Modified Polynucleotides for the Production of Cytoplasmic and Cytoskeletal Proteins; International Application No. PCT/US2013/030067, filed Mar. 9, 2013, entitled Modified Polynucleotides for the Production of Nuclear Proteins; International Application No. PCT/US2013/030060, filed Mar. 9, 2013, entitled Modified Polynucleotides for the Production of Proteins; International Application No. PCT/US2013/030061, filed Mar. 9, 2013, entitled Modified Polynucleotides for the Production of Proteins Associated with Human Disease; U.S. patent application Ser. No. 13/791,910, filed Mar. 9, 2013, entitled Modified Polynucleotides for the Production of Proteins Associated with Human Disease; International Application No. PCT/US2013/030068, filed Mar. 9, 2013, entitled Modified Polynucleotides for the Production of Cosmetic Proteins and Peptides; and International Application No. PCT/US2013/030070, filed Mar. 9, 2013, entitled Modified Polynucleotides for the Production of Oncology-Related Proteins and Peptides; International Patent Application No. PCT/US2013/031821, filed Mar. 15, 2013, entitled In Vivo Production of Proteins; the contents of each of which are herein incorporated by reference in their entireties.

Formulations and delivery of modified polynucleotides are described in, for example, co-pending and co-owned International Publication No WO2013090648, filed Dec. 14, 2012, entitled Modified Nucleoside, Nucleotide, Nucleic Acid Compositions and US Publication No US20130156849, filed Dec. 14, 2012, entitled Modified Nucleoside, Nucleotide, Nucleic Acid Compositions; the contents of each of which are herein incorporated by reference in their entireties.

The next generation of therapeutics must also address the complex cellular microenvironment of the cancer and have the capacity for cell, tissue, organ or patient stratification, whether structurally or functionally.

The present invention addresses this need by providing nucleic acid based compounds or polynucleotide-encoding nucleic acid-based compounds (e.g., signal-sensor polynucleotides) which encode a polypeptide of interest and which have structural and/or chemical features that allow for greater selectivity, profiling or stratification along definable disease characteristics or metrics.

SUMMARY OF THE INVENTION

Described herein are compositions, methods, processes, kits and devices for the design, preparation, manufacture and/or formulation of signal-sensor polynucleotide molecules encoding at least one oncology-related polypeptide of interest. Such signal-sensor polynucleotides may be chemically modified mRNA (mmRNA) molecules.

The present invention provides an isolated signal-sensor polynucleotide comprising a region encoding an oncology-related polypeptide of interest that functions, when translated, to send a death or survival signal. Such death or survival signals include those which (i) alter (increase or decrease) the expression of one or more proteins, nucleic acids, or non-coding nucleic acids, (ii) alter the binding properties of biomolecules within the cell, and/or (iii) perturb the cellular microenvironment in a therapeutically beneficial way.

Optionally, the signal-sensor polynucleotide may also encode in a flanking region, one or more sensor sequences. Such sensor sequences function to "sense" the cell, tissue or organ microenvironment and confer upon the signal-sensor polynucleotide an altered expression or half life profile (increased or decreased) depending on the interactions of the sensor sequence with the cell, tissue or organ microenvironment.

In one aspect, provided herein are signal-sensor polynucleotide comprising, a first region of linked nucleosides, a first flanking region located 5' relative to said first region and a second flanking region located 3' relative to said first region. The first region may encode an oncology-related polypeptide of interest such as, but not limited to, SEQ ID NOs: 1321-2487, 6611-6616 and 7355-7361, 7490, 7492, 7493, 7512, 7514, 7516 and 7517 and the first flanking region may include a sequence of linked nucleosides such as, but not limited to, the native 5' untranslated region (UTR) of any of the nucleic acids that encode any of SEQ ID NOs: 1321-2487, 6611-6616, 7355-7361, 7490, 7492, 7493, 7512, 7514, 7516, 7517, SEQ ID NO: 1-4 and functional variants thereof. The first region may comprise at least an open reading frame of a nucleic acid sequence selected from the group consisting of SEQ ID NOs: 2488-2496, 6617-6621, 7348-7354, 7362-7489, 7491, 7494, 7506, 7511 and 7513.

The second flanking region may include a sequence of linked nucleosides such as, but not limited to, the native 3' UTR of any of the nucleic acids that encode any of SEQ ID NOs: 1321-2487, 6611-6616, 7355-7361, 7490, 7492, 7493, 7512, 7514, 7516, 7517, SEQ ID NO: 5-21 and functional variants thereof, and one or more sensor sequences located such as, but not limited to, SEQ ID NOs: 3529-4549, SEQ ID NOs: 5571-6591 and functional variants thereof. The signal-sensor polynucleotide may also include a 3' tailing sequence of linked nucleosides.

In another aspect, provided herein is a signal-sensor polynucleotide which comprises an mRNA encoding an oncology-related polypeptide of interest and one or more sensor sequences such as, but not limited to, SEQ ID NOs: 3529-4549, SEQ ID NOs: 5571-6591 and functional variants thereof. The oncology-related polypeptide of interest may be, but is not limited to, SEQ ID NOs: 1321-2487, 6611-6616, 7355-7361, 7490, 7492, 7493, 7512, 7514, 7516 and 7517. The mRNA may include at least one open reading frame of a nucleic acid sequence selected from the group consisting of SEQ ID NOs: 2488-2496, 6617-6621, 7348-7354, 7362-7489, 7491, 7494, 7506, 7511 and 7513.

The signal-sensor polynucleotides may comprise one, two, three or more than three stop codons. In one aspect, the signal-sensor polynucleotides comprise two stop codons. As a non-limiting example, the first stop codon is "TGA" and the second stop codon is selected from the group consisting of "TAA," "TGA" and "TAG." In another aspect, signal-sensor polynucleotides comprise three stop codons.

The signal-sensor polynucleotides may have a 3' tailing sequence of linked nucleosides such as, but not limited to, a poly-A tail of at least 140 nucleotides, a triple helix, and a poly A-G quartet.

The signal-sensor polynucleotides may have a 5' cap such as, but not limited to, Cap0, Cap1, ARCA, inosine, N1-methyl-guanosine, 2'fluoro-guanosine, 7-deaza-guanosine, 8-oxo-guanosine, 2-amino-guanosine, LNA-guanosine, and 2-azido-guanosine.

In one aspect, the signal-sensor polynucleotides may include at least one chemical modification such as, but not limited to, modifications located on one or more of a nucleoside and/or the backbone of the nucleotides. In one embodiment, the signal-sensor polynucleotides comprise a pseudouridine analog such as, but not limited to, 1-carboxymethyl-pseudouridine, 1-propynyl-pseudouridine, 1-taurinomethyl-pseudouridine, 1-taurinomethyl-4-thio-pseudouridine, 1-methyl-pseudouridine ($m^1\psi$), 1-methyl-4-thio-pseudouridine ($m^1s^4\psi$), 4-thio-1-methyl-pseudouridine, 3-methyl-pseudouridine ($m^3\psi$), 2-thio-1-methyl-pseudouridine, 1-methyl-1-deaza-pseudouridine, 2-thio-1-methyl-1-deaza-pseudouridine, dihydropseudouridine, 2-thio-dihydropseudouridine, 2-methoxyuridine, 2-methoxy-4-thio-uridine, 4-methoxy-pseudouridine, 4-methoxy-2-thio-pseudouridine, N1-methyl-pseudouridine, 1-methyl-3-(3-amino-3-carboxypropyl)pseudouridine ($acp^3 \psi$), and 2'-O-methyl-pseudouridine ($\psi m$). In another embodiment, the signal-sensor polynucleotides comprise the pseudouridine analog 1-methylpseudouridine. In yet another embodiment, the signal-sensor polynucleotides comprise the pseudouridine analog 1-methylpseudouridine and the modified nucleoside 5-methylcytidine.

In another aspect, the signal-sensor polynucleotides may include at least two chemical modifications such as, but not limited to, modifications located on one or more of a nucleoside and/or the backbone of the nucleotides. As a non-limiting example, the signal-sensor polynucleotide comprises the chemical modifications 1-methylpseudouridine and 5-methylcytidine.

The signal-sensor polynucleotides may comprise at least one translation enhancer element (TEE) such as, but not limited to, TEE-001-TEE-705.

In one aspect, the signal-sensor polynucleotide encodes a factor modulating the affinity between HIF subunits and/or HIF-dependent gene expression such as, but not limited to, SEQ ID NO: 6611-6616.

The signal-sensor polynucleotides may be purified and/or formulated.

Employing the signal-sensor polynucleotides, the present invention provides a method of treating a disease, disorder and/or condition in a subject in need thereof by increasing the level of an oncology-related polypeptide of interest comprising administering to said subject an isolated signal-sensor polynucleotide encoding said oncology-related polypeptide. The disease, disorder and/or condition may include, but is not limited to, adrenal cortical cancer, advanced cancer, anal cancer, aplastic anemia, bileduct cancer, bladder cancer, bone cancer, bone metastasis, brain tumors, brain cancer, breast cancer, childhood cancer, cancer of unknown primary origin, Castleman disease, cervical cancer, colon/rectal cancer, endometrial cancer, esophagus cancer, Ewing family of tumors, eye cancer, gallbladder cancer, gastrointestinal carcinoid tumors, gastrointestinal stromal tumors, gestational trophoblastic disease, Hodgkin disease, Kaposi sarcoma, renal cell carcinoma, laryngeal and hypopharyngeal cancer, acute lymphocytic leukemia, acute myeloid leukemia, chronic lymphocytic leukemia, chronic myeloid leukemia, chronic myelomonocytic leukemia, liver cancer, non-small cell lung cancer, small cell lung cancer, lung carcinoid tumor, lymphoma of the skin, malignant mesothelioma, multiple myeloma, myelodysplastic syndrome, nasal cavity and paranasal sinus cancer, nasopharyngeal cancer, neuroblastoma, non-Hodgkin lymphoma, oral cavity and oropharyngeal cancer, osteosarcoma, ovarian cancer, pancreatic cancer, penile cancer, pituitary tumors, prostate cancer, retinoblastoma, rhabdomyosarcoma, salivary gland cancer, sarcoma in adult soft tissue, basal and squamous cell skin cancer, melanoma, small intestine cancer, stomach cancer, testicular cancer, throat cancer, thymus cancer, thyroid cancer, uterine sarcoma, vaginal cancer, vulvar cancer, Waldenstrom macroglobulinemia, Wilms tumor and secondary cancers caused by cancer treatment.

The present invention provides a method of reducing, eliminating, or preventing tumor growth in a subject in need thereof by increasing the level of an oncology-related polypeptide of interest comprising administering to said subject an isolated signal-sensor polynucleotide encoding said oncology-related polypeptide. The tumor growth may be associated with or results from a disease, disorder and/or condition such as, but not limited to, adrenal cortical cancer, advanced cancer, anal cancer, aplastic anemia, bileduct cancer, bladder cancer, bone cancer, bone metastasis, brain tumors, brain cancer, breast cancer, childhood cancer, cancer of unknown primary origin, Castleman disease, cervical cancer, colon/rectal cancer, endometrial cancer, esophagus cancer, Ewing family of tumors, eye cancer, gallbladder cancer, gastrointestinal carcinoid tumors, gastrointestinal stromal tumors, gestational trophoblastic disease, Hodgkin disease, Kaposi sarcoma, renal cell carcinoma, laryngeal and hypopharyngeal cancer, acute lymphocytic leukemia, acute myeloid leukemia, chronic lymphocytic leukemia, chronic myeloid leukemia, chronic myelomonocytic leukemia, liver cancer, non-small cell lung cancer, small cell lung cancer, lung carcinoid tumor, lymphoma of the skin, malignant mesothelioma, multiple myeloma, myelodysplastic syndrome, nasal cavity and paranasal sinus cancer, nasopharyngeal cancer, neuroblastoma, non-Hodgkin lymphoma, oral cavity and oropharyngeal cancer, osteosarcoma, ovarian cancer, pancreatic cancer, penile cancer, pituitary tumors, prostate cancer, retinoblastoma, rhabdomyosarcoma, salivary gland cancer, sarcoma in adult soft tissue, basal and squamous cell skin cancer, melanoma, small intestine cancer, stomach cancer, testicular cancer, throat cancer, thymus cancer, thyroid cancer, uterine sarcoma, vaginal cancer, vulvar cancer, Waldenstrom macroglobulinemia, Wilms tumor and secondary cancers caused by cancer treatment.

The present invention provides a method of reducing and/or ameliorating at least one symptom of cancer in a subject in need thereof by increasing the level of a polypeptide of interest comprising administering to said subject an isolated signal-sensor polynucleotide encoding said oncology-related polypeptide. Non-limiting examples of symptoms include weakness, aches and pains, fever, fatigue, weight loss, blood clots, increased blood calcium levels, low white blood cell count, short of breath, dizziness, headaches, hyperpigmentation, jaundice, erythema, pruritis, excessive hair growth, change in bowel habits, change in bladder function, long-lasting sores, white patches inside the mouth, white spots on the tongue, unusual bleeding or discharge, thickening or lump on parts of the body, indigestion, trouble swallowing, changes in warts or moles, change in new skin and nagging cough and hoarseness.

The present invention provides a method of preferentially inducing cell death in cancer cells in a tissue or organ comprising contacting the tissue or organ with a signal-sensor polynucleotide encoding an oncology-related polypeptide whose expression triggers apoptosis or cell death and at least one microRNA binding site of a microRNA where the expression of the microRNA in the cancer cell is lower than the expression of the mircroRNA in normal non-cancerous cells.

The signal-sensor polynucleotide may be administered at a total daily dose of between 0.001 ug and 150 ug. Administration of a signal-sensor polynucleotide may be by injection, topical administration, ophthalmic administration or intranasal administration. In one aspect, administration may be by injection such as, but not limited to, intradermal, subcutaneous and intramuscular. In another aspect, administration may be topical such as, but not limited to, using creams, lotions, ointments, gels, sprays, solutions and the like.

The details of various embodiments of the invention are set forth in the description below. Other features, objects, and advantages of the invention will be apparent from the description and the drawings, and from the claims.

BRIEF DESCRIPTION OF THE DRAWINGS

The foregoing and other objects, features and advantages will be apparent from the following description of particular embodiments of the invention, as illustrated in the accompanying drawings in which like reference characters refer to the same parts throughout the different views. The drawings are not necessarily to scale, emphasis instead being placed upon illustrating the principles of various embodiments of the invention.

FIGS. 3A and 3B show the expected size of AIFsh.

FIGS. 4A and 4B show the expected size of SIAH1.

FIGS. 5A and 5B show the expected size of C.A. caspase 3.

FIGS. 6A and 6B show the expected size of granulysin.

FIG. 7A shows protein from C.A. caspase 3 modified mRNA fully modified with 5-methylcytidine and 1-methylpseudouridine or fully modified with 1-methylpseudouridine. FIG. 7B shows protein from C.A. caspase 6 modified mRNA fully modified with 5-methylcytidine and 1-methylpseudouridine or fully modified with 1-methylpseudouridine.

DETAILED DESCRIPTION

Figure 1:
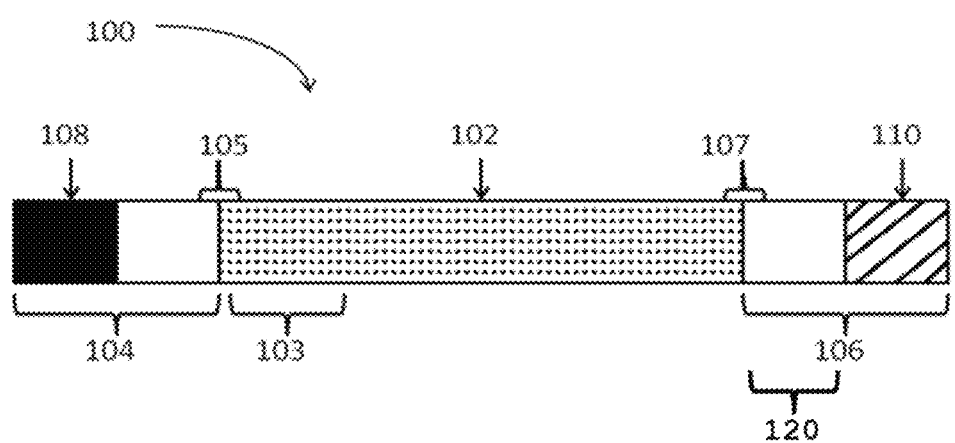
FIG. 1 is a schematic of a primary construct of the present invention.

It is of great interest in the fields of therapeutics, diagnostics, reagents and for biological assays to be able to deliver a nucleic acid, e.g., a ribonucleic acid (RNA) inside a cell, whether in vitro, in vivo, in situ or ex vivo, such as to cause intracellular translation of the nucleic acid and production of an encoded polypeptide of interest. Of particular importance is the delivery and function of a non-integrative polynucleotide.

Described herein are compositions (including pharmaceutical compositions) and methods for the design, preparation, manufacture and/or formulation of polynucleotides encoding one or more polypeptides of interest. Also provided are systems, processes, devices and kits for the selection, design and/or utilization of the polynucleotides encoding the polypeptides of interest described herein.

To this end, polypeptides of the present invention are encoded by a new class of polynucleotide therapeutics, termed "signal-sensor polynucleotides" which are particularly useful in the stratification, profiling and/or personalization of the polynucleotide therapeutic (e.g., mRNA) and which are tailored to a particular cell type, disease or cell microenvironment or biological profile.

It is known that cancers exhibit diverse gene expression patterns, physicochemical environments and metastatic or motility behaviors and according to Hanahan and Weinberg (Cell, 2011, 144:646-674) there are six hallmarks of cancer. These include sustaining a proliferative signaling, evading growth suppressors, resisting cell death, enabling replicative immortality, inducing angiogenesis, and activating invasion and metastasis. These hallmarks or functions of cancer allow the cancer to survive, proliferate and disseminate and each arises at different times and in different patterns depending on the cancer type.

The development of cancer therapeutics which to selectively target the cancer cells while sparing normal cells dominates ongoing efforts in every area of oncology. The polynucleotides of the present invention represent such therapeutics; having the ability to selectively stabilize or destabilize cell systems, signal proliferation (survival) or death, trigger the cell cycle or senescence and/or activate or avoid the immune response depending on the cell type, e.g., cancer or normal cell.

According to the present invention, signal-sensor polynucleotide therapeutics may be used to destabilize the survival advantages or hallmarks of a cancer cell (hence they would be cytotoxic). In one embodiment diagnostic efforts would include the profiling of the cancer (although this would not be required a priori) including metabolic state (hypoxic, acidotic), apoptotic vs. survival gene profiles, cell cycle vs. senescent stage, immune status, and stromal factors present.

In one embodiment the signal-sensor polynucleotide disrupts the transcriptome of the cancer cell. The disruption may affect one or more signaling or expression events. For example the encoded oncology-related polypeptide may act upstream of a transcription factor known to induce or enhance the expression of genes associated with a cancer. Delivery of the signal-sensor polynucleotide encoding the oncology-related polypeptide which inhibits such a transcription factor (either by binding or sequestration or degradation) would thereby alter the transcriptome of the cancer cell and have a therapeutic benefit. One such transcription factor is HIF-1alpha. A signal-sensor polynucleotide encoding a protein which is capable of binding HIF-1alpha or whose expression results in lower HIF-1alpha, would effectively turn down HIF-1alpha regulated genes, e.g., VEGFA or SLC2A1, and destabilize the cancer.

In one embodiment, the profile of the cancer may be evaluated before the signal-sensor polynucleotide is selected. Such profiling data would inform the selection of which oncology-related polypeptide to be delivered. The profile of gene expression, categorized by hallmark class such as apoptosis, replicative capacity or metabolic signature would allow dynamic instability scoring for a polypeptide and an optimization of therapeutic window for the signal-sensor polynucleotide. As used herein, a "dynamic instability index" refers to a dose of signal-sensor polynucleotide sufficient to induce 50% increase of the oncology-related target protein in vitro in a cancer cell as compared to a normal matched cell.

Profiling may also be done within hallmark classes such as the distinction between caspase-dependent and caspase independent gene expression for the apoptosis class. Alternatively, profiling could be conducted across classes such as gene profiling of apoptosis, senescence (replicative capacity), and metabolic classes.

In one embodiment, the signal-sensor polynucleotides described herein may be used to reduce the expression and/or amount of a polypeptide in a cell. As a non-limiting example, MYC inhibitor A, MYC inhibitor B, MYC inhibitor C or MYC inhibitor D may be used on Hep3B cells in order to determine the potency of MYC inhibitor A, MYC inhibitor B, MYC inhibitor C or MYC inhibitor D at various concentrations (see e.g., Example 55).

In one embodiment, the signal-sensor polynucleotides described herein may direct either cytotoxic or cytoprotective therapeutic benefit to specific cells, e.g., normal vs. cancerous.

In one embodiment signal-sensor polynucleotides would not only encode an oncology-related polypeptide but also a sensor sequence. Sensor sequences include, for example, microRNA binding sites, transcription factor binding sites, artificial binding sites engineered to act as pseudo-receptors for endogenous nucleic acid binding molecules. A "sensor region" is a region of linked nucleosides of the signal-sensor polynucleotide comprising at least one sensor sequence. The signal-sensor polynucleotides of the present invention may have one or more sensor regions.

In one embodiment, one or more sensor regions may be located in the first flanking region. As a non-limiting example, the sensor region in the first flanking region may comprise at least one sensor sequence. The sensor sequence may be, but is not limited to, mir-122, mir-142-3p, mir-142-5p, mir-146, fragments or variants thereof. As another non-limiting example, the sensor region in the first flanking region may comprise at least one sensor sequence such as a mir-122 sequence. The mir-122 sequence may be, but is not limited to, a mir-122 binding site, mir-122 seed sequence, mir-122 binding site without the seed sequence or a combination thereof.

In another embodiment, one or more sensor regions may be located in the second flanking region. As a non-limiting example, the sensor region in the second flanking region may include a sensor sequence such as mir-122, mir-142-3p, mir-142-5p, mir-146, fragments or variants thereof. As another non-limiting example, the sensor region in the second flanking region may include three sensor sequences. The sensor sequences may be, but are not limited to, mir-122 sequences such as mir-122 binding sites, mir-122 seed sequences, mir-122 binding sites without the seed sequence or a combination thereof. As yet another non-limiting example, the sensor region in the second flanking region is located in the 3'UTR and the sensor region may include a sensor sequence which is a mir-122 sequence. The mir-122 sequence may be, but is not limited to, a mir-122 binding site, mir-122 seed sequence, mir-122 binding site without the seed sequence or a combination thereof.

In one embodiment, two or more sensor regions may be located in the same region of the signal-sensor polynucleotide such as, but not limited to, a first region first region of linked nucleotides, the first flanking region and/or the second flanking region. As a non-limiting example, the two or more sensor regions are located in the second flanking region. As yet another non-limiting example, three sensor regions are located in the 3' UTR in the second flanking region. The three sensor regions may include, mir-122 binding sites, mir-122 seed sequences, mir-122 binding sites without the seed sequence or a combination thereof.

In another embodiment, two or more sensor regions may be located in different regions of the signal-sensor polynucleotide such as, but not limited to, the first region of linked nucleotides, the first flanking region and/or the second flanking region. As a non-limiting example, a first sensor region is located in the first flanking region and a second sensor region is located in the second flanking region. The sensor regions may comprise the same sensor sequence or different sensor sequences.

In one embodiment, a start codon is located within a sensor region.

In one embodiment, a sensor region may comprise two or more sensor sequences. The sensor sequences may be the same or different.

In one embodiment, the sensor region may comprise two or more sensor sequence which are different from each other but they may be based on the same mir binding site. As a non-limiting example, the sensor region may include at least one miR binding site sequence and at least one mir binding site sequence with the seed removed. As another non-limiting example, the sensor region may include at least one miR binding site sequence and at least one miR seed sequence. As yet another non-limiting example, the sensor region may include at least one miR binding site sequence with the seed removed and at least one miR seed sequence.

In another embodiment, the sensor region may comprise two or more sensor sequences which are in a pattern such as ABABAB or AABBAABBAABB or ABCABCABC or variants thereof repeated once, twice, or more than three times. In these patterns, each letter, A, B, or C represent a different miR sequence.

In yet another embodiment, the signal-sensor polynucleotide may include two or more sensor regions with each sensor region having one or more sensor sequences. As a non-limiting example, the sensor sequences may be in a pattern such as ABABAB or AABBAABBAABB or ABCABCABC or variants thereof repeated once, twice, or more than three times in each of the sensor regions. As another non-limiting example, the sensor sequences may be in a pattern such as ABABAB or AABBAABBAABB or ABCABCABC or variants thereof repeated once, twice, or more than three times across the entire signal-sensor polynucleotide. In these patterns, each letter, A, B, or C represent a different miR sequence. As a non-limiting example, the first sensor region may have sensor sequences in the pattern ABA and the second sensor region may have sensor sequences in the pattern BAB so the overall pattern of the sensor sequences in the signal-sensor polynucleotide is ABABAB. As another non-limiting example, the first sensor region may have sensor sequences AA, the second sensor region may have sensor sequences BB, the third sensor region may have sensor sequences AA and the fourth sensor region may have sensor sequences BB so the overall pattern of the sensor sequences in the signal-sensor polynucleotide is AABBAABB.

The sensor sequences in the signal-sensor polynucleotides of the present invention may include one or more regulatory sequences in the 3-UTR and/or 5'UTR of natural mRNAs, which regulate mRNA stability and translation in different tissues and cells. Such cis-regulatory elements may include, but are not limited to, Cis-RNP (Ribonucleoprotein)/RBP (RNA binding protein) regulatory elements, AU-rich element AUE, structured stem-loop, constitutive decay elements (CDEs), GC-richness and other structured mRNA motifs (Parker B J et al., Genome Research, 2011, 21, 1929-1943, which is herein incorporated by reference in its entirety.). For example, CDEs are a class of regulatory motifs that mediate mRNA degradation through their interaction with Roquin proteins. In particular, CDEs are found in many mRNAs that encode regulators of development and inflammation to limit cytokine production in macrophage (Leppek K et al., Cell, 2013, 153, 869-881, which is herein incorporated by reference in its entirety.).

In one embodiment, a particular CDE can be introduced to the signal-sensor polynucleotide when the degradation of polypeptides in a cell or tissue is desired. A particular CDE can also be removed from the signal-sensor polynucleotide in order to maintain a more stable mRNA in a cell or tissue for sustaining protein expression.

In one embodiment, microRNA (miRNA) profiling of the cancer cells or tissues may be conducted to determine the presence or absence of miRNA in the cells or tissues to determine the appropriate microRNA to use as sensor sequences in the signal sensor polynucleotides.

MicroRNA gene regulation may be influenced by the sequence surrounding the microRNA such as, but not limited to, the species of the surrounding sequence, the type of sequence (e.g., heterologous, homologous and artificial), regulatory elements in the surrounding sequence and/or structural elements in the surrounding sequence. The microRNA may be influenced by the 5'UTR and/or the 3'UTR. As a non-limiting example, a non-human 3'UTR may increase the regulatory effect of the microRNA sequence on the expression of a polypeptide of interest compared to a human 3'UTR of the same sequence type.

Other regulatory elements and/or structural elements of the 5'-UTR can influence microRNA mediated gene regulation. One such example is a structured IRES (Internal Ribosome Entry Site) in the 5'UTR, which is necessary for the binding of translational elongation factors to initiate protein translation. EIF4A2 binding to this secondarily structured element in the 5'UTR is necessary for microRNA mediated gene expression (Meijer H A et al., Science, 2013, 340, 82-85, herein incorporated by reference in its entirety). The sensor-signal polynucleotide can further be modified to include this structured 5'-UTR in order to enhance microRNA mediated gene regulation.

At least one microRNA site can be engineered into the 3' UTR of the signal-sensor polynucleotides of the present invention. In this context, at least two, at least three, at least four, at least five, at least six, at least seven, at least eight, at least nine, at least ten or more microRNA sites may be engineered into the 3' UTR of the signal-sensor polynucleotides of the present invention. In one embodiment, the microRNA sites incorporated into the signal-sensor polynucleotides may be the same or may be different microRNA sites. In another embodiment, the microRNA sites incorporated into the signal-sensor polynucleotides may target the same or different tissues in the body. As a non-limiting example, through the introduction of tissue-, cell-type-, or disease-specific microRNA binding sites in the 3' UTR of a signal-sensor polynucleotide, the degree of expression in specific cell types (e.g. hepatocytes, myeloid cells, endothelial cells, cancer cells, etc.) can be reduced.

In one embodiment, a microRNA site can be engineered near the 5' terminus of the 3'UTR, about halfway between the 5' terminus and 3' terminus of the 3'UTR and/or near the 3' terminus of the 3'UTR. As a non-limiting example, a microRNA site may be engineered near the 5' terminus of the 3'UTR and about halfway between the 5' terminus and 3' terminus of the 3'UTR. As another non-limiting example, a microRNA site may be engineered near the 3' terminus of the 3'UTR and about halfway between the 5' terminus and 3' terminus of the 3'UTR. As yet another non-limiting example, a microRNA site may be engineered near the 5' terminus of the 3'UTR and near the 3' terminus of the 3'UTR.

In another embodiment, a 3'UTR can comprise 4 microRNA sites. The microRNA sites may be complete microRNA binding sites, microRNA seed sequences and/or microRNA binding site sequences without the seed sequence.

In one embodiment, a signal-sensor polynucleotide may be engineered to include microRNA sites which are expressed in different tissues of a subject. As a non-limiting example, a signal-sensor polynucleotide of the present invention may be engineered to include miR-192 and miR-122 to regulate expression of the signal-sensor polynucleotide in the liver and kidneys of a subject. In another embodiment, a signal-sensor polynucleotide may be engineered to include more than one microRNA sites for the same tissue. For example a signal-sensor polynucleotide of the present invention may be engineered to include miR-17-92 and miR-126 to regulate expression of the signal-sensor polynucleotide in endothelial cells of a subject.

In one embodiment, the therapeutic window and or differential expression associated with the oncology-related polypeptide encoded by the signal-sensor polynucleotide of the invention may be altered. For example, signal-sensor polynucleotides may be designed whereby a death signal is more highly expressed in cancer cells (or a survival signal in a normal cell) by virtue of the miRNA signature of those cells. Where a cancer cell expresses a lower level of a particular miRNA, the signal-sensor polynucleotide encoding the binding site for that miRNA (or miRNAs) would be more highly expressed. Hence, the oncology-related polypeptide encoded by the signal-sensor polynucleotide is selected as a protein which triggers or induces cell death. Neighboring noncancer cells, harboring a higher expression of the same miRNA would be less affected by the encoded death signal as the signal-sensor polynucleotide would be expressed at a lower level due to the affects of the miRNA binding to the binding site or "sensor" encoded in the 3'UTR. Conversely, cell survival or cytoprotective signals may be delivered to tissues containing cancer and non cancerous cells where a miRNA has a higher expression in the cancer cells—the result being a lower survival signal to the cancer cell and a larger survival signature to the normal cell. Multiple signal-sensor polynucleotides may be designed and administered having different signals according to the previous paradigm.

In one embodiment, the expression of a signal-sensor polynucleotide may be controlled by incorporating at least one sensor sequence in the signal-sensor polynucleotide and formulating the signal-sensor polynucleotide. As a non-limiting example, a polynucleotide may be targeted to an orthotopic tumor by having a polynucleotide incorporating a miR-122 binding site and formulated in a lipid nanoparticle comprising the cationic lipid DLin-KC2-DMA (see e.g., the experiments described in Example 56A and 56B).

Through an understanding of the expression patterns of microRNA in different cell types, signal-sensor polynucleotides can be engineered for more targeted expression in specific cell types or only under specific biological conditions. Through introduction of tissue-specific microRNA binding sites, signal-sensor polynucleotides could be designed that would be optimal for protein expression in a tissue or in the context of a biological condition such as cancer.

Transfection experiments can be conducted in relevant cell lines, using engineered signal-sensor polynucleotides and protein production can be assayed at various time points post-transfection. For example, cells can be transfected with different microRNA binding site-engineering nucleic acids or signal-sensor polynucleotides and by using an ELISA kit to the relevant protein and assaying protein produced at 6 hr, 12 hr, 24 hr, 48 hr, 72 hr and 7 days post-transfection. In vivo experiments can also be conducted using microRNA-binding site-engineered molecules to examine changes in tissue-specific expression of formulated signal-sensor polynucleotides.

In one embodiment, the signal-sensor polynucleotides of the invention may include at least one microRNA in order to dampen the antigen presentation by antigen presenting cells. The microRNA may be the complete microRNA sequence, the microRNA seed sequence, the microRNA sequence without the seed or a combination thereof. As a non-limiting example, the microRNA incorporated into the signal-sensor polynucleotide may be specific to the hematopoietic system. As another non-limiting example, the microRNA incorporated into the signal-sensor polynucleotides of the invention to dampen antigen presentation is miR-142-3p.

In one embodiment, the signal-sensor polynucleotides of the invention may include at least one microRNA in order to dampen expression of the encoded polypeptide in a cell of interest. As a non-limiting example, the signal-sensor polynucleotides of the invention may include at least one miR-122 binding site in order to dampen expression of an encoded polypeptide of interest in the liver. As another non-limiting example, the signal-sensor polynucleotides of the invention may include at least one miR-142-3p binding site, miR-142-3p seed sequence, miR-142-3p binding site without the seed, miR-142-5p binding site, miR-142-5p seed sequence, miR-142-5p binding site without the seed, miR-146 binding site, miR-146 seed sequence and/or miR-146 binding site without the seed sequence (see e.g., the experiment outlined in Example 47 and Example 60).

According to the present invention, the signal-sensor polynucleotides described herein may be modified as to avoid the deficiencies of other polypeptide-encoding molecules of the art. Hence, in this embodiment the signal-sensor polynucleotides are referred to as modified signal-sensor polynucleotides or primary constructs, modified mRNA or mmRNA.

Provided herein, in part, are signal-sensor polynucleotides, primary constructs and/or mmRNA encoding oncology-related polypeptides of interest which have been designed to improve one or more of the stability and/or clearance in tissues, receptor uptake and/or kinetics, cellular access by the compositions, engagement with translational machinery, mRNA half-life, translation efficiency, immune evasion, protein production capacity, secretion efficiency (when applicable), accessibility to circulation, protein half-life and/or modulation of a cell's status, function and/or activity.

I. Compositions of the Invention

The present invention provides nucleic acid molecules, specifically signal-sensor polynucleotides, primary constructs and/or mmRNA which encode one or more oncology-related polypeptides of interest. Specifically the invention contemplates signal-sensor polynucleotides which are useful in cancer or cancer related diseases, disorders. As used herein, "signal-sensor polynucleotides" are nucleic acid transcripts which encode one or more oncology-related polypeptides of interest that, when translated, delivers a "signal" to the cell (cancer or noncancerous) which results in the therapeutic benefit to the organism of either being detrimental to the cancer cell or beneficial to normal cells or both detrimental to cancer cells and advantageous to normal cells. The signal-sensor polynucleotides may optionally further comprise a sequence (translatable or not) which "senses" the microenvironment of the polynucleotide and alters (a) the function or phenotypic outcome associated with the peptide or protein which is translated, (b) the expression level of the signal-sensor polynucleotide, and/or both.

The term "nucleic acid," in its broadest sense, includes any compound and/or substance that comprise a polymer of nucleotides. These polymers are often referred to as polynucleotides. Exemplary nucleic acids or polynucleotides of the invention include, but are not limited to, ribonucleic acids (RNAs), deoxyribonucleic acids (DNAs), threose nucleic acids (TNAs), glycol nucleic acids (GNAs), peptide nucleic acids (PNAs), locked nucleic acids (LNAs, including LNA having a β-D-ribo configuration, α-LNA having an α-L-ribo configuration (a diastereomer of LNA), 2'-amino-LNA having a 2'-amino functionalization, and 2'-amino-α-LNA having a 2'-amino functionalization) or hybrids thereof.

In preferred embodiments, the signal-sensor polynucleotide or nucleic acid molecule is a messenger RNA (mRNA). As used herein, the term "messenger RNA" (mRNA) refers to any polynucleotide which encodes a polypeptide of interest and which is capable of being translated to produce the encoded polypeptide of interest in vitro, in vivo, in situ or ex vivo. Signal-sensor polynucleotides of the invention may be mRNA or any nucleic acid molecule and may or may not be chemically modified.

Traditionally, the basic components of an mRNA molecule include at least a coding region, a 5'UTR, a 3'UTR, a 5' cap and a poly-A tail. Building on this wild type modular structure, the present invention expands the scope of functionality of traditional mRNA molecules by providing signal-sensor polynucleotides or primary RNA constructs which maintain a modular organization, but which comprise one or more structural and/or chemical modifications or alterations which impart useful properties to the polynucleotide including, in some embodiments, the lack of a substantial induction of the innate immune response of a cell into which the signal-sensor polynucleotide is introduced. As such, modified mRNA molecules of the present invention, which may be synthetic, are termed "mmRNA." As used herein, a "structural" feature or modification is one in which two or more linked nucleotides are inserted, deleted, duplicated, inverted or randomized in a signal-sensor polynucleotide, primary construct or mmRNA without significant chemical modification to the nucleotides themselves.

Because chemical bonds will necessarily be broken and reformed to effect a structural modification, structural modifications are of a chemical nature and hence are chemical modifications. However, structural modifications will result in a different sequence of nucleotides. For example, the polynucleotide "ATCG" may be chemically modified to "AT-5meC-G". The same polynucleotide may be structurally modified from "ATCG" to "ATCCG". Here, the dinucleotide "CC" has been inserted, resulting in a structural modification to the polynucleotide.

Signal-Sensor Polynucleotide, Primary Construct or mmRNA Architecture

The signal-sensor polynucleotides of the present invention are distinguished from wild type mRNA in their functional and/or structural design features which serve to, as evidenced herein, overcome existing problems of effective polypeptide production using nucleic acid-based therapeutics.

FIG. 1 shows a representative signal-sensor primary construct 100 of the present invention. As used herein, the term "primary construct" or "primary mRNA construct" refers to a signal-sensor polynucleotide transcript which encodes one or more polypeptides of interest and which retains sufficient structural and/or chemical features to allow the polypeptide of interest encoded therein to be translated. Signal-sensor primary constructs may be polynucleotides of the invention. When structurally or chemically modified, the signal-sensor primary construct may be referred to as a mmRNA.

Returning to FIG. 1, the primary construct 100 here contains a first region of linked nucleotides 102 that is flanked by a first flanking region 104 and a second flaking region 106. As used herein, the "first region" may be referred to as a "coding region" or "region encoding" or simply the "first region." This first region may include, but is not limited to, the encoded oncology-related polypeptide of interest. The oncology-related polypeptide of interest may comprise at its 5' terminus one or more signal peptide sequences encoded by a signal peptide sequence region 103. The flanking region 104 may comprise a region of linked nucleotides comprising one or more complete or incomplete 5' UTRs sequences. The flanking region 104 may also comprise a 5' terminal cap 108. The second flanking region 106 may comprise a region of linked nucleotides comprising one or more complete or incomplete 3' UTRs. The flanking region 106 may also comprise a 3' tailing sequence 110 and a 3'UTR 120.

Bridging the 5' terminus of the first region 102 and the first flanking region 104 is a first operational region 105. Traditionally this operational region comprises a start codon. The operational region may alternatively comprise any translation initiation sequence or signal including a start codon.

Bridging the 3' terminus of the first region 102 and the second flanking region 106 is a second operational region 107. Traditionally this operational region comprises a stop codon. The operational region may alternatively comprise any translation initiation sequence or signal including a stop codon. According to the present invention, multiple serial stop codons may also be used. In one embodiment, the operation region of the present invention may comprise two stop codons. The first stop codon may be "TGA" and the second stop codon may be selected from the group consisting of "TAA," "TGA" and "TAG." The operation region may further comprise three stop codons. The third stop codon may be selected from the group consisting of "TAA," "TGA" and "TAG."

Figure 2:
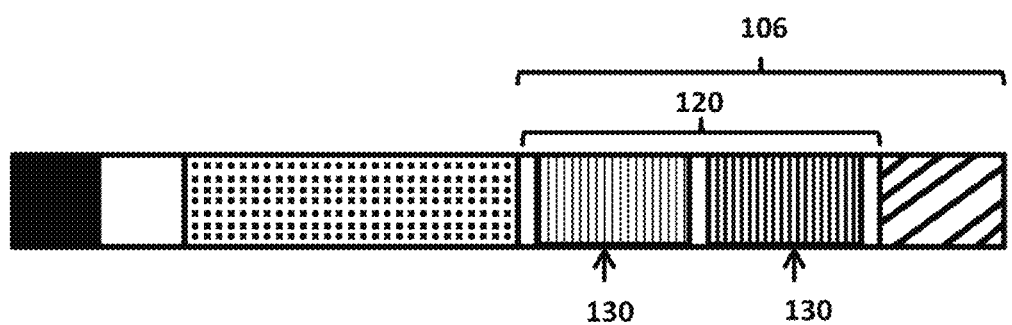
FIG. 2 is an expanded schematic of the second flanking region of a primary construct of the present invention illustrating the signal-sensor elements of the polynucleotide.

Turning to FIG. 2, the 3'UTR 120 of the second flanking region 106 may comprise one or more sensor sequences 130. A region comprising at least one sensor sequence is referred to as a "sensor region." These sensor sequences as discussed herein operate as pseudo-receptors (or binding sites) for ligands of the local microenvironment of the primary construct or signal-sensor polynucleotide. For example, microRNA binding sites or miRNA seeds may be used as sensors such that they function as pseudoreceptors for any microRNAs present in the environment of the polynucleotide.

Generally, the shortest length of the first region of the signal-sensor primary construct of the present invention can be the length of a nucleic acid sequence that is sufficient to encode for a dipeptide, a tripeptide, a tetrapeptide, a pentapeptide, a hexapeptide, a heptapeptide, an octapeptide, a nonapeptide, or a decapeptide. In another embodiment, the length may be sufficient to encode a peptide of 2-30 amino acids, e.g. 5-30, 10-30, 2-25, 5-25, 10-25, or 10-20 amino acids. The length may be sufficient to encode for a peptide of at least 11, 12, 13, 14, 15, 17, 20, 25 or 30 amino acids, or a peptide that is no longer than 40 amino acids, e.g. no longer than 35, 30, 25, 20, 17, 15, 14, 13, 12, 11 or 10 amino acids. Examples of dipeptides that the polynucleotide sequences can encode or include, but are not limited to, carnosine and anserine.

Generally, the length of the first region encoding the oncology-related polypeptide of interest of the present invention is greater than about 30 nucleotides in length (e.g., at least or greater than about 35, 40, 45, 50, 55, 60, 70, 80, 90, 100, 120, 140, 160, 180, 200, 250, 300, 350, 400, 450, 500, 600, 700, 800, 900, 1,000, 1,100, 1,200, 1,300, 1,400, 1,500, 1,600, 1,700, 1,800, 1,900, 2,000, 2,500, and 3,000, 4,000, 5,000, 6,000, 7,000, 8,000, 9,000, 10,000, 20,000, 30,000, 40,000, 50,000, 60,000, 70,000, 80,000, 90,000 or up to and including 100,000 nucleotides). As used herein, the "first region" may be referred to as a "coding region" or "region encoding" or simply the "first region."

In some embodiments, the signal-sensor polynucleotide, primary construct, or mmRNA includes from about 30 to about 100,000 nucleotides (e.g., from 30 to 50, from 30 to 100, from 30 to 250, from 30 to 500, from 30 to 1,000, from 30 to 1,500, from 30 to 3,000, from 30 to 5,000, from 30 to 7,000, from 30 to 10,000, from 30 to 25,000, from 30 to 50,000, from 30 to 70,000, from 100 to 250, from 100 to 500, from 100 to 1,000, from 100 to 1,500, from 100 to 3,000, from 100 to 5,000, from 100 to 7,000, from 100 to 10,000, from 100 to 25,000, from 100 to 50,000, from 100 to 70,000, from 100 to 100,000, from 500 to 1,000, from 500 to 1,500, from 500 to 2,000, from 500 to 3,000, from 500 to 5,000, from 500 to 7,000, from 500 to 10,000, from 500 to 25,000, from 500 to 50,000, from 500 to 70,000, from 500 to 100,000, from 1,000 to 1,500, from 1,000 to 2,000, from 1,000 to 3,000, from 1,000 to 5,000, from 1,000 to 7,000, from 1,000 to 10,000, from 1,000 to 25,000, from 1,000 to 50,000, from 1,000 to 70,000, from 1,000 to 100,000, from 1,500 to 3,000, from 1,500 to 5,000, from 1,500 to 7,000, from 1,500 to 10,000, from 1,500 to 25,000, from 1,500 to 50,000, from 1,500 to 70,000, from 1,500 to 100,000, from 2,000 to 3,000, from 2,000 to 5,000, from 2,000 to 7,000, from 2,000 to 10,000, from 2,000 to 25,000, from 2,000 to 50,000, from 2,000 to 70,000, and from 2,000 to 100,000).

According to the present invention, the first and second flanking regions may range independently from 15-1,000 nucleotides in length (e.g., greater than 30, 40, 45, 50, 55, 60, 70, 80, 90, 100, 120, 140, 160, 180, 200, 250, 300, 350, 400, 450, 500, 600, 700, 800, and 900 nucleotides or at least 30, 40, 45, 50, 55, 60, 70, 80, 90, 100, 120, 140, 160, 180, 200, 250, 300, 350, 400, 450, 500, 600, 700, 800, 900, and 1,000 nucleotides).

According to the present invention, the tailing sequence may range from absent to 500 nucleotides in length (e.g., at least 60, 70, 80, 90, 120, 140, 160, 180, 200, 250, 300, 350, 400, 450, or 500 nucleotides). Where the tailing region is a polyA tail, the length may be determined in units of or as a function of polyA binding protein binding. In this embodiment, the polyA tail is long enough to bind at least 4 monomers of polyA binding protein. PolyA binding protein monomers bind to stretches of approximately 38 nucleotides. As such, it has been observed that polyA tails of about 80 nucleotides and 160 nucleotides are functional.

According to the present invention, the capping region may comprise a single cap or a series of nucleotides forming the cap. In this embodiment the capping region may be from 1 to 10, e.g. 2-9, 3-8, 4-7, 1-5, 5-10, or at least 2, or 10 or fewer nucleotides in length. In some embodiments, the cap is absent.

According to the present invention, the first and second operational regions may range from 3 to 40, e.g., 5-30, 10-20, 15, or at least 4, or 30 or fewer nucleotides in length and may comprise, in addition to a start and/or stop codon, one or more signal and/or restriction sequences.

Cyclic Signal-Sensor Polynucleotides

According to the present invention, a signal-sensor primary construct or mmRNA may be cyclized, or concatemerized, to generate a translation competent molecule to assist interactions between poly-A binding proteins and 5'-end binding proteins. The mechanism of cyclization or concatemerization may occur through at least 3 different routes: 1) chemical, 2) enzymatic, and 3) ribozyme catalyzed. The newly formed 5'/3'-linkage may be intramolecular or intermolecular.

In the first route, the 5'-end and the 3'-end of the nucleic acid may contain chemically reactive groups that, when close together, form a new covalent linkage between the 5'-end and the 3'-end of the molecule. The 5'-end may contain an NHS-ester reactive group and the 3'-end may contain a 3'-amino-terminated nucleotide such that in an organic solvent the 3'-amino-terminated nucleotide on the 3'-end of a synthetic mRNA molecule will undergo a nucleophilic attack on the 5'-NHS-ester moiety forming a new 5'-/3'-amide bond.

In the second route, T4 RNA ligase may be used to enzymatically link a 5'-phosphorylated nucleic acid molecule to the 3'-hydroxyl group of a nucleic acid forming a new phosphoro diester linkage. In an example reaction, 1 µg of a nucleic acid molecule is incubated at 37° C. for 1 hour with 1-10 units of T4 RNA ligase (New England Biolabs, Ipswich, Mass.) according to the manufacturer's protocol. The ligation reaction may occur in the presence of a split oligonucleotide capable of base-pairing with both the 5'- and 3'-region in juxtaposition to assist the enzymatic ligation reaction.

In the third route, either the 5'- or 3'-end of the cDNA template encodes a ligase ribozyme sequence such that during in vitro transcription, the resultant nucleic acid molecule can contain an active ribozyme sequence capable of ligating the 5'-end of a nucleic acid molecule to the 3'-end of a nucleic acid molecule. The ligase ribozyme may be derived from the Group I Intron, Group I Intron, Hepatitis Delta Virus, Hairpin ribozyme or may be selected by SELEX (systematic evolution of ligands by exponential enrichment). The ribozyme ligase reaction may take 1 to 24 hours at temperatures between 0 and 37° C.

Signal-Sensor Polynucleotide Multimers

According to the present invention, multiple distinct signal-sensor polynucleotides, primary constructs or mmRNA may be linked together through the 3'-end using nucleotides which are modified at the 3'-terminus. Chemical conjugation may be used to control the stoichiometry of delivery into cells. For example, the glyoxylate cycle enzymes, isocitrate lyase and malate synthase, may be supplied into HepG2 cells at a 1:1 ratio to alter cellular fatty acid metabolism. This ratio may be controlled by chemically linking signal-sensor polynucleotides, primary constructs or mmRNA using a 3'-azido terminated nucleotide on one signal-sensor polynucleotide, primary construct or mmRNA species and a C5-ethynyl or alkynyl-containing nucleotide on the opposite signal-sensor polynucleotide, primary construct or mmRNA species. The modified nucleotide is added post-transcriptionally using terminal transferase (New England Biolabs, Ipswich, Mass.) according to the manufacturer's protocol. After the addition of the 3'-modified nucleotide, the two signal-sensor polynucleotide, primary construct or mmRNA species may be combined in an aqueous solution, in the presence or absence of copper, to form a new covalent linkage via a click chemistry mechanism as described in the literature.

In another example, more than two signal-sensor polynucleotides may be linked together using a functionalized linker molecule. For example, a functionalized saccharide molecule may be chemically modified to contain multiple chemical reactive groups (SH—, $NH_2$—, $N_3$, etc. . . . ) to react with the cognate moiety on a 3'-functionalized signal-sensor polynucleotide molecule (i.e., a 3'-maleimide ester, 3'-NHS-ester, alkynyl). The number of reactive groups on the modified saccharide can be controlled in a stoichiometric fashion to directly control the stoichiometric ratio of conjugated signal-sensor polynucleotide, primary construct or mmRNA.

Signal-Sensor Polynucleotide Conjugates and Combinations

In order to further enhance oncology-related protein production, signal-sensor polynucleotide primary constructs or mmRNA of the present invention can be designed to be conjugated to other polynucleotides, oncology-related polypeptides, dyes, intercalating agents (e.g. acridines), crosslinkers (e.g. psoralene, mitomycin C), porphyrins (TPPC4, texaphyrin, Sapphyrin), polycyclic aromatic hydrocarbons (e.g., phenazine, dihydrophenazine), artificial endonucleases (e.g. EDTA), alkylating agents, phosphate, amino, mercapto, PEG (e.g., PEG-40K), MPEG, $[MPEG]_2$, polyamino, alkyl, substituted alkyl, radiolabeled markers, enzymes, haptens (e.g. biotin), transport/absorption facilitators (e.g., aspirin, vitamin E, folic acid), synthetic ribonucleases, proteins, e.g., glycoproteins, or peptides, e.g., molecules having a specific affinity for a co-ligand, or antibodies e.g., an antibody, that binds to a specified cell type such as a cancer cell, endothelial cell, or bone cell, hormones and hormone receptors, non-peptidic species, such as lipids, lectins, carbohydrates, vitamins, cofactors, or a drug.

Conjugation may result in increased stability and/or half life and may be particularly useful in targeting the signal-sensor polynucleotides, primary constructs or mmRNA to specific sites in the cell, tissue or organism.

According to the present invention, the signal-sensor polynucleotide mmRNA or primary constructs may be administered with, or further encode one or more of RNAi agents, siRNAs, shRNAs, miRNAs, miRNA binding sites, antisense RNAs, ribozymes, catalytic DNA, tRNA, RNAs that induce triple helix formation, aptamers or vectors, and the like.

In one embodiment, the signal-sensor polynucleotides described herein may be conjugated with a moiety to target various cancer cells such as, but not limited to, the moieties described in US Patent Application No. US20130216561, the contents of which are herein incorporated by reference in its entirety. The linkage between the signal-sensor polynucleotides and the cancer targeting moiety may be an acid cleavable linkage that can increase the efficacy of the conjugate such as, but not limited to, the linkages described in US Patent Application No. US20130216561, the contents of which are herein incorporated by reference in its entirety.

Bifunctional Signal-Sensor Polynucleotide

In one embodiment of the invention are bifunctional signal-sensor polynucleotides (e.g., bifunctional primary constructs or bifunctional mmRNA). As the name implies, bifunctional signal-sensor polynucleotides are those having or capable of at least two functions. These molecules may also by convention be referred to as multifunctional.

The multiple functionalities of bifunctional signal-sensor polynucleotides may be encoded by the RNA (the function may not manifest until the encoded product is translated) or may be a property of the polynucleotide itself. It may be structural or chemical. Bifunctional modified signal-sensor polynucleotides may comprise a function that is covalently or electrostatically associated with the polynucleotides. Further, the two functions may be provided in the context of a complex of a signal-sensor polynucleotide and another molecule.

Bifunctional signal-sensor polynucleotides may encode oncology-related peptides which are anti-proliferative. These peptides may be linear, cyclic, constrained or random coil. They may function as aptamers, signaling molecules, ligands or mimics or mimetics thereof. Anti-proliferative peptides may, as translated, be from 3 to 50 amino acids in length. They may be 5-40, 10-30, or approximately 15 amino acids long. They may be single chain, multichain or branched and may form complexes, aggregates or any multi-unit structure once translated.

Noncoding Signal-Sensor Polynucleotides

As described herein, provided are signal-sensor polynucleotides and primary constructs having sequences that are partially or substantially not translatable, e.g., having a noncoding region. Such noncoding region may be the "first region" of the signal-sensor primary construct. Alternatively, the noncoding region may be a region other than the first region. Such molecules are generally not translated, but can exert an effect on protein production by one or more of binding to and sequestering one or more translational machinery components such as a ribosomal protein or a transfer RNA (tRNA), thereby effectively reducing protein expression in the cell or modulating one or more pathways or cascades in a cell which in turn alters protein levels. The signal-sensor polynucleotide and/or primary construct may contain or encode one or more long noncoding RNA (lncRNA, or lincRNA) or portion thereof, a small nucleolar RNA (sno-RNA), micro RNA (miRNA), small interfering RNA (siRNA) or Piwi-interacting RNA (piRNA).

Auxotrophic Signal-Sensor Polynucleotides

In one embodiment, the signal-sensor polynucleotides of the present invention may be auxotrophic. As used herein, the term "auxotrophic" refers to signal-sensor polynucleotides that comprise at least one feature that triggers, facilitates or induces the degradation or inactivation of the itself in response to spatial or temporal cues such that oncology-related protein expression is substantially prevented or reduced. Such spatial or temporal cues include the location of the signal-sensor polynucleotide to be translated such as a particular tissue or organ or cellular environment. Also contemplated are cues involving temperature, pH, ionic strength, moisture content, and the like.

In one embodiment, the feature is located in a terminal region of the signal-sensor polynucleotides of the present invention. As a non-limiting example, the auxotrophic mRNA may contain a miR binding site in the terminal region which binds to a miR expressed in a selected tissue so that the expression of the auxotrophic mRNA is substantially prevented or reduced in the selected tissue. To this end and for example, an auxotrophic mRNA containing a miR-122 binding site will not produce protein if localized to the liver since miR-122 is expressed in the liver and binding of the miR would effectuate destruction of the auxotrophic mRNA. As a non-limiting example, HEK293 cells do not express miR-122 so there would be little to no downregulation of a signal-sensor polynucleotide having a miR-122 sequence in HEK293 but for hepatocytes which do expression miR-122 there would be a downregulation of a signal-sensor polynucleotide having a miR-122 sequence in hepatocytes (see e.g., the study outlined Example 19). As another non-limiting example, the miR-122 level can be measured in HeLa cells, primary human hepatocytes and primary rat hepatocytes prior to administration with a signal-sensor polynucleotide encoding having at least one miR-122 binding site, miR-122 binding site without the seed sequence or a miR-122 binding site After administration the expression of the signal-sensor polynucleotide can be measured to determine the dampening effect of the miR-122 in the signal-sensor polynucleotide (see e.g., the studies outlined in Examples 41, 42, 43 57, 58 and 59). As yet another non-limiting example, the effectiveness of the miR-122 binding site, miR-122 seed or the miR-122 binding site without the seed in different 3'UTRs may be evaluated in order to determine the proper UTR for the desired outcome such as, but not limited to, the highest dampening effect (see e.g., the study outlined in Example 46).

In one embodiment, the degradation or inactivation of auxotrophic mRNA may comprise a feature responsive to a change in pH. As a non-limiting example, the auxotrophic mRNA may be triggered in an environment having a pH of between pH 4.5 to 8.0 such as at a pH of 5.0 to 6.0 or a pH of 6.0 to 6.5. The change in pH may be a change of 0.1 unit, 0.2 units, 0.3 units, 0.4 units, 0.5 units, 0.6 units, 0.7 units, 0.8 units, 0.9 units, 1.0 units, 1.1 units, 1.2 units, 1.3 units, 1.4 units, 1.5 units, 1.6 units, 1.7 units, 1.8 units, 1.9 units, 2.0 units, 2.1 units, 2.2 units, 2.3 units, 2.4 units, 2.5 units, 2.6 units, 2.7 units, 2.8 units, 2.9 units, 3.0 units, 3.1 units, 3.2 units, 3.3 units, 3.4 units, 3.5 units, 3.6 units, 3.7 units, 3.8 units, 3.9 units, 4.0 units or more.

In another embodiment, the degradation or inactivation of auxotrophic mRNA may be triggered or induced by changes in temperature. As a non-limiting example, a change of temperature from room temperature to body temperature. The change of temperature may be less than 1° C., less than 5° C., less than 10° C., less than 15° C., less than 20° C., less than 25° C. or more than 25° C.

In yet another embodiment, the degradation or inactivation of auxotrophic mRNA may be triggered or induced by a change in the levels of ions in the subject. The ions may be cations or anions such as, but not limited to, sodium ions, potassium ions, chloride ions, calcium ions, magnesium ions and/or phosphate ions.

Oncology-Related Polypeptides of Interest

According to the present invention, the signal-sensor primary construct is designed to encode one or more oncology-related polypeptides of interest or fragments thereof. An oncology-related polypeptide of interest may include, but is not limited to, whole polypeptides, a plurality of polypeptides or fragments of polypeptides, which independently may be encoded by one or more nucleic acids, a plurality of nucleic acids, fragments of nucleic acids or variants of any of the aforementioned. As used herein, the term "oncology-related polypeptides of interest" refers to any polypeptide which is selected to be encoded in the signal-sensor primary construct of the present invention. As used herein, "polypeptide" means a polymer of amino acid residues (natural or unnatural) linked together most often by peptide bonds. The term, as used herein, refers to proteins, polypeptides, and peptides of any size, structure, or function. In some instances the polypeptide encoded is smaller than about 50 amino acids and the polypeptide is then termed a peptide. If the polypeptide is a peptide, it will be at least about 2, 3, 4, or at least 5 amino acid residues long. Thus, polypeptides include gene products, naturally occurring polypeptides, synthetic polypeptides, homologs, orthologs, paralogs, fragments and other equivalents, variants, and analogs of the foregoing. A polypeptide may be a single molecule or may be a multi-molecular complex such as a dimer, trimer or tetramer. They may also comprise single chain or multichain polypeptides such as antibodies or insulin and may be associated or linked. Most commonly disulfide linkages are found in multichain polypeptides. The term polypeptide may also apply to amino acid polymers in which one or more amino acid residues are an artificial chemical analogue of a corresponding naturally occurring amino acid.

The term "polypeptide variant" refers to molecules which differ in their amino acid sequence from a native or reference sequence. The amino acid sequence variants may possess substitutions, deletions, and/or insertions at certain positions within the amino acid sequence, as compared to a native or reference sequence. Ordinarily, variants will possess at least about 50% identity (homology) to a native or reference sequence, and preferably, they will be at least about 80%, more preferably at least about 90% identical (homologous) to a native or reference sequence.

In some embodiments "variant mimics" are provided. As used herein, the term "variant mimic" is one which contains one or more amino acids which would mimic an activated sequence. For example, glutamate may serve as a mimic for phosphoro-threonine and/or phosphoro-serine. Alternatively, variant mimics may result in deactivation or in an inactivated product containing the mimic, e.g., phenylalanine may act as an inactivating substitution for tyrosine; or alanine may act as an inactivating substitution for serine.

"Homology" as it applies to amino acid sequences is defined as the percentage of residues in the candidate amino acid sequence that are identical with the residues in the amino acid sequence of a second sequence after aligning the sequences and introducing gaps, if necessary, to achieve the maximum percent homology. Methods and computer programs for the alignment are well known in the art. It is understood that homology depends on a calculation of percent identity but may differ in value due to gaps and penalties introduced in the calculation.

By "homologs" as it applies to polypeptide sequences means the corresponding sequence of other species having substantial identity to a second sequence of a second species.

"Analogs" is meant to include polypeptide variants which differ by one or more amino acid alterations, e.g., substitutions, additions or deletions of amino acid residues that still maintain one or more of the properties of the parent or starting polypeptide.

The present invention contemplates several types of compositions which are polypeptide based including variants and derivatives. These include substitutional, insertional, deletion and covalent variants and derivatives. The term "derivative" is used synonymously with the term "variant" but generally refers to a molecule that has been modified and/or changed in any way relative to a reference molecule or starting molecule.

As such, signal-sensor polynucleotides encoding oncology-related polypeptides containing substitutions, insertions and/or additions, deletions and covalent modifications with respect to reference sequences, in particular the oncology-related polypeptide sequences disclosed herein, are included within the scope of this invention. For example, sequence tags or amino acids, such as one or more lysines, can be added to the peptide sequences of the invention (e.g., at the N-terminal or C-terminal ends). Sequence tags can be used for peptide purification or localization. Lysines can be used to increase peptide solubility or to allow for biotinylation. Alternatively, amino acid residues located at the carboxy and amino terminal regions of the amino acid sequence of a peptide or protein may optionally be deleted providing for truncated sequences. Certain amino acids (e.g., C-terminal or N-terminal residues) may alternatively be deleted depending on the use of the sequence, as for example, expression of the sequence as part of a larger sequence which is soluble, or linked to a solid support.

"Substitutional variants" when referring to polypeptides are those that have at least one amino acid residue in a native or starting sequence removed and a different amino acid inserted in its place at the same position. The substitutions may be single, where only one amino acid in the molecule has been substituted, or they may be multiple, where two or more amino acids have been substituted in the same molecule.

As used herein the term "conservative amino acid substitution" refers to the substitution of an amino acid that is normally present in the sequence with a different amino acid of similar size, charge, or polarity. Examples of conservative substitutions include the substitution of a non-polar (hydrophobic) residue such as isoleucine, valine and leucine for another non-polar residue. Likewise, examples of conservative substitutions include the substitution of one polar (hydrophilic) residue for another such as between arginine and lysine, between glutamine and asparagine, and between glycine and serine. Additionally, the substitution of a basic residue such as lysine, arginine or histidine for another, or the substitution of one acidic residue such as aspartic acid or glutamic acid for another acidic residue are additional examples of conservative substitutions. Examples of non-conservative substitutions include the substitution of a non-polar (hydrophobic) amino acid residue such as isoleucine, valine, leucine, alanine, methionine for a polar (hydrophilic) residue such as cysteine, glutamine, glutamic acid or lysine and/or a polar residue for a non-polar residue.

"Insertional variants" when referring to polypeptides are those with one or more amino acids inserted immediately adjacent to an amino acid at a particular position in a native or starting sequence. "Immediately adjacent" to an amino acid means connected to either the alpha-carboxy or alpha-amino functional group of the amino acid.

"Deletional variants" when referring to polypeptides are those with one or more amino acids in the native or starting amino acid sequence removed. Ordinarily, deletional variants will have one or more amino acids deleted in a particular region of the molecule.

"Covalent derivatives" when referring to polypeptides include modifications of a native or starting protein with an organic proteinaceous or non-proteinaceous derivatizing agent, and/or post-translational modifications. Covalent modifications are traditionally introduced by reacting targeted amino acid residues of the protein with an organic derivatizing agent that is capable of reacting with selected side-chains or terminal residues, or by harnessing mechanisms of post-translational modifications that function in selected recombinant host cells. The resultant covalent derivatives are useful in programs directed at identifying residues important for biological activity, for immunoassays, or for the preparation of anti-protein antibodies for immunoaffinity purification of the recombinant glycoprotein. Such modifications are within the ordinary skill in the art and are performed without undue experimentation.

Certain post-translational modifications are the result of the action of recombinant host cells on the expressed oncology-related polypeptide. Glutaminyl and asparaginyl residues are frequently post-translationally deamidated to the corresponding glutamyl and aspartyl residues. Alternatively, these residues are deamidated under mildly acidic conditions. Either form of these residues may be present in the oncology-related polypeptides produced in accordance with the present invention.

Other post-translational modifications include hydroxylation of proline and lysine, phosphorylation of hydroxyl groups of seryl or threonyl residues, methylation of the alpha-amino groups of lysine, arginine, and histidine side chains (T. E. Creighton, Proteins: Structure and Molecular Properties, W.H. Freeman & Co., San Francisco, pp. 79-86 (1983)).

"Features" when referring to polypeptides are defined as distinct amino acid sequence-based components of a molecule. Features of the polypeptides encoded by the mmRNA of the present invention include surface manifestations, local conformational shape, folds, loops, half-loops, domains, half-domains, sites, termini or any combination thereof.

As used herein when referring to polypeptides the term "surface manifestation" refers to a polypeptide based component of a protein appearing on an outermost surface.

As used herein when referring to polypeptides the term "local conformational shape" means a polypeptide based structural manifestation of a protein which is located within a definable space of the protein.

As used herein when referring to polypeptides the term "fold" refers to the resultant conformation of an amino acid sequence upon energy minimization. A fold may occur at the secondary or tertiary level of the folding process. Examples of secondary level folds include beta sheets and alpha helices. Examples of tertiary folds include domains and regions formed due to aggregation or separation of energetic forces. Regions formed in this way include hydrophobic and hydrophilic pockets, and the like.

As used herein the term "turn" as it relates to protein conformation means a bend which alters the direction of the backbone of a peptide or polypeptide and may involve one, two, three or more amino acid residues.

As used herein when referring to polypeptides the term "loop" refers to a structural feature of a polypeptide which may serve to reverse the direction of the backbone of a peptide or polypeptide. Where the loop is found in a polypeptide and only alters the direction of the backbone, it may comprise four or more amino acid residues. Oliva et al. have identified at least 5 classes of protein loops (J. Mol Biol 266 (4): 814-830; 1997). Loops may be open or closed. Closed loops or "cyclic" loops may comprise 2, 3, 4, 5, 6, 7, 8, 9, 10 or more amino acids between the bridging moieties. Such bridging moieties may comprise a cysteine-cysteine bridge (Cys-Cys) typical in polypeptides having disulfide bridges or alternatively bridging moieties may be non-protein based such as the dibromozylyl agents used herein.

As used herein when referring to polypeptides the term "half-loop" refers to a portion of an identified loop having at least half the number of amino acid resides as the loop from which it is derived. It is understood that loops may not always contain an even number of amino acid residues. Therefore, in those cases where a loop contains or is identified to comprise an odd number of amino acids, a half-loop of the odd-numbered loop will comprise the whole number portion or next whole number portion of the loop (number of amino acids of the loop/2+/−0.5 amino acids). For example, a loop identified as a 7 amino acid loop could produce half-loops of 3 amino acids or 4 amino acids (7/2=3.5+/−0.5 being 3 or 4).

As used herein when referring to polypeptides the term "domain" refers to a motif of a polypeptide having one or more identifiable structural or functional characteristics or properties (e.g., binding capacity, serving as a site for protein-protein interactions).

As used herein when referring to polypeptides the term "half-domain" means a portion of an identified domain having at least half the number of amino acid resides as the domain from which it is derived. It is understood that domains may not always contain an even number of amino acid residues. Therefore, in those cases where a domain contains or is identified to comprise an odd number of amino acids, a half-domain of the odd-numbered domain will comprise the whole number portion or next whole number portion of the domain (number of amino acids of the domain/2+/−0.5 amino acids). For example, a domain identified as a 7 amino acid domain could produce half-domains of 3 amino acids or 4 amino acids (7/2=3.5+/−0.5 being 3 or 4). It is also understood that subdomains may be identified within domains or half-domains, these subdomains possessing less than all of the structural or functional properties identified in the domains or half domains from which they were derived. It is also understood that the amino acids that comprise any of the domain types herein need not be contiguous along the backbone of the polypeptide (i.e., nonadjacent amino acids may fold structurally to produce a domain, half-domain or subdomain).

As used herein when referring to polypeptides the terms "site" as it pertains to amino acid based embodiments is used synonymously with "amino acid residue" and "amino acid side chain." A site represents a position within a peptide or polypeptide that may be modified, manipulated, altered, derivatized or varied within the polypeptide based molecules of the present invention.

As used herein the terms "termini" or "terminus" when referring to polypeptides refers to an extremity of a peptide or polypeptide. Such extremity is not limited only to the first or final site of the peptide or polypeptide but may include additional amino acids in the terminal regions. The polypeptide based molecules of the present invention may be characterized as having both an N-terminus (terminated by an amino acid with a free amino group (NH2)) and a C-terminus (terminated by an amino acid with a free carboxyl group (COOH)). Proteins of the invention are in some cases made up of multiple polypeptide chains brought together by disulfide bonds or by non-covalent forces (multimers, oligomers). These sorts of proteins will have multiple N- and C-termini. Alternatively, the termini of the polypeptides may be modified such that they begin or end, as the case may be, with a non-polypeptide based moiety such as an organic conjugate.

Once any of the features have been identified or defined as a desired component of a polypeptide to be encoded by the signal-sensor primary construct or mmRNA of the invention, any of several manipulations and/or modifications of these features may be performed by moving, swapping, inverting, deleting, randomizing or duplicating. Furthermore, it is understood that manipulation of features may result in the same outcome as a modification to the molecules of the invention. For example, a manipulation which involved deleting a domain would result in the alteration of the length of a molecule just as modification of a nucleic acid to encode less than a full length molecule would.

Modifications and manipulations can be accomplished by methods known in the art such as, but not limited to, site directed mutagenesis. The resulting modified molecules may then be tested for activity using in vitro or in vivo assays such as those described herein or any other suitable screening assay known in the art.

According to the present invention, the oncology-related polypeptides may comprise a consensus sequence which is discovered through rounds of experimentation. As used herein a "consensus" sequence is a single sequence which represents a collective population of sequences allowing for variability at one or more sites.

As recognized by those skilled in the art, protein fragments, functional protein domains, and homologous proteins are also considered to be within the scope of oncology-related polypeptides of interest of this invention. For example, provided herein is any protein fragment (meaning an oncology-related polypeptide sequence at least one amino acid residue shorter than a reference oncology-related polypeptide sequence but otherwise identical) of a reference oncology-related protein 10, 20, 30, 40, 50, 60, 70, 80, 90, 100 or greater than 100 amino acids in length. In another example, any oncology-related protein that includes a stretch of about 20, about 30, about 40, about 50, or about 100 amino acids which are about 40%, about 50%, about 60%, about 70%, about 80%, about 90%, about 95%, or about 100% identical to any of the sequences described herein can be utilized in accordance with the invention. In certain embodiments, a polypeptide to be utilized in accordance with the invention includes 2, 3, 4, 5, 6, 7, 8, 9, 10, or more mutations as shown in any of the sequences provided or referenced herein.

Encoded Oncology-Related Polypeptides

The signal-sensor primary constructs or mmRNA of the present invention may be designed to encode oncology-related polypeptides of interest such as oncology-related peptides and proteins.

In one embodiment, signal-sensor primary constructs or mmRNA of the present invention may encode variant polypeptides which have a certain identity with a reference oncology-related polypeptide sequence. As used herein, a "reference oncology-related polypeptide sequence" refers to a starting oncology-related polypeptide sequence. Reference sequences may be wild type sequences or any sequence to which reference is made in the design of another sequence. A "reference polypeptide sequence" may, e.g., be any one of the protein sequence listed in Table 6.

The term "identity" as known in the art, refers to a relationship between the sequences of two or more peptides, as determined by comparing the sequences. In the art, identity also means the degree of sequence relatedness between peptides, as determined by the number of matches between strings of two or more amino acid residues. Identity measures the percent of identical matches between the smaller of two or more sequences with gap alignments (if any) addressed by a particular mathematical model or computer program (i.e., "algorithms"). Identity of related peptides can be readily calculated by known methods. Such methods include, but are not limited to, those described in Computational Molecular Biology, Lesk, A. M., ed., Oxford University Press, New York, 1988; Biocomputing: Informatics and Genome Projects, Smith, D. W., ed., Academic Press, New York, 1993; Computer Analysis of Sequence Data, Part 1, Griffin, A. M., and Griffin, H. G., eds., Humana Press, New Jersey, 1994; Sequence Analysis in Molecular Biology, von Heinje, G., Academic Press, 1987; Sequence Analysis Primer, Gribskov, M. and Devereux, J., eds., M. Stockton Press, New York, 1991; and Carillo et al., SIAM J. Applied Math. 48, 1073 (1988).

In some embodiments, the polypeptide variant may have the same or a similar activity as the reference oncology-related polypeptide. Alternatively, the variant may have an altered activity (e.g., increased or decreased) relative to a reference oncology-related polypeptide. Generally, variants of a particular signal-sensor polynucleotide or oncology-related polypeptide of the invention will have at least about 40%, 45%, 50%, 55%, 60%, 65%, 70%, 75%, 80%, 85%, 90%, 91%, 92%, 93%, 94%, 95%, 96%, 97%, 98%, 99% but less than 100% sequence identity to that particular reference signal-sensor polynucleotide or oncology-related polypeptide as determined by sequence alignment programs and parameters described herein and known to those skilled in the art. Such tools for alignment include those of the BLAST suite (Stephen F. Altschul, Thomas L. Madden, Alejandro A. Schaffer, Jinghui Zhang, Zheng Zhang, Webb Miller, and David J. Lipman (1997), "Gapped BLAST and PSI-BLAST: a new generation of protein database search programs", Nucleic Acids Res. 25:3389-3402.) Other tools are described herein, specifically in the definition of "identity."

Default parameters in the BLAST algorithm include, for example, an expect threshold of 10, Word size of 28, Match/Mismatch Scores 1, −2, Gap costs Linear. Any filter can be applied as well as a selection for species specific repeats, e.g., *Homo sapiens*.

In one embodiment, the signal-sensor polynucleotides, primary constructs and/or mmRNA may be used to treat a disease, disorder and/or condition in a subject.

In one embodiment, the polynucleotides, primary constructs and/or mmRNA may be used to reduce, eliminate or prevent tumor growth in a subject.

In one embodiment, the signal-sensor polynucleotides, primary constructs and/or mmRNA may be used to recude and/or ameliorate at least one symptom of cancer in a subject. A symptom of cancer may include, but is not limited to, weakness, aches and pains, fever, fatigue, weight loss, blood clots, increased blood calcium levels, low white blood cell count, short of breath, dizziness, headaches, hyperpigmentation, jaundice, erthema, pruritis, excessive hair growth, change in bowel habits, change in bladder function, long-lasting sores, white patches inside the mouth, white spots on the tongue, unusual bleeding or discharge, thickening or lump on parts of the body, indigestion, trouble swallowing, changes in warts or moles, change in new skin and nagging cough or hoarseness. Further, the signal-sensor polynucleotides, primary constructs and/or mmRNA may reduce a side-effect associated with cancer such as, but not limited to, chemo brain, peripheral neuropathy, fatigue, depression, nausea, vomiting, pain, anemia, lymphedema, infections, sexual side effects, reduced fertility or infertility, ostomies, insomnia and hair loss.

Oncology-Related Proteins or Oncology-Related Peptides

The signal-sensor primary constructs or mmRNA disclosed herein, may encode one or more validated or "in testing" oncology-related proteins or oncology-related peptides.

According to the present invention, one or more oncology-related proteins or oncology-related peptides currently being marketed or in development may be encoded by the oncology-related signal-sensor polynucleotide, primary constructs or mmRNA of the present invention. While not wishing to be bound by theory, it is believed that incorporation into the signal-sensor primary constructs or mmRNA of the invention will result in improved therapeutic efficacy due at least in part to the specificity, purity and selectivity of the construct designs.

The signal-sensor polynucleotides, primary constructs and/or mmRNA may alter a biological and/or physiological process and/or compound such as, but not limited to, the cell cycle, the DNA damage response (e.g., DNA damage repair), apoptosis, angiogenesis, cell motility, the epithelial to mesenchymal transition in epithelial cells, the phosphatidyl inositol 3 (PI3) kinase/Akt cellular signaling pathway, telomerase activity and/or expression, tumor metastasis, tumorigenesis, cathepsins, cell senescence, receptor tyrosine kinase signaling, metabolism and drug metabolism, G protein signaling, growth factors and receptors, heat shock proteins, histone deacetylases, hormone receptors, hypoxia, poly ADP-ribose polymerases, protein kinases, RAS signaling, topoisomerases, transcription factors and tumor suppressor activity in cancerous, precancerous and/or other cells.

In one embodiment, the signal-sensor polynucleotides, primary constructs and/or mmRNA may used to express a polypeptide in cells or tissues for the purpose of replacing the protein produced from a deleted or mutated gene.

Further, the polynucleotides, primary constructs or mmRNA of the invention may be used to treat cancer which has been caused by carcinogens of natural and/or synthetic origin. In another embodiment, the use of the polynucleotides, primary constructs and/or mmRNA may be used to treat cancer caused by other organisms and/or cancers caused by viral infection.

Sensors in the Flanking Regions: Untranslated Regions (UTRs)

Untranslated regions (UTRs) of a gene are transcribed but not translated. The 5'UTR starts at the transcription start site and continues to the start codon but does not include the start codon; whereas, the 3'UTR starts immediately following the stop codon and continues until the transcriptional termination signal. There is growing body of evidence about the regulatory roles played by the UTRs in terms of stability of the nucleic acid molecule and translation. The regulatory features of a UTR can be incorporated into the signal-sensor polynucleotides, primary constructs and/or mmRNA of the present invention to enhance the stability of the molecule. The specific features can also be incorporated to ensure controlled down-regulation of the transcript in case they are misdirected to undesired organs sites. The untranslated regions may be incorporated into a vector system which can produce mRNA and/or be delivered to a cell, tissue and/or organism to produce a polypeptide of interest.

In one embodiment, the signal-sensor polynucleotides, primary constructs and/or mmRNA of the present may comprise at least one terminal modification. Non-limiting examples of terminal modifications are described in U.S. Provisional Patent Application No. 61/729,933, filed Nov. 26, 2012, entitled Terminally Optimized Modified RNAs, U.S. Provisional Patent application No. 61/737,224, filed Dec. 14, 2012, entitled Terminally Optimized RNAs, U.S. Provisional Patent Application No. 61/758,921, filed Jan. 31, 2013, entitled Differential Targeting Using RNA Constructs, U.S. Provisional Patent Application No. 61/781,139, filed Mar. 14, 2013, entitled Differential Targeting Using RNA Constructs, U.S. Provisional Patent Application No. 61/829,359, filed May 31, 2013, entitled Differential Targeting Using RNA Constructs, U.S. Provisional Patent Application No. 61/839,903, filed Jun. 27, 2013, entitled Differential Targeting Using RNA Constructs, U.S. Provisional Patent Application No. 61/842,709, filed Jul. 3, 2013, entitled Differential Targeting Using RNA Constructs, and U.S. Provisional Patent Application No. 61/857,436, filed Jul. 23, 2013, entitled Differential Targeting Using RNA Constructs, the contents of each of which are herein incorporated by reference in their entireties. These terminal modifications include, but are not limited to, 5' caps, microRNA binding sites in the terminal region, chain terminating nucleosides, translation enhancer elements in the terminal region and tailing sequences including a polyA-G quartet and stem loop sequences.

5' UTR and Translation Initiation

Natural 5'UTRs bear features which play roles in for translation initiation. They harbor signatures like Kozak sequences which are commonly known to be involved in the process by which the ribosome initiates translation of many genes. Kozak sequences have the consensus CCR(A/G) CCAUGG, where R is a purine (adenine or guanine) three bases upstream of the start codon (AUG), which is followed by another 'G'. 5'UTR also have been known to form secondary structures which are involved in elongation factor binding. For example, one of the secondary 5'-UTR structures is the structured IRES for eIF4A2 elongation factor binding, which is necessary for the microRNA mediated gene repression at 3'-UTR.

5'UTR secondary structures involved in elongation factor binding can interact with other RNA binding molecules in the 5'UTR or 3'UTR to regulate gene expression. For example, the elongation factor EIF4A2 binding to a secondarily structured element in the 5'UTR is necessary for microRNA mediated repression (Meijer H A et al., Science, 2013, 340, 82-85, herein incorporated by reference in its entirety). The different secondary structures in the 5'UTR can be incorporated into the flanking region to either stabilize or selectively destabilized mRNAs in specific tissues or cells.

By engineering the features typically found in abundantly expressed genes of specific target organs, one can enhance the stability and oncology-related protein production of the signal-sensor polynucleotides, primary constructs or mmRNA of the invention. For example, introduction of 5' UTR of liver-expressed mRNA, such as albumin, serum amyloid A, Apolipoprotein AB/E, transferrin, alpha fetoprotein, erythropoietin, or Factor VIII, could be used to enhance expression of a nucleic acid molecule, such as a mmRNA, in hepatic cell lines or liver. Likewise, use of 5' UTR from other tissue-specific mRNA to improve expression in that tissue is possible—for muscle (MyoD, Myosin, Myoglobin, Myogenin, Herculin), for endothelial cells (Tie-1, CD36), for myeloid cells (C/EBP, AML1, G-CSF, GM-CSF, CD11b, MSR, Fr-1, i-NOS), for leukocytes (CD45, CD18), for adipose tissue (CD36, GLUT4, ACRP30, adiponectin) and for lung epithelial cells (SP-A/B/C/D).

Other non-UTR sequences may be incorporated into the 5' (or 3' UTR) UTRs. For example, introns or portions of introns sequences may be incorporated into the flanking regions of the signal-sensor polynucleotides, primary constructs or mmRNA of the invention. Incorporation of intronic sequences may increase protein production as well as mRNA levels.

Translation Enhancer Elements (TEEs)

In one embodiment, the 5'UTR of the signal-sensor polynucleotides, primary constructs, modified nucleic acids and/or mmRNA may include at least one translational enhancer polynucleotide, translation enhancer element, translational enhancer elements (collectively referred to as "TEE"s). As a non-limiting example, the TEE may be located between the transcription promoter and the start codon. The signal-sensor polynucleotides, primary constructs, modified nucleic acids and/or mmRNA with at least one TEE in the 5'UTR may include a cap at the 5'UTR. Further, at least one TEE may be located in the 5'UTR of signal-sensor polynucleotides, primary constructs, modified nucleic acids and/or mmRNA undergoing cap-dependent or cap-independent translation.

The term "translational enhancer element" or "translation enhancer element" (herein collectively referred to as "TEE") refers to sequences that increase the amount of polypeptide or protein produced from an mRNA.

In one embodiment, TEEs are conserved elements in the UTR which can promote translational activity of a nucleic acid such as, but not limited to, cap-dependent or cap-independent translation. The conservation of these sequences has been previously shown by Panek et al (Nucleic Acids Research, 2013, 1-10; herein incorporated by reference in its entirety) across 14 species including humans.

In one embodiment, the TEE may be any of the TEEs listed in Table 35 in Example 45, including portion and/or fragments thereof. The TEE sequence may include at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, at least 99% or more than 99% of the TEE sequences disclosed in Table 35 and/or the TEE sequence may include a 5-30 nucleotide fragment, a 5-25 nucleotide fragment, a 5-20 nucleotide fragment, a 5-15 nucleotide fragment, a 5-10 nucleotide fragment of the TEE sequences disclosed in Table 35.

In one non-limiting example, the TEEs known may be in the 5'-leader of the Gtx homeodomain protein (Chappell et al., Proc. Natl. Acad. Sci. USA 101:9590-9594, 2004, herein incorporated by reference in their entirety).

In another non-limiting example, TEEs are disclosed as SEQ ID NOs: 1-35 in US Patent Publication No. US20090226470, SEQ ID NOs: 1-35 in US Patent Publication US20130177581, SEQ ID NOs: 1-35 in International Patent Publication No. WO2009075886, SEQ ID NOs: 1-5, and 7-645 in International Patent Publication No. WO2012009644, SEQ ID NO: 1 in International Patent Publication No. WO1999024595, SEQ ID NO: 1 in U.S. Pat. No. 6,310,197, and SEQ ID NO: 1 in U.S. Pat. No. 6,849,405, each of which is herein incorporated by reference in its entirety.

In yet another non-limiting example, the TEE may be an internal ribosome entry site (IRES), HCV-IRES or an IRES element such as, but not limited to, those described in U.S. Pat. No. 7,468,275, US Patent Publication Nos. US20070048776 and US20110124100 and International Patent Publication Nos. WO2007025008 and WO2001055369, each of which is herein incorporated by reference in its entirety. The IRES elements may include, but are not limited to, the Gtx sequences (e.g., Gtx9-nt, Gtx8-nt, Gtx7-nt) described by Chappell et al. (Proc. Natl. Acad. Sci. USA 101:9590-9594, 2004) and Zhou et al. (PNAS 102: 6273-6278, 2005) and in US Patent Publication Nos. US20070048776 and US20110124100 and International Patent Publication No. WO2007025008, each of which is herein incorporated by reference in its entirety.

"Translational enhancer polynucleotides" or "translation enhancer polynucleotide sequences" are polynucleotides which include one or more of the specific TEE exemplified herein and/or disclosed in the art (see e.g., U.S. Pat. Nos. 6,310,197, 6,849,405, 7,456,273, 7,183,395, US20090226470, US20070048776, US20110124100, US20090093049, US20130177581, WO2009075886, WO2007025008, WO2012009644, WO2001055371 WO1999024595, and EP2610341A1 and EP2610340A1; each of which is herein incorporated by reference in its entirety) or their variants, homologs or functional derivatives. One or multiple copies of a specific TEE can be present in the signal-sensor polynucleotides, primary constructs, modified nucleic acids and/or mmRNA. The TEEs in the translational enhancer polynucleotides can be organized in one or more sequence segments. A sequence segment can harbor one or more of the specific TEEs exemplified herein, with each TEE being present in one or more copies. When multiple sequence segments are present in a translational enhancer polynucleotide, they can be homogenous or heterogeneous. Thus, the multiple sequence segments in a translational enhancer polynucleotide can harbor identical or different types of the specific TEEs exemplified herein, identical or different number of copies of each of the specific TEEs, and/or identical or different organization of the TEEs within each sequence segment.

In one embodiment, the signal-sensor polynucleotides, primary constructs, modified nucleic acids and/or mmRNA may include at least one TEE that is described in International Patent Publication No. WO1999024595, WO2012009644, WO2009075886, WO2007025008, WO1999024595, European Patent Publication No. EP2610341A1 and EP2610340A1, U.S. Pat. Nos. 6,310, 197, 6,849,405, 7,456,273, 7,183,395, US Patent Publication No. US20090226470, US20110124100, US20070048776, US20090093049 and US20130177581, each of which is herein incorporated by reference in its entirety. The TEE may be located in the 5'UTR of the signal-sensor polynucleotides, primary constructs, modified nucleic acids and/or mmRNA.

In another embodiment, the signal-sensor polynucleotides, primary constructs, modified nucleic acids and/or mmRNA may include at least one TEE that has at least 50%, at least 55%, at least 60%, at least 65%, at least 70%, at least 75%, at least 80%, at least 85%, at least 90%, at least 95% or at least 99% identity with the TEEs described in US Patent Publication Nos. US20090226470, US20070048776, US20130177581 and US20110124100, International Patent Publication No. WO1999024595, WO2012009644, WO2009075886 and WO2007025008, European Patent Publication No. EP2610341A1 and EP2610340A1, U.S. Pat. Nos. 6,310,197, 6,849,405, 7,456,273, 7,183,395, each of which is herein incorporated by reference in its entirety.

In one embodiment, the 5'UTR of the signal-sensor polynucleotides, primary constructs, modified nucleic acids and/or mmRNA may include at least 1, at least 2, at least 3, at least 4, at least 5, at least 6, at least 7, at least 8, at least 9, at least 10, at least 11, at least 12, at least 13, at least 14, at least 15, at least 16, at least 17, at least 18 at least 19, at least 20, at least 21, at least 22, at least 23, at least 24, at least 25, at least 30, at least 35, at least 40, at least 45, at least 50, at least 55 or more than 60 TEE sequences. The TEE sequences in the 5'UTR of the signal-sensor polynucleotides, primary constructs, modified nucleic acids and/or mmRNA of the present invention may be the same or different TEE sequences. The TEE sequences may be in a pattern such as ABABAB or AABBAABBAABB or ABCABCABC or variants thereof repeated once, twice, or more than three times. In these patterns, each letter, A, B, or C represent a different TEE sequence at the nucleotide level.

In one embodiment, the 5'UTR may include a spacer to separate two TEE sequences. As a non-limiting example, the spacer may be a 15 nucleotide spacer and/or other spacers known in the art. As another non-limiting example, the 5'UTR may include a TEE sequence-spacer module repeated at least once, at least twice, at least 3 times, at least 4 times, at least 5 times, at least 6 times, at least 7 times, at least 8 times and at least 9 times or more than 9 times in the 5'UTR.

In another embodiment, the spacer separating two TEE sequences may include other sequences known in the art which may regulate the translation of the signal-sensor polynucleotides, primary constructs, modified nucleic acids and/or mmRNA of the present invention such as, but not limited to, miR sequences described herein (e.g., miR binding sites and miR seeds). As a non-limiting example, each spacer used to separate two TEE sequences may include a different miR sequence or component of a miR sequence (e.g., miR seed sequence).

In one embodiment, the TEE in the 5'UTR of the signal-sensor polynucleotides, primary constructs, modified nucleic acids and/or mmRNA of the present invention may include at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, at least 99% or more than 99% of the TEE sequences disclosed in US Patent Publication Nos. US20090226470, US20070048776, US20130177581 and US20110124100, International Patent Publication No. WO1999024595, WO2012009644, WO2009075886 and WO2007025008, European Patent Publication No. EP2610341A1 and EP2610340A1, U.S. Pat. Nos. 6,310, 197, 6,849,405, 7,456,273, 7,183,395. In another embodiment, the TEE in the 5'UTR of the signal-sensor polynucleotides, primary constructs, modified nucleic acids and/or mmRNA of the present invention may include a 5-30 nucleotide fragment, a 5-25 nucleotide fragment, a 5-20 nucleotide fragment, a 5-15 nucleotide fragment, a 5-10 nucleotide fragment of the TEE sequences disclosed in US Patent Publication Nos. US20090226470, US20070048776, US20130177581 and US20110124100, International Patent Publication No. WO1999024595, WO2012009644, WO2009075886 and WO2007025008, European Patent Publication No. EP2610341A1 and EP2610340A1, U.S. Pat. Nos. 6,310,197, 6,849,405, 7,456,273, 7,183,395; each of which are herein incorporated by reference in their entirety.

In one embodiment, the TEE in the 5'UTR of the signal-sensor polynucleotides, primary constructs, modified nucleic acids and/or mmRNA of the present invention may include at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, at least 99% or more than 99% of the TEE sequences disclosed in Chappell et al. (Proc. Natl. Acad. Sci. USA 101:9590-9594, 2004) and Thou et al. (PNAS 102:6273-6278, 2005), in Supplemental Table 1 and in Supplemental Table 2 disclosed by Wellensiek et al (Genome-wide profiling of human cap-independent translation-enhancing elements, Nature Methods, 2013; DOI: 10.1038/NMETH.2522); each of which is herein incorporated by reference in its entirety. In another embodiment, the TEE in the 5'UTR of the signal-sensor polynucleotides, primary constructs, modified nucleic acids and/or mmRNA of the present invention may include a 5-30 nucleotide fragment, a 5-25 nucleotide fragment, a 5-20 nucleotide fragment, a 5-15 nucleotide fragment, a 5-10 nucleotide fragment of the TEE sequences disclosed in Chappell et al. (Proc. Natl. Acad. Sci. USA 101:9590-9594, 2004) and Zhou et al. (PNAS 102:6273-6278, 2005), in Supplemental Table 1 and in Supplemental Table 2 disclosed by Wellensiek et al (Genome-wide profiling of human cap-independent translation-enhancing elements, Nature Methods, 2013; DOI:10.1038/NMETH.2522); each of which is herein incorporated by reference in its entirety.

In one embodiment, the TEE used in the 5'UTR of the signal-sensor polynucleotides, primary constructs, modified nucleic acids and/or mmRNA of the present invention is an IRES sequence such as, but not limited to, those described in U.S. Pat. No. 7,468,275 and International Patent Publication No. WO2001055369, each of which is herein incorporated by reference in its entirety.

In one embodiment, the TEEs used in the 5'UTR of the signal-sensor polynucleotides, primary constructs, modified nucleic acids and/or mmRNA of the present invention may be identified by the methods described in US Patent Publication No. US20070048776 and US20110124100 and International Patent Publication Nos. WO2007025008 and WO2012009644, each of which is herein incorporated by reference in its entirety.

In another embodiment, the TEEs used in the 5'UTR of the signal-sensor polynucleotides, primary constructs, modified nucleic acids and/or mmRNA of the present invention may be a transcription regulatory element described in U.S. Pat. Nos. 7,456,273 and 7,183,395, US Patent Publication No. US20090093049, and International Publication No. WO2001055371, each of which is herein incorporated by reference in their entirety. The transcription regulatory elements may be identified by methods known in the art, such as, but not limited to, the methods described in U.S. Pat. Nos. 7,456,273 and 7,183,395, US Patent Publication No. US20090093049, and International Publication No. WO2001055371, each of which is herein incorporated by reference in their entirety.

In yet another embodiment, the TEE used in the 5'UTR of the signal-sensor polynucleotides, primary constructs, modified nucleic acids and/or mmRNA of the present invention is an oligonucleotide or portion thereof as described in U.S. Pat. Nos. 7,456,273 and 7,183,395, US Patent Publication No. US20090093049, and International Publication No. WO2001055371, each of which is herein incorporated by reference in their entirety.

The 5' UTR comprising at least one TEE described herein may be incorporated in a monocistronic sequence such as, but not limited to, a vector system or a nucleic acid vector. As a non-limiting example, the vector systems and nucleic acid vectors may include those described in U.S. Pat. Nos. 7,456,273 and 7,183,395, US Patent Publication No. US20070048776, US20090093049 and US20110124100 and International Patent Publication Nos. WO2007025008 and WO2001055371, each of which is herein incorporated by reference in its entirety.

In one embodiment, the TEEs described herein may be located in the 5'UTR and/or the 3'UTR of the signal-sensor polynucleotides, primary constructs, modified nucleic acids and/or mmRNA. The TEEs located in the 3'UTR may be the same and/or different than the TEEs located in and/or described for incorporation in the 5'UTR.

In one embodiment, the 3'UTR of the signal-sensor polynucleotides, primary constructs, modified nucleic acids and/or mmRNA may include at least 1, at least 2, at least 3, at least 4, at least 5, at least 6, at least 7, at least 8, at least 9, at least 10, at least 11, at least 12, at least 13, at least 14, at least 15, at least 16, at least 17, at least 18 at least 19, at least 20, at least 21, at least 22, at least 23, at least 24, at least 25, at least 30, at least 35, at least 40, at least 45, at least 50, at least 55 or more than 60 TEE sequences. The TEE sequences in the 3'UTR of the signal-sensor polynucleotides, primary constructs, modified nucleic acids and/or mmRNA of the present invention may be the same or different TEE sequences. The TEE sequences may be in a pattern such as ABABAB or AABBAABBAABB or ABCABCABC or variants thereof repeated once, twice, or more than three times. In these patterns, each letter, A, B, or C represent a different TEE sequence at the nucleotide level.

In one embodiment, the 3'UTR may include a spacer to separate two TEE sequences. As a non-limiting example, the spacer may be a 15 nucleotide spacer and/or other spacers known in the art. As another non-limiting example, the 3'UTR may include a TEE sequence-spacer module repeated at least once, at least twice, at least 3 times, at least 4 times, at least 5 times, at least 6 times, at least 7 times, at least 8 times and at least 9 times or more than 9 times in the 3'UTR.

In another embodiment, the spacer separating two TEE sequences may include other sequences known in the art which may regulate the translation of the signal-sensor polynucleotides, primary constructs, modified nucleic acids and/or mmRNA of the present invention such as, but not limited to, miR sequences described herein (e.g., miR binding sites and miR seeds). As a non-limiting example, each spacer used to separate two TEE sequences may include a different miR sequence or component of a miR sequence (e.g., miR seed sequence).

In one embodiment, the incorporation of a miR sequence and/or a TEE sequence changes the shape of the stem loop region which may increase and/or decrease translation. (see e.g, Kedde et al. A Pumilio-induced RNA structure switch in p27-3'UTR controls miR-221 and miR-22 accessibility. Nature Cell Biology. 2010, herein incorporated by reference in its entirety).

In one embodiment, the 5'UTR may comprise at least one microRNA sequence. The microRNA sequence may be, but is not limited to, a 19 or 22 nucleotide sequence and/or a microRNA sequence without the seed.

In one embodiment the microRNA sequence in the 5'UTR may be used to stabilize the nucleic acid and/or mRNA described herein.

In another embodiment, a microRNA sequence in the 5'UTR may be used to decrease the accessibility of the site of translation initiation such as, but not limited to a start codon. Matsuda et al (PLoS One. 2010 11(5):e15057; herein incorporated by reference in its entirety) used antisense locked nucleic acid (LNA) oligonucleotides and exon-junction complexes (EJCs) around a start codon (−4 to +37 where the A of the AUG codons is +1) in order to decrease the accessibility to the first start codon (AUG). Matsuda showed that altering the sequence around the start codon with an LNA or EJC the efficiency, length and structural stability of the nucleic acid or mRNA is affected. The signal-sensor polynucleotides of the present invention may comprise a microRNA sequence, instead of the LNA or EJC sequence described by Matsuda et al, near the site of translation initiation in order to decrease the accessibility to the site of translation initiation. The site of translation initiation may be prior to, after or within the microRNA sequence. As a non-limiting example, the site of translation initiation may be located within a microRNA sequence such as a seed sequence or binding site. As another non-limiting example, the site of translation initiation may be located within a miR-122 sequence such as the seed sequence or the mir-122 binding site.

In one embodiment, the nucleic acids or mRNA of the present invention comprises at least one microRNA sequence in a region of the nucleic acid or mRNA which may interact with a RNA binding protein.

RNA Motifs for RNA Binding Proteins (RBPs)

RNA binding proteins (RBPs) can regulate numerous aspects of co- and post-transcription gene expression such as, but not limited to, RNA splicing, localization, translation, turnover, polyadenylation, capping, modification, export and localization. RNA-binding domains (RBDs), such as, but not limited to, RNA recognition motif (RR) and hnRNP K-homology (KH) domains, typically regulate the sequence association between RBPs and their RNA targets (Ray et al. Nature 2013. 499:172-177; herein incorporated by reference in its entirety). In one embodiment, the canonical RBDs can bind short RNA sequences. In another embodiment, the canonical RBDs can recognize structure RNAs.

In one embodiment, the nucleic acids and/or mRNA may comprise at least one RNA-binding motif such as, but not limited to a RNA-binding domain (RBD).

In one embodiment, the RBD may be any of the RBDs, fragments or variants thereof descried by Ray et al. (Nature 2013. 499:172-177; herein incorporated by reference in its entirety).

In one embodiment, the nucleic acids or mRNA of the present invention may comprise a sequence for at least one RNA-binding domain (RBDs). When the nucleic acids or mRNA of the present invention comprise more than one RBD, the RBDs do not need to be from the same species or even the same structural class.

In one embodiment, at least one flanking region (e.g., the 5'UTR and/or the 3'UTR) may comprise at least one RBD. In another embodiment, the first flanking region and the second flanking region may both comprise at least one RBD. The RBD may be the same or each of the RBDs may have at least 60% sequence identity to the other RBD. As a non-limiting example, at least on RBD may be located before, after and/or within the 3'UTR of the nucleic acid or mRNA of the present invention. As another non-limiting example, at least one RBD may be located before or within the first 300 nucleosides of the 3'UTR.

In another embodiment, the nucleic acids and/or mRNA of the present invention may comprise at least one RBD in the first region of linked nucleosides. The RBD may be located before, after or within a coding region (e.g., the ORF).

In yet another embodiment, the first region of linked nucleosides and/or at least one flanking region may comprise at least on RBD. As a non-limiting example, the first region of linked nucleosides may comprise a RBD related to splicing factors and at least one flanking region may comprise a RBD for stability and/or translation factors.

In one embodiment, the nucleic acids and/or mRNA of the present invention may comprise at least one RBD located in a coding and/or non-coding region of the nucleic acids and/or mRNA.

In one embodiment, at least one RBD may be incorporated into at least one flanking region to increase the stability of the nucleic acid and/or mRNA of the present invention.

In one embodiment, a microRNA sequence in a RNA binding protein motif may be used to decrease the accessibility of the site of translation initiation such as, but not limited to a start codon. The signal-sensor polynucleotides of the present invention may comprise a microRNA sequence, instead of the LNA or EJC sequence described by Matsuda et al, near the site of translation initiation in order to decrease the accessibility to the site of translation initiation. The site of translation initiation may be prior to, after or within the microRNA sequence. As a non-limiting example, the site of translation initiation may be located within a microRNA sequence such as a seed sequence or binding site. As another non-limiting example, the site of translation initiation may be located within a miR-122 sequence such as the seed sequence or the mir-122 binding site.

In another embodiment, an antisense locked nucleic acid (LNA) oligonucleotides and exon-junction complexes (EJCs) may be used in the RNA binding protein motif. The LNA and EJCs may be used around a start codon (−4 to +37 where the A of the AUG codons is +1) in order to decrease the accessibility to the first start codon (AUG).

3' UTR and the AU Rich Elements

3'UTRs are known to have stretches of Adenosines and Uridines embedded in them. These AU rich signatures are particularly prevalent in genes with high rates of turnover. Based on their sequence features and functional properties, the AU rich elements (AREs) can be separated into three classes (Chen et al, 1995): Class I AREs contain several dispersed copies of an AUUUA motif within U-rich regions. C-Myc and MyoD contain class I AREs. Class II AREs possess two or more overlapping UUAUUUA(U/A)(U/A) nonamers. Molecules containing this type of AREs include GM-CSF and TNF-a. Class III ARES are less well defined. These U rich regions do not contain an AUUUA motif. c-Jun and Myogenin are two well-studied examples of this class. Most proteins binding to the AREs are known to destabilize the messenger, whereas members of the ELAV family, most notably HuR, have been documented to increase the stability of mRNA. HuR binds to AREs of all the three classes. Engineering the HuR specific binding sites into the 3' UTR of nucleic acid molecules will lead to HuR binding and thus, stabilization of the message in vivo.

Introduction, removal or modification of 3' UTR AU rich elements (AREs) can be used to modulate the stability of signal-sensor polynucleotides, primary constructs or mmRNA of the invention. When engineering specific polynucleotides, primary constructs or mmRNA, one or more copies of an ARE can be introduced to make polynucleotides, primary constructs or mmRNA of the invention less stable and thereby curtail translation and decrease production of the resultant protein. Likewise, AREs can be identified and removed or mutated to increase the intracellular stability and thus increase translation and production of the resultant protein. Transfection experiments can be conducted in relevant cell lines, using signal-sensor polynucleotides, primary constructs or mmRNA of the invention and protein production can be assayed at various time points post-transfection. For example, cells can be transfected with different ARE-engineering molecules and by using an ELISA kit to the relevant protein and assaying protein produced at 6 hr, 12 hr, 24 hr, 48 hr, and 7 days post-transfection.

3' UTR and Triple Helices

In one embodiment, signal-sequence polynucleotides of the present invention may include a triple helix on the 3' end of the signal-sequence polynucleotides. The 3' end of the nucleic acids of the present invention may include a triple helix alone or in combination with a Poly-A tail.

In one embodiment, the signal-sequence polynucleotides of the present invention may comprise at least a first and a second U-rich region, a conserved stem loop region between the first and second region and an A-rich region. The first and second U-rich region and the A-rich region may associate to form a triple helix on the 3' end of the nucleic acid. This triple helix may stabilize the nucleic acid, enhance the translational efficiency of the nucleic acid and/or protect the 3' end from degradation. Exemplary triple helices include, but are not limited to, the triple helix sequence of metastasis-associated lung adenocarcinoma transcript 1 (MALAT1), MEN-β and polyadenylated nuclear (PAN) RNA (See Wilusz et al., Genes & Development 2012 26:2392-2407; herein incorporated by reference in its entirety). In one embodiment, the 3' end of the modified nucleic acids, enhanced modified RNA or ribonucleic acids of the present invention comprises a first U-rich region comprising TTTTTCTTTT (SEQ ID NO: 1), a second U-rich region comprising TTTTGCTTTTT (SEQ ID NO: 2) or TTTTGCTTTT (SEQ ID NO: 3), an A-rich region comprising AAAAAGCAAAA (SEQ ID NO: 4). In another embodiment, the 3' end of the nucleic acids of the present invention comprises a triple helix formation structure comprising a first U-rich region, a conserved region, a second U-rich region and an A-rich region.

In one embodiment, the triple helix may be formed from the cleavage of a MALAT1 sequence prior to the cloverleaf structure. While not meaning to be bound by theory, MALAT1 is a long non-coding RNA which, when cleaved, forms a triple helix and a tRNA-like cloverleaf structure. The MALAT1 transcript then localizes to nuclear speckles and the tRNA-like cloverleaf localizes to the cytoplasm (Wilusz et al. Cell 2008 135(5): 919-932; herein incorporated by reference in its entirety).

As a non-limiting example, the terminal end of the nucleic acid of the present invention comprising the MALAT1 sequence can then form a triple helix structure, after RNaseP cleavage from the cloverleaf structure, which stabilizes the nucleic acid (Peart et al. *Non-mRNA 3' end formation: how the other half lives*; WIREs RNA 2013; herein incorporated by reference in its entirety).

In one embodiment, the signal-sequence polynucleotides described herein comprise a MALAT1 sequence. In another embodiment, the signal-sequence polynucleotides may be polyadenylated. In yet another embodiment, the signal-sequence polynucleotides is not polyadenylated but has an increased resistance to degradation compared to unmodified nucleic acids or mRNA.

In one embodiment, the signal-sequence polynucleotides of the present invention may comprise a MALAT1 sequence in the second flanking region (e.g., the 3'UTR). As a non-limiting example, the MALAT1 sequence may be human or mouse.

In another embodiment, the cloverleaf structure of the MALAT1 sequence may also undergo processing by RNaseZ and CCA adding enzyme to form a tRNA-like structure called mascRNA (MALAT1-associated small cytoplasmic RNA). As a non-limiting example, the mascRNA may encode a protein or a fragment thereof and/or may comprise a microRNA sequence. The mascRNA may comprise at least one chemical modification described herein.

Stem Loop

In one embodiment, the nucleic acids of the present invention may include a stem loop such as, but not limited to, a histone stem loop. The stem loop may be a nucleotide sequence that is about 25 or about 26 nucleotides in length such as, but not limited to, SEQ ID NOs: 7-17 as described in International Patent Publication No. WO2013103659, herein incorporated by reference in its entirety. The histone stem loop may be located 3' relative to the coding region (e.g., at the 3' terminus of the coding region). As a non-limiting example, the stem loop may be located at the 3' end of a nucleic acid described herein.

In one embodiment, the stem loop may be located in the second terminal region. As a non-limiting example, the stem loop may be located within an untranslated region (e.g., 3'UTR) in the second terminal region.

In one embodiment, the nucleic acid such as, but not limited to mRNA, which comprises the histone stem loop may be stabilized by the addition of at least one chain terminating nucleoside. Not wishing to be bound by theory, the addition of at least one chain terminating nucleoside may slow the degradation of a nucleic acid and thus can increase the half-life of the nucleic acid.

In one embodiment, the chain terminating nucleoside may be, but is not limited to, those described in International Patent Publication No. WO2013103659, herein incorporated by reference in its entirety. In another embodiment, the chain terminating nucleosides which may be used with the present invention includes, but is not limited to, 3'-deoxyadenosine (cordycepin), 3'-deoxyuridine, 3'-deoxycytosine, 3'-deoxyguanosine, 3'-deoxythymine, 2',3'-dideoxynucleosides, such as 2',3'-dideoxyadenosine, 2',3'-dideoxyuridine, 2',3'-dideoxycytosine, 2',3'-dideoxyguanosine, 2',3'-dideoxythymine, a 2'-deoxynucleoside, or a —O-methylnucleoside.

In another embodiment, the nucleic acid such as, but not limited to mRNA, which comprises the histone stem loop may be stabilized by a modification to the 3' region of the nucleic acid that can prevent and/or inhibit the addition of oligo(U) (see e.g., International Patent Publication No. WO2013103659, herein incorporated by reference in its entirety).

In yet another embodiment, the nucleic acid such as, but not limited to mRNA, which comprises the histone stem loop may be stabilized by the addition of an oligonucleotide that terminates in a 3'-deoxynucleoside, 2',3'-dideoxynucleoside 3'-O-methylnucleosides, 3'-O-ethylnucleosides, 3'-arabinosides, and other modified nucleosides known in the art and/or described herein.

In one embodiment, the nucleic acids of the present invention may include a histone stem loop, a polyA tail sequence and/or a 5' cap structure. The histone stem loop may be before and/or after the polyA tail sequence. The nucleic acids comprising the histone stem loop and a polyA tail sequence may include a chain terminating nucleoside described herein.

In another embodiment, the nucleic acids of the present invention may include a histone stem loop and a 5' cap structure. The 5' cap structure may include, but is not limited to, those described herein and/or known in the art.

In one embodiment, the conserved stem loop region may comprise a miR sequence described herein. As a non-limiting example, the stem loop region may comprise the seed sequence of a miR sequence described herein. In another non-limiting example, the stem loop region may comprise a miR-122 seed sequence.

In another embodiment, the conserved stem loop region may comprise a miR sequence described herein and may also include a TEE sequence.

In one embodiment, the incorporation of a miR sequence and/or a TEE sequence changes the shape of the stem loop region which may increase and/or decrease translation. (see e.g, Kedde et al. A Pumilio-induced RNA structure switch in p27-3'UTR controls miR-221 and miR-22 accessibility. Nature Cell Biology. 2010, herein incorporated by reference in its entirety).

5' Capping

The 5' cap structure of an mRNA is involved in nuclear export, increasing mRNA stability and binds the mRNA Cap Binding Protein (CBP), which is responsible for mRNA stability in the cell and translation competency through the association of CBP with poly(A) binding protein to form the mature cyclic mRNA species. The cap further assists the removal of 5' proximal introns removal during mRNA splicing.

Endogenous mRNA molecules may be 5'-end capped generating a 5'-ppp-5'-triphosphate linkage between a terminal guanosine cap residue and the 5'-terminal transcribed sense nucleotide of the mRNA molecule. This 5'-guanylate cap may then be methylated to generate an N7-methyl-guanylate residue. The ribose sugars of the terminal and/or antiterminal transcribed nucleotides of the 5' end of the mRNA may optionally also be 2'-O-methylated. 5'-decapping through hydrolysis and cleavage of the guanylate cap structure may target a nucleic acid molecule, such as an mRNA molecule, for degradation.

Modifications to the signal-sensor polynucleotides, primary constructs, and mmRNA of the present invention may generate a non-hydrolyzable cap structure preventing decapping and thus increasing mRNA half-life. Because cap structure hydrolysis requires cleavage of 5'-ppp-5' phosphorodiester linkages, modified nucleotides may be used during the capping reaction. For example, a Vaccinia Capping Enzyme from New England Biolabs (Ipswich, Mass.) may be used with α-thio-guanosine nucleotides according to the manufacturer's instructions to create a phosphorothioate linkage in the 5'-ppp-5' cap. Additional modified guanosine nucleotides may be used such as α-methyl-phosphonate and seleno-phosphate nucleotides.

Additional modifications include, but are not limited to, 2'-O-methylation of the ribose sugars of 5'-terminal and/or 5'-antiterminal nucleotides of the mRNA (as mentioned above) on the 2'-hydroxyl group of the sugar ring. Multiple distinct 5'-cap structures can be used to generate the 5'-cap of a nucleic acid molecule, such as an mRNA molecule.

Cap analogs, which herein are also referred to as synthetic cap analogs, chemical caps, chemical cap analogs, or structural or functional cap analogs, differ from natural (i.e. endogenous, wild-type or physiological) 5'-caps in their chemical structure, while retaining cap function. Cap analogs may be chemically (i.e. non-enzymatically) or enzymatically synthesized and/linked to a nucleic acid molecule.

For example, the Anti-Reverse Cap Analog (ARCA) cap contains two guanines linked by a 5'-5'-triphosphate group, wherein one guanine contains an N7 methyl group as well as a 3'-O-methyl group (i.e., N7,3'-O-dimethyl-guanosine-5'-triphosphate-5'-guanosine (m$^7$G-3'mppp-G; which may equivalently be designated 3' O-Me-m7G(5')ppp(5')G). The 3'-O atom of the other, unmodified, guanine becomes linked to the 5'-terminal nucleotide of the capped nucleic acid molecule (e.g. an mRNA or mmRNA). The N7- and 3'-O-methylated guanine provides the terminal moiety of the capped nucleic acid molecule (e.g. mRNA or mmRNA).

Another exemplary cap is mCAP, which is similar to ARCA but has a 2'-O-methyl group on guanosine (i.e., N7,2'-O-dimethyl-guanosine-5'-triphosphate-5'-guanosine, m$^7$Gm-ppp-G).

While cap analogs allow for the concomitant capping of a nucleic acid molecule in an in vitro transcription reaction, up to 20% of transcripts remain uncapped. This, as well as the structural differences of a cap analog from an endogenous 5'-cap structures of nucleic acids produced by the endogenous, cellular transcription machinery, may lead to reduced translational competency and reduced cellular stability.

Signal-sensor polynucleotides, primary constructs and mmRNA of the invention may also be capped post-transcriptionally, using enzymes, in order to generate more authentic 5'-cap structures. As used herein, the phrase "more authentic" refers to a feature that closely mirrors or mimics, either structurally or functionally, an endogenous or wild type feature. That is, a "more authentic" feature is better representative of an endogenous, wild-type, natural or physiological cellular function and/or structure as compared to synthetic features or analogs, etc., of the prior art, or which outperforms the corresponding endogenous, wild-type, natural or physiological feature in one or more respects. Non-limiting examples of more authentic 5' cap structures of the present invention are those which, among other things, have enhanced binding of cap binding proteins, increased half life, reduced susceptibility to 5' endonucleases and/or reduced 5' decapping, as compared to synthetic 5' cap structures known in the art (or to a wild-type, natural or physiological 5' cap structure). For example, recombinant Vaccinia Virus Capping Enzyme and recombinant 2'-O-methyltransferase enzyme can create a canonical 5'-5'-triphosphate linkage between the 5'-terminal nucleotide of an mRNA and a guanine cap nucleotide wherein the cap guanine contains an N7 methylation and the 5'-terminal nucleotide of the mRNA contains a 2'-O-methyl. Such a structure is termed the Cap1 structure. This cap results in a higher translational-competency and cellular stability and a reduced activation of cellular pro-inflammatory cytokines, as compared, e.g., to other 5' cap analog structures known in the art. Cap structures include 7mG(5')ppp(5')N, pN2p (cap 0), 7mG(5')ppp(5')N1mpNp (cap 1), and 7mG(5')-ppp(5') N1mpN2mp (cap 2).

Because the signal-sensor polynucleotides, primary constructs or mmRNA may be capped post-transcriptionally, and because this process is more efficient, nearly 100% of the signal-sensor polynucleotides, primary constructs or mmRNA may be capped. This is in contrast to ~80% when a cap analog is linked to an mRNA in the course of an in vitro transcription reaction.

According to the present invention, 5' terminal caps may include endogenous caps or cap analogs. According to the present invention, a 5' terminal cap may comprise a guanine analog. Useful guanine analogs include inosine, N1-methyl-guanosine, 2'fluoro-guanosine, 7-deaza-guanosine, 8-oxo-guanosine, 2-amino-guanosine, LNA-guanosine, and 2-azido-guanosine.

Viral Sequences

Additional viral sequences such as, but not limited to, the translation enhancer sequence of the barley yellow dwarf virus (BYDV-PAV) can be engineered and inserted in the 3' UTR of the signal-sensor polynucleotides, primary constructs or mmRNA of the invention and can stimulate the translation of the construct in vitro and in vivo.

Transfection experiments can be conducted in relevant cell lines at and protein production can be assayed by ELISA at 12 hr, 24 hr, 48 hr, 72 hr and day 7 post-transfection.

IRES Sequences

Further, provided are signal-sensor polynucleotides, primary constructs or mmRNA which may contain an internal ribosome entry site (IRES). First identified as a feature Picorna virus RNA, IRES plays an important role in initiating protein synthesis in absence of the 5' cap structure. An IRES may act as the sole ribosome binding site, or may serve as one of multiple ribosome binding sites of an mRNA. signal-sensor polynucleotides, primary constructs or mmRNA containing more than one functional ribosome binding site may encode several oncology-related peptides or oncology-related polypeptides that are translated independently by the ribosomes ("multicistronic nucleic acid molecules"). When signal-sensor polynucleotides, primary constructs or mmRNA are provided with an IRES, further optionally provided is a second translatable region. Examples of IRES sequences that can be used according to the invention include without limitation, those from picornaviruses (e.g. FMDV), pest viruses (CFFV), polio viruses (PV), encephalomyocarditis viruses (ECMV), foot-and-mouth disease viruses (FMDV), hepatitis C viruses (HCV), classical swine fever viruses (CSFV), murine leukemia virus (MLV), simian immune deficiency viruses (SIV) or cricket paralysis viruses (CrPV).

Poly-A Tails

During RNA processing, a long chain of adenine nucleotides (poly-A tail) may be added to a polynucleotide such as an mRNA molecule in order to increase stability. Immediately after transcription, the 3' end of the transcript may be cleaved to free a 3' hydroxyl. Then poly-A polymerase adds a chain of adenine nucleotides to the RNA. The process, called polyadenylation, adds a poly-A tail that can be between 100 and 250 residues long.

It has been discovered that unique poly-A tail lengths provide certain advantages to the signal-sensor polynucleotides, primary constructs or mmRNA of the present invention.

Generally, the length of a poly-A tail of the present invention is greater than 30 nucleotides in length. In another embodiment, the poly-A tail is greater than 35 nucleotides in length (e.g., at least or greater than about 35, 40, 45, 50, 55, 60, 70, 80, 90, 100, 120, 140, 160, 180, 200, 250, 300, 350, 400, 450, 500, 600, 700, 800, 900, 1,000, 1,100, 1,200, 1,300, 1,400, 1,500, 1,600, 1,700, 1,800, 1,900, 2,000, 2,500, and 3,000 nucleotides). In some embodiments, the signal-sensor polynucleotides, primary construct, or mmRNA includes from about 30 to about 3,000 nucleotides (e.g., from 30 to 50, from 30 to 100, from 30 to 250, from 30 to 500, from 30 to 750, from 30 to 1,000, from 30 to 1,500, from 30 to 2,000, from 30 to 2,500, from 50 to 100, from 50 to 250, from 50 to 500, from 50 to 750, from 50 to 1,000, from 50 to 1,500, from 50 to 2,000, from 50 to 2,500, from 50 to 3,000, from 100 to 500, from 100 to 750, from 100 to 1,000, from 100 to 1,500, from 100 to 2,000, from 100 to 2,500, from 100 to 3,000, from 500 to 750, from 500 to 1,000, from 500 to 1,500, from 500 to 2,000, from 500 to 2,500, from 500 to 3,000, from 1,000 to 1,500, from 1,000 to 2,000, from 1,000 to 2,500, from 1,000 to 3,000, from 1,500 to 2,000, from 1,500 to 2,500, from 1,500 to 3,000, from 2,000 to 3,000, from 2,000 to 2,500, and from 2,500 to 3,000).

In one embodiment, the poly-A tail is designed relative to the length of the overall signal-sensor polynucleotides, primary constructs or mmRNA. This design may be based on the length of the coding region, the length of a particular feature or region (such as the first or flanking regions), or based on the length of the ultimate product expressed from the polynucleotides, primary constructs or mmRNA.

In this context the poly-A tail may be 10, 20, 30, 40, 50, 60, 70, 80, 90, or 100% greater in length than the signal-sensor polynucleotides, primary constructs or mmRNA or feature thereof. The poly-A tail may also be designed as a fraction of polynucleotides, primary constructs or mmRNA to which it belongs. In this context, the poly-A tail may be 10, 20, 30, 40, 50, 60, 70, 80, or 90% or more of the total length of the construct or the total length of the construct minus the poly-A tail.

In one embodiment, engineered binding sites and/or conjugation of signal-sensor polynucleotides, primary constructs or mmRNA for Poly-A binding protein may be used to enhance expression. The engineered binding sites may be sensor sequences which can operate as binding sites for ligands of the local microenvironment of the nucleic acids and/or mRNA. As a non-limiting example, the nucleic acids and/or mRNA may comprise at least one engineered binding site to alter the binding affinity of Poly-A binding protein (PABP) and analogs thereof. The incorporation of at least one engineered binding site may increase the binding affinity of the PABP and analogs thereof.

Additionally, multiple distinct signal-sensor polynucleotides, primary constructs or mmRNA may be linked together to the PABP (Poly-A binding protein) through the 3'-end using modified nucleotides at the 3'-terminus of the poly-A tail. Transfection experiments can be conducted in relevant cell lines and protein production can be assayed by ELISA at 12 hr, 24 hr, 48 hr, 72 hr and day 7 post-transfection. As a non-limiting example, the transfection experiments may be used to evaluate the effect on PABP or analogs thereof binding affinity as a result of the addition of at least one engineered binding site.

In one embodiment, the signal-sensor polynucleotides and primary constructs of the present invention are designed to include a polyA-G Quartet. The G-quartet is a cyclic hydrogen bonded array of four guanine nucleotides that can be formed by G-rich sequences in both DNA and RNA. In this embodiment, the G-quartet is incorporated at the end of the poly-A tail. The resultant mmRNA construct is assayed for stability, protein production and other parameters including half-life at various time points. It has been discovered that the polyA-G quartet results in protein production equivalent to at least 75% of that seen using a poly-A tail of 120 nucleotides alone.

In one embodiment, the nucleic acids or mRNA of the present invention may comprise a polyA tail and may be stabilized by the addition of a chain terminating nucleoside. The nucleic acids and/or mRNA with a polyA tail may further comprise a 5' cap structure.

In another embodiment, the nucleic acids or mRNA of the present invention may comprise a polyA-G Quartet. The nucleic acids and/or mRNA with a polyA-G Quartet may further comprise a 5' cap structure.

In one embodiment, the chain terminating nucleoside which may be used to stabilize the nucleic acid or mRNA comprising a polyA tail or polyA-G Quartet may be, but is not limited to, those described in International Patent Publication No. WO2013103659, herein incorporated by reference in its entirety. In another embodiment, the chain terminating nucleosides which may be used with the present invention includes, but is not limited to, 3'-deoxyadenosine (cordycepin), 3'-deoxyuridine, 3'-deoxycytosine, 3'-deoxyguanosine, 3'-deoxythymine, 2',3'-dideoxynucleosides, such as 2',3'-dideoxyadenosine, 2',3'-dideoxyuridine, 2',3'-dideoxycytosine, 2',3'-dideoxyguanosine, 2',3'-dideoxythymine, a 2'-deoxynucleoside, or a —O-methylnucleoside.

In another embodiment, the nucleic acid such as, but not limited to mRNA, which comprise a polyA tail or a polyA-G Quartet may be stabilized by a modification to the 3' region of the nucleic acid that can prevent and/or inhibit the addition of oligo(U) (see e.g., International Patent Publication No. WO2013103659, herein incorporated by reference in its entirety).

In yet another embodiment, the nucleic acid such as, but not limited to mRNA, which comprise a polyA tail or a polyA-G Quartet may be stabilized by the addition of an oligonucleotide that terminates in a 3'-deoxynucleoside, 2',3'-dideoxynucleoside 3'-0-methylnucleosides, 3'-0-ethylnucleosides, 3'-arabinosides, and other modified nucleosides known in the art and/or described herein.

Quantification

In one embodiment, the signal-sensor polynucleotides, primary constructs or mmRNA of the present invention may be quantified in exosomes derived from one or more bodily fluid. As used herein "bodily fluids" include peripheral blood, serum, plasma, ascites, urine, cerebrospinal fluid (CSF), sputum, saliva, bone marrow, synovial fluid, aqueous humor, amniotic fluid, cerumen, breast milk, bronchioalveolar lavage fluid, semen, prostatic fluid, cowper's fluid or pre-ejaculatory fluid, sweat, fecal matter, hair, tears, cyst fluid, pleural and peritoneal fluid, pericardial fluid, lymph, chyme, chyle, bile, interstitial fluid, menses, pus, sebum, vomit, vaginal secretions, mucosal secretion, stool water, pancreatic juice, lavage fluids from sinus cavities, bronchopulmonary aspirates, blastocyl cavity fluid, and umbilical cord blood. Alternatively, exosomes may be retrieved from an organ selected from the group consisting of lung, heart, pancreas, stomach, intestine, bladder, kidney, ovary, testis, skin, colon, breast, prostate, brain, esophagus, liver, and placenta.

In the quantification method, a sample of not more than 2 mL is obtained from the subject and the exosomes isolated by size exclusion chromatography, density gradient centrifugation, differential centrifugation, nanomembrane ultrafiltration, immunoabsorbent capture, affinity purification, microfluidic separation, or combinations thereof. In the analysis, the level or concentration of signal-sensor polynucleotides, primary construct or mmRNA may be an expression level, presence, absence, truncation or alteration of the administered construct. It is advantageous to correlate the level with one or more clinical phenotypes or with an assay for a human disease biomarker. The assay may be performed using construct specific probes, cytometry, qRT-PCR, real-time PCR, PCR, flow cytometry, electrophoresis, mass spectrometry, or combinations thereof while the exosomes may be isolated using immunohistochemical methods such as enzyme linked immunosorbent assay (ELISA) methods. Exosomes may also be isolated by size exclusion chromatography, density gradient centrifugation, differential centrifugation, nanomembrane ultrafiltration, immunoabsorbent capture, affinity purification, microfluidic separation, or combinations thereof.

These methods afford the investigator the ability to monitor, in real time, the level of signal-sensor polynucleotides, primary constructs or mmRNA remaining or delivered. This is possible because the polynucleotides, primary constructs or mmRNA of the present invention differ from the endogenous forms due to the structural and/or chemical modifications.

II. Design and Synthesis of Signal-Sensor Polynucleotides

Signal-sensor polynucleotides, primary constructs or mmRNA for use in accordance with the invention may be prepared according to any available technique including, but not limited to chemical synthesis, enzymatic synthesis, which is generally termed in vitro transcription (IVT) or enzymatic or chemical cleavage of a longer precursor, etc. Methods of synthesizing RNAs are known in the art (see, e.g., Gait, M. J. (ed.) *Oligonucleotide synthesis: a practical approach*, Oxford [Oxfordshire], Washington, D.C.: IRL Press, 1984; and Herdewijn, P. (ed.) *Oligonucleotide synthesis: methods and applications*, Methods in Molecular Biology, v. 288 (Clifton, N.J.) Totowa, N.J.: Humana Press, 2005; both of which are incorporated herein by reference).

The process of design and synthesis of the signal-sensor primary constructs of the invention generally includes the steps of gene construction, mRNA production (either with or without modifications) and purification. In the enzymatic synthesis method, a target signal-sensor polynucleotide sequence encoding the oncology-related polypeptide of interest is first selected for incorporation into a vector which will be amplified to produce a cDNA template. Optionally, the target signal-sensor polynucleotide sequence and/or any flanking sequences may be codon optimized. The cDNA template is then used to produce mRNA through in vitro transcription (IVT). After production, the mRNA may undergo purification and clean-up processes. The steps of which are provided in more detail below.

Gene Construction

The step of gene construction may include, but is not limited to gene synthesis, vector amplification, plasmid purification, plasmid linearization and clean-up, and cDNA template synthesis and clean-up.

Gene Synthesis

Once an oncology-related polypeptide of interest, or target, is selected for production, a signal-sensor primary construct is designed. Within the primary construct, a first region of linked nucleosides encoding the polypeptide of interest may be constructed using an open reading frame (ORF) of a selected nucleic acid (DNA or RNA) transcript. The ORF may comprise the wild type ORF, an isoform, variant or a fragment thereof. As used herein, an "open reading frame" or "ORF" is meant to refer to a nucleic acid sequence (DNA or RNA) which is capable of encoding an oncology-related polypeptide of interest. ORFs often begin with the start codon, ATG and end with a nonsense or termination codon or signal.

Further, the nucleotide sequence of the first region may be codon optimized. Codon optimization methods are known in the art and may be useful in efforts to achieve one or more of several goals. These goals include to match codon frequencies in target and host organisms to ensure proper folding, bias GC content to increase mRNA stability or reduce secondary structures, minimize tandem repeat codons or base runs that may impair gene construction or expression, customize transcriptional and translational control regions, insert or remove protein trafficking sequences, remove/add post translation modification sites in encoded protein (e.g. glycosylation sites), add, remove or shuffle protein domains, insert or delete restriction sites, modify ribosome binding sites and mRNA degradation sites, to adjust translational rates to allow the various domains of the protein to fold properly, or to reduce or eliminate problem secondary structures within the mRNA. Codon optimization tools, algorithms and services are known in the art, non-limiting examples include services from GeneArt (Life Technologies) and/or DNA2.0 (Menlo Park Calif.). In one embodiment, the ORF sequence is optimized using optimization algorithms. Codon options for each amino acid are given in Table 1.

TABLE 1

| | | |
|---|---|---|
| Codon Options | | |
| Amino Acid | Single Letter Code | Codon Options |
| Isoleucine | I | ATT, ATC, ATA |
| Leucine | L | CTT, CTC, CTA, CTG, TTA, TTG |
| Valine | V | GTT, GTC, GTA, GTG |
| Phenylalanine | F | TTT, TTC |
| Methionine | M | ATG |
| Cysteine | C | TGT, TGC |
| Alanine | A | GCT, GCC, GCA, GCG |

TABLE 1-continued

Codon Options

| Amino Acid | Single Letter Code | Codon Options |
|---|---|---|
| Glycine | G | GGT, GGC, GGA, GGG |
| Proline | P | CCT, CCC, CCA, CCG |
| Threonine | T | ACT, ACC, ACA, ACG |
| Serine | S | TCT, TCC, TCA, TCG, AGT, AGC |
| Tyrosine | Y | TAT, TAC |
| Tryptophan | W | TGG |
| Glutamine | Q | CAA, CAG |
| Asparagine | N | AAT, AAC |
| Histidine | H | CAT, CAC |
| Glutamic acid | E | GAA, GAG |
| Aspartic acid | D | GAT, GAC |
| Lysine | K | AAA, AAG |
| Arginine | R | CGT, CGC, CGA, CGG, AGA, AGG |
| Selenocysteine | Sec | UGA in mRNA in presence of Selenocystein insertion element (SECIS) |
| Stop codons | Stop | TAA, TAG, TGA |

In one embodiment, after a nucleotide sequence has been codon optimized it may be further evaluated for regions containing restriction sites. At least one nucleotide within the restriction site regions may be replaced with another nucleotide in order to remove the restriction site from the sequence but the replacement of nucleotides does alter the amino acid sequence which is encoded by the codon optimized nucleotide sequence.

Features, which may be considered beneficial in some embodiments of the present invention, may be encoded by the signal-sensor primary construct and may flank the ORF as a first or second flanking region. The flanking regions may be incorporated into the signal-sensor primary construct before and/or after optimization of the ORF. It is not required that a signal-sensor primary construct contain both a 5' and 3' flanking region. Examples of such features include, but are not limited to, untranslated regions (UTRs), Kozak sequences, an oligo(dT) sequence, and detectable tags and may include multiple cloning sites which may have XbaI recognition.

In some embodiments, a 5' UTR and/or a 3' UTR may be provided as flanking regions. Multiple 5' or 3' UTRs may be included in the flanking regions and may be the same or of different sequences. Any portion of the flanking regions, including none, may be codon optimized and any may independently contain one or more different structural or chemical modifications, before and/or after codon optimization. Combinations of features may be included in the first and second flanking regions and may be contained within other features. For example, the ORF may be flanked by a 5' UTR which may contain a strong Kozak translational initiation signal and/or a 3' UTR which may include an oligo(dT) sequence for templated addition of a poly-A tail.

Tables 2 and 3 provide a listing of exemplary UTRs which may be utilized in the signal-sensor primary construct of the present invention as flanking regions. Shown in Table 2 is a representative listing of a 5'-untranslated region of the invention. Variants of 5' UTRs may be utilized wherein one or more nucleotides are added or removed to the termini, including A, T, C or G.

TABLE 2

5'-Untranslated Regions

| 5' UTR Identifier | Name/Description | Sequence | SEQ ID NO. |
|---|---|---|---|
| Native | Wild type UTR | See wild type sequence | — |
| 5UTR-001 | Synthetic UTR | GGGAAATAAGAGAGAAAAGAAGAGTAAGAAGAAATATAAGAGCCACC | 1 |
| 5UTR-002 | Upstream UTR | GGGAGATCAGAGAGAAAAGAAGAGTAAGAAGAAATATAAGAGCCACC | 2 |
| 5UTR-003 | Upstream UTR | GGAATAAAAGTCTCAACACAACATATACAAAACAAACGAATCTCAAGCAATCAAGCATTCTACTTCTATTGCAGCAATTTAAATCATTTCTTTTAAAGCAAAAGCAATTTTCTGAAAATTTTCACCATTTACGAACGATAGCAAC | 3 |
| 5UTR-004 | Upstream UTR | GGGAGACAAGCUUGGCAUUCCGGUACUGUUGGUAAAGCCACC | 4 |

Shown in Table 3 is a representative listing of 3'-untranslated regions of the invention. Variants of 3' UTRs may be utilized wherein one or more nucleotides are added or removed to the termini, including A, T, C or G.

TABLE 3

3'-Untranslated Regions

| 3' UTR Identifier | Name/Description | Sequence | SEQ ID NO. |
|---|---|---|---|
| 3UTR-001 | Creatine Kinase | GCGCCTGCCCACCTGCCACCGACTGCTGGAACCCAGCCAGTGGGAGGGCCTGGCCCACCAGAGTCCTGCTCCCTCACTCCTCGCCCCGCCCCCTGTCCCA | 5 |

TABLE 3-continued

3'-Untranslated Regions

| 3' UTR Identifier | Name/ Description | Sequence | SEQ ID NO. |
|---|---|---|---|
| | | GAGTCCCACCTGGGGGCTCTCTCCACCCTTCTCA GAGTTCCAGTTTCAACCAGAGTTCCAACCAATG GGCTCCATCCTCTGGATTCTGGCCAATGAAATAT CTCCCTGGCAGGGTCCTCTTCTTTTCCCAGAGCT CCACCCCAACCAGGAGCTCTAGTTAATGGAGAG CTCCCAGCACACTCGGAGCTTGTGCTTTGTCTCC ACGCAAAGCGATAAATAAAAGCATTGGTGGCCT TTGGTCTTTGAATAAAGCCTGAGTAGGAAGTCTA GA | |
| 3UTR-002 | Myoglobin | GCCCCTGCCGCTCCCACCCCCACCCATCTGGGCC CCGGGTTCAAGAGAGAGCGGGGTCTGATCTCGT GTAGCCATATAGAGTTTGCTTCTGAGTGTCTGCT TTGTTTAGTAGAGGTGGGCAGGAGGAGCTGAGG GGCTGGGGCTGGGGTGTTGAAGTTGGCTTTGCAT GCCCAGCGATGCGCCTCCCTGTGGGATGTCATCA CCCTGGGAACCGGGAGTGGCCCTTGGCTCACTG TGTTCTGCATGGTTTGGATCTGAATTAATTGTCC TTTCTTCTAAATCCCAACCGAACTTCTTCCAACC TCCAAACTGGCTGTAACCCCAAATCCAAGCCATT AACTACACCTGACAGTAGCAATTGTCTGATTAAT CACTGGCCCCTTGAAGACAGCAGAATGTCCCTTT GCAATGAGGAGGAGATCTGGGCTGGGCGGGCCA GCTGGGGAAGCATTTGACTATCTGGAACTTGTGT GTGCCTCCTCAGGTATGGCAGTGACTCACCTGGT TTTAATAAAACAACCTGCAACATCTCATGGTCTT TGAATAAAGCCTGAGTAGGAAGTCTAGA | 6 |
| 3UTR-003 | α-actin | ACACACTCCACCTCCAGCACGCGACTTCTCAGG ACGACGAATCTTCTCAATGGGGGGCGGCTGAG CTCCAGCCACCCCGCAGTCACTTTCTTTGTAACA ACTTCCGTTGCTGCCATCGTAAACTGACACAGTG TTTATAACGTGTACATACATTAACTTATTACCTC ATTTTGTTATTTTCGAAACAAAGCCCTGTGGAA GAAAATGGAAAACTTGAAGAAGCATTAAAGTCA TTCTGTTAAGCTGCGTAAATGGTCTTTGAATAAA GCCTGAGTAGGAAGTCTAGA | 7 |
| 3UTR-004 | Albumin | CATCACATTTAAAAGCATCTCAGCCTACCATGAG AATAAGAGAAAGAAAATGAAGATCAAAAGCTT ATTCATCTGTTTTTCTTTTTCGTTGGTGTAAAGCC AACACCCTGTCTAAAAAACATAAATTTCTTTAAT CATTTTGCCTCTTTTCTCTGTGCTTCAATTAATAA AAAATGGAAAGAATCTAATAGAGTGGTACAGCA CTGTTATTTTTCAAAGATGTGTTGCTATCCTGAA AATTCTGTAGGTTCTGTGGAAGTTCCAGTGTTCT CTCTTATTCCACTTCGGTAGAGGATTTCTAGTTT CTTGTGGGCTAATTAAATAAATCATTAATACTCT TCTAATGGTCTTTGAATAAAGCCTGAGTAGGAA GTCTAGA | 8 |
| 3UTR-005 | α-globin | GCTGCCTTCTGCGGGGCTTGCCTTCTGGCCATGC CCTTCTTCTCTCCCTTGCACCTGTACCTCTTGGTC TTTGAATAAAGCCTGAGTAGGAAGGCGGCCGCT CGAGCATGCATCTAGA | 9 |
| 3UTR-006 | G-CSF | GCCAAGCCCTCCCCATCCCATGTATTTATCTCTA TTTAATATTTATGTCTATTTAAGCCTCATATTTAA AGACAGGGAAGAGCAGAACGGAGCCCCAGGCC TCTGTGTCCTTCCCTGCATTTCTGAGTTTCATTCT CCTGCCTGTAGCAGTGAGAAAAAGCTCCTGTCCT CCCATCCCCTGGACTGGGAGGTAGATAGGTAAA TACCAAGTATTTATTACTATGACTGCTCCCCAGC CCTGGCTCTGCAATGGGCACTGGGATGAGCCGC TGTGAGCCCCTGGTCCTGAGGGTCCCCACCTGGG ACCCTTGAGAGTATCAGGTCTCCCACGTGGGAG ACAAGAAATCCCTGTTTAATATTTAAACAGCAGT GTTCCCCATCTGGGTCCTTGCACCCCTCACTCTG GCCTCAGCCGACTGCACAGCGGCCCCTGCATCC CCTTGGCTGTGAGGCCCCTGGACAAGCAGAGGT GGCCAGAGCTGGGAGGCATGGCCCTGGGGTCCC ACGAATTTGCTGGGGAATCTCGTTTTTCTTCTTA AGACTTTTGGGACATGGTTTGACTCCCGAACATC ACCGACGCGTCTCCTGTTTTTCTGGGTGGCCTCG | 10 |

TABLE 3-continued

3'-Untranslated Regions

| 3' UTR Identifier | Name/Description | Sequence | SEQ ID NO. |
|---|---|---|---|
| | | GGACACCTGCCCTGCCCCCACGAGGGTCAGGAC TGTGACTCTTTTTAGGGCCAGGCAGGTGCCTGGA CATTTGCCTTGCTGGACGGGGACTGGGGATGTG GGAGGGAGCAGACAGGAGGAATCATGTCAGGC CTGTGTGTGAAAGGAAGCTCCACTGTCACCCTCC ACCTCTTCACCCCCCACTCACCAGTGTCCCCTCC ACTGTCACATTGTAACTGAACTTCAGGATAATAA AGTGTTTGCCTCCATGGTCTTTGAATAAAGCCTG AGTAGGAAGGCGGCCGCTCGAGCATGCATCTAGA | |
| 3UTR-007 | Col1a2; collagen, type I, alpha 2 | ACTCAATCTAAATTAAAAAAGAAAGAAATTTGA AAAAACTTTCTCTTTGCCATTTCTTCTTCTTCTTT TTTAACTGAAAGCTGAATCCTTCCATTTCTTCTG CACATCTACTTGCTTAAATTGTGGGCAAAAGAG AAAAAGAAGGATTGATCAGAGCATTGTGCAATA CAGTTTCATTAACTCCTTCCCCCGCTCCCCCAAA AATTTGAATTTTTTTTCAACACTCTTACACCTGT TATGGAAAATGTCAACCTTTGTAAGAAAACCAA AATAAAAATTGAAAAATAAAAACCATAAACATT TGCACCACTTGTGGCTTTTGAATATCTTCCACAG AGGGAAGTTTAAAACCCAAACTTCCAAAGGTTT AAACTACCTCAAAACACTTTCCCATGAGTGTGAT CCACATTGTTAGGTGCTGACCTAGACAGAGATG AACTGAGGTCCTTGTTTTGTTTTGTTCATAATAC AAAGGTGCTAATTAATAGTATTTCAGATACTTGA AGAATGTTGATGGTGCTAGAAGAATTTGAGAAG AAATACTCCTGTATTGAGTTGTATCGTGTGGTGT ATTTTTTAAAAAATTTGATTTAGCATTCATATTTT CCATCTTATTCCCAATTAAAAGTATGCAGATTAT TTGCCCAAATCTTCTTCAGATTCAGCATTTGTTCT TTGCCAGTCTCATTTTCATCTTCTTCCATGGTTCC ACAGAAGCTTTGTTTCTTGGGCAAGCAGAAAAA TTAAATTGTACCTATTTTGTATATGTGAGATGTT TAAATAAATTGTGAAAAAAATGAAATAAAGCAT GTTTGGTTTTCCAAAAGAACATAT | 11 |
| 3UTR-008 | Col6a2; collagen, type VI, alpha 2 | CGCCGCCGCCCGGGCCCCGCAGTCGAGGGTCGT GAGCCCACCCCGTCCATGGTGCTAAGCGGGCCC GGGTCCCACACGGCCAGCACCGCTGCTCACTCG GACGACGCCCTGGGCCTGCACCTCTCCAGCTCCT CCCACGGGGTCCCCGTAGCCCCGGCCCCCGCCC AGCCCCAGGTCTCCCCAGGCCCTCCGCAGGCTG CCCGGCCTCCCTCCCCCTGCAGCCATCCCAAGGC TCCTGACCTACCTGGCCCCTGAGCTCTGGAGCAA GCCCTGACCCAATAAAGGCTTTGAACCCAT | 12 |
| 3UTR-009 | RPN1; ribophorin I | GGGGCTAGAGCCCTCTCCGCACAGCGTGGAGAC GGGGCAAGGAGGGGGGGTTATTAGGATTGGTGGT TTTGTTTTGCTTTGTTTAAAGCCGTGGGAAAATG GCACAACTTTACCTCTGTGGGAGATGCAACACT GAGAGCCAAGGGGTGGGAGTTGGGATAATTTTT ATATAAAAGAAGTTTTTCCACTTTGAATTGCTAA AAGTGGCATTTTTCCTATGTGCAGTCACTCCTCT CATTTCTAAAATAGGGACGTGGCCAGGCACGGT GGCTCATGCCTGTAATCCCAGCACTTTGGGAGGC CGAGGCAGGCGGCTCACGAGGTCAGGAGATCGA GACTATCCTGGCTAACACGGTAAAACCCTGTCTC TACTAAAAGTACAAAAAATTAGCTGGGCGTGGT GGTGGGCACCTGTAGTCCCAGCTACTCGGGAGG CTGAGGCAGGAGAAAGGCATGAATCCAAGAGG CAGAGCTTGCAGTGAGCTGAGATCACGCCATTG CACTCCAGCCTGGGCAACAGTGTTAAGACTCTGT CTCAAATATAAATAAATAAATAAATAAATAAAT AAATAAATAAAAATAAAGCGAGATGTTGCCCTC AAA | 13 |
| 3UTR-010 | LRP1; low density lipoprotein receptor-related protein 1 | GGCCCTGCCCCGTCGGACTGCCCCCAGAAAGCC TCCTGCCCCCTGCCAGTGAAGTCCTTCAGTGAGC CCCTCCCCAGCCAGCCCTTCCTGGCCCCGCCGG ATGTATAAATGTAAAAATGAAGGAATTACATTT TATATGTGAGCGAGCAAGCCGGCAAGCGAGCAC AGTATTATTTCTCCATCCCCTCCCTGCCTGCTCCT TGGCACCCCCATGCTGCCTTCAGGGAGACAGGC AGGGAGGGCTTGGGGCTGCACCTCCTACCCTCC | 14 |

TABLE 3-continued

3'-Untranslated Regions

| 3' UTR Identifier | Name/ Description | Sequence | SEQ ID NO. |
|---|---|---|---|
| | | CACCAGAACGCACCCCACTGGGAGAGCTGGTGG<br>TGCAGCCTTCCCCTCCCTGTATAAGACACTTTGC<br>CAAGGCTCTCCCCTCTCGCCCCATCCCTGCTTGC<br>CCGCTCCCACAGCTTCCTGAGGGCTAATTCTGGG<br>AAGGGAGAGTTCTTTGCTGCCCCTGTCTGGAAG<br>ACGTGGCTCTGGGTGAGGTAGGCGGGAAAGGAT<br>GGAGTGTTTTAGTTCTTGGGGGAGGCCACCCCA<br>AACCCCAGCCCCAACTCCAGGGGCACCTATGAG<br>ATGGCCATGCTCAACCCCCCTCCCAGACAGGCC<br>CTCCCTGTCTCCAGGGCCCCCACCGAGGTTCCCA<br>GGGCTGGAGACTTCCTCTGGTAAACATTCCTCCA<br>GCCTCCCCTCCCCTGGGGACGCCAAGGAGGTGG<br>GCCACACCCAGGAAGGGAAAGCGGGCAGCCCC<br>GTTTTGGGGACGTGAACGTTTTAATAATTTTTGC<br>TGAATTCCTTTACAACTAAATAACACAGATATTG<br>TTATAAATAAAATTGT | |
| 3UTR-011 | Nnt1; cardiotrophin- like cytokine factor 1 | ATATTAAGGATCAAGCTGTTAGCTAATAATGCC<br>ACCTCTGCAGTTTTGGGAACAGGCAAATAAAGT<br>ATCAGTATACATGGTGATGTACATCTGTAGCAA<br>AGCTCTTGGAGAAAATGAAGACTGAAGAAAGCA<br>AAGCAAAAACTGTATAGAGAGATTTTTCAAAAG<br>CAGTAATCCCTCAATTTTAAAAAAGGATTGAAA<br>ATTCTAAATGTCTTTCTGTGCATATTTTTTGTGTT<br>AGGAATCAAAAGTATTTTATAAAAGGAGAAAGA<br>ACAGCCTCATTTTAGATGTAGTCCTGTTGGATTT<br>TTTATGCCTCCTCAGTAACCAGAAATGTTTTAAA<br>AAACTAAGTGTTTAGGATTTCAAGACAACATTAT<br>ACATGGCTCTGAAATATCTGACACAATGTAAAC<br>ATTGCAGGCACCTGCATTTTATGTTTTTTTTTCA<br>ACAAATGTGACTAATTTGAAACTTTTATGAACTT<br>CTGAGCTGTCCCCTTGCAATTCAACCGCAGTTTG<br>AATTAATCATATCAAATCAGTTTTAATTTTTTAA<br>ATTGTACTTCAGAGTCTATATTTCAAGGGCACAT<br>TTTCTCACTACTATTTTAATACATTAAAGGACTA<br>AATAATCTTTCAGAGATGCTGGAAACAAATCAT<br>TTGCTTTATATGTTTCATTAGAATACCAATGAAA<br>CATACAACTTGAAAATTAGTAATAGTATTTTTGA<br>AGATCCCATTTCTAATTGGAGATCTCTTTAATTT<br>CGATCAACTTATAATGTGTAGTACTATATTAAGT<br>GCACTTGAGTGGAATTCAACATTTGACTAATAA<br>AATGAGTTCATCATGTTGGCAAGTGATGTGGCA<br>ATTATCTCTGGTGACAAAAGAGTAAAATCAAAT<br>ATTTCTGCCTGTTACAAATATCAAGGAAGACCTG<br>CTACTATGAAATAGATGACATTAATCTGTCTTCA<br>CTGTTTATAATACGGATGGATTTTTTTTCAAATC<br>AGTGTGTGTTTTGAGGTCTTATGTAATTGATGAC<br>ATTTGAGAGAAATGGTGGCTTTTTTTTAGCTACCT<br>CTTTGTTCATTTAAGCACCAGTAAAGATCATGTC<br>TTTTTATAGAAGTGTAGATTTTCTTTGTGACTTTG<br>CTATCGTGCCTAAAGCTCTAAATATAGGTGAATG<br>TGTGATGAATACTCAGATTATTTGTCTCTCTATA<br>TAATTAGTTTGGTACTAAGTTTCTCAAAAAATTA<br>TTAACACATGAAAGACAATCTCTAAACCAGAAA<br>AAGAAGTAGTACAAATTTGTTACTGTAATGCTC<br>GCGTTTAGTGAGTTTAAAACACACAGTATCTTTT<br>GGTTTTATAATCAGTTTCTATTTTGCTGTGCCTGA<br>GATTAAGATCTGTGTATGTGTGTGTGTGTGTGTG<br>TGCGTTTGTGTGTTAAAGCAGAAAAGACTTTTTT<br>AAAAGTTTTAAGTGATAAATGCAATTTGTTAATT<br>GATCTTAGATCACTAGTAAACTCAGGGCTGAATT<br>ATACCATGTATATTCTATTAGAAGAAAGTAAAC<br>ACCATCTTTATTCCTGCCCTTTTTCTTCTCTCAAA<br>GTAGTTGTAGTTATATCTAGAAAGAAGCAATTTT<br>GATTTCTTGAAAAGGTAGTTCCTGCACTCAGTTT<br>AAACTAAAAATAATCATACTTGGATTTTATTTAT<br>TTTTGTCATAGTAAAAATTTTAATTTATATATATT<br>TTTATTTAGTATTATCTTATTCTTTGCTATTTGCC<br>AATCCTTTGTCATCAATTGTGTTAAATGAATTGA<br>AAATTCATGCCCTGTTCATTTTATTTTACTTTATT<br>GGTTAGGATATTTAAAGGATTTTTGTATATATAA<br>TTTCTTAAATTAATATTCCAAAAGGTTAGTGGAC<br>TTAGATTATAAATTATGGCAAAAATCTAAAAAC<br>AACAAAAATGATTTTTATACATTCTATTTCATTA | 15 |

TABLE 3-continued

3'-Untranslated Regions

| 3' UTR Identifier | Name/ Description | Sequence | SEQ ID NO. |
|---|---|---|---|
| | | TTCCTCTTTTTCCAATAAGTCATACAATTGGTAG ATATGACTTATTTTATTTTTGTATTATTCACTATA TCTTTATGATATTTAAGTATAAATAATTAAAAAA ATTTATTGTACCTTATAGTCTGTCACCAAAAAAA AAAAATTATCTGTAGGTAGTGAAATGCTAATGTT GATTTGTCTTTAAGGGCTTGTTAACTATCCTTTAT TTTCTCATTTGTCTTAAATTAGGAGTTTGTGTTTA AATTACTCATCTAAGCAAAAAATGTATATAAAT CCCATTACTGGGTATATACCCAAAGGATTATAA ATCATGCTGCTATAAAGACACATGCACACGTAT GTTTATTGCAGCACTATTCACAATAGCAAAGACT TGGAACCAACCCAAATGTCCATCAATGATAGAC TTGATTAAGAAAATGTGCACATATACACCATGG AATACTATGCAGCCATAAAAAAGGATGAGTTCA TGTCCTTTGTAGGGACATGGATAAAGCTGGAAA CCATCATTCTGAGCAAACTATTGCAAGGACAGA AAACCAAACACTGCATGTTCTCACTCATAGGTG GGAATTGAACAATGAGAACACTTGGACACAAGG TGGGGAACACCACACACCAGGGCCTGTCATGGG GTGGGGGGAGTGGGGAGGGATAGCATTAGGAG ATATACCTAATGTAAATGATGAGTTAATGGGTG CAGCACACCAACATGGCACATGTATACATATGT AGCAAACCTGCACGTTGTGCACATGTACCCTAG AACTTAAAGTATAATTAAAAAAAAAAAGAAAAC AGAAGCTATTTATAAAGAAGTTATTTGCTGAAAT AAATGTGATCTTTCCCATTAAAAAAATAAAGAA ATTTTGGGGTAAAAAAACACAATATATTGTATTC TTGAAAAATTCTAAGAGAGTGGATGTGAAGTGT TCTCACCACAAAAGTGATAACTAATTGAGGTAA TGCACATATTAATTAGAAAGATTTTGTCATTCCA CAATGTATATATACTTAAAAATATGTTATACACA ATAAATACATACATTAAAAAATAAGTAAATGTA | |
| 3UTR-012 | Col6a1; collagen, type VI, alpha 1 | CCCACCCTGCACGCCGGCACCAAACCCTGTCCTC CCACCCCTCCCCACTCATCACTAAACAGAGTAA AATGTGATGCGAATTTTCCCGACCAACCTGATTC GCTAGATTTTTTTAAGGAAAAGCTTGGAAAGCC AGGACACAACGCTGCTGCCTGCTTTGTGCAGGG TCCTCCGGGGCTCAGCCCTGAGTTGGCATCACCT GCGCAGGGCCCTCTGGGGCTCAGCCCTGAGCTA GTGTCACCTGCACAGGGCCCTCTGAGGCTCAGC CCTGAGCTGGCGTCACCTGTGCAGGGCCCTCTGG GGCTCAGCCCTGAGCTGGCCTCACCTGGGTTCCC CACCCCGGGCTCTCCTGCCCTGCCCTCCTGCCCG CCCTCCCTCCTGCCTGCGCAGCTCCTTCCCTAGG CACCTCTGTGCTGCATCCCACCAGCCTGAGCAAG ACGCCCTCTCGGGGCCTGTGCCGCACTAGCCTCC CTCTCCTCTGTCCCCATAGCTGGTTTTTCCCACCA ATCCTCACCTAACAGTTACTTTACAATTAAACTC AAAGCAAGCTCTTCTCCTCAGCTTGGGGCAGCC ATTGGCCTCTGTCTCGTTTTGGGAAACCAAGGTC AGGAGGCCGTTGCAGACATAAATCTCGGCGACT CGGCCCCGTCTCCTGAGGGTCCTGCTGGTGACCG GCCTGGACCTTGGCCCTACAGCCCTGGAGGCCG CTGCTGACCAGCACTGACCCCGACCTCAGAGAG TACTCGCAGGGGCGCTGGCTGCACTCAAGACCC TCGAGATTAACGGTGCTAACCCCGTCTGCTCCTC CCTCCCGCAGAGACTGGGGCCTGGACTGGACAT GAGAGCCCCTTGGTGCCACAGAGGGCTGTGTCT TACTAGAAACAACGCAAACCTCTCCTTCCTCAGA ATAGTGATGTGTTCGACGTTTTATCAAAGGCCCC CTTTCTATGTTCATGTTAGTTTTGCTCCTTCTGTG TTTTTTTCTGAACCATATCCATGTTGCTGACTTTT CCAAATAAAGGTTTTCACTCCTCTC | 16 |
| 3UTR-013 | Calr; calreticulin | AGAGGCCTGCCTCCAGGGCTGGACTGAGGCCTG AGCGCTCCTGCCGCAGAGCTGGCCGCGCCAAAT AATGTCTCTGTGAGACTCGAGAACTTTCATTTTT TTCCAGGCTGGTTCGGATTTGGGGTGGATTTTGG TTTTGTTCCCCTCCTCCACTCTCCCCCACCCCCTC CCCGCCCTTTTTTTTTTTTTTTTTAAACTGGTAT TTTATCTTTGATTCTCCTTCAGCCCTCACCCCTGG TTCTCATCTTTCTTGATCAACATCTTTTCTTGCCT CTGTCCCCTTCTCTCATCTCTTAGCTCCCCTCCAA | 17 |

TABLE 3-continued

3'-Untranslated Regions

| 3' UTR Identifier | Name/ Description | Sequence | SEQ ID NO. |
|---|---|---|---|
| | | CCTGGGGGGCAGTGGTGTGGAGAAGCCACAGGC<br>CTGAGATTTCATCTGCTCTCCTTCCTGGAGCCCA<br>GAGGAGGGCAGCAGAAGGGGGTGGTGTCTCCAA<br>CCCCCCAGCACTGAGGAAGAACGGGGCTCTTCT<br>CATTTCACCCCTCCCTTTCTCCCCTGCCCCCAGG<br>ACTGGGCCACTTCTGGGTGGGGCAGTGGGTCCC<br>AGATTGGCTCACACTGAGAATGTAAGAACTACA<br>AACAAAATTTCTATTAAATTAAATTTTGTGTCTCC | |
| 3UTR-014 | Col1a1; collagen, type I, alpha 1 | CTCCCTCCATCCCAACCTGGCTCCCTCCCACCCA<br>ACCAACTTTCCCCCCAACCCGGAAACAGACAAG<br>CAACCCAAACTGAACCCCCTCAAAAGCCAAAAA<br>ATGGGAGACAATTTCACATGGACTTTGGAAAAT<br>ATTTTTTTCCTTTGCATTCATCTCTCAAACTTAGT<br>TTTTATCTTTGACCAACCGAACATGACCAAAAAC<br>CAAAAGTGCATTCAACCTTACCAAAAAAAAAA<br>AAAAAAAAGAATAAATAAATAACTTTTTAAAAA<br>AGGAAGCTTGGTCCACTTGCTTGAAGACCCATG<br>CGGGGGTAAGTCCCTTTCTGCCCGTTGGGCTTAT<br>GAAACCCCAATGCTGCCCTTTCTGCTCCTTTCTC<br>CACACCCCCCTTGGGGCCTCCCCTCCACTCCTTC<br>CCAAATCTGTCTCCCCAGAAGACACAGGAAACA<br>ATGTATTGTCTGCCCAGCAATCAAAGGCAATGCT<br>CAAACACCCAAGTGGCCCCCACCCTCAGCCCGC<br>TCCTGCCCGCCCAGCACCCCCAGGCCCTGGGGG<br>ACCTGGGGTTCTCAGACTGCCAAAGAAGCCTTG<br>CCATCTGGCGCTCCCATGGCTCTTGCAACATCTC<br>CCCTTCGTTTTTGAGGGGGTCATGCCGGGGGAGC<br>CACCAGCCCCTCACTGGGTTCGGAGGAGAGTCA<br>GGAAGGGCCACGACAAAGCAGAAACATCGGATT<br>TGGGGAACGCGTGTCAATCCCTTGTGCCGCAGG<br>GCTGGGCGGGAGAGACTGTTCTGTTCCTTGTGTA<br>ACTGTGTTGCTGAAAGACTACCTCGTTCTTGTCT<br>TGATGTGTCACCGGGGCAACTGCCTGGGGGCGG<br>GGATGGGGGCAGGGTGGAAGCGGCTCCCCATTT<br>TATACCAAAGGTGCTACATCTATGTGATGGGTG<br>GGGTGGGGAGGGAATCACTGGTGCTATAGAAAT<br>TGAGATGCCCCCCCAGGCCAGCAAATGTTCCTTT<br>TTGTTCAAAGTCTATTTTTATTCCTTGATATTTTT<br>CTTTTTTTTTTTTTTTTTGTGGATGGGGACTTG<br>TGAATTTTTCTAAAGGTGCTATTTAACATGGGAG<br>GAGAGCGTGTGCGGCTCCAGCCCAGCCCGCTGC<br>TCACTTTCCACCCTCTCTCCACCTGCCTCTGGCTT<br>CTCAGGCCTCTGCTCTCCGACCTCTCTCCTCTGA<br>AACCCTCCTCCACAGCTGCAGCCCATCCTCCCGG<br>CTCCCTCCTAGTCTGTCCTGCGTCCTCTGTCCCCG<br>GGTTTCAGAGACAACTTCCCAAAGCACAAAGCA<br>GTTTTTCCCCCTAGGGGTGGGAGGAAGCAAAAG<br>ACTCTGTACCTATTTTGTATGTGTATAATAATTT<br>GAGATGTTTTAATTATTTTGATTGCTGGAATAA<br>AGCATGTGGAAATGACCCAAACATAATCCGCAG<br>TGGCCTCCTAATTTCCTTCTTTGGAGTTGGGGGA<br>GGGGTAGACATGGGGAAGGGGCTTTGGGGTGAT<br>GGGCTTGCCTTCCATTCCTGCCCTTTCCCTCCCCA<br>CTATTCTCTTCTAGATCCCTCCATAACCCCACTC<br>CCCTTTCTCTCACCCTTCTTATACCGCAAACCTTT<br>CTACTTCCTCTTTCATTTTCTATTCTTGCAATTTC<br>CTTGCACCTTTTCCAAATCCTCTTCTCCCCTGCAA<br>TACCATACAGGCAATCCACGTGCACAACACACA<br>CACACACTCTTCACATCTGGGGTTGTCCAAACCT<br>CATACCCACTCCCCTTCAAGCCCATCCACTCTCC<br>ACCCCCTGGATGCCCTGCACTTGGTGGCGGTGG<br>GATGCTCATGGATACTGGGAGGGTGAGGGGAGT<br>GGAACCCGTGAGGAGGACCTGGGGGCCTCTCCT<br>TGAACTGACATGAAGGGTCATCTGGCCTCTGCTC<br>CCTTCTCACCCACGCTGACCTCCTGCCGAAGGAG<br>CAACGCAACAGGAGAGGGGTCTGCTGAGCCTGG<br>CGAGGGTCTGGGAGGGACCAGGAGGAAGGCGT<br>GCTCCCTGCTCGCTGTCCTGGCCCTGGGGGAGTG<br>AGGGAGACAGACACCTGGGAGAGCTGTGGGGA<br>AGGCACTCGCACCGTGCTCTTGGGAAGGAAGGA | 18 |

TABLE 3-continued

3'-Untranslated Regions

| 3' UTR Identifier | Name/ Description | Sequence | SEQ ID NO. |
|---|---|---|---|
| | | GACCTGGCCCTGCTCACCACGGACTGGGTGCCTC GACCTCCTGAATCCCCAGAACACAACCCCCCTG GGCTGGGGTGGTCTGGGGAACCATCGTGCCCCC GCCTCCCGCCTACTCCTTTTTAAGCTT | |
| 3UTR-015 | Plod1; procollagen-lysine, 2-oxoglutarate 5-dioxygenase 1 | TTGGCCAGGCCTGACCCTCTTGGACCTTTCTTCT TTGCCGACAACCACTGCCCAGCAGCCTCTGGGA CCTCGGGGTCCCAGGGAACCCAGTCCAGCCTCC TGGCTGTTGACTTCCCATTGCTCTTGGAGCCACC AATCAAAGAGATTCAAAGAGATTCCTGCAGGCC AGAGGCGGAACACACCTTTATGGCTGGGGCTCT CCGTGGTGTTCTGGACCCAGCCCCTGGAGACAC CATTCACTTTTACTGCTTTGTAGTGACTCGTGCTC TCCAACCTGTCTTCCTGAAAAACCAAGGCCCCCT TCCCCCACCTCTTCCATGGGGTGAGACTTGAGCA GAACAGGGGCTTCCCCAAGTTGCCCAGAAAGAC TGTCTGGGTGAGAAGCCATGGCCAGAGCTTCTC CCAGGCACAGGTGTTGCACCAGGGACTTCTGCTT CAAGTTTTGGGGTAAAGACACCTGGATCAGACT CCAAGGGCTGCCCTGAGTCTGGGACTTCTGCCTC CATGGCTGGTCATGAGAGCAAACCGTAGTCCCC TGGAGACAGCGACTCCAGAGAACCTCTTGGGAG ACAGAAGAGGCATCTGTGCACAGCTCGATCTTC TACTTGCCTGTGGGGAGGGGAGTGACAGGTCCA CACACCACACTGGGTCACCCTGTCCTGGATGCCT CTGAAGAGAGGGACAGACCGTCAGAAACTGGA GAGTTTCTATTAAAGGTCATTTAAACCA | 19 |
| 3UTR-016 | Nucb1; nucleobindin 1 | TCCTCCGGGACCCCAGCCCTCAGGATTCCTGATG CTCCAAGGCGACTGATGGGCGCTGGATGAAGTG GCACAGTCAGCTTCCCTGGGGGCTGGTGTCATGT TGGGCTCCTGGGGCGGGGGCACGGCCTGGCATT TCACGCATTGCTGCCACCCCAGGTCCACCTGTCT CCACTTTCACAGCCTCCAAGTCTGTGGCTCTTCC CTTCTGTCCTCCGAGGGGCTTGCCTTCTCTCGTG TCCAGTGAGGTGCTCAGTGATCGGCTTAACTTAG AGAAGCCCGCCCCCTCCCCTTCTCCGTCTGTCCC AAGAGGGTCTGCTCTGAGCCTGCGTTCCTAGGTG GCTCGGCCTCAGCTGCCTGGGTTGTGGCCGCCCT AGCATCCTGTATGCCCACAGCTACTGGAATCCCC GCTGCTGCTCCGGGCCAAGCTTCTGGTTGATTAA TGAGGGCATGGGGTGGTCCCTCAAGACCTTCCC CTACCTTTTGTGGAACCAGTGATGCCTCAAAGAC AGTGTCCCCTCCACAGCTGGGTGCCAGGGGCAG GGGATCCTCAGTATAGCCGGTGAACCCTGATAC CAGGAGCCTGGGCCTCCCTGAACCCTGGCTTCC AGCCATCTCATCGCCAGCCTCCTCCTGGACCTCT TGGCCCCCAGCCCCTTCCCCACACAGCCCCAGA AGGGTCCCAGAGCTGACCCCACTCCAGGACCTA GGCCCAGCCCCTCAGCCTCATCTGGAGCCCTGA AGACCAGTCCCACCCACCTTTCTGGCCTCATCTG ACACTGCTCCGCATCCTGCTGTGTGTCCTGTTCC ATGTTCCGGTTCCATCCAAATACACTTTCTGGAA CAAA | 20 |
| 3UTR-017 | α-globin | GCTGGAGCCTCGGTGGCCATGCTTCTTGCCCCTT GGGCCTCCCCCCAGCCCCTCCTCCCCTTCCTGCA CCCGTACCCCCGTGGTCTTTGAATAAAGTCTGAG TGGGCGGC | 21 |

It should be understood that those listed in the previous tables are examples and that any UTR from any gene may be incorporated into the respective first or second flanking region of the primary construct. Furthermore, multiple wild-type UTRs of any known gene may be utilized. It is also within the scope of the present invention to provide artificial UTRs which are not variants of wild type genes. These UTRs or portions thereof may be placed in the same orientation as in the transcript from which they were selected or may be altered in orientation or location. Hence a 5' or 3' UTR may be inverted, shortened, lengthened, made chimeric with one or more other 5' UTRs or 3' UTRs. As used herein, the term "altered" as it relates to a UTR sequence, means that the UTR has been changed in some way in relation to a reference sequence. For example, a 3' or 5' UTR may be altered relative to a wild type or native UTR by the change in orientation or location as taught above or may be altered by the inclusion of additional nucleotides, deletion of nucleotides, swapping or transposition of nucleotides. Any of these changes producing an "altered" UTR (whether 3' or 5') comprise a variant UTR.

In one embodiment, a double, triple or quadruple UTR such as a 5' or 3' UTR may be used. As used herein, a "double" UTR is one in which two copies of the same UTR are encoded either in series or substantially in series. For example, a double beta-globin 3' UTR may be used as described in US Patent publication 20100129877, the contents of which are incorporated herein by reference in its entirety.

It is also within the scope of the present invention to have patterned UTRs. As used herein "patterned UTRs" are those UTRs which reflect a repeating or alternating pattern, such as ABABAB or AABBAABBAABB or ABCABCABC or variants thereof repeated once, twice, or more than 3 times. In these patterns, each letter, A, B, or C represent a different UTR at the nucleotide level.

In one embodiment, flanking regions are selected from a family of transcripts whose proteins share a common function, structure, feature of property. For example, oncology-related polypeptides of interest may belong to a family of proteins which are expressed in a particular cell, tissue or at some time during development. The UTRs from any of these genes may be swapped for any other UTR of the same or different family of proteins to create a new chimeric primary transcript. As used herein, a "family of proteins" is used in the broadest sense to refer to a group of two or more oncology-related polypeptides of interest which share at least one function, structure, feature, localization, origin, or expression pattern.

After optimization (if desired), the signal-sensor primary construct components are reconstituted and transformed into a vector such as, but not limited to, plasmids, viruses, cosmids, and artificial chromosomes. For example, the optimized construct may be reconstituted and transformed into chemically competent *E. coli*, yeast, *Neurospora, maize, Drosophila*, etc. where high copy plasmid-like or chromosome structures occur by methods described herein.

Stop Codons

In one embodiment, the signal-sensor primary constructs of the present invention may include at least two stop codons before the 3' untranslated region (UTR). The stop codon may be selected from TGA, TAA and TAG. In one embodiment, the signal-sensor primary constructs of the present invention include the stop codon TGA and one additional stop codon. In a further embodiment the addition stop codon may be TAA.

Vector Amplification

The vector containing the signal-sensor primary construct is then amplified and the plasmid isolated and purified using methods known in the art such as, but not limited to, a maxi prep using the Invitrogen PURELINK™ HiPure Maxiprep Kit (Carlsbad, Calif.).

Plasmid Linearization

The plasmid may then be linearized using methods known in the art such as, but not limited to, the use of restriction enzymes and buffers. The linearization reaction may be purified using methods including, for example Invitrogen's PURELINK™ PCR Micro Kit (Carlsbad, Calif.), and HPLC based purification methods such as, but not limited to, strong anion exchange HPLC, weak anion exchange HPLC, reverse phase HPLC (RP-HPLC), and hydrophobic interaction HPLC (HIC-HPLC) and Invitrogen's standard PURELINK™ PCR Kit (Carlsbad, Calif.). The purification method may be modified depending on the size of the linearization reaction which was conducted. The linearized plasmid is then used to generate cDNA for in vitro transcription (IVT) reactions.

cDNA Template Synthesis

A cDNA template may be synthesized by having a linearized plasmid undergo polymerase chain reaction (PCR). Table 4 is a listing of primers and probes that may be useful in the PCR reactions of the present invention. It should be understood that the listing is not exhaustive and that primer-probe design for any amplification is within the skill of those in the art. Probes may also contain chemically modified bases to increase base-pairing fidelity to the target molecule and base-pairing strength. Such modifications may include 5-methyl-Cytidine, 2,6-di-amino-purine, 2'-fluoro, phosphoro-thiolate, or locked nucleic acids.

TABLE 4

Primers and Probes

| Primer/Probe Identifier | Sequence (5'-3') | Hybridization target | SEQ ID NO. |
|---|---|---|---|
| UFP | TTGGACCCTCGTACAGAAGCTAATACG | cDNA Template | 22 |
| URP | $T_{x160}$CTTCCTACTCAGGCTTTATTCAAAGACCA | cDNA Template | 23 |
| GBA1 | CCTTGACCTTCTGGAACTTC | Acid glucocerebrosidase | 24 |
| GBA2 | CCAAGCACTGAAACGGATAT | Acid glucocerebrosidase | 25 |
| LUC1 | GATGAAAAGTGCTCCAAGGA | Luciferase | 26 |
| LUC2 | AACCGTGATGAAAAGGTACC | Luciferase | 27 |
| LUC3 | TCATGCAGATTGGAAAGGTC | Luciferase | 28 |
| GCSF1 | CTTCTTGGACTGTCCAGAGG | G-CSF | 29 |

TABLE 4-continued

Primers and Probes

| Primer/<br>Probe<br>Identifier | Sequence (5'-3') | Hybridization<br>target | SEQ<br>ID<br>NO. |
|---|---|---|---|
| GCSF2 | GCAGTCCCTGATACAAGAAC | G-CSF | 30 |
| GCSF3 | GATTGAAGGTGGCTCGCTAC | G-CSF | 31 |

*UFP is universal forward primer; URP is universal reverse primer.

In one embodiment, the cDNA may be submitted for sequencing analysis before undergoing transcription.

Signal-Sensor Polynucleotide Production (Signal-Sensor mRNA)

The process of signal-sensor polynucleotide production may include, but is not limited to, in vitro transcription, cDNA template removal and RNA clean-up, and capping and/or tailing reactions.

In Vitro Transcription

The cDNA produced in the previous step may be transcribed using an in vitro transcription (IVT) system. The system typically comprises a transcription buffer, nucleotide triphosphates (NTPs), an RNase inhibitor and a polymerase. The NTPs may be manufactured in house, may be selected from a supplier, or may be synthesized as described herein. The NTPs may be selected from, but are not limited to, those described herein including natural and unnatural (modified) NTPs. The polymerase may be selected from, but is not limited to, T7 RNA polymerase, T3 RNA polymerase and mutant polymerases such as, but not limited to, polymerases able to be incorporated into modified nucleic acids.

RNA Polymerases

Any number of RNA polymerases or variants may be used in the design of the signal-sensor primary constructs of the present invention.

RNA polymerases may be modified by inserting or deleting amino acids of the RNA polymerase sequence. As a non-limiting example, the RNA polymerase may be modified to exhibit an increased ability to incorporate a 2'-modified nucleotide triphosphate compared to an unmodified RNA polymerase (see International Publication WO2008078180 and U.S. Pat. No. 8,101,385; herein incorporated by reference in their entireties).

Variants may be obtained by evolving an RNA polymerase, optimizing the RNA polymerase amino acid and/or nucleic acid sequence and/or by using other methods known in the art. As a non-limiting example, T7 RNA polymerase variants may be evolved using the continuous directed evolution system set out by Esvelt et al. (Nature (2011) 472(7344):499-503; herein incorporated by reference in its entirety) where clones of T7 RNA polymerase may encode at least one mutation such as, but not limited to, lysine at position 93 substituted for threonine (K93T), I4M, A7T, E63V, V64D, A65E, D66Y, T76N, C125R, S128R, A136T, N165S, G175R, H176L, Y178H, F182L, L196F, G198V, D208Y, E222K, S228A, Q239R, T243N, G259D, M267I, G280C, H300R, D351A, A354S, E356D, L360P, A383V, Y385C, D388Y, S397R, M401T, N410S, K450R, P451T, G452V, E484A, H523L, H524N, G542V, E565K, K577E, K577M, N601S, S684Y, L699I, K713E, N748D, Q754R, E775K, A827V, D851N or L864F. As another non-limiting example, T7 RNA polymerase variants may encode at least mutation as described in U.S. Pub. Nos. 20100120024 and 20070117112; herein incorporated by reference in their entireties. Variants of RNA polymerase may also include, but are not limited to, substitutional variants, conservative amino acid substitution, insertional variants, deletional variants and/or covalent derivatives.

In one embodiment, the signal-sensor primary construct may be designed to be recognized by the wild type or variant RNA polymerases. In doing so, the signal-sensor primary construct may be modified to contain sites or regions of sequence changes from the wild type or parent primary construct.

In one embodiment, the signal-sensor primary construct may be designed to include at least one substitution and/or insertion upstream of an RNA polymerase binding or recognition site, downstream of the RNA polymerase binding or recognition site, upstream of the TATA box sequence, downstream of the TATA box sequence of the signal-sensor primary construct but upstream of the coding region of the primary construct, within the 5'UTR, before the 5'UTR and/or after the 5'UTR.

In one embodiment, the 5'UTR of the signal-sensor primary construct may be replaced by the insertion of at least one region and/or string of nucleotides of the same base. The region and/or string of nucleotides may include, but is not limited to, at least 3, at least 4, at least 5, at least 6, at least 7 or at least 8 nucleotides and the nucleotides may be natural and/or unnatural. As a non-limiting example, the group of nucleotides may include 5-8 adenine, cytosine, thymine, a string of any of the other nucleotides disclosed herein and/or combinations thereof.

In one embodiment, the 5'UTR of the signal-sensor primary construct may be replaced by the insertion of at least two regions and/or strings of nucleotides of two different bases such as, but not limited to, adenine, cytosine, thymine, any of the other nucleotides disclosed herein and/or combinations thereof. For example, the 5'UTR may be replaced by inserting 5-8 adenine bases followed by the insertion of 5-8 cytosine bases. In another example, the 5'UTR may be replaced by inserting 5-8 cytosine bases followed by the insertion of 5-8 adenine bases.

In one embodiment, the signal-sensor primary construct may include at least one substitution and/or insertion downstream of the transcription start site which may be recognized by an RNA polymerase. As a non-limiting example, at least one substitution and/or insertion may occur downstream the transcription start site by substituting at least one nucleic acid in the region just downstream of the transcription start site (such as, but not limited to, +1 to +6). Changes to region of nucleotides just downstream of the transcription start site may affect initiation rates, increase apparent nucleotide triphosphate (NTP) reaction constant values, and increase the dissociation of short transcripts from the transcription complex curing initial transcription (Brieba et al, Biochemistry (2002) 41: 5144-5149; herein incorporated by reference in its entirety). The modification, substitution and/or insertion of at least one nucleic acid may cause a silent mutation of the nucleic acid sequence or may cause a mutation in the amino acid sequence.

In one embodiment, the signal-sensor primary construct may include the substitution of at least 1, at least 2, at least 3, at least 4, at least 5, at least 6, at least 7, at least 8, at least 9, at least 10, at least 11, at least 12 or at least 13 guanine bases downstream of the transcription start site.

In one embodiment, the signal-sensor primary construct may include the substitution of at least 1, at least 2, at least 3, at least 4, at least 5 or at least 6 guanine bases in the region just downstream of the transcription start site. As a non-limiting example, if the nucleotides in the region are GGGAGA the guanine bases may be substituted by at least 1, at least 2, at least 3 or at least 4 adenine nucleotides. In another non-limiting example, if the nucleotides in the region are GGGAGA the guanine bases may be substituted by at least 1, at least 2, at least 3 or at least 4 cytosine bases. In another non-limiting example, if the nucleotides in the region are GGGAGA the guanine bases may be substituted by at least 1, at least 2, at least 3 or at least 4 thymine, and/or any of the nucleotides described herein.

In one embodiment, the signal-sensor primary construct may include at least one substitution and/or insertion upstream of the start codon. For the purpose of clarity, one of skill in the art would appreciate that the start codon is the first codon of the protein coding region whereas the transcription start site is the site where transcription begins. The signal-sensor primary construct may include, but is not limited to, at least 1, at least 2, at least 3, at least 4, at least 5, at least 6, at least 7 or at least 8 substitutions and/or insertions of nucleotide bases. The nucleotide bases may be inserted or substituted at 1, at least 1, at least 2, at least 3, at least 4 or at least 5 locations upstream of the start codon. The nucleotides inserted and/or substituted may be the same base (e.g., all A or all C or all T or all G), two different bases (e.g., A and C, A and T, or C and T), three different bases (e.g., A, C and T or A, C and T) or at least four different bases. As a non-limiting example, the guanine base upstream of the coding region in the signal-sensor primary construct may be substituted with adenine, cytosine, thymine, or any of the nucleotides described herein. In another non-limiting example the substitution of guanine bases in the signal-sensor primary construct may be designed so as to leave one guanine base in the region downstream of the transcription start site and before the start codon (see Esvelt et al. Nature (2011) 472(7344):499-503; herein incorporated by reference in its entirety). As a non-limiting example, at least 5 nucleotides may be inserted at 1 location downstream of the transcription start site but upstream of the start codon and the at least 5 nucleotides may be the same base type.

cDNA Template Removal and Clean-Up

The cDNA template may be removed using methods known in the art such as, but not limited to, treatment with Deoxyribonuclease I (DNase I). RNA clean-up may also include a purification method such as, but not limited to, AGENCOURT® CLEANSEQ® system from Beckman Coulter (Danvers, Mass.), HPLC based purification methods such as, but not limited to, strong anion exchange HPLC, weak anion exchange HPLC, reverse phase HPLC (RP-HPLC), and hydrophobic interaction HPLC (HIC-HPLC).

Capping and/or Tailing Reactions

The signal-sensor primary construct or mmRNA may also undergo capping and/or tailing reactions. A capping reaction may be performed by methods known in the art to add a 5' cap to the 5' end of the signal-sensor primary construct. Methods for capping include, but are not limited to, using a Vaccinia Capping enzyme (New England Biolabs, Ipswich, Mass.).

A poly-A tailing reaction may be performed by methods known in the art, such as, but not limited to, 2' O-methyltransferase and by methods as described herein. If the signal-sensor primary construct generated from cDNA does not include a poly-T, it may be beneficial to perform the poly-A-tailing reaction before the signal-sensor primary construct is cleaned.

Purification

Signal-sensor primary construct or mmRNA purification may include, but is not limited to, mRNA or mmRNA clean-up, quality assurance and quality control. mRNA or mmRNA clean-up may be performed by methods known in the arts such as, but not limited to, AGENCOURT® beads (Beckman Coulter Genomics, Danvers, Mass.), poly-T beads, LNA™ oligo-T capture probes (EXIQON® Inc, Vedbaek, Denmark) or HPLC based purification methods such as, but not limited to, strong anion exchange HPLC, weak anion exchange HPLC, reverse phase HPLC (RP-HPLC), and hydrophobic interaction HPLC (HIC-HPLC). The term "purified" when used in relation to a polynucleotide such as a "purified mRNA or signal-sensor mmRNA" refers to one that is separated from at least one contaminant. As used herein, a "contaminant" is any substance which makes another unfit, impure or inferior. Thus, a purified signal-sensor polynucleotide (e.g., DNA and RNA) is present in a form or setting different from that in which it is found in nature, or a form or setting different from that which existed prior to subjecting it to a treatment or purification method.

A quality assurance and/or quality control check may be conducted using methods such as, but not limited to, gel electrophoresis, UV absorbance, or analytical HPLC.

In another embodiment, the signal-sensor mRNA or mmRNA may be sequenced by methods including, but not limited to reverse-transcriptase-PCR.

In one embodiment, the signal-sensor mRNA or mmRNA may be quantified using methods such as, but not limited to, ultraviolet visible spectroscopy (UV/Vis). A non-limiting example of a UV/Vis spectrometer is a NANODROP® spectrometer (ThermoFisher, Waltham, Mass.). The quantified signal-sensor mRNA or mmRNA may be analyzed in order to determine if the signal-sensor mRNA or mmRNA may be of proper size, check that no degradation of the signal-sensor mRNA or mmRNA has occurred. Degradation of the signal-sensor mRNA and/or mmRNA may be checked by methods such as, but not limited to, agarose gel electrophoresis, HPLC based purification methods such as, but not limited to, strong anion exchange HPLC, weak anion exchange HPLC, reverse phase HPLC (RP-HPLC), and hydrophobic interaction HPLC (HIC-HPLC), liquid chromatography-mass spectrometry (LCMS), capillary electrophoresis (CE) and capillary gel electrophoresis (CGE).

Signal Peptides or Proteins

The signal-sensor primary constructs or mmRNA may also encode additional features which facilitate trafficking of the polypeptides to therapeutically relevant sites. One such feature which aids in protein trafficking is the signal peptide sequence. As used herein, a "signal sequence" or "signal peptide" is a polynucleotide or polypeptide, respectively, which is from about 9 to 200 nucleotides (3-60 amino acids) in length which is incorporated at the 5' (or N-terminus) of the coding region or polypeptide encoded, respectively. Addition of these sequences result in trafficking of the encoded oncology-related polypeptide to the endoplasmic reticulum through one or more secretory pathways. Some signal peptides are cleaved from the protein by signal peptidase after the proteins are transported.

Table 5 is a representative listing of signal proteins or peptides which may be incorporated for encoding by the signal-sensor polynucleotides, primary constructs or mmRNA of the invention.

TABLE 5

Signal Peptides

| ID | Description | NUCLEOTIDE SEQUENCE (5'-3') | SEQ ID NO. | ENCODED PEPTIDE | SEQ ID NO. |
|---|---|---|---|---|---|
| SS-001 | α-1-antitrypsin | ATGATGCCATCCTCAGTCTCATGGGGTATTTTGCTCTTGGCGGGTCTGTGCTGTCTCGTGCCGGTGTCGCTCGCA | 32 | MMPSSVSWGILLAGLCCLVPVSLA | 94 |
| SS-002 | G-CSF | ATGGCCGGACCGGCGACTCAGTCGCCCATGAAACTCATGGCCCTGCAGTTGTTGCTTTGGCACTCAGCCCTCTGGACCGTCCAAGAGGCG | 33 | MAGPATQSPMKLMALQLLLWHSALWTVQEA | 95 |
| SS-003 | Factor IX | ATGCAGAGAGTGAACATGATTATGGCCGAGTCCCCATCGCTCATCACAATCTGCCTGCTTGGTACCTGCTTTCCGCCGAATGCACTGTCTTTCTGGATCACGAGAATGCGAATAAGATCTTGAACCGACCCAAACGG | 34 | MQRVNMIMAESPSLITICLLGYLLSAECTVFLDHENANKILNRPKR | 96 |
| SS-004 | Prolactin | ATGAAAGGATCATTGCTGTTGCTCCTCGTGTCGAACCTTCTGCTTTGCCAGTCCGTAGCCCCC | 35 | MKGSLLLLLVSNLLLCQSVAP | 97 |
| SS-005 | Albumin | ATGAAATGGGTGACGTTCATCTCACTGTTGTTTTTGTTCTCGTCCGCCTACTCCAGGGGAGTATTCCGCCGA | 36 | MKWVTFISLLFLFSSAYSRGVFRR | 98 |
| SS-006 | HMMSP38 | ATGTGGTGGCGGCTCTGGTGGCTGCTCCTGTTGCTCCTCTTGCTGTGGCCCATGGTGTGGGCA | 37 | MWWRLWWLLLLLLLPMWA | 99 |
| MLS-001 | ornithine carbamoyltransferase | TGCTCTTTAACCTCCGCATCCTGTTGAATAACGCTGCGTTCCGAAATGGGCATAACTTCATGGTACGCAACTTCAGATGCGGCCAGCCACTCCAG | 38 | MLFNLRILLNNAAFRNGHNFMVRNFRCGQPLQ | 100 |
| MLS-002 | Cytochrome C Oxidase subunit 8A | ATGTCCGTCTTGACACCCCTGCTCTTGAGAGGGCTGACGGGGTCCGCTAGACGCCTGCCGGTACCGCGAGCGAAGATCCACTCCCTG | 39 | MSVLTPLLLRGLTGSARRLPVPRAKIHSL | 101 |
| MLS-003 | Cytochrome C Oxidase subunit 8A | ATGAGCGTGCTCACTCCGTTGCTTCTTCGAGGGCTTACGGGATCGGCTCGGAGGTTGCCCGTCCCGAGAGCGAAGATCCATTCGTTG | 40 | MSVLTPLLLRGLTGSARRLPVPRAKIHSL | 102 |
| SS-007 | Type III, bacterial | TGACAAAAATAACTTTATCTCCCCAGAATTTTAGAATCCAAAAACAGGAAACCACACTACTAAAAGAAAAATCAACCGAGAAAAATTCTTTAGCAAAAAGTATTCTCGCAGTAAAAATCACTTCATCGAATTAAGGTCAAAATTATCGGAACGTTTTATTTCGCATAAGAACACT | 41 | MVTKITLSPQNFRIQKQETTLLKEKSTEKNSLAKSILAVKNHFIELRSKLSERFISHKNT | 103 |
| SS-008 | Viral | ATGCTGAGCTTTGTGGATACCCGCACCCTGCTGCTGCTGGCGGTGACCAGCTGCCTGGCGACCTGCCAG | 42 | MLSFVDTRTLLLLAVTSCLATCQ | 104 |
| SS-009 | viral | ATGGGCAGCAGCCAGGCGCCGCGCATGGGCAGCGTGGGCGGCCATGGCCTGATGGCGCTGC | 43 | MGSSQAPRMGSVGGHGLMALL | 105 |

TABLE 5-continued

Signal Peptides

| ID | Description | NUCLEOTIDE SEQUENCE (5'-3') | SEQ ID NO. | ENCODED PEPTIDE | SEQ ID NO. |
|---|---|---|---|---|---|
| | | TGATGGCGGGCCTGATTCTGC CGGGCATTCTGGCG | | MAGLILPG ILA | |
| SS-010 | Viral | ATGGCGGGCATTTTTTATTTTC TGTTTAGCTTTCTGTTTGGCAT TTGCGAT | 44 | MAGIFYFL FSFLFGICD | 106 |
| SS-011 | Viral | ATGGAAAACCGCCTGCTGCGC GTGTTTCTGGTGTGGGCGGCG CTGACCATGGATGGCGCGAGC GCG | 45 | MENRLLR VFLVWAA LTMDGASA | 107 |
| SS-012 | Viral | ATGGCGCGCCAGGGCTGCTTT GGCAGCTATCAGGTGATTAGC CTGTTTACCTTTGCGATTGGC GTGAACCTGTGCCTGGGC | 46 | MARQGCF GSYQVISL FTFAIGVN LCLG | 108 |
| SS-013 | Bacillus | ATGAGCCGCCTGCCGGTGCTG CTGCTGCTGCAGCTGCTGGTG CGCCCGGGCCTGCAG | 47 | MSRLPVLL LLQLLVRP GLQ | 109 |
| SS-014 | Bacillus | ATGAAACAGCAGAAACGCCT GTATGCGCGCCTGCTGACCCT GCTGTTTGCGCTGATTTTTCTG CTGCCGCATAGCAGCGCGAGC GCG | 48 | MKQQKRL YARLLTLL FALIFLLPH SSASA | 110 |
| SS-015 | Secretion signal | ATGGCGACGCCGCTGCCTCCG CCCTCCCCGCGGCACCTGCGG CTGCTGCGGCTGCTGCTCTCC GCCCTCGTCCTCGGC | 49 | MATPLPPP SPRHLRLL RLLLSG | 111 |
| SS-016 | Secretion signal | ATGAAGGCTCCGGGTCGGCTC GTGCTCATCATCCTGTGCTCC GTGGTCTTCTCT | 50 | MKAPGRL VLIILCSVV FS | 112 |
| SS-017 | Secretion signal | ATGCTTCAGCTTTGGAAACTT GTTCTCCTGTGCGGCGTGCTC ACT | 51 | MLQLWKL LCGVLT | 113 |
| SS-018 | Secretion signal | ATGCTTTATCTCCAGGGTTGG AGCATGCCTGCTGTGGCA | 52 | MLYLQGW SMPAVA | 114 |
| SS-019 | Secretion signal | ATGGATAACGTGCAGCCGAA AATAAAACATCGCCCCTTCTG CTTCAGTGTGAAAGGCCACGT GAAGATGCTGCGGCTGGATAT TATCAACTCACTGGTAACAAC AGTATTCATGCTCATCGTATC TGTGTTGGCACTGATACCA | 53 | MDNVQPK IKHRPFCF SVKGHVK MLRLDIIN SLVTTVFM LIVSVLALIP | 115 |
| SS-020 | Secretion signal | ATGCCCTGCCTAGACCAACAG CTCACTGTTCATGCCCTACCCT GCCCTGCCCAGCCCTCCTCTC TGGCCTTCTGCCAAGTGGGGT TCTTAACAGCA | 54 | MPCLDQQ LTVHALPC PAQPSSLA FCQVGFLTA | 116 |
| SS-021 | Secretion signal | ATGAAAACCTTGTTCAATCCA GCCCCTGCCATTGCTGACCTG GATCCCCAGTTCTACACCCTC TCAGATGTGTTCTGCTGCAAT GAAAGTGAGGCTGAGATTTTA ACTGGCCTCACGGTGGGCAGC GCTGCAGATGCT | 55 | MKTLFNP APAIADLD PQFYTLSD VFCCNESE AEILTGLT VGSAADA | 117 |
| SS-022 | Secretion signal | ATGAAGCCTCTCCTTGTTGTG TTTGTCTTTCTTTTCCTTTGGG ATCCAGTGCTGGCA | 56 | MKPLLVV FVFLFLWD PVLA | 118 |
| SS-023 | Secretion signal | ATGTCCTGTTCCCTAAAGTTT ACTTTGATTGTAATTTTTTTTT ACTGTTGGCTTTCATCCAGC | 57 | MSCSLKFT LIVIFFTCT LSSS | 119 |

TABLE 5-continued

Signal Peptides

| ID | Description | NUCLEOTIDE SEQUENCE (5'-3') | SEQ ID NO. | ENCODED PEPTIDE | SEQ ID NO. |
|---|---|---|---|---|---|
| SS-024 | Secretion signal | ATGGTTCTTACTAAACCTCTTC AAAGAAATGGCAGCATGATG AGCTTTGAAAATGTGAAAGAA AAGAGCAGAGAAGGAGGGCC CCATGCACACACACCCGAAGA AGAATTGTGTTTCGTGGTAAC ACACTACCCTCAGGTTCAGAC CACACTCAACCTGTTTTTCCAT ATATTCAAGGTCTTACTCAA CCACTTTCCCTTCTGTGGGGT | 58 | MVLTKPL QRNGSMM SFENVKEK SREGGPHA HTPEEELC FVVTHTPQ VQTTLNLF FHIFKVLT QPLSLLWG | 120 |
| SS-025 | Secretion signal | ATGGCCACCCCGCCATTCCGG CTGATAAGGAAGATGTTTTCC TTCAAGGTGAGCAGATGGATG GGCTTGCCTGCTTCCGGTCC CTGGCGGCATCC | 59 | MATPPFRL IRKMFSFK VSRWMGL ACFRSLAAS | 121 |
| SS-026 | Secretion signal | ATGAGCTTTTTCCAACTCCTG ATGAAAAGGAAGGAACTCAT TCCCTTGGTGGTGTTCATGAC TGTGGCGGCGGGTGGAGCCTC ATCT | 60 | MSFFQLL MKRKELIP LVVFMTV AAGGASS | 122 |
| SS-027 | Secretion signal | ATGGTCTCAGCTCTGCGGGGA GCACCCCTGATCAGGGTGCAC TCAAGCCCTGTTTCTTCTCCTT CTGTGAGTGGACCACGGAGGC TGGTGAGCTGCCTGTCATCCC AAAGCTCAGCTCTGAGC | 61 | MVSALRG APLIRVHS SPVSSPSV SGPAALVS CLSSQSSA LS | 123 |
| SS-028 | Secretion signal | ATGATGGGGTCCCCAGTGAGT CATCTGCTGGCCGGCTTCTGT GTGTGGGTCGTCTTGGGC | 62 | MMGSPVS HLLAGFC VWVVLG | 124 |
| SS-029 | Secretion signal | ATGGCAAGCATGGCTGCCGTG CTCACCTGGGCTCTGGCTCTT CTTTCAGCGTTTTCGGCCACC CAGGCA | 63 | MASMAAV LTWALAL LSAFSATQA | 125 |
| SS-030 | Secretion signal | ATGGTGCTCATGTGGACCAGT GGTGACGCCTTCAAGACGGCC TACTTCCTGCTGAAGGGTGCC CCTCTGCAGTTCTCCGTGTGC GGCCTGCTGCAGGTGCTGGTG GACCTGGCCATCCTGGGGCAG GCCTACGCC | 64 | MVLMWTS GDAFKTA YFLLKGAP LQFSVCGL LQVLVDL AILGQATA | 126 |
| SS-031 | Secretion signal | ATGGATTTTGTCGCTGGAGCC ATCGGAGGCGTCTGCGGTGTT GCTGTGGGCTACCCCCTGGAC ACGGTGAAGGTCAGGATCCA GACGGAGCCAAAGTACACAG GCATCTGGCACTGCGTCCGGG ATACGTATCACCGAGAGCGCG TGTGGG GCTTCTACCGGGGCCTCTCGC TGCCCGTGTGCACGGTGTCCC TGGTATCTTCC | 65 | MDFVAGA IGGVCGV AVGYPLD TVKVRIQT EPLYTGIW HCVRDTY HRERVWG FYRGLSLP VCTVSLVSS | 127 |
| SS-032 | Secretion signal | ATGGAGAAGCCCCTCTTCCCA TTAGTGCCTTTGCATTGGTTTG GCTTTGGCTACACAGCACTGG TTGTTTCTGGTGGATCGTTG GCTATGTAAAAACAGGCAGC GTGCCGTCCCTGGCTGCAGGG CTGCTCTTCGGCAGTCTAGCC | 66 | MEKPLFPL VPLHWFG FGYTALV VSGGIVGY VKTGSVPS LAAGLLFG SLA | 128 |
| SS-033 | Secretion signal | ATGGGTCTGCTCCTTCCCCTG GCACTCTGCATCCTAGTCCTG TGC | 67 | MGLLLPL ALCILVLC | 129 |

TABLE 5-continued

Signal Peptides

| ID | Description | NUCLEOTIDE SEQUENCE (5'-3') | SEQ ID NO. | ENCODED PEPTIDE | SEQ ID NO. |
|---|---|---|---|---|---|
| SS-034 | Secretion signal | ATGGGGATCCAGACGAGCCCC GTCCTGCTGGCCTCCCTGGGG GTGGGGCTGGTCACTCTGCTC GGCCTGGCTGTGGGC | 68 | MGIQTSPV LLASLGVG LVTLLGLA VG | 130 |
| SS-035 | Secretion signal | ATGTCGGACCTGCTACTACTG GGCCTGATTGGGGGCCTGACT CTCTTACTGCTGCTGACGCTG CTAGCCTTTGCC | 69 | MSDLLLL GLIGGLTL LLLLTLLA FA | 131 |
| SS-036 | Secretion signal | ATGGAGACTGTGGTGATTGTT GCCATAGGTGTGCTGGCCACC ATGTTTCTGGCTTCGTTTGCAG CCTTGGTGCTGGTTTGCAGGC AG | 70 | METVVIV AIGVLATI FLASFAAL VLVCRQ | 132 |
| SS-037 | Secretion signal | ATGCGCGGCTCTGTGGAGTGC ACCTGGGGTTGGGGGCACTGT GCCCCCAGCCCCCTGCTCCTT TGGACTCTACTTCTGTTTGCA GCCCCATTTGGCCTGCTGGGG | 71 | MAGSVEC TWGWGH CAPSPLLL WTLLLFA APFGLLG | 133 |
| SS-038 | Secretion signal | ATGATGCCGTCCCGTACCAAC CTGGCTACTGGAATCCCCAGT AGTAAAGTGAAATATTCAAGG CTCTCCAGCACAGACGATGGC TACATTGACCTTCAGTTTAAG AAAACCCCTCCTAAGATCCCT TATAAGGCCATCGCACTTGCC ACTGTGCTGTTTTTGATTGGC GCC | 72 | MMPSRTN LATGIPSS KVKYSRLS STDDGYID LQFKKTPP KIPYKAIA LATVLFLI GA | 134 |
| SS-039 | Secretion signal | ATGGCCCTGCCCCAGATGTGT GACGGGAGCCACTTGGCCTCC ACCCTCCGCTATTGCATGACA GTCAGCGGCACAGTGGTTCTG GTGGCCGGGACGCTCTGCTTC GCT | 73 | MALPQMC DGSHLAST LRYCMTV SGTVVLV AGTLCFA | 135 |
| SS-041 | Vrg-6 | TGAAAAAGTGGTTCGTTGCTG CCGGCATCGGCGCTGCCGGAC TCATGCTCTCCAGCGCCGCCA | 74 | MKKWFVA AGIGAGLL MLSSAA | 136 |
| SS-042 | PhoA | ATGAAACAGAGCACCATTGCG CTGGCGCTGCTGCCGCTGCTG TTTACCCCGGTGACCAAAGCG | 75 | MKQSTIAL ALLPLLFT PVTKA | 137 |
| SS-043 | OmpA | ATGAAAAAAACCGCGATTGC GATTGCGGTGGCGCTGGCGGG CTTTGCGACCGTGGCGCAGGCG | 76 | MKKTAIAI AVALAGF ATVAQA | 138 |
| SS-044 | STI | ATGAAAAAACTGATGCTGGCG ATTTTTTTTAGCGTGCTGAGCT TTCCGAGCTTTAGCCAGAGC | 77 | MKKLMLA IFFSVLSFP SFSQS | 139 |
| SS-045 | STII | ATGAAAAAAAACATTGCGTTT CTGCTGGCGAGCATGTTTGTG TTTAGCATTGCGACCAACGCG TATGCG | 78 | MKKNIAFL LASMFVFS IATNAYA | 140 |
| SS-046 | Amylase | ATGTTTGCGAAACGCTTTAAA ACCAGCCTGCTGCCGCTGTTT GCGGGCTTTCTGCTGCTGTTTC ATCTGGTGCTGGCGGGCCCGG CGGCGGCGAGC | 79 | MFAKRFK TSLLPLFA GFLLLFHL VLAGPAA AS | 141 |
| SS-047 | Alpha Factor | ATGCGCTTTCCAGCATTTTT ACCGCGGTGCTGTTTGCGGCG AGCAGCGCGCTGGCG | 80 | MRFPSIFT AVLFAASS ALA | 142 |
| SS-048 | Alpha Factor | ATGCGCTTTCCAGCATTTTT ACCACCGTGCTGTTTGCGGCG AGCAGCGCGCTGGCG | 81 | MRFPSIFT TVLFAASS ALA | 143 |

TABLE 5-continued

Signal Peptides

| ID | Description | NUCLEOTIDE SEQUENCE (5'-3') | SEQ ID NO. | ENCODED PEPTIDE | SEQ ID NO. |
|---|---|---|---|---|---|
| SS-049 | Alpha Factor | ATGCGCTTTCCGAGCATTTTT ACCAGCGTGCTGTTTGCGGCG AGCAGCGCGCTGGCG | 82 | MRFPSIFTS VLFAASSA LA | 144 |
| SS-050 | Alpha Factor | ATGCGCTTTCCGAGCATTTTT ACCCATGTGCTGTTTGCGGCG AGCAGCGCGCTGGCG | 83 | MRFPSIFT HVLFAASS ALA | 145 |
| SS-051 | Alpha Factor | ATGCGCTTTCCGAGCATTTTT ACCATTGTGCTGTTTGCGGCG AGCAGCGCGCTGGCG | 84 | MRFPSIFTI VLFAASSA LA | 146 |
| SS-052 | Alpha Factor | ATGCGCTTTCCGAGCATTTTT ACCTTTGTGCTGTTTGCGGCG AGCAGCGCGCTGGCG | 85 | MRFPSIFTF VLFAASSA LA | 147 |
| SS-053 | Alpha Factor | ATGCGCTTTCCGAGCATTTTT ACCGAAGTGCTGTTTGCGGCG AGCAGCGCGCTGGCG | 86 | MRFPSIFT EVLFAASS ALA | 148 |
| SS-054 | Alpha Factor | ATGCGCTTTCCGAGCATTTTT ACCGGCGTGCTGTTTGCGGCG AGCAGCGCGCTGGCG | 87 | MRFPSIFT GVLFAASS ALA | 149 |
| SS-055 | Endoglucanase V | ATGCGTTCCTCCCCCCTCCTCC GCTCCGCCGTTGTGGCCGCCC TGCCGGTGTTGGCCCTTGCC | 88 | MRSSPLLR SAVVAAL PVLALA | 150 |
| SS-056 | Secretion signal | ATGGGCGCGGCGGCCGTGCGC TGGCACTTGTGCGTGCTGCTG GCCCTGGGCACACGCGGGCG GCTG | 89 | MGAAAVR WHLCVLL ALGTRGRL | 151 |
| SS-057 | Fungal | ATGAGGAGCTCCCTTGTGCTG TTCTTTGTCTCTGCGTGGACG GCCTTGGCCAG | 90 | MRSSLVLF FVSAWTA LA | 152 |
| SS-058 | Fibronectin | ATGCTCAGGGGTCCGGGACCC GGGCGGCTGCTGCTGCTAGCA GTCCTGTGCCTGGGGACATCG GTGCGCTGCACCGAAACCGGG AAGAGCAAGAGG | 91 | MLRGPGP GRLLLLAV LCLGTSVR CTETGKSKR | 153 |
| SS-059 | Fibronectin | ATGCTTAGGGGTCCGGGGCCC GGGCTGCTGCTGCTGGCCGTC CAGCTGGGGACAGCGGTGCCC TCCACG | 92 | MLRGPGP GLLLLAV QCLGTAV PSTGA | 154 |
| SS-060 | Fibronectin | ATGCGCCGGGGGCCCTGACC GGGCTGCTCCTGGTCCTGTGC CTGAGTGTTGTGCTACGTGCA GCCCCCTCTGCAACAAGCAAG AAGCGCAGG | 93 | MRRGALT GLLLVLCL SVVLRAAP SATSKKRR | 155 |

In the table, SS is secretion signal and MLS is mitochondrial leader signal. The signal-sensor primary constructs or mmRNA of the present invention may be designed to encode any of the signal peptide sequences of SEQ ID NOs 94-155, or fragments or variants thereof. These sequences may be included at the beginning of the oncology-related polypeptide coding region, in the middle or at the terminus or alternatively into a flanking region. Further, any of the signal-sensor polynucleotide primary constructs of the present invention may also comprise one or more of the sequences defined by SEQ ID NOs 32-93. These may be in the first region or either flanking region.

Additional signal peptide sequences which may be utilized in the present invention include those taught in, for example, databases such as those found at http://www.signalpeptide.de/ or http://proline.bic.nus.edu.sg/spdb/. Those described in U.S. Pat. Nos. 8,124,379; 7,413,875 and 7,385,034 are also within the scope of the invention and the contents of each are incorporated herein by reference in their entirety.

In one embodiment, the signal-sensor polynucleotide, primary constructs or mmRNA may include a nucleic acid sequence encoding a nuclear localization signal (NLS) and/or a nuclear export signal (NES). In one aspect, a signal-sensor polynucleotide, primary constructs or mmRNA may include a nucleic acid sequence encoding a nuclear localization signal (NLS). The signal-sensor polynucleotide, primary construct or mmRNA encoding a NLS would be able to traffic an oncology related polypeptide into the nucleus and deliver a survival or death signal to the nuclear microenvironment. In another aspect, the signal-sensor polynucleotide, primary constructs or mmRNA may include a nucleic acid sequence encoding a nuclear export signal such as NES1 and/or NES2. As a nonlimiting example, the signal-sensor polynucleotide, primary constructs or mmRNA may encode a NES1, NES2 and a NLS signal and an oncology related polypeptide or a scrambled sequence which is not translatable in order to interact with HIF1-alpha to alter the transcriptome of the cancer cells.

Target Selection

According to the present invention, the signal-sensor primary constructs comprise at least a first region of linked nucleosides encoding at least one oncology-related polypeptide of interest. The oncology-related polypeptides of interest or "targets" or oncology-related proteins and oncology-related peptides of the present invention are listed in Table 6, Table 7 and Table 41. Oncology-related polypeptides may be divided into classes based on their function and area of cancer intervention. For example, the classes may include targets associated with (1) apoptosis or Survival signal imbalance (AS targets). These may be caspase dependent or caspase independent targets; (2) replicative potential or anti-senescence (CC/S targets); (3) metabolic stress including the involvement of acidosis or hypoxia ($O_2 > 1\%$) (M targets); (4) immune response (I targets); and (5) DNA damage/protection (DDR targets).

Shown in Table 6, in addition to the name and description of the gene encoding the oncology-related polypeptide of interest are the ENSEMBL Transcript ID (ENST), the ENSEMBL Protein ID (ENSP), each present where applicable, and when available the optimized sequence ID (OPT. SEQ ID). The targets are also categorized by group where "AS" refers to targets involved in apoptotic signaling; "M" refers to targets involved in metabolic processes and "CC/S" refers to targets involved in cell cycle and senscense.

TABLE 6

Oncology Related Targets

| Cat. | Target | Target Description | ENST ID | Trans. SEQ ID NO | ENSP ID | Prot. SEQ ID NO | OPT. SEQ ID NO |
|---|---|---|---|---|---|---|---|
| AS | 14-3-3 | tyrosine 3-monooxygenase/tryptophan 5-monooxygenase activation protein, theta polypeptide | 238081 | 156 | 238081 | 1321 | |
| AS | 14-3-3 | tyrosine 3-monooxygenase/tryptophan 5-monooxygenase activation protein, eta polypeptide | 248975 | 157 | 248975 | 1322 | |
| AS | 14-3-3 | tyrosine 3-monooxygenase/tryptophan 5-monooxygenase activation protein, epsilon polypeptide | 264335 | 158 | 264335 | 1323 | |
| AS | 14-3-3 | tyrosine 3-monooxygenase/tryptophan 5-monooxygenase activation protein, gamma polypeptide | 307630 | 159 | 306330 | 1324 | |
| AS | 14-3-3 | tyrosine 3-monooxygenase/tryptophan 5-monooxygenase activation protein, zeta polypeptide | 353245 | 160 | 309503 | 1325 | |
| AS | 14-3-3 | tyrosine 3-monooxygenase/tryptophan 5-monooxygenase activation protein, beta polypeptide | 353703 | 161 | 300161 | 1326 | |
| AS | 14-3-3 | tyrosine 3-monooxygenase/tryptophan 5-monooxygenase activation protein, beta polypeptide | 372839 | 162 | 361930 | 1327 | |
| AS | 14-3-3 | tyrosine 3-monooxygenase/tryptophan 5-monooxygenase activation protein, theta polypeptide | 381844 | 163 | 371267 | 1328 | |
| AS | 14-3-3 | tyrosine 3-monooxygenase/tryptophan 5-monooxygenase activation protein, zeta polypeptide | 395948 | 164 | 379278 | 1329 | |
| AS | 14-3-3 | tyrosine 3-monooxygenase/tryptophan 5-monooxygenase activation protein, zeta polypeptide | 395951 | 165 | 379281 | 1330 | |
| AS | 14-3-3 | tyrosine 3-monooxygenase/tryptophan 5-monooxygenase activation protein, zeta polypeptide | 395953 | 166 | 379283 | 1331 | |
| AS | 14-3-3 | tyrosine 3-monooxygenase/tryptophan 5-monooxygenase activation protein, zeta polypeptide | 395956 | 167 | 379286 | 1332 | |

TABLE 6-continued

Oncology Related Targets

| Cat. | Target | Target Description | ENST ID | Trans. SEQ ID NO | ENSP ID | Prot. SEQ ID NO | OPT. SEQ ID NO |
|---|---|---|---|---|---|---|---|
| AS | 14-3-3 | tyrosine 3-monooxygenase/tryptophan 5-monooxygenase activation protein, zeta polypeptide | 395957 | 168 | 379287 | 1333 | |
| AS | 14-3-3 | tyrosine 3-monooxygenase/tryptophan 5-monooxygenase activation protein, zeta polypeptide | 395958 | 169 | 379288 | 1334 | |
| AS | 14-3-3 | tyrosine 3-monooxygenase/tryptophan 5-monooxygenase activation protein, epsilon polypeptide | 414131 | 170 | 406058 | 1335 | |
| AS | 14-3-3 | tyrosine 3-monooxygenase/tryptophan 5-monooxygenase activation protein, zeta polypeptide | 418997 | 171 | 416551 | 1336 | |
| AS | 14-3-3 | tyrosine 3-monooxygenase/tryptophan 5-monooxygenase activation protein, zeta polypeptide | 419477 | 172 | 395114 | 1337 | |
| AS | 14-3-3 | tyrosine 3-monooxygenase/tryptophan 5-monooxygenase activation protein, beta polypeptide | 428262 | 173 | 394729 | 1338 | |
| AS | 14-3-3 | tyrosine 3-monooxygenase/tryptophan 5-monooxygenase activation protein, zeta polypeptide | 437293 | 174 | 394880 | 1339 | |
| AS | 14-3-3 | tyrosine 3-monooxygenase/tryptophan 5-monooxygenase activation protein, beta polypeptide | 445830 | 175 | 394558 | 1340 | |
| AS | 14-3-3 | tyrosine 3-monooxygenase/tryptophan 5-monooxygenase activation protein, theta polypeptide | 446619 | 176 | 398990 | 1341 | |
| AS | 14-3-3 | tyrosine 3-monooxygenase/tryptophan 5-monooxygenase activation protein, gamma polypeptide | 453207 | 177 | 390645 | 1342 | |
| AS | 14-3-3 | tyrosine 3-monooxygenase/tryptophan 5-monooxygenase activation protein, zeta polypeptide | 457309 | 178 | 398599 | 1343 | |
| AS | 14-3-3 | tyrosine 3-monooxygenase/tryptophan 5-monooxygenase activation protein, zeta polypeptide | 517797 | 179 | 427801 | 1344 | |
| AS | 14-3-3 | tyrosine 3-monooxygenase/tryptophan 5-monooxygenase activation protein, zeta polypeptide | 521309 | 180 | 429623 | 1345 | |
| AS | 14-3-3 | tyrosine 3-monooxygenase/tryptophan 5-monooxygenase activation protein, zeta polypeptide | 521328 | 181 | 429041 | 1346 | |
| AS | 14-3-3 | tyrosine 3-monooxygenase/tryptophan 5-monooxygenase activation protein, zeta polypeptide | 521607 | 182 | 430058 | 1347 | |
| AS | 14-3-3 | tyrosine 3-monooxygenase/tryptophan 5-monooxygenase activation protein, zeta polypeptide | 522542 | 183 | 430072 | 1348 | |
| AS | 14-3-3 | tyrosine 3-monooxygenase/tryptophan 5-monooxygenase activation protein, zeta polypeptide | 522819 | 184 | 428775 | 1349 | |

TABLE 6-continued

Oncology Related Targets

| Cat. | Target | Target Description | ENST ID | Trans. SEQ ID NO | ENSP ID | Prot. SEQ ID NO | OPT. SEQ ID NO |
|---|---|---|---|---|---|---|---|
| AS | 14-3-3 | tyrosine 3-monooxygenase/tryptophan 5-monooxygenase activation protein, zeta polypeptide | 523131 | 185 | 428381 | 1350 | |
| AS | 14-3-3 | tyrosine 3-monooxygenase/tryptophan 5-monooxygenase activation protein, zeta polypeptide | 523848 | 186 | 428860 | 1351 | |
| AS | 14-3-3 | tyrosine 3-monooxygenase/tryptophan 5-monooxygenase activation protein, gamma polypeptide | 536755 | 187 | 443803 | 1352 | |
| AS | 14-3-3 | tyrosine 3-monooxygenase/tryptophan 5-monooxygenase activation protein, theta polypeptide | 539979 | 188 | 443226 | 1353 | |
| AS | AIF | apoptosis-inducing factor, mitochondrion-associated, 1 | 287295 | 189 | 287295 | 1354 | |
| AS | AIF | apoptosis-inducing factor, mitochondrion-associated, 2 | 307864 | 190 | 312370 | 1355 | |
| AS | AIF | apoptosis-inducing factor, mitochondrion-associated, 1 | 319908 | 191 | 315122 | 1356 | |
| AS | AIF | apoptosis-inducing factor, mitochondrion-associated, 3 | 333607 | 192 | 327671 | 1357 | |
| AS | AIF | apoptosis-inducing factor, mitochondrion-associated, 3 | 335375 | 193 | 335369 | 1358 | |
| AS | AIF | apoptosis-inducing factor, mitochondrion-associated, 1 | 346424 | 194 | 316320 | 1359 | |
| AS | AIF | apoptosis-inducing factor, mitochondrion-associated, 2 | 373248 | 195 | 362345 | 1360 | |
| AS | AIF | apoptosis-inducing factor, mitochondrion-associated, 2 | 395039 | 196 | 378480 | 1361 | |
| AS | AIF | apoptosis-inducing factor, mitochondrion-associated, 3 | 399163 | 197 | 382116 | 1362 | |
| AS | AIF | apoptosis-inducing factor, mitochondrion-associated, 3 | 399167 | 198 | 382120 | 1363 | |
| AS | AIF | apoptosis-inducing factor, mitochondrion-associated, 3 | 405089 | 199 | 385800 | 1364 | |
| AS | AIF | apoptosis-inducing factor, mitochondrion-associated, 3 | 434714 | 200 | 399657 | 1365 | |
| AS | AIF | apoptosis-inducing factor, mitochondrion-associated, 3 | 440238 | 201 | 390798 | 1366 | |
| AS | AIF | apoptosis-inducing factor, mitochondrion-associated, 1 | 440263 | 202 | 405879 | 1367 | |
| AS | AIF | apoptosis-inducing factor, mitochondrion-associated, 3 | 441376 | 203 | 402067 | 1368 | |
| AS | AIF | apoptosis-inducing factor, mitochondrion-associated, 1 | 460436 | 204 | 431222 | 1369 | |
| AS | AIF | apoptosis-inducing factor, mitochondrion-associated, 1 | 535724 | 205 | 446113 | 1370 | |
| AS | AKT (PKB) | v-akt murine thymoma viral oncogene homolog 3 (protein kinase B, gamma) | 263826 | 206 | 263826 | 1371 | |
| AS | AKT (PKB) | v-akt murine thymoma viral oncogene homolog 2 | 311278 | 207 | 309428 | 1372 | |
| AS | AKT (PKB) | v-akt murine thymoma viral oncogene homolog 3 (protein kinase B, gamma) | 336199 | 208 | 336943 | 1373 | |
| AS | AKT (PKB) | v-akt murine thymoma viral oncogene homolog 1 | 349310 | 209 | 270202 | 1374 | |
| AS | AKT (PKB) | v-akt murine thymoma viral oncogene homolog 2 | 358335 | 210 | 351095 | 1375 | |
| AS | AKT (PKB) | v-akt murine thymoma viral oncogene homolog 3 (protein kinase B, gamma) | 366539 | 211 | 355497 | 1376 | |
| AS | AKT (PKB) | v-akt murine thymoma viral oncogene homolog 3 (protein kinase B, gamma) | 366540 | 212 | 355498 | 1377 | |
| AS | AKT (PKB) | v-akt murine thymoma viral oncogene homolog 2 | 391844 | 213 | 375719 | 1378 | |
| AS | AKT (PKB) | v-akt murine thymoma viral oncogene homolog 2 | 392037 | 214 | 375891 | 1379 | |

TABLE 6-continued

Oncology Related Targets

| Cat. | Target | Target Description | ENST ID | Trans. SEQ ID NO | ENSP ID | Prot. SEQ ID NO | OPT. SEQ ID NO |
|---|---|---|---|---|---|---|---|
| AS | AKT (PKB) | v-akt murine thymoma viral oncogene homolog 2 | 392038 | 215 | 375892 | 1380 | |
| AS | AKT (PKB) | v-akt murine thymoma viral oncogene homolog 1 | 402615 | 216 | 385326 | 1381 | |
| AS | AKT (PKB) | v-akt murine thymoma viral oncogene homolog 1 | 407796 | 217 | 384293 | 1382 | |
| AS | AKT (PKB) | v-akt murine thymoma viral oncogene homolog 2 | 416362 | 218 | 407999 | 1383 | |
| AS | AKT (PKB) | v-akt murine thymoma viral oncogene homolog 2 | 416994 | 219 | 392458 | 1384 | |
| AS | AKT (PKB) | v-akt murine thymoma viral oncogene homolog 2 | 423127 | 220 | 403842 | 1385 | |
| AS | AKT (PKB) | v-akt murine thymoma viral oncogene homolog 2 | 424901 | 221 | 399532 | 1386 | |
| AS | AKT (PKB) | v-akt murine thymoma viral oncogene homolog 2 | 427375 | 222 | 403890 | 1387 | |
| AS | AKT (PKB) | v-akt murine thymoma viral oncogene homolog 2 | 452077 | 223 | 404083 | 1388 | |
| AS | AKT (PKB) | v-akt murine thymoma viral oncogene homolog 2 | 456441 | 224 | 396532 | 1389 | |
| AS | AKT (PKB) | v-akt murine thymoma viral oncogene homolog 2 | 537834 | 225 | 441591 | 1390 | |
| AS | AKT (PKB) | v-akt murine thymoma viral oncogene homolog 1 | 544168 | 226 | 443897 | 1391 | |
| AS | AKT (PKB) | v-akt murine thymoma viral oncogene homolog 3 (protein kinase B, gamma) | 552631 | 227 | 447820 | 1392 | |
| AS | AKT (PKB) | v-akt murine thymoma viral oncogene homolog 1 | 554581 | 228 | 451828 | 1393 | |
| AS | AKT (PKB) | v-akt murine thymoma viral oncogene homolog 1 | 554848 | 229 | 451166 | 1394 | |
| AS | AKT (PKB) | v-akt murine thymoma viral oncogene homolog 1 | 555528 | 230 | 450688 | 1395 | |
| AS | AKT (PKB) | v-akt murine thymoma viral oncogene homolog 1 | 555926 | 231 | 451824 | 1396 | |
| AS | ANT | solute carrier family 25 (mitochondrial carrier; adenine nucleotide translocator), member 4 | 281456 | 232 | 281456 | 1397 | |
| AS | Apaf-1 | apoptotic peptidase activating factor 1 | 333991 | 233 | 334558 | 1398 | |
| AS | Apaf-1 | apoptotic peptidase activating factor 1 | 339433 | 234 | 341830 | 1399 | |
| AS | Apaf-1 | apoptotic peptidase activating factor 1 | 357310 | 235 | 349862 | 1400 | |
| AS | Apaf-1 | apoptotic peptidase activating factor 1 | 359972 | 236 | 353059 | 1401 | |
| AS | Apaf-1 | apoptotic peptidase activating factor 1 | 547045 | 237 | 449791 | 1402 | |
| AS | Apaf-1 | apoptotic peptidase activating factor 1 | 549007 | 238 | 448161 | 1403 | |
| AS | Apaf-1 | apoptotic peptidase activating factor 1 | 550527 | 239 | 448449 | 1404 | |
| AS | Apaf-1 | apoptotic peptidase activating factor 1 | 551964 | 240 | 448165 | 1405 | |
| AS | Apaf-1 | apoptotic peptidase activating factor 1 | 552268 | 241 | 448826 | 1406 | |
| AS | APRIL (TNFSF13) | tumor necrosis factor (ligand) superfamily, member 13 | 338784 | 242 | 343505 | 1407 | |
| AS | APRIL (TNFSF13) | tumor necrosis factor (ligand) superfamily, member 13 | 349228 | 243 | 314455 | 1408 | |
| AS | APRIL (TNFSF13) | tumor necrosis factor (ligand) superfamily, member 13 | 380535 | 244 | 369908 | 1409 | |
| AS | APRIL (TNFSF13) | tumor necrosis factor (ligand) superfamily, member 13 | 396545 | 245 | 379794 | 1410 | |
| AS | ARTS | phosphoribosyl pyrophosphate synthetase 1 | 372418 | 246 | 361495 | 1411 | |
| AS | ARTS | phosphoribosyl pyrophosphate synthetase 1 | 372419 | 247 | 361496 | 1412 | |
| AS | ARTS | phosphoribosyl pyrophosphate synthetase 1 | 372428 | 248 | 361505 | 1413 | |
| AS | ARTS | phosphoribosyl pyrophosphate synthetase 1 | 372435 | 249 | 361512 | 1414 | |

TABLE 6-continued

Oncology Related Targets

| Cat. | Target | Target Description | ENST ID | Trans. SEQ ID NO | ENSP ID | Prot. SEQ ID NO | OPT. SEQ ID NO |
|---|---|---|---|---|---|---|---|
| AS | ARTS | phosphoribosyl pyrophosphate synthetase 1 | 543248 | 250 | 443185 | 1415 | |
| AS | ASK1 (MAP3K5) | mitogen-activated protein kinase kinase kinase 5 | 355845 | 251 | 348104 | 1416 | |
| AS | ASK1 (MAP3K5) | mitogen-activated protein kinase kinase kinase 5 | 359015 | 252 | 351908 | 1417 | |
| AS | ASK1 (MAP3K5) | mitogen-activated protein kinase kinase kinase 5 | 367768 | 253 | 356742 | 1418 | |
| AS | BAD | BCL2-associated agonist of cell death | 309032 | 254 | 309103 | 1419 | |
| AS | BAD | BCL2-associated agonist of cell death | 394532 | 255 | 378040 | 1420 | |
| AS | BAD | BCL2-associated agonist of cell death | 540152 | 256 | 440807 | 1421 | |
| AS | BAFF(TNFSF13B) | tumor necrosis factor (ligand) superfamily, member 13b | 375887 | 257 | 365048 | 1422 | |
| AS | BAFF(TNFSF13B) | tumor necrosis factor (ligand) superfamily, member 13b | 430559 | 258 | 389540 | 1423 | |
| AS | BAFF(TNFSF13B) | tumor necrosis factor (ligand) superfamily, member 13b | 542136 | 259 | 445334 | 1424 | |
| AS | Bak | BCL2-antagonist/killer 1 | 360661 | 260 | 353878 | 1425 | |
| AS | Bak | BCL2-antagonist/killer 1 | 374460 | 261 | 363584 | 1426 | |
| AS | Bak | BCL2-antagonist/killer 1 | 374467 | 262 | 363591 | 1427 | |
| AS | Bak | BCL2-antagonist/killer 1 | 442998 | 263 | 391258 | 1428 | |
| AS | BAX | BCL2-associated X protein | 293288 | 264 | 293288 | 1429 | |
| AS | BAX | BCL2-associated X protein | 345358 | 265 | 263262 | 1430 | |
| AS | BAX | BCL2-associated X protein | 354470 | 266 | 346461 | 1431 | |
| AS | BAX | BCL2-associated X protein | 391871 | 267 | 375744 | 1432 | |
| AS | BAX | BCL2-associated X protein | 415969 | 268 | 389971 | 1433 | |
| AS | BAX | BCL2-associated X protein | 539787 | 269 | 441413 | 1434 | |
| AS | Bcl-2 | B-cell CLL/lymphoma 2 | 333681 | 270 | 329623 | 1435 | |
| AS | Bcl-2 | B-cell CLL/lymphoma 2 | 398117 | 271 | 381185 | 1436 | |
| AS | Bcl-2 | B-cell CLL/lymphoma 2 | 444484 | 272 | 404214 | 1437 | |
| AS | Bcl-B | BCL2-like 10 (apoptosis facilitator) | 260442 | 273 | 260442 | 1438 | |
| AS | Bcl-W | BCL2-like 2 | 250405 | 274 | 250405 | 1439 | |
| AS | Bcl-W | BCL2-like 2 | 554635 | 275 | 451234 | 1440 | |
| AS | Bcl-W | BCL2-like 2 | 557236 | 276 | 451701 | 1441 | |
| AS | Bcl-W | BCL2-like 2 | 557579 | 277 | 452265 | 1442 | |
| AS | Bcl-XL | BCL2-like 1 | 307677 | 278 | 302564 | 1443 | |
| AS | Bcl-XL | BCL2-like 1 | 376055 | 279 | 365223 | 1444 | |
| AS | Bcl-XL | BCL2-like 1 | 376062 | 280 | 365230 | 1445 | |
| AS | Bcl-XL | BCL2-like 1 | 420488 | 281 | 390760 | 1446 | |
| AS | Bcl-XL | BCL2-like 1 | 420653 | 282 | 405563 | 1447 | |
| AS | Bcl-XL | BCL2-like 1 | 422920 | 283 | 411252 | 1448 | |
| AS | Bcl-XL | BCL2-like 1 | 439267 | 284 | 389688 | 1449 | |
| AS | Bcl-XL | BCL2-like 1 | 450273 | 285 | 406203 | 1450 | |
| AS | Bcl-XL | BCL2-like 1 | 456404 | 286 | 395545 | 1451 | |
| AS | BCMA | tumor necrosis factor receptor superfamily, member 17 | 53243 | 287 | 53243 | 1452 | |
| AS | BCMA | tumor necrosis factor receptor superfamily, member 17 | 396495 | 288 | 379753 | 1453 | |
| AS | BCMA | tumor necrosis factor receptor superfamily, member 17 | 435355 | 289 | 401782 | 1454 | |
| AS | BFL1 | BCL2-related protein A1 | 267953 | 290 | 267953 | 1455 | |
| AS | BFL1 | BCL2-related protein A1 | 335661 | 291 | 335250 | 1456 | |
| AS | Bid | BH3 interacting domain death agonist | 317361 | 292 | 318822 | 1457 | |
| AS | Bid | BH3 interacting domain death agonist | 342111 | 293 | 344594 | 1458 | |
| AS | Bid | BH3 interacting domain death agonist | 399765 | 294 | 382667 | 1459 | |
| AS | Bid | BH3 interacting domain death agonist | 399767 | 295 | 382669 | 1460 | |
| AS | Bid | BH3 interacting domain death agonist | 399774 | 296 | 382674 | 1461 | |
| AS | Bid | BH3 interacting domain death agonist | 551952 | 297 | 449236 | 1462 | |
| AS | Bik | BCL2-interacting killer (apoptosis-inducing) | 216115 | 298 | 216115 | 1463 | |
| AS | Bim | BCL2-like 11 (apoptosis facilitator) | 308659 | 299 | 309226 | 1464 | |

TABLE 6-continued

Oncology Related Targets

| Cat. | Target | Target Description | ENST ID | Trans. SEQ ID NO | ENSP ID | Prot. SEQ ID NO | OPT. SEQ ID NO |
|---|---|---|---|---|---|---|---|
| AS | Bim | BCL2-like 11 (apoptosis facilitator) | 337565 | 300 | 338374 | 1465 | |
| AS | Bim | BCL2-like 11 (apoptosis facilitator) | 357757 | 301 | 350398 | 1466 | |
| AS | Bim | BCL2-like 11 (apoptosis facilitator) | 393252 | 302 | 376941 | 1467 | |
| AS | Bim | BCL2-like 11 (apoptosis facilitator) | 393253 | 303 | 376942 | 1468 | |
| AS | Bim | BCL2-like 11 (apoptosis facilitator) | 393256 | 304 | 376943 | 1469 | |
| AS | Bim | BCL2-like 11 (apoptosis facilitator) | 432179 | 305 | 411870 | 1470 | |
| AS | Bim | BCL2-like 11 (apoptosis facilitator) | 452033 | 306 | 403666 | 1471 | |
| AS | BMF | Bcl2 modifying factor | 220446 | 307 | 220446 | 1472 | |
| AS | BMF | Bcl2 modifying factor | 354670 | 308 | 346697 | 1473 | |
| AS | BMF | Bcl2 modifying factor | 397573 | 309 | 380703 | 1474 | |
| AS | BMF | Bcl2 modifying factor | 431415 | 310 | 396511 | 1475 | |
| AS | BMF | Bcl2 modifying factor | 559701 | 311 | 453919 | 1476 | |
| AS | BMF | Bcl2 modifying factor | 561282 | 312 | 453522 | 1477 | |
| AS | BMF | Bcl2 modifying factor | 561360 | 313 | 453892 | 1478 | |
| AS | BRE | brain and reproductive organ-expressed (TNFRSF1A modulator) | 342045 | 314 | 339371 | 1479 | |
| AS | BRE | brain and reproductive organ-expressed (TNFRSF1A modulator) | 344773 | 315 | 343412 | 1480 | |
| AS | BRE | brain and reproductive organ-expressed (TNFRSF1A modulator) | 361704 | 316 | 354699 | 1481 | |
| AS | BRE | brain and reproductive organ-expressed (TNFRSF1A modulator) | 379623 | 317 | 368944 | 1482 | |
| AS | BRE | brain and reproductive organ-expressed (TNFRSF1A modulator) | 379624 | 318 | 368945 | 1483 | |
| AS | BRE | brain and reproductive organ-expressed (TNFRSF1A modulator) | 379632 | 319 | 368953 | 1484 | |
| AS | BRE | brain and reproductive organ-expressed (TNFRSF1A modulator) | 436924 | 320 | 392345 | 1485 | |
| AS | Calcineurin A | protein phosphatase 3, catalytic subunit, alpha isozyme | 323055 | 321 | 320580 | 1486 | |
| AS | Calcineurin A | protein phosphatase 3, catalytic subunit, alpha isozyme | 394853 | 322 | 378322 | 1487 | |
| AS | Calcineurin A | protein phosphatase 3, catalytic subunit, alpha isozyme | 394854 | 323 | 378323 | 1488 | |
| AS | Calcineurin A | protein phosphatase 3, catalytic subunit, alpha isozyme | 507176 | 324 | 422990 | 1489 | |
| AS | Calcineurin A | protein phosphatase 3, catalytic subunit, alpha isozyme | 512215 | 325 | 422781 | 1490 | |
| AS | Calcineurin A | protein phosphatase 3, catalytic subunit, alpha isozyme | 523694 | 326 | 429350 | 1491 | |
| AS | Calcineurin A | protein phosphatase 3, catalytic subunit, alpha isozyme | 525819 | 327 | 434599 | 1492 | |
| AS | Calcineurin A | protein phosphatase 3, catalytic subunit, alpha isozyme | 529324 | 328 | 431619 | 1493 | |
| AS | Caspase-1 | caspase 1, apoptosis-related cysteine peptidase (interleukin 1, beta, convertase) | 353247 | 329 | 344132 | 1494 | |
| AS | Caspase-1 | caspase 1, apoptosis-related cysteine peptidase (interleukin 1, beta, convertase) | 393136 | 330 | 376844 | 1495 | |
| AS | Caspase-1 | caspase 1, apoptosis-related cysteine peptidase (interleukin 1, beta, convertase) | 415981 | 331 | 408446 | 1496 | |
| AS | Caspase-1 | caspase 1, apoptosis-related cysteine peptidase (interleukin 1, beta, convertase) | 436863 | 332 | 410076 | 1497 | |
| AS | Caspase-1 | caspase 1, apoptosis-related cysteine peptidase (interleukin 1, beta, convertase) | 446369 | 333 | 403260 | 1498 | |

TABLE 6-continued

Oncology Related Targets

| Cat. | Target | Target Description | ENST ID | Trans. SEQ ID NO | ENSP ID | Prot. SEQ ID NO | OPT. SEQ ID NO |
|---|---|---|---|---|---|---|---|
| AS | Caspase-1 | caspase 1, apoptosis-related cysteine peptidase (interleukin 1, beta, convertase) | 525825 | 334 | 434779 | 1499 | |
| AS | Caspase-1 | caspase 1, apoptosis-related cysteine peptidase (interleukin 1, beta, convertase) | 526568 | 335 | 434250 | 1500 | |
| AS | Caspase-1 | caspase 1, apoptosis-related cysteine peptidase (interleukin 1, beta, convertase) | 528974 | 336 | 434259 | 1501 | |
| AS | Caspase-1 | caspase 1, apoptosis-related cysteine peptidase (interleukin 1, beta, convertase) | 529871 | 337 | 431947 | 1502 | |
| AS | Caspase-1 | caspase 1, apoptosis-related cysteine peptidase (interleukin 1, beta, convertase) | 531166 | 338 | 434303 | 1503 | |
| AS | Caspase-1 | caspase 1, apoptosis-related cysteine peptidase (interleukin 1, beta, convertase) | 533400 | 339 | 433138 | 1504 | |
| AS | Caspase-1 | caspase 1, apoptosis-related cysteine peptidase (interleukin 1, beta, convertase) | 534497 | 340 | 436875 | 1505 | |
| AS | Caspase-10 | caspase 10, apoptosis-related cysteine peptidase | 272879 | 341 | 272879 | 1506 | |
| AS | Caspase-10 | caspase 10, apoptosis-related cysteine peptidase | 286186 | 342 | 286186 | 1507 | |
| AS | Caspase-10 | caspase 10, apoptosis-related cysteine peptidase | 346817 | 343 | 237865 | 1508 | |
| AS | Caspase-10 | caspase 10, apoptosis-related cysteine peptidase | 360132 | 344 | 353250 | 1509 | |
| AS | Caspase-2 | caspase 2, apoptosis-related cysteine peptidase | 310447 | 345 | 312664 | 1510 | |
| AS | Caspase-2 | caspase 2, apoptosis-related cysteine peptidase | 350623 | 346 | 340030 | 1511 | |
| AS | Caspase-2 | caspase 2, apoptosis-related cysteine peptidase | 392923 | 347 | 376654 | 1512 | |
| AS | Caspase-3 | caspase 3, apoptosis-related cysteine peptidase | 308394 | 348 | 311032 | 1513 | |
| AS | Caspase-3 | caspase 3, apoptosis-related cysteine peptidase | 438467 | 349 | 390792 | 1514 | |
| AS | Caspase-3 | caspase 3, apoptosis-related cysteine peptidase | 447121 | 350 | 407142 | 1515 | |
| AS | Caspase-3 | caspase 3, apoptosis-related cysteine peptidase | 523916 | 351 | 428929 | 1516 | |
| AS | Caspase-4 | caspase 4, apoptosis-related cysteine peptidase | 355546 | 352 | 347741 | 1517 | |
| AS | Caspase-4 | caspase 4, apoptosis-related cysteine peptidase | 417440 | 353 | 401673 | 1518 | |
| AS | Caspase-4 | caspase 4, apoptosis-related cysteine peptidase | 444739 | 354 | 388566 | 1519 | |
| AS | Caspase-5 | caspase 5, apoptosis-related cysteine peptidase | 260315 | 355 | 260315 | 1520 | |
| AS | Caspase-5 | caspase 5, apoptosis-related cysteine peptidase | 393139 | 356 | 376847 | 1521 | |
| AS | Caspase-5 | caspase 5, apoptosis-related cysteine peptidase | 393141 | 357 | 376849 | 1522 | |
| AS | Caspase-5 | caspase 5, apoptosis-related cysteine peptidase | 418434 | 358 | 398130 | 1523 | |
| AS | Caspase-5 | caspase 5, apoptosis-related cysteine peptidase | 444749 | 359 | 388365 | 1524 | |
| AS | Caspase-5 | caspase 5, apoptosis-related cysteine peptidase | 526056 | 360 | 436877 | 1525 | |
| AS | Caspase-5 | caspase 5, apoptosis-related cysteine peptidase | 531367 | 361 | 434471 | 1526 | |
| AS | Caspase-6 | caspase 6, apoptosis-related cysteine peptidase | 265164 | 362 | 265164 | 1527 | |
| AS | Caspase-6 | caspase 6, apoptosis-related cysteine peptidase | 352981 | 363 | 285333 | 1528 | |
| AS | Caspase-7 | caspase 7, apoptosis-related cysteine peptidase | 345633 | 364 | 298701 | 1529 | |
| AS | Caspase-7 | caspase 7, apoptosis-related cysteine peptidase | 369315 | 365 | 358321 | 1530 | |
| AS | Caspase-7 | caspase 7, apoptosis-related cysteine peptidase | 369316 | 366 | 358322 | 1531 | |

TABLE 6-continued

Oncology Related Targets

| Cat. | Target | Target Description | ENST ID | Trans. SEQ ID NO | ENSP ID | Prot. SEQ ID NO | OPT. SEQ ID NO |
|---|---|---|---|---|---|---|---|
| AS | Caspase-7 | caspase 7, apoptosis-related cysteine peptidase | 369318 | 367 | 358324 | 1532 | |
| AS | Caspase-7 | caspase 7, apoptosis-related cysteine peptidase | 369319 | 368 | 358325 | 1533 | |
| AS | Caspase-7 | caspase 7, apoptosis-related cysteine peptidase | 369321 | 369 | 358327 | 1534 | |
| AS | Caspase-7 | caspase 7, apoptosis-related cysteine peptidase | 369331 | 370 | 358337 | 1535 | |
| AS | Caspase-7 | caspase 7, apoptosis-related cysteine peptidase | 429617 | 371 | 400094 | 1536 | |
| AS | Caspase-7 | caspase 7, apoptosis-related cysteine peptidase | 442393 | 372 | 394482 | 1537 | |
| AS | Caspase-7 | caspase 7, apoptosis-related cysteine peptidase | 452490 | 373 | 398107 | 1538 | |
| AS | Caspase-8 | caspase 8, apoptosis-related cysteine peptidase | 264274 | 374 | 264274 | 1539 | |
| AS | Caspase-8 | caspase 8, apoptosis-related cysteine peptidase | 264275 | 375 | 264275 | 1540 | |
| AS | Caspase-8 | caspase 8, apoptosis-related cysteine peptidase | 323492 | 376 | 325722 | 1541 | |
| AS | Caspase-8 | caspase 8, apoptosis-related cysteine peptidase | 358485 | 377 | 351273 | 1542 | |
| AS | Caspase-8 | caspase 8, apoptosis-related cysteine peptidase | 392258 | 378 | 376087 | 1543 | |
| AS | Caspase-8 | caspase 8, apoptosis-related cysteine peptidase | 392259 | 379 | 376088 | 1544 | |
| AS | Caspase-8 | caspase 8, apoptosis-related cysteine peptidase | 392261 | 380 | 376089 | 1545 | |
| AS | Caspase-8 | caspase 8, apoptosis-related cysteine peptidase | 392263 | 381 | 376091 | 1546 | |
| AS | Caspase-8 | caspase 8, apoptosis-related cysteine peptidase | 392266 | 382 | 376094 | 1547 | |
| AS | Caspase-8 | caspase 8, apoptosis-related cysteine peptidase | 413726 | 383 | 397528 | 1548 | |
| AS | Caspase-8 | caspase 8, apoptosis-related cysteine peptidase | 429881 | 384 | 390641 | 1549 | |
| AS | Caspase-8 | caspase 8, apoptosis-related cysteine peptidase | 432109 | 385 | 412523 | 1550 | |
| AS | Caspase-8 | caspase 8, apoptosis-related cysteine peptidase | 440732 | 386 | 396869 | 1551 | |
| AS | Caspase-8 | caspase 8, apoptosis-related cysteine peptidase | 447616 | 387 | 388306 | 1552 | |
| AS | Caspase-9 | caspase 9, apoptosis-related cysteine peptidase | 333868 | 388 | 330237 | 1553 | |
| AS | Caspase-9 | caspase 9, apoptosis-related cysteine peptidase | 348549 | 389 | 255256 | 1554 | |
| AS | Caspase-9 | caspase 9, apoptosis-related cysteine peptidase | 375874 | 390 | 365034 | 1555 | |
| AS | Caspase-9 | caspase 9, apoptosis-related cysteine peptidase | 375890 | 391 | 365051 | 1556 | |
| AS | Caspase-9 | caspase 9, apoptosis-related cysteine peptidase | 440484 | 392 | 411304 | 1557 | |
| AS | Caspase-9 | caspase 9, apoptosis-related cysteine peptidase | 447522 | 393 | 396540 | 1558 | |
| AS | Caspase-9 | caspase 9, apoptosis-related cysteine peptidase | 546424 | 394 | 449584 | 1559 | |
| AS | CD27 | CD27 molecule | 266557 | 395 | 266557 | 1560 | |
| AS | CD30 | tumor necrosis factor receptor superfamily, member 8 | 263932 | 396 | 263932 | 1561 | |
| AS | CD30 | tumor necrosis factor receptor superfamily, member 8 | 413146 | 397 | 398337 | 1562 | |
| AS | CD30 | tumor necrosis factor receptor superfamily, member 8 | 417814 | 398 | 390650 | 1563 | |
| AS | CD30L | tumor necrosis factor (ligand) superfamily, member 8 | 223795 | 399 | 223795 | 1564 | |
| AS | CD40 | CD40 molecule, TNF receptor superfamily member 5 | 372278 | 400 | 361352 | 1565 | |
| AS | CD40L (TNFSF5) | CD40 ligand | 370628 | 401 | 359662 | 1566 | |
| AS | CD40L (TNFSF5) | CD40 ligand | 370629 | 402 | 359663 | 1567 | |
| AS | CD41 | CD40 molecule, TNF receptor superfamily member 5 | 372276 | 403 | 361350 | 1568 | |

TABLE 6-continued

Oncology Related Targets

| Cat. | Target | Target Description | ENST ID | Trans. SEQ ID NO | ENSP ID | Prot. SEQ ID NO | OPT. SEQ ID NO |
|---|---|---|---|---|---|---|---|
| AS | CD42 | CD40 molecule, TNF receptor superfamily member 5 | 372285 | 404 | 361359 | 1569 | |
| AS | CD70(TNFSF7) | CD70 molecule | 245903 | 405 | 245903 | 1570 | |
| AS | CD70(TNFSF7) | CD70 molecule | 423145 | 406 | 395294 | 1571 | |
| AS | CDK1 (p34) | cyclin-dependent kinase 1 | 316629 | 407 | 325970 | 1572 | |
| AS | CDK1 (p34) | cyclin-dependent kinase 1 | 373809 | 408 | 362915 | 1573 | |
| AS | CDK1 (p34) | cyclin-dependent kinase 1 | 395284 | 409 | 378699 | 1574 | |
| AS | CDK1 (p34) | cyclin-dependent kinase 1 | 448257 | 410 | 397973 | 1575 | |
| AS | CDK1 (p34) | cyclin-dependent kinase 1 | 519078 | 411 | 430665 | 1576 | |
| AS | CDK5 | cyclin-dependent kinase 5 | 485972 | 412 | 419782 | 1577 | |
| AS | CDK5R1 (p35) | cyclin-dependent kinase 5, regulatory subunit 1 (p35) | 313401 | 413 | 318486 | 1578 | |
| AS | c-FLIP(S) | CASP8 and FADD-like apoptosis regulator | 309955 | 414 | 312455 | 1579 | |
| AS | c-FLIP(S) | CASP8 and FADD-like apoptosis regulator | 340870 | 415 | 339326 | 1580 | |
| AS | c-FLIP(S) | CASP8 and FADD-like apoptosis regulator | 343375 | 416 | 339391 | 1581 | |
| AS | c-FLIP(S) | CASP8 and FADD-like apoptosis regulator | 355558 | 417 | 347757 | 1582 | |
| AS | c-FLIP(S) | CASP8 and FADD-like apoptosis regulator | 395148 | 418 | 378580 | 1583 | |
| AS | c-FLIP(S) | CASP8 and FADD-like apoptosis regulator | 417748 | 419 | 412882 | 1584 | |
| AS | c-FLIP(S) | CASP8 and FADD-like apoptosis regulator | 423241 | 420 | 399420 | 1585 | |
| AS | c-FLIP(S) | CASP8 and FADD-like apoptosis regulator | 433445 | 421 | 391029 | 1586 | |
| AS | c-FLIP(S) | CASP8 and FADD-like apoptosis regulator | 441224 | 422 | 411897 | 1587 | |
| AS | c-FLIP(S) | CASP8 and FADD-like apoptosis regulator | 443227 | 423 | 413270 | 1588 | |
| AS | cIAP1 | baculoviral IAP repeat containing 3 | NA | 424 | NA | 1589 | 2488 |
| AS | c-IAP1 | baculoviral IAP repeat containing 3 | 263464 | 425 | 263464 | 1590 | |
| AS | c-IAP1 | baculoviral IAP repeat containing 3 | 532808 | 426 | 432907 | 1591 | |
| AS | cIAP2 | baculoviral IAP repeat containing 2 | NA | 427 | NA | 1592 | |
| AS | C-IAP2 | baculoviral IAP repeat containing 2 | 227758 | 428 | 227758 | 1593 | |
| AS | C-IAP2 | baculoviral IAP repeat containing 2 | 530675 | 429 | 431723 | 1594 | |
| AS | C-IAP2 | baculoviral IAP repeat containing 2 | 532672 | 430 | 434979 | 1595 | |
| AS | C-IAP2 | baculoviral IAP repeat containing 2 | 541741 | 431 | 440771 | 1596 | |
| AS | c-Jun | jun proto-oncogene | 371222 | 432 | 360266 | 1597 | |
| AS | c-Raf-1 | v-raf-1 murine leukemia viral oncogene homolog 1 | 251849 | 433 | 251849 | 1598 | |
| AS | c-Raf-1 | v-raf-1 murine leukemia viral oncogene homolog 1 | 442415 | 434 | 401888 | 1599 | |
| AS | c-Raf-1 | v-raf-1 murine leukemia viral oncogene homolog 1 | 534997 | 435 | 441186 | 1600 | |
| AS | c-Raf-1 | v-raf-1 murine leukemia viral oncogene homolog 1 | 542177 | 436 | 443567 | 1601 | |
| AS | Cytochrome c | cytochrome c, somatic | 305786 | 437 | 307786 | 1602 | |
| AS | Cytochrome c | cytochrome c, somatic | 409409 | 438 | 386270 | 1603 | |
| AS | Cytochrome c | cytochrome c, somatic | 409764 | 439 | 387279 | 1604 | |
| AS | Cytochrome c | cytochrome c, somatic | 413447 | 440 | 416479 | 1605 | |
| AS | DAXX | death-domain associated protein | 266000 | 441 | 266000 | 1606 | |
| AS | DAXX | death-domain associated protein | 374542 | 442 | 363668 | 1607 | |
| AS | DAXX | death-domain associated protein | 383062 | 443 | 372539 | 1608 | |

TABLE 6-continued

Oncology Related Targets

| Cat. | Target | Target Description | ENST ID | Trans. SEQ ID NO | ENSP ID | Prot. SEQ ID NO | OPT. SEQ ID NO |
|---|---|---|---|---|---|---|---|
| AS | DAXX | death-domain associated protein | 383194 | 444 | 372681 | 1609 | |
| AS | DAXX | death-domain associated protein | 399060 | 445 | 382014 | 1610 | |
| AS | DAXX | death-domain associated protein | 399344 | 446 | 382281 | 1611 | |
| AS | DAXX | death-domain associated protein | 414083 | 447 | 396876 | 1612 | |
| AS | DAXX | death-domain associated protein | 414272 | 448 | 409756 | 1613 | |
| AS | DAXX | death-domain associated protein | 419855 | 449 | 397612 | 1614 | |
| AS | DAXX | death-domain associated protein | 428268 | 450 | 408215 | 1615 | |
| AS | DAXX | death-domain associated protein | 429531 | 451 | 415898 | 1616 | |
| AS | DAXX | death-domain associated protein | 433482 | 452 | 404623 | 1617 | |
| AS | DAXX | death-domain associated protein | 436311 | 453 | 404376 | 1618 | |
| AS | DAXX | death-domain associated protein | 438332 | 454 | 411700 | 1619 | |
| AS | DAXX | death-domain associated protein | 440500 | 455 | 403986 | 1620 | |
| AS | DAXX | death-domain associated protein | 445009 | 456 | 394108 | 1621 | |
| AS | DAXX | death-domain associated protein | 446403 | 457 | 406008 | 1622 | |
| AS | DAXX | death-domain associated protein | 453407 | 458 | 408499 | 1623 | |
| AS | DAXX | death-domain associated protein | 453931 | 459 | 412433 | 1624 | |
| AS | DAXX | death-domain associated protein | 454197 | 460 | 412177 | 1625 | |
| AS | DAXX | death-domain associated protein | 455860 | 461 | 410772 | 1626 | |
| AS | DAXX | death-domain associated protein | 547663 | 462 | 447115 | 1627 | |
| AS | DAXX | death-domain associated protein | 548604 | 463 | 448337 | 1628 | |
| AS | DAXX | death-domain associated protein | 550822 | 464 | 447861 | 1629 | |
| AS | DAXX | death-domain associated protein | 552944 | 465 | 447833 | 1630 | |
| AS | DcR3 | tumor necrosis factor receptor superfamily, member 6b, decoy | 342852 | 466 | 342328 | 1631 | |
| AS | DcR3 | tumor necrosis factor receptor superfamily, member 6b, decoy | 369996 | 467 | 359013 | 1632 | |
| AS | DcR3 | tumor necrosis factor receptor superfamily, member 6b, decoy | 370006 | 468 | 359023 | 1633 | |
| AS | DFF40 (CAD) | DNA fragmentation factor, 40 kDa, beta polypeptide (caspase-activated DNase) | 338895 | 469 | 339524 | 1634 | |
| AS | DFF40 (CAD) | DNA fragmentation factor, 40 kDa, beta polypeptide (caspase-activated DNase) | 339350 | 470 | 343218 | 1635 | |
| AS | DFF40 (CAD) | DNA fragmentation factor, 40 kDa, beta polypeptide (caspase-activated DNase) | 341385 | 471 | 345906 | 1636 | |
| AS | DFF40 (CAD) | DNA fragmentation factor, 40 kDa, beta polypeptide (caspase-activated DNase) | 378206 | 472 | 367448 | 1637 | |
| AS | DFF40 (CAD) | DNA fragmentation factor, 40 kDa, beta polypeptide (caspase-activated DNase) | 378209 | 473 | 367454 | 1638 | |
| AS | DFF40 (CAD) | DNA fragmentation factor, 40 kDa, beta polypeptide (caspase-activated DNase) | 378212 | 474 | 367457 | 1639 | |

TABLE 6-continued

Oncology Related Targets

| Cat. | Target | Target Description | ENST ID | Trans. SEQ ID NO | ENSP ID | Prot. SEQ ID NO | OPT. SEQ ID NO |
|---|---|---|---|---|---|---|---|
| AS | DFF40 (CAD) | DNA fragmentation factor, 40 kDa, beta polypeptide (caspase-activated DNase) | 430539 | 475 | 389502 | 1640 | |
| AS | DFF40 (CAD) | DNA fragmentation factor, 40 kDa, beta polypeptide (caspase-activated DNase) | 448632 | 476 | 411635 | 1641 | |
| AS | DFF40 (CAD) | DNA fragmentation factor, 40 kDa, beta polypeptide (caspase-activated DNase) | 491998 | 477 | 436775 | 1642 | |
| AS | DR3 | tumor necrosis factor receptor superfamily, member 25 | 348333 | 478 | 314451 | 1643 | |
| AS | DR3 | tumor necrosis factor receptor superfamily, member 25 | 351748 | 479 | 326762 | 1644 | |
| AS | DR3 | tumor necrosis factor receptor superfamily, member 25 | 351959 | 480 | 337713 | 1645 | |
| AS | DR3 | tumor necrosis factor receptor superfamily, member 25 | 356876 | 481 | 349341 | 1646 | |
| AS | DR3 | tumor necrosis factor receptor superfamily, member 25 | 377782 | 482 | 367013 | 1647 | |
| AS | DR4 | tumor necrosis factor receptor superfamily, member 10a | 221132 | 483 | 221132 | 1648 | |
| AS | DR5 | tumor necrosis factor receptor superfamily, member 10b | 276431 | 484 | 276431 | 1649 | |
| AS | DR5 | tumor necrosis factor receptor superfamily, member 10b | 347739 | 485 | 317859 | 1650 | |
| AS | DR5 | tumor necrosis factor receptor superfamily, member 10b | 542226 | 486 | 443386 | 1651 | |
| AS | DR6 | tumor necrosis factor receptor superfamily, member 21 | 296861 | 487 | 296861 | 1652 | |
| AS | DR6 | tumor necrosis factor receptor superfamily, member 21 | 419206 | 488 | 390032 | 1653 | |
| AS | EGFR | epidermal growth factor receptor | 275493 | 489 | 275493 | 1654 | |
| AS | EGFR | epidermal growth factor receptor | 342916 | 490 | 342376 | 1655 | |
| AS | EGFR | epidermal growth factor receptor | 344576 | 491 | 345973 | 1656 | |
| AS | EGFR | epidermal growth factor receptor | 395504 | 492 | 378880 | 1657 | |
| AS | EGFR | epidermal growth factor receptor | 420316 | 493 | 413843 | 1658 | |
| AS | EGFR | epidermal growth factor receptor | 442591 | 494 | 410031 | 1659 | |
| AS | EGFR | epidermal growth factor receptor | 454757 | 495 | 395243 | 1660 | |
| AS | EGFR | epidermal growth factor receptor | 455089 | 496 | 415559 | 1661 | |
| AS | EGFR | epidermal growth factor receptor | 533450 | 497 | 435262 | 1662 | |
| AS | ErbB2 | v-erb-b2 erythroblastic leukemia viral oncogene homolog 2, neuro/glioblastoma derived oncogene homolog (avian) | 269571 | 498 | 269571 | 1663 | |
| AS | ErbB2 | v-erb-b2 erythroblastic leukemia viral oncogene homolog 2, neuro/glioblastoma derived oncogene homolog (avian) | 406381 | 499 | 385185 | 1664 | |
| AS | ErbB2 | v-erb-b2 erythroblastic leukemia viral oncogene homolog 2, neuro/glioblastoma derived oncogene homolog (avian) | 445658 | 500 | 404047 | 1665 | |
| AS | ErbB2 | v-erb-b2 erythroblastic leukemia viral oncogene homolog 2, neuro/glioblastoma derived oncogene homolog (avian) | 540042 | 501 | 446382 | 1666 | |

TABLE 6-continued

Oncology Related Targets

| Cat. | Target | Target Description | ENST ID | Trans. SEQ ID NO | ENSP ID | Prot. SEQ ID NO | OPT. SEQ ID NO |
|---|---|---|---|---|---|---|---|
| AS | ErbB2 | v-erb-b2 erythroblastic leukemia viral oncogene homolog 2, neuro/glioblastoma derived oncogene homolog (avian) | 540147 | 502 | 443562 | 1667 | |
| AS | ErbB2 | v-erb-b2 erythroblastic leukemia viral oncogene homolog 2, neuro/glioblastoma derived oncogene homolog (avian) | 541774 | 503 | 446466 | 1668 | |
| AS | ErbB3 | v-erb-b2 erythroblastic leukemia viral oncogene homolog 3 (avian) | 267101 | 504 | 267101 | 1669 | |
| AS | ErbB3 | v-erb-b2 erythroblastic leukemia viral oncogene homolog 3 (avian) | 394099 | 505 | 377659 | 1670 | |
| AS | ErbB3 | v-erb-b2 erythroblastic leukemia viral oncogene homolog 3 (avian) | 411731 | 506 | 415753 | 1671 | |
| AS | ErbB3 | v-erb-b2 erythroblastic leukemia viral oncogene homolog 3 (avian) | 415288 | 507 | 408340 | 1672 | |
| AS | ErbB3 | v-erb-b2 erythroblastic leukemia viral oncogene homolog 3 (avian) | 450146 | 508 | 399178 | 1673 | |
| AS | ErbB3 | v-erb-b2 erythroblastic leukemia viral oncogene homolog 3 (avian) | 549282 | 509 | 448636 | 1674 | |
| AS | ErbB3 | v-erb-b2 erythroblastic leukemia viral oncogene homolog 3 (avian) | 551085 | 510 | 448483 | 1675 | |
| AS | Erk(MAPK1/3) | mitogen-activated protein kinase 1 | 215832 | 511 | 215832 | 1676 | |
| AS | Erk(MAPK1/3) | mitogen-activated protein kinase 3 | 263025 | 512 | 263025 | 1677 | |
| AS | Erk(MAPK1/3) | mitogen-activated protein kinase 3 | 322266 | 513 | 327293 | 1678 | |
| AS | Erk(MAPK1/3) | mitogen-activated protein kinase 3 | 395200 | 514 | 378626 | 1679 | |
| AS | Erk(MAPK1/3) | mitogen-activated protein kinase 3 | 395202 | 515 | 378628 | 1680 | |
| AS | Erk(MAPK1/3) | mitogen-activated protein kinase 1 | 398822 | 516 | 381803 | 1681 | |
| AS | Erk(MAPK1/3) | mitogen-activated protein kinase 3 | 403394 | 517 | 384895 | 1682 | |
| AS | Erk(MAPK1/3) | mitogen-activated protein kinase 1 | 415911 | 518 | 409149 | 1683 | |
| AS | Erk(MAPK1/3) | mitogen-activated protein kinase 3 | 484663 | 519 | 432742 | 1684 | |
| AS | Erk(MAPK1/3) | mitogen-activated protein kinase 1 | 544786 | 520 | 440842 | 1685 | |
| AS | FADD | Fas (TNFRSF6)-associated via death domain | 301838 | 521 | 301838 | 1686 | |
| AS | FLASH | caspase 8 associated protein 2 | 237177 | 522 | NA | 1687 | |
| AS | FLASH | caspase 8 associated protein 2 | 419040 | 523 | NA | | |
| AS | FLASH | caspase 8 associated protein 2 | 444163 | 524 | NA | | |
| AS | FLASH | caspase 8 associated protein 2 | 547893 | 525 | NA | | |
| AS | FLASH | caspase 8 associated protein 2 | 548224 | 526 | NA | | |
| AS | FLASH | caspase 8 associated protein 2 | 551025 | 527 | NA | | |
| AS | FLASH | caspase 8 associated protein 2 | 552401 | 528 | NA | | |
| AS | FN14 | tumor necrosis factor receptor superfamily, member 12A | 326577 | 529 | 326737 | 1688 | |
| AS | FN14 | tumor necrosis factor receptor superfamily, member 12A | 341627 | 530 | 343894 | 1689 | |
| AS | GCK (MAP4K2) | mitogen-activated protein kinase kinase kinase kinase 2 | 294066 | 531 | 294066 | 1690 | |
| AS | GRB2 | growth factor receptor-bound protein 2 | 316615 | 532 | 317360 | 1691 | |
| AS | GRB2 | growth factor receptor-bound protein 2 | 316804 | 533 | 339007 | 1692 | |
| AS | GRB2 | growth factor receptor-bound protein 2 | 392562 | 534 | 376345 | 1693 | |

TABLE 6-continued

Oncology Related Targets

| Cat. | Target | Target Description | ENST ID | Trans. SEQ ID NO | ENSP ID | Prot. SEQ ID NO | OPT. SEQ ID NO |
|---|---|---|---|---|---|---|---|
| AS | GRB2 | growth factor receptor-bound protein 2 | 392564 | 535 | 376347 | 1694 | |
| AS | H-Ras | v-Ha-ras Harvey rat sarcoma viral oncogene homolog | 311189 | 536 | 309845 | 1695 | |
| AS | H-Ras | v-Ha-ras Harvey rat sarcoma viral oncogene homolog | 397594 | 537 | 380722 | 1696 | |
| AS | H-Ras | v-Ha-ras Harvey rat sarcoma viral oncogene homolog | 397596 | 538 | 380723 | 1697 | |
| AS | H-Ras | v-Ha-ras Harvey rat sarcoma viral oncogene homolog | 417302 | 539 | 388246 | 1698 | |
| AS | H-Ras | v-Ha-ras Harvey rat sarcoma viral oncogene homolog | 451590 | 540 | 407586 | 1699 | |
| AS | H-Ras | v-Ha-ras Harvey rat sarcoma viral oncogene homolog | 493230 | 541 | 434023 | 1700 | |
| AS | HRK | harakiri, BCL2 interacting protein (contains only BH3 domain) | 257572 | 542 | 257572 | 1701 | |
| AS | HSP27 | heat shock 27 kDa protein 1 | 248553 | 543 | 248553 | 1702 | |
| AS | HSP27 | heat shock 27 kDa protein 3 | 302005 | 544 | 303394 | 1703 | |
| AS | HSP27 | Heat shock protein beta-2 | 304298 | 545 | 302476 | 1704 | |
| AS | HSP27 | heat shock 27 kDa protein 1 | 432276 | 546 | 406545 | 1705 | |
| AS | HSP27 | Heat shock protein beta-2 | 537382 | 547 | 445585 | 1706 | |
| AS | HtrA2/Omi | HtrA serine peptidase 2 | 258080 | 548 | 258080 | 1707 | |
| AS | HtrA2/Omi | HtrA serine peptidase 2 | 352222 | 549 | 312893 | 1708 | |
| AS | Humanin | MT-RNR2-like 4 | 399974 | 550 | 382856 | 1709 | |
| AS | Humanin | MT-RNR2-like 5 | 512524 | 551 | 437910 | 1710 | |
| AS | Humanin | MT-RNR2-like 8 | 536684 | 552 | 439666 | 1711 | |
| AS | Humanin | MT-RNR2-like 1 | 540040 | 553 | 439228 | 1712 | |
| AS | Humanin | MT-RNR2-like 3 | 543500 | 554 | 443339 | 1713 | |
| AS | Humanin | MT-RNR2-like 7 | 544824 | 555 | 439985 | 1714 | |
| AS | Humanin | MT-RNR2-like 10 | 545075 | 556 | 442159 | 1715 | |
| AS | Humanin | MT-RNR2-like 6 | 570419 | 557 | 461075 | 1716 | |
| AS | ICAD | DNA fragmentation factor, 45 kDa, alpha polypeptide | 377036 | 558 | 366235 | 1717 | |
| AS | ICAD | DNA fragmentation factor, 45 kDa, alpha polypeptide | 377038 | 559 | 366237 | 1718 | |
| AS | IGF-1R | insulin-like growth factor 1 receptor | 268035 | 560 | 268035 | 1719 | |
| AS | IKK (alpha) | conserved helix-loop-helix ubiquitous kinase | 370397 | 561 | 359424 | 1720 | |
| AS | IKK (beta) | inhibitor of kappa light polypeptide gene enhancer in B-cells, kinase beta | 379708 | 562 | 369030 | 1721 | |
| AS | IKK (beta) | inhibitor of kappa light polypeptide gene enhancer in B-cells, kinase beta | 416505 | 563 | 404920 | 1722 | |
| AS | IKK (beta) | inhibitor of kappa light polypeptide gene enhancer in B-cells, kinase beta | 520810 | 564 | 430684 | 1723 | |
| AS | IKK-gamma | inhibitor of kappa light polypeptide gene enhancer in B-cells, kinase gamma | 263518 | 565 | 263518 | 1724 | |
| AS | IKK-gamma | inhibitor of kappa light polypeptide gene enhancer in B-cells, kinase gamma | 369601 | 566 | 358614 | 1725 | |
| AS | IKK-gamma | inhibitor of kappa light polypeptide gene enhancer in B-cells, kinase gamma | 369606 | 567 | 358619 | 1726 | |
| AS | IKK-gamma | inhibitor of kappa light polypeptide gene enhancer in B-cells, kinase gamma | 369607 | 568 | 358620 | 1727 | |
| AS | IKK-gamma | inhibitor of kappa light polypeptide gene enhancer in B-cells, kinase gamma | 369609 | 569 | 358622 | 1728 | |
| AS | IKK-gamma | inhibitor of kappa light polypeptide gene enhancer in B-cells, kinase gamma | 422680 | 570 | 390368 | 1729 | |
| AS | IKK-gamma | inhibitor of kappa light polypeptide gene enhancer in B-cells, kinase gamma | 440286 | 571 | 394934 | 1730 | |
| AS | IKK-gamma | inhibitor of kappa light polypeptide gene enhancer in B-cells, kinase gamma | 445622 | 572 | 395205 | 1731 | |

TABLE 6-continued

Oncology Related Targets

| Cat. | Target | Target Description | ENST ID | Trans. SEQ ID NO | ENSP ID | Prot. SEQ ID NO | OPT. SEQ ID NO |
|---|---|---|---|---|---|---|---|
| AS | IKK-gamma | inhibitor of kappa light polypeptide gene enhancer in B-cells, kinase gamma | 455588 | 573 | 400769 | 1732 | |
| AS | IRAK1 | interleukin-1 receptor-associated kinase 1 | 369980 | 574 | 358997 | 1733 | |
| AS | IRAK1 | interleukin-1 receptor-associated kinase 1 | 393682 | 575 | 377287 | 1734 | |
| AS | IRAK1 | interleukin-1 receptor-associated kinase 1 | 393687 | 576 | 377291 | 1735 | |
| AS | IRAK1 | interleukin-1 receptor-associated kinase 1 | 429936 | 577 | 392662 | 1736 | |
| AS | IRAK2 | interleukin-1 receptor-associated kinase 2 | 256458 | 578 | 256458 | 1737 | |
| AS | IRS-1 | insulin receptor substrate 1 | 305123 | 579 | 304895 | 1738 | |
| AS | jBid; formed after cleaving BID at position 25 | jBID | NA | | NA | 1739 | |
| AS | JNK1(MAPK8) | mitogen-activated protein kinase 8 | 360332 | 580 | 353483 | 1740 | |
| AS | JNK1(MAPK8) | mitogen-activated protein kinase 8 | 374174 | 581 | 363289 | 1741 | |
| AS | JNK1(MAPK8) | mitogen-activated protein kinase 8 | 374176 | 582 | 363291 | 1742 | |
| AS | JNK1(MAPK8) | mitogen-activated protein kinase 8 | 374179 | 583 | 363294 | 1743 | |
| AS | JNK1(MAPK8) | mitogen-activated protein kinase 8 | 374182 | 584 | 363297 | 1744 | |
| AS | JNK1(MAPK8) | mitogen-activated protein kinase 8 | 374189 | 585 | 363304 | 1745 | |
| AS | JNK1(MAPK8) | mitogen-activated protein kinase 8 | 395611 | 586 | 378974 | 1746 | |
| AS | JNK1(MAPK8) | mitogen-activated protein kinase 8 | 426557 | 587 | 397729 | 1747 | |
| AS | JNK1(MAPK8) | mitogen-activated protein kinase 8 | 429041 | 588 | 393223 | 1748 | |
| AS | JNK1(MAPK8) | mitogen-activated protein kinase 8 | 432379 | 589 | 387936 | 1749 | |
| AS | JNK3(MAPK10) | mitogen-activated protein kinase 10 | 359221 | 590 | 352157 | 1750 | |
| AS | JNK3(MAPK10) | mitogen-activated protein kinase 10 | 361569 | 591 | 355297 | 1751 | |
| AS | JNK3(MAPK10) | mitogen-activated protein kinase 10 | 395157 | 592 | 378586 | 1752 | |
| AS | JNK3(MAPK10) | mitogen-activated protein kinase 10 | 395160 | 593 | 378589 | 1753 | |
| AS | JNK3(MAPK10) | mitogen-activated protein kinase 10 | 395161 | 594 | 378590 | 1754 | |
| AS | JNK3(MAPK10) | mitogen-activated protein kinase 10 | 395166 | 595 | 378595 | 1755 | |
| AS | JNK3(MAPK10) | mitogen-activated protein kinase 10 | 395169 | 596 | 378598 | 1756 | |
| AS | JNK3(MAPK10) | mitogen-activated protein kinase 10 | 449047 | 597 | 414469 | 1757 | |
| AS | JNK3(MAPK10) | mitogen-activated protein kinase 10 | 502302 | 598 | 423918 | 1758 | |
| AS | JNK3(MAPK10) | mitogen-activated protein kinase 10 | 503911 | 599 | 421409 | 1759 | |
| AS | JNK3(MAPK10) | mitogen-activated protein kinase 10 | 506773 | 600 | 421359 | 1760 | |
| AS | JNK3(MAPK10) | mitogen-activated protein kinase 10 | 509464 | 601 | 424128 | 1761 | |
| AS | JNK3(MAPK10) | mitogen-activated protein kinase 10 | 511167 | 602 | 422277 | 1762 | |
| AS | JNK3(MAPK10) | mitogen-activated protein kinase 10 | 511328 | 603 | 421762 | 1763 | |
| AS | JNK3(MAPK10) | mitogen-activated protein kinase 10 | 512017 | 604 | 424755 | 1764 | |
| AS | JNK3(MAPK10) | mitogen-activated protein kinase 10 | 512564 | 605 | 422985 | 1765 | |

TABLE 6-continued

Oncology Related Targets

| Cat. | Target | Target Description | ENST ID | Trans. SEQ ID NO | ENSP ID | Prot. SEQ ID NO | OPT. SEQ ID NO |
|---|---|---|---|---|---|---|---|
| AS | JNK3(MAPK10) | mitogen-activated protein kinase 10 | 515400 | 606 | 424154 | 1766 | |
| AS | MAP1 | mannan-binding lectin serine peptidase 1 (C4/C2 activating component of Ra-reactive factor) | 169293 | 607 | 169293 | 1767 | |
| AS | MAP1 | mannan-binding lectin serine peptidase 1 (C4/C2 activating component of Ra-reactive factor) | 296280 | 608 | 296280 | 1768 | |
| AS | MAP1 | mannan-binding lectin serine peptidase 1 (C4/C2 activating component of Ra-reactive factor) | 337774 | 609 | 336792 | 1769 | |
| AS | MAP1 | mannan-binding lectin serine peptidase 1 (C4/C2 activating component of Ra-reactive factor) | 392472 | 610 | 376264 | 1770 | |
| AS | MAP1 | mannan-binding lectin serine peptidase 1 (C4/C2 activating component of Ra-reactive factor) | 541811 | 611 | 440446 | 1771 | |
| AS | MAP1 | mannan-binding lectin serine peptidase 1 (C4/C2 activating component of Ra-reactive factor) | 541896 | 612 | 446240 | 1772 | |
| AS | Mcl-1 | myeloid cell leukemia sequence 1 (BCL2-related) | 307940 | 613 | 309973 | 1773 | |
| AS | Mcl-1 | myeloid cell leukemia sequence 1 (BCL2-related) | 369026 | 614 | 358022 | 1774 | |
| AS | Mcl-1 | myeloid cell leukemia sequence 1 (BCL2-related) | 439749 | 615 | 411395 | 1775 | |
| AS | MEK1 (MAP2K1) | mitogen-activated protein kinase 1 | 215832 | 616 | 215832 | 1776 | |
| AS | MEK1 (MAP2K1) | mitogen-activated protein kinase kinase 1 | 307102 | 617 | 302486 | 1777 | |
| AS | MEK1 (MAP2K1) | mitogen-activated protein kinase 1 | 415911 | 618 | 409149 | 1778 | |
| AS | MEK1 (MAP2K1) | mitogen-activated protein kinase 1 | 544786 | 619 | 440842 | 1779 | |
| AS | MEK2 (MAP2K2) | mitogen-activated protein kinase kinase 2 | 262948 | 620 | 262948 | 1780 | |
| AS | MEK4 (MAP2K4) | mitogen-activated protein kinase kinase 4 | 353533 | 621 | 262445 | 1781 | |
| AS | MEK4 (MAP2K4) | mitogen-activated protein kinase kinase 4 | 415385 | 622 | 410402 | 1782 | |
| AS | MEK4 (MAP2K4) | mitogen-activated protein kinase kinase 4 | 536413 | 623 | 441610 | 1783 | |
| AS | MEK4 (MAP2K4) | mitogen-activated protein kinase kinase 4 | 538465 | 624 | 444874 | 1784 | |
| AS | MEKK1 (MAP3K1) | mitogen-activated protein kinase kinase kinase 1 | 399503 | 625 | 382423 | 1785 | |
| AS | NADE (NGFRAP1) | nerve growth factor receptor (TNFRSF16) associated protein 1 | 299872 | 626 | 299872 | 1786 | |
| AS | NADE (NGFRAP1) | nerve growth factor receptor (TNFRSF16) associated protein 1 | 361298 | 627 | 354843 | 1787 | |
| AS | NADE (NGFRAP1) | nerve growth factor receptor (TNFRSF16) associated protein 1 | 372634 | 628 | 361717 | 1788 | |
| AS | NADE (NGFRAP1) | nerve growth factor receptor (TNFRSF16) associated protein 1 | 372635 | 629 | 361718 | 1789 | |
| AS | NADE (NGFRAP1) | nerve growth factor receptor (TNFRSF16) associated protein 1 | 372645 | 630 | 361728 | 1790 | |
| AS | NGF | nerve growth factor (beta polypeptide) | 369512 | 631 | 358525 | 1791 | |
| AS | NGFR | nerve growth factor receptor | 172229 | 632 | 172229 | 1792 | |
| AS | NGFR | nerve growth factor receptor | 504201 | 633 | 421731 | 1793 | |
| AS | NIK (MAP3K14) | mitogen-activated protein kinase kinase kinase 14 | 344686 | 634 | 342059 | 1794 | |

TABLE 6-continued

Oncology Related Targets

| Cat. | Target | Target Description | ENST ID | Trans. SEQ ID NO | ENSP ID | Prot. SEQ ID NO | OPT. SEQ ID NO |
|---|---|---|---|---|---|---|---|
| AS | NIK (MAP3K14) | mitogen-activated protein kinase kinase kinase 14 | 376926 | 635 | 366125 | 1795 | |
| AS | NOXA | phorbol-12-myristate-13-acetate-induced protein 1 | 269518 | 636 | 269518 | 1796 | |
| AS | NOXA | phorbol-12-myristate-13-acetate-induced protein 1 | 316660 | 637 | 326119 | 1797 | |
| AS | OX40 | tumor necrosis factor receptor superfamily, member 4 | 379236 | 638 | 368538 | 1798 | |
| AS | OX40 | tumor necrosis factor receptor superfamily, member 4 | 453580 | 639 | 390907 | 1799 | |
| AS | OX40L (TNFSF4) | tumor necrosis factor (ligand) superfamily, member 4 | 281834 | 640 | 281834 | 1800 | |
| AS | OX40L TNFSF4) | tumor necrosis factor (ligand) superfamily, member 4 | 367718 | 641 | 356691 | 1801 | |
| AS | OX40L TNFSF4) | tumor necrosis factor (ligand) superfamily, member 4 | 545292 | 642 | 439704 | 1802 | |
| AS | p53 | tumor protein p53 | 269305 | 643 | 269305 | 1803 | |
| AS | p53 | tumor protein p53 | 269305 | 644 | 269305 | 1804 | 2489 |
| AS | p53 | tumor protein p53 | 359597 | 645 | 352610 | 1805 | |
| AS | p53 | tumor protein p53 | 396473 | 646 | 379735 | 1806 | |
| AS | p53 | tumor protein p53 | 413465 | 647 | 410739 | 1807 | |
| AS | p53 | tumor protein p53 | 414315 | 648 | 394195 | 1808 | |
| AS | p53 | tumor protein p53 | 419024 | 649 | 402130 | 1809 | |
| AS | p53 | tumor protein p53 | 420246 | 650 | 391127 | 1810 | |
| AS | p53 | tumor protein p53 | 445888 | 651 | 391478 | 1811 | 2490 |
| AS | p53 | tumor protein p53 | 455263 | 652 | 398846 | 1812 | |
| AS | p53 | tumor protein p53 | 503591 | 653 | 426252 | 1813 | |
| AS | p53 | tumor protein p53 | 508793 | 654 | 424104 | 1814 | |
| AS | p53 | tumor protein p53 | 509690 | 655 | 425104 | 1815 | |
| AS | p53 | tumor protein p53 | 514944 | 656 | 423862 | 1816 | |
| AS | p53 | tumor protein p53 | 545858 | 657 | 437792 | 1817 | |
| AS | p70 S6 kinase 1 | ribosomal protein S6 kinase, 70 kDa, polypeptide 1 | 225577 | 658 | 225577 | 1818 | |
| AS | p70 S6 kinase 1 | ribosomal protein S6 kinase, 70 kDa, polypeptide 1 | 393021 | 659 | 376744 | 1819 | |
| AS | p70 S6 kinase 1 | ribosomal protein S6 kinase, 70 kDa, polypeptide 1 | 406116 | 660 | 384335 | 1820 | |
| AS | p70 S6 kinase 1 | ribosomal protein S6 kinase, 70 kDa, polypeptide 1 | 443572 | 661 | 441993 | 1821 | |
| AS | p70 S6 kinase 2 | ribosomal protein S6 kinase, 70 kDa, polypeptide 2 | 312629 | 662 | 308413 | 1822 | |
| AS | p70 S6 kinase 2 | ribosomal protein S6 kinase, 70 kDa, polypeptide 2 | 528964 | 663 | 432847 | 1823 | |
| AS | p70 S6 kinase 2 | ribosomal protein S6 kinase, 70 kDa, polypeptide 2 | 539188 | 664 | 442949 | 1824 | |
| AS | p90Rsk | ribosomal protein S6 kinase, 90 kDa, polypeptide 1 | 374162 | 665 | 363277 | 1825 | |
| AS | p90Rsk | ribosomal protein S6 kinase, 90 kDa, polypeptide 1 | 374164 | 666 | 363279 | 1826 | |
| AS | p90Rsk | ribosomal protein S6 kinase, 90 kDa, polypeptide 1 | 374168 | 667 | 363283 | 1827 | |
| AS | p90Rsk | ribosomal protein S6 kinase, 90 kDa, polypeptide 1 | 403732 | 668 | 383967 | 1828 | |
| AS | p90Rsk | ribosomal protein S6 kinase, 90 kDa, polypeptide 1 | 530003 | 669 | 432281 | 1829 | |
| AS | p90Rsk | ribosomal protein S6 kinase, 90 kDa, polypeptide 1 | 531382 | 670 | 435412 | 1830 | |
| AS | PAK2 | p21 protein (Cdc42/Rac)-activated kinase 2 | 327134 | 671 | 314067 | 1831 | |
| AS | PARP-1 | poly (ADP-ribose) polymerase 1 | 366790 | 672 | 355755 | 1832 | |
| AS | PARP-1 | poly (ADP-ribose) polymerase 1 | 366791 | 673 | 355756 | 1833 | |
| AS | PARP-1 | poly (ADP-ribose) polymerase 1 | 366792 | 674 | 355757 | 1834 | |
| AS | PARP-1 | poly (ADP-ribose) polymerase 1 | 366794 | 675 | 355759 | 1835 | |
| AS | PARP-1 | poly (ADP-ribose) polymerase 1 | 432338 | 676 | 412774 | 1836 | |
| AS | PDPK1 | 3-phosphoinositide dependent protein kinase-1 | 342085 | 677 | 344220 | 1837 | |
| AS | PDPK1 | 3-phosphoinositide dependent protein kinase-1 | 354836 | 678 | 346895 | 1838 | |
| AS | PDPK1 | 3-phosphoinositide dependent protein kinase-1 | 441549 | 679 | 395357 | 1839 | |

TABLE 6-continued

Oncology Related Targets

| Cat. | Target | Target Description | ENST ID | Trans. SEQ ID NO | ENSP ID | Prot. SEQ ID NO | OPT. SEQ ID NO |
|---|---|---|---|---|---|---|---|
| AS | PI3K | phosphoinositide-3-kinase, catalytic, alpha polypeptide | 263967 | 680 | 263967 | 1840 | |
| AS | PI3K | phosphoinositide-3-kinase, catalytic, beta polypeptide | 289153 | 681 | 289153 | 1841 | |
| AS | PI3K | phosphoinositide-3-kinase, catalytic, gamma polypeptide | 359195 | 682 | 352121 | 1842 | |
| AS | PI3K | phosphoinositide-3-kinase, catalytic, delta polypeptide | 360563 | 683 | 353766 | 1843 | |
| AS | PI3K | phosphoinositide-3-kinase, catalytic, delta polypeptide | 361110 | 684 | 354410 | 1844 | |
| AS | PI3K | phosphoinositide-3-kinase, catalytic, delta polypeptide | 377346 | 685 | 366563 | 1845 | |
| AS | PI3K | phosphoinositide-3-kinase, catalytic, gamma polypeptide | 440650 | 686 | 392258 | 1846 | |
| AS | PI3K | phosphoinositide-3-kinase, catalytic, beta polypeptide | 461451 | 687 | 420399 | 1847 | |
| AS | PI3K | phosphoinositide-3-kinase, catalytic, alpha polypeptide | 468036 | 688 | 417479 | 1848 | |
| AS | PI3K | phosphoinositide-3-kinase, catalytic, beta polypeptide | 477593 | 689 | 418143 | 1849 | |
| AS | PI3K | phosphoinositide-3-kinase, catalytic, beta polypeptide | 483968 | 690 | 419857 | 1850 | |
| AS | PI3K | phosphoinositide-3-kinase, catalytic, beta polypeptide | 493568 | 691 | 417869 | 1851 | |
| AS | PI3K | phosphoinositide-3-kinase, catalytic, gamma polypeptide | 496166 | 692 | 419260 | 1852 | |
| AS | PI3K | phosphoinositide-3-kinase, catalytic, delta polypeptide | 536656 | 693 | 446444 | 1853 | |
| AS | PI3K | phosphoinositide-3-kinase, catalytic, delta polypeptide | 543390 | 694 | 443811 | 1854 | |
| AS | PI3K | phosphoinositide-3-kinase, catalytic, beta polypeptide | 544716 | 695 | 438259 | 1855 | |
| AS | PKA-cat | protein kinase, cAMP-dependent, catalytic, alpha | 308677 | 696 | 309591 | 1856 | |
| AS | PKA-cat | protein kinase, cAMP-dependent, catalytic, alpha | 350356 | 697 | 340940 | 1857 | |
| AS | PKA-cat | protein kinase, cAMP-dependent, catalytic, beta | 370679 | 698 | 359713 | 1858 | |
| AS | PKA-cat | protein kinase, cAMP-dependent, catalytic, beta | 370680 | 699 | 359714 | 1859 | |
| AS | PKA-cat | protein kinase, cAMP-dependent, catalytic, beta | 370681 | 700 | 359715 | 1860 | |
| AS | PKA-cat | protein kinase, cAMP-dependent, catalytic, beta | 370682 | 701 | 359716 | 1861 | |
| AS | PKA-cat | protein kinase, cAMP-dependent, catalytic, beta | 370684 | 702 | 359718 | 1862 | |
| AS | PKA-cat | protein kinase, cAMP-dependent, catalytic, beta | 370685 | 703 | 359719 | 1863 | |
| AS | PKA-cat | protein kinase, cAMP-dependent, catalytic, beta | 370688 | 704 | 359722 | 1864 | |
| AS | PKA-cat | protein kinase, cAMP-dependent, catalytic, beta | 370689 | 705 | 359723 | 1865 | |
| AS | PKA-cat | protein kinase, cAMP-dependent, catalytic, gamma | 377276 | 706 | 366488 | 1866 | |
| AS | PKA-cat | protein kinase, cAMP-dependent, catalytic, beta | 394838 | 707 | 378314 | 1867 | |
| AS | PKA-cat | protein kinase, cAMP-dependent, catalytic, beta | 394839 | 708 | 378315 | 1868 | |
| AS | PKA-cat | protein kinase, cAMP-dependent, catalytic, beta | 413538 | 709 | 397175 | 1869 | |
| AS | PKA-cat | protein kinase, cAMP-dependent, catalytic, beta | 417530 | 710 | 399326 | 1870 | |
| AS | PKA-cat | protein kinase, cAMP-dependent, catalytic, beta | 432111 | 711 | 392275 | 1871 | |
| AS | PKA-cat | protein kinase, cAMP-dependent, catalytic, beta | 436133 | 712 | 390906 | 1872 | |
| AS | PKA-cat | protein kinase, cAMP-dependent, catalytic, beta | 446538 | 713 | 401252 | 1873 | |
| AS | PKA-cat | protein kinase, cAMP-dependent, catalytic, beta | 450730 | 714 | 393654 | 1874 | |
| AS | PKA-cat | protein kinase, cAMP-dependent, catalytic, alpha | 535695 | 715 | 441654 | 1875 | |

TABLE 6-continued

Oncology Related Targets

| Cat. | Target | Target Description | ENST ID | Trans. SEQ ID NO | ENSP ID | Prot. SEQ ID NO | OPT. SEQ ID NO |
|---|---|---|---|---|---|---|---|
| AS | PKA-cat | protein kinase, cAMP-dependent, catalytic, alpha | 536649 | 716 | 440418 | 1876 | |
| AS | PKC-delta | protein kinase C, delta | 330452 | 717 | 331602 | 1877 | |
| AS | PKC-delta | protein kinase C, delta | 394729 | 718 | 378217 | 1878 | |
| AS | PKC-delta | protein kinase C, delta | 478843 | 719 | 419726 | 1879 | |
| AS | PKC-delta | protein kinase C, delta | 487897 | 720 | 418106 | 1880 | |
| AS | PKC-Zeta | protein kinase C, zeta | 378567 | 721 | 367830 | 1881 | |
| AS | PKC-Zeta | protein kinase C, zeta | 400920 | 722 | 383711 | 1882 | |
| AS | PKC-Zeta | protein kinase C, zeta | 400921 | 723 | 383712 | 1883 | |
| AS | PKC-Zeta | protein kinase C, zeta | 461106 | 724 | 426412 | 1884 | |
| AS | PKC-Zeta | protein kinase C, zeta | 470511 | 725 | 421350 | 1885 | |
| AS | PKC-Zeta | protein kinase C, zeta | 470596 | 726 | 424228 | 1886 | |
| AS | PKC-Zeta | protein kinase C, zeta | 470986 | 727 | 421219 | 1887 | |
| AS | PKC-Zeta | protein kinase C, zeta | 482686 | 728 | 425317 | 1888 | |
| AS | PKC-Zeta | protein kinase C, zeta | 496325 | 729 | 421869 | 1889 | |
| AS | PP1-cat alpha | protein phosphatase 1, catalytic subunit, alpha isozyme | 312989 | 730 | 326031 | 1890 | |
| AS | PP1-cat alpha | protein phosphatase 1, catalytic subunit, alpha isozyme | 376745 | 731 | 365936 | 1891 | |
| AS | PP1-cat alpha | protein phosphatase 1, catalytic subunit, alpha isozyme | 451458 | 732 | 405603 | 1892 | |
| AS | PP2a catalytic | protein phosphatase 2, catalytic subunit, alpha isozyme | 481195 | 733 | 418447 | 1893 | |
| AS | PP2C | protein phosphatase, Mg2+/Mn2+ dependent, 1H | 228705 | 734 | 228705 | 1894 | |
| AS | PP2C | protein phosphatase, Mg2+/Mn2+ dependent, 1F | 263212 | 735 | 263212 | 1895 | |
| AS | PP2C | protein phosphatase, Mg2+/Mn2+ dependent, 1B | 282412 | 736 | 282412 | 1896 | |
| AS | PP2C | protein phosphatase, Mg2+/Mn2+ dependent, 1K | 295908 | 737 | 295908 | 1897 | |
| AS | PP2C | protein phosphatase, Mg2+/Mn2+ dependent, 1M | 296487 | 738 | 296487 | 1898 | |
| AS | PP2C | protein phosphatase, Mg2+/Mn2+ dependent, 1D | 305921 | 739 | 306682 | 1899 | |
| AS | PP2C | protein phosphatase, Mg2+/Mn2+ dependent, 1E | 308249 | 740 | 312411 | 1900 | |
| AS | PP2C | protein phosphatase, Mg2+/Mn2+ dependent, 1J | 309276 | 741 | 308926 | 1901 | |
| AS | PP2C | protein phosphatase, Mg2+/Mn2+ dependent, 1K | 315194 | 742 | 324761 | 1902 | |
| AS | PP2C | protein phosphatase, Mg2+/Mn2+ dependent, 1M | 323588 | 743 | 319894 | 1903 | |
| AS | PP2C | protein phosphatase, Mg2+/Mn2+ dependent, 1N (putative) | 324688 | 744 | 321761 | 1904 | |
| AS | PP2C | protein phosphatase, Mg2+/Mn2+ dependent, 1A | 325642 | 745 | 327255 | 1905 | |
| AS | PP2C | protein phosphatase, Mg2+/Mn2+ dependent, 1A | 325658 | 746 | 314850 | 1906 | |
| AS | PP2C | protein phosphatase, Mg2+/Mn2+ dependent, 1G | 344034 | 747 | 342778 | 1907 | |
| AS | PP2C | protein phosphatase, Mg2+/Mn2+ dependent, 1B | 345249 | 748 | 326089 | 1908 | |
| AS | PP2C | protein phosphatase, Mg2+/Mn2+ dependent, 1G | 350803 | 749 | 264714 | 1909 | |
| AS | PP2C | protein phosphatase, Mg2+/Mn2+ dependent, 1J | 359994 | 750 | 353088 | 1910 | |
| AS | PP2C | protein phosphatase, Mg2+/Mn2+ dependent, 1B | 378551 | 751 | 367813 | 1911 | |

TABLE 6-continued

Oncology Related Targets

| Cat. | Target | Target Description | ENST ID | Trans. SEQ ID NO | ENSP ID | Prot. SEQ ID NO | OPT. SEQ ID NO |
|---|---|---|---|---|---|---|---|
| AS | PP2C | protein phosphatase, Mg2+/Mn2+ dependent, 1D | 392995 | 752 | 376720 | 1912 | |
| AS | PP2C | protein phosphatase, Mg2+/Mn2+ dependent, 1A | 395076 | 753 | 378514 | 1913 | |
| AS | PP2C | protein phosphatase, Mg2+/Mn2+ dependent, 1G | 395543 | 754 | 378913 | 1914 | |
| AS | PP2C | protein phosphatase, Mg2+/Mn2+ dependent, 1N (putative) | 396734 | 755 | 379960 | 1915 | |
| AS | PP2C | protein phosphatase, Mg2+/Mn2+ dependent, 1F | 397495 | 756 | 380632 | 1916 | |
| AS | PP2C | protein phosphatase, Mg2+/Mn2+ dependent, 1F | 406981 | 757 | 384715 | 1917 | |
| AS | PP2C | protein phosphatase, Mg2+/Mn2+ dependent, 1F | 407142 | 758 | 384930 | 1918 | |
| AS | PP2C | protein phosphatase, Mg2+/Mn2+ dependent, 1B | 409432 | 759 | 387287 | 1919 | |
| AS | PP2C | protein phosphatase, Mg2+/Mn2+ dependent, 1M | 409502 | 760 | 387046 | 1920 | |
| AS | PP2C | protein phosphatase, Mg2+/Mn2+ dependent, 1B | 409895 | 761 | 387341 | 1921 | |
| AS | PP2C | protein phosphatase, Mg2+/Mn2+ dependent, 1B | 419807 | 762 | 390087 | 1922 | |
| AS | PP2C | protein phosphatase, Mg2+/Mn2+ dependent, 1E | 443121 | 763 | 390257 | 1923 | |
| AS | PP2C | protein phosphatase, Mg2+/Mn2+ dependent, 1M | 457351 | 764 | 393747 | 1924 | |
| AS | PP2C | protein phosphatase, Mg2+/Mn2+ dependent, 1L | 497343 | 765 | 420354 | 1925 | |
| AS | PP2C | protein phosphatase, Mg2+/Mn2+ dependent, 1L | 498165 | 766 | 417659 | 1926 | |
| AS | PP2C | protein phosphatase, Mg2+/Mn2+ dependent, 1K | 506423 | 767 | 424155 | 1927 | |
| AS | PP2C | protein phosphatase, Mg2+/Mn2+ dependent, 1A | 525399 | 768 | 435398 | 1928 | |
| AS | PP2C | protein phosphatase, Mg2+/Mn2+ dependent, 1A | 528241 | 769 | 431453 | 1929 | |
| AS | PP2C | protein phosphatase, Mg2+/Mn2+ dependent, 1A | 529574 | 770 | 432966 | 1930 | |
| AS | PP2C | protein phosphatase, Mg2+/Mn2+ dependent, 1A | 531937 | 771 | 435575 | 1931 | |
| AS | PP2C | protein phosphatase, Mg2+/Mn2+ dependent, 1F | 538191 | 772 | 439915 | 1932 | |
| AS | PP2C | protein phosphatase, Mg2+/Mn2+ dependent, 1G | 544412 | 773 | 442536 | 1933 | |
| AS | PP2C | protein phosphatase, Mg2+/Mn2+ dependent, 1D | 544712 | 774 | 438518 | 1934 | |
| AS | Puma | BCL2 binding component 3 | 300880 | 775 | 300880 | 1935 | |
| AS | Puma | BCL2 binding component 3 | 341983 | 776 | 341155 | 1936 | |
| AS | Puma | BCL2 binding component 3 | 439096 | 777 | 395862 | 1937 | |
| AS | Puma | BCL2 binding component 3 | 449228 | 778 | 404503 | 1938 | |
| AS | RAIDD | CASP2 and RIPK1 domain containing adaptor with death domain | 332896 | 779 | 327647 | 1939 | |
| AS | RAIDD | CASP2 and RIPK1 domain containing adaptor with death domain | 541813 | 780 | 442624 | 1940 | |
| AS | RAIDD | CASP2 and RIPK1 domain containing adaptor with death domain | 542893 | 781 | 439068 | 1941 | |
| AS | RAIDD | CASP2 and RIPK1 domain containing adaptor with death domain | 551065 | 782 | 448425 | 1942 | |
| AS | RANK | tumor necrosis factor receptor superfamily, member 11a, NFKB activator | 269485 | 783 | 269485 | 1943 | |
| AS | RANK | tumor necrosis factor receptor superfamily, member 11a, NFKB activator | 382790 | 784 | 372240 | 1944 | |
| AS | RANKL | tumor necrosis factor (ligand) superfamily, member 11 | 239849 | 785 | 239849 | 1945 | |
| AS | RANKL | tumor necrosis factor (ligand) superfamily, member 11 | 358545 | 786 | 351347 | 1946 | |

TABLE 6-continued

Oncology Related Targets

| Cat. | Target | Target Description | ENST ID | Trans. SEQ ID NO | ENSP ID | Prot. SEQ ID NO | OPT. SEQ ID NO |
|---|---|---|---|---|---|---|---|
| AS | RANKL | tumor necrosis factor (ligand) superfamily, member 11 | 398795 | 787 | 381775 | 1947 | |
| AS | RANKL | tumor necrosis factor (ligand) superfamily, member 11 | 405262 | 788 | 384042 | 1948 | |
| AS | RANKL | tumor necrosis factor (ligand) superfamily, member 11 | 544862 | 789 | 444913 | 1949 | |
| AS | RelA (p65 NF-kappaB subunit) | v-rel reticuloendotheliosis viral oncogene homolog A (avian) | 308639 | 790 | 311508 | 1950 | |
| AS | RelA (p65 NF-kappaB subunit) | v-rel reticuloendotheliosis viral oncogene homolog A (avian) | 406246 | 791 | 384273 | 1951 | |
| AS | RelA (p65 NF-kappaB subunit) | v-rel reticuloendotheliosis viral oncogene homolog A (avian) | 426617 | 792 | 437980 | 1952 | |
| AS | RelA (p65 NF-kappaB subunit) | v-rel reticuloendotheliosis viral oncogene homolog A (avian) | 525693 | 793 | 432537 | 1953 | |
| AS | RelA (p65 NF-kappaB subunit) | v-rel reticuloendotheliosis viral oncogene homolog A (avian) | 526283 | 794 | 435290 | 1954 | |
| AS | RelA (p65 NF-kappaB subunit) | v-rel reticuloendotheliosis viral oncogene homolog A (avian) | 545816 | 795 | 443700 | 1955 | |
| AS | RIPK1 | receptor (TNFRSF)-interacting serine-threonine kinase 1 | 259808 | 796 | 259808 | 1956 | |
| AS | RIPK1 | receptor (TNFRSF)-interacting serine-threonine kinase 1 | 380409 | 797 | 369773 | 1957 | |
| AS | RIPK1 | receptor (TNFRSF)-interacting serine-threonine kinase 1 | 453483 | 798 | 415981 | 1958 | |
| AS | RIPK1 | receptor (TNFRSF)-interacting serine-threonine kinase 1 | 541791 | 799 | 442294 | 1959 | |
| AS | Sequestosome 1 (p62) | sequestosome 1 | 360718 | 800 | 353944 | 1960 | |
| AS | Sequestosome 1 (p62) | sequestosome 1 | 376929 | 801 | 366128 | 1961 | |
| AS | Sequestosome 1 (p62) | sequestosome 1 | 389805 | 802 | 374455 | 1962 | |
| AS | Sequestosome 1 (p62) | sequestosome 1 | 402874 | 803 | 385553 | 1963 | |
| AS | Sequestosome 1 (p62) | sequestosome 1 | 422245 | 804 | 394534 | 1964 | |
| AS | Sequestosome 1 (p62) | sequestosome 1 | 454378 | 805 | 408107 | 1965 | |
| AS | Sequestosome 1 (p62) | sequestosome 1 | 514093 | 806 | 427308 | 1966 | |
| AS | Shc | SHC (Src homology 2 domain containing) transforming protein 2 | 264554 | 807 | 264554 | 1967 | |
| AS | Shc | SHC (Src homology 2 domain containing) transforming protein 1 | 366442 | 808 | 396162 | 1968 | |
| AS | Shc | SHC (Src homology 2 domain containing) transforming protein 1 | 368441 | 809 | 357426 | 1969 | |
| AS | Shc | SHC (Src homology 2 domain containing) transforming protein 1 | 368443 | 810 | 357428 | 1970 | |
| AS | Shc | SHC (Src homology 2 domain containing) transforming protein 1 | 368445 | 811 | 357430 | 1971 | |

TABLE 6-continued

Oncology Related Targets

| Cat. | Target | Target Description | ENST ID | Trans. SEQ ID NO | ENSP ID | Prot. SEQ ID NO | OPT. SEQ ID NO |
|---|---|---|---|---|---|---|---|
| AS | Shc | SHC (Src homology 2 domain containing) transforming protein 1 | 368449 | 812 | 357434 | 1972 | |
| AS | Shc | SHC (Src homology 2 domain containing) transforming protein 1 | 368450 | 813 | 357435 | 1973 | |
| AS | Shc | SHC (Src homology 2 domain containing) transforming protein 1 | 368453 | 814 | 357438 | 1974 | |
| AS | Shc | SHC (Src homology 2 domain containing) transforming protein 3 | 375830 | 815 | 364990 | 1975 | |
| AS | Shc | SHC (Src homology 2 domain containing) transforming protein 3 | 375831 | 816 | 364991 | 1976 | |
| AS | Shc | SHC (Src homology 2 domain containing) transforming protein 3 | 375835 | 817 | 364995 | 1977 | |
| AS | Shc | SHC (Src homology 2 domain containing) transforming protein 1 | 412170 | 818 | 398441 | 1978 | |
| AS | Shc | SHC (Src homology 2 domain containing) transforming protein 1 | 414115 | 819 | 404908 | 1979 | |
| AS | Shc | SHC (Src homology 2 domain containing) transforming protein 1 | 444179 | 820 | 398864 | 1980 | |
| AS | Shc | SHC (Src homology 2 domain containing) transforming protein 1 | 444664 | 821 | 396333 | 1981 | |
| AS | Shc | SHC (Src homology 2 domain containing) transforming protein 1 | 448116 | 822 | 401303 | 1982 | |
| AS | Siah-1 | seven in absentia homolog 1 (Drosophila) | 356721 | 823 | 349156 | 1983 | |
| AS | Siah-1 | seven in absentia homolog 1 (Drosophila) | 380006 | 824 | 369343 | 1984 | |
| AS | Siah-1 | seven in absentia homolog 1 (Drosophila) | 394725 | 825 | 378214 | 1985 | |
| AS | SMAC | diablo, IAP-binding mitochondrial protein | NA | 826 | NA | 1986 | |
| AS | Smac/Diablo | diablo, IAP-binding mitochondrial protein | 267169 | 827 | 267169 | 1987 | |
| AS | Smac/Diablo | diablo, IAP-binding mitochondrial protein | 353548 | 828 | 320343 | 1988 | |
| AS | Smac/Diablo | diablo, IAP-binding mitochondrial protein | 413918 | 829 | 411638 | 1989 | |
| AS | Smac/Diablo | diablo, IAP-binding mitochondrial protein | 443649 | 830 | 398495 | 1990 | |
| AS | Smac/Diablo | diablo, IAP-binding mitochondrial protein | 464942 | 831 | 442360 | 1991 | |
| AS | SODD | BCL2-associated athanogene 4 | 287322 | 832 | 287322 | 1992 | |
| AS | SODD | BCL2-associated athanogene 4 | 432471 | 833 | 393298 | 1993 | |
| AS | SOS | son of sevenless homolog 2 (Drosophila) | 216373 | 834 | 216373 | 1994 | |
| AS | SOS | son of sevenless homolog 1 (Drosophila) | 263879 | 835 | 263879 | 1995 | |
| AS | SOS | son of sevenless homolog 1 (Drosophila) | 395038 | 836 | 378479 | 1996 | |
| AS | SOS | son of sevenless homolog 1 (Drosophila) | 402219 | 837 | 384675 | 1997 | |
| AS | SOS | son of sevenless homolog 1 (Drosophila) | 426016 | 838 | 387784 | 1998 | |
| AS | SOS | son of sevenless homolog 1 (Drosophila) | 428721 | 839 | 399992 | 1999 | |
| AS | SOS | son of sevenless homolog 2 (Drosophila) | 543680 | 840 | 445328 | 2000 | |
| AS | SOS | son of sevenless homolog 1 (Drosophila) | 543698 | 841 | 441172 | 2001 | |
| AS | SUMO-1 | SMT3 suppressor of mif two 3 homolog 1 (S. cerevisiae) | 392244 | 842 | 376075 | 2002 | |
| AS | SUMO-1 | SMT3 suppressor of mif two 3 homolog 1 (S. cerevisiae) | 392245 | 843 | 376076 | 2003 | |

TABLE 6-continued

Oncology Related Targets

| Cat. | Target | Target Description | ENST ID | Trans. SEQ ID NO | ENSP ID | Prot. SEQ ID NO | OPT. SEQ ID NO |
|---|---|---|---|---|---|---|---|
| AS | SUMO-1 | SMT3 suppressor of mif two 3 homolog 1 (S. cerevisiae) | 392246 | 844 | 376077 | 2004 | |
| AS | SUMO-1 | SMT3 suppressor of mif two 3 homolog 1 (S. cerevisiae) | 409205 | 845 | 386267 | 2005 | |
| AS | SUMO-1 | SMT3 suppressor of mif two 3 homolog 1 (S. cerevisiae) | 409498 | 846 | 386472 | 2006 | |
| AS | Survivin | baculoviral IAP repeat containing 5 | 301633 | 847 | 301633 | 2007 | |
| AS | Survivin | baculoviral IAP repeat containing 5 | 350051 | 848 | 324180 | 2008 | |
| AS | Survivin | baculoviral IAP repeat containing 5 | 374948 | 849 | 364086 | 2009 | |
| AS | Survivin | baculoviral IAP repeat containing 5 | 432014 | 850 | 389088 | 2010 | |
| AS | TACI | tumor necrosis factor receptor superfamily, member 13B | 261652 | 851 | 261652 | 2011 | |
| AS | TACI | tumor necrosis factor receptor superfamily, member 13B | 437538 | 852 | 413453 | 2012 | |
| AS | tBid | tBID | NA | | NA | 2013 | |
| AS | TL1A | tumor necrosis factor (ligand) superfamily, member 15 | 374044 | 853 | 363156 | 2014 | |
| AS | TL1A | tumor necrosis factor (ligand) superfamily, member 15 | 374045 | 854 | 363157 | 2015 | |
| AS | TNF-alpha | tumor necrosis factor | 376122 | 855 | 365290 | 2016 | |
| AS | TNF-alpha | tumor necrosis factor | 383496 | 856 | 372988 | 2017 | |
| AS | TNF-alpha | tumor necrosis factor | 412275 | 857 | 392858 | 2018 | |
| AS | TNF-alpha | tumor necrosis factor | 420425 | 858 | 410668 | 2019 | |
| AS | TNF-alpha | tumor necrosis factor | 443707 | 859 | 389492 | 2020 | |
| AS | TNF-alpha | tumor necrosis factor | 445232 | 860 | 389265 | 2021 | |
| AS | TNF-alpha | tumor necrosis factor | 448781 | 861 | 389490 | 2022 | |
| AS | TNF-alpha | tumor necrosis factor | 449264 | 862 | 398698 | 2023 | |
| AS | TNF-R1 | tumor necrosis factor receptor superfamily, member 1A | 162749 | 863 | 162749 | 2024 | |
| AS | TNF-R1 | tumor necrosis factor receptor superfamily, member 1A | 366159 | 864 | 380389 | 2025 | |
| AS | TNF-R2 | tumor necrosis factor receptor superfamily, member 1B | 376259 | 865 | 365435 | 2026 | |
| AS | TNF-R2 | tumor necrosis factor receptor superfamily, member 1B | 376259 | 866 | 365435 | 2027 | 2491 |
| AS | TNF-R2 | tumor necrosis factor receptor superfamily, member 1B | 400863 | 867 | 383660 | 2028 | |
| AS | TNF-R2 | tumor necrosis factor receptor superfamily, member 1B | 536782 | 868 | 440425 | 2029 | |
| AS | TRADD | TNFRSF1A-associated via death domain | 345057 | 869 | 341268 | 2030 | |
| AS | TRAF2 | TNF receptor-associated factor 2 | 247668 | 870 | 247668 | 2031 | |
| AS | TRAF2 | TNF receptor-associated factor 2 | 359662 | 871 | 352685 | 2032 | |
| AS | TRAF2 | TNF receptor-associated factor 2 | 371645 | 872 | 360708 | 2033 | |
| AS | TRAF2 | TNF receptor-associated factor 2 | 414589 | 873 | 397653 | 2034 | |
| AS | TRAF2 | TNF receptor-associated factor 2 | 419057 | 874 | 405860 | 2035 | |
| AS | TRAF2 | TNF receptor-associated factor 2 | 429509 | 875 | 406524 | 2036 | |
| AS | TRAF2 | TNF receptor-associated factor 2 | 432785 | 876 | 400061 | 2037 | |
| AS | TRAF2 | TNF receptor-associated factor 2 | 536468 | 877 | 446414 | 2038 | |
| AS | TRAF3 | TNF receptor-associated factor 3 | 347662 | 878 | 328003 | 2039 | |
| AS | TRAF3 | TNF receptor-associated factor 3 | 351691 | 879 | 332468 | 2040 | |
| AS | TRAF3 | TNF receptor-associated factor 3 | 392745 | 880 | 376500 | 2041 | |
| AS | TRAF3 | TNF receptor-associated factor 3 | 539721 | 881 | 445998 | 2042 | |
| AS | TRAF3 | TNF receptor-associated factor 3 | 560371 | 882 | 454207 | 2043 | |
| AS | TRAF3 | TNF receptor-associated factor 3 | 560463 | 883 | 453623 | 2044 | |
| AS | TRAF5 | TNF receptor-associated factor 5 | 261464 | 884 | 261464 | 2045 | |
| AS | TRAF5 | TNF receptor-associated factor 5 | 336184 | 885 | 336825 | 2046 | |
| AS | TRAF5 | TNF receptor-associated factor 5 | 367004 | 886 | 355971 | 2047 | |
| AS | TRAF5 | TNF receptor-associated factor 5 | 427925 | 887 | 389891 | 2048 | |
| AS | TRAF6 | TNF receptor-associated factor 6 | 348124 | 888 | 337853 | 2049 | |
| AS | TRAF6 | TNF receptor-associated factor 6 | 526995 | 889 | 433623 | 2050 | |

TABLE 6-continued

Oncology Related Targets

| Cat. | Target | Target Description | ENST ID | Trans. SEQ ID NO | ENSP ID | Prot. SEQ ID NO | OPT. SEQ ID NO |
|---|---|---|---|---|---|---|---|
| AS | TrkA | neurotrophic tyrosine kinase, receptor, type 1 | 368196 | 890 | 357179 | 2051 | |
| AS | TrkA | neurotrophic tyrosine kinase, receptor, type 1 | 392302 | 891 | 376120 | 2052 | |
| AS | TrkA | neurotrophic tyrosine kinase, receptor, type 1 | 524377 | 892 | 431418 | 2053 | |
| AS | TWEAK (TNFSF12) | tumor necrosis factor (ligand) superfamily, member 12 | 293825 | 893 | 293825 | 2054 | |
| AS | TWEAK (TNFSF12) | tumor necrosis factor (ligand) superfamily, member 12 | 557233 | 894 | 451451 | 2055 | |
| AS | VDAC 1 | voltage-dependent anion channel 1 | 265333 | 895 | 265333 | 2056 | |
| AS | VDAC 1 | voltage-dependent anion channel 1 | 395044 | 896 | 378484 | 2057 | |
| AS | VDAC 1 | voltage-dependent anion channel 1 | 395047 | 897 | 378487 | 2058 | |
| AS | VDAC 2 | voltage-dependent anion channel 2 | 298468 | 898 | 298468 | 2059 | |
| AS | VDAC 2 | voltage-dependent anion channel 2 | 313132 | 899 | 361635 | 2060 | |
| AS | VDAC 2 | voltage-dependent anion channel 2 | 332211 | 900 | 361686 | 2061 | |
| AS | VDAC 2 | voltage-dependent anion channel 2 | 344036 | 901 | 344876 | 2062 | |
| AS | VDAC 2 | voltage-dependent anion channel 2 | 413289 | 902 | 389551 | 2063 | |
| AS | VDAC 2 | voltage-dependent anion channel 2 | 447677 | 903 | 401492 | 2064 | |
| AS | VDAC 2 | voltage-dependent anion channel 2 | 535553 | 904 | 445901 | 2065 | |
| AS | VDAC 2 | voltage-dependent anion channel 2 | 543351 | 905 | 443092 | 2066 | |
| AS | XIAP | X-linked inhibitor of apoptosis | 355640 | 906 | 347858 | 2067 | |
| AS | XIAP | X-linked inhibitor of apoptosis | 371199 | 907 | 360242 | 2068 | |
| AS | XIAP | X-linked inhibitor of apoptosis | 430625 | 908 | 400637 | 2069 | |
| AS | XIAP | X-linked inhibitor of apoptosis | 434753 | 909 | 395230 | 2070 | |
| AS | XIAP | X-linked inhibitor of apoptosis | NA | 910 | NA | 2071 | |
| CC/S | ATM | ataxia telangiectasia mutated | 278616 | 911 | 278616 | 2072 | |
| CC/S | ATM | ataxia telangiectasia mutated | 389511 | 912 | 374162 | 2073 | |
| CC/S | ATM | ataxia telangiectasia mutated | 452508 | 913 | 388058 | 2074 | |
| CC/S | ATM | ataxia telangiectasia mutated | 532931 | 914 | 432318 | 2075 | |
| CC/S | ATR | ataxia telangiectasia and Rad3 related | 350721 | 915 | 343741 | 2076 | |
| CC/S | ATR | ataxia telangiectasia and Rad3 related | 383101 | 916 | 372581 | 2077 | |
| CC/S | ATRIP | ATR interacting protein | 320211 | 917 | 323099 | 2078 | |
| CC/S | ATRIP | ATR interacting protein | 346691 | 918 | 302338 | 2079 | |
| CC/S | ATRIP | ATR interacting protein | 357105 | 919 | 349620 | 2080 | |
| CC/S | ATRIP | ATR interacting protein | 412052 | 920 | 400930 | 2081 | |
| CC/S | ATRIP | ATR interacting protein | 421175 | 921 | 406664 | 2082 | |
| CC/S | Bard1 | BRCA1 associated RING domain 1 | 260947 | 922 | 260947 | 2083 | |
| CC/S | Bard1 | BRCA1 associated RING domain 1 | 449967 | 923 | 406752 | 2084 | |
| CC/S | BLM | Bloom syndrome, RecQ helicase-like | 355112 | 924 | 347232 | 2085 | |
| CC/S | BLM | Bloom syndrome, RecQ helicase-like | 536925 | 925 | 442330 | 2086 | |
| CC/S | BLM | Bloom syndrome, RecQ helicase-like | 543977 | 926 | 439075 | 2087 | |
| CC/S | Brca1 | breast cancer 1, early onset | 309486 | 927 | 310938 | 2088 | |
| CC/S | Brca1 | breast cancer 1, early onset | 346315 | 928 | 246907 | 2089 | |
| CC/S | Brca1 | breast cancer 1, early onset | 351666 | 929 | 338007 | 2090 | |
| CC/S | Brca1 | breast cancer 1, early onset | 352993 | 930 | 312236 | 2091 | |
| CC/S | Brca1 | breast cancer 1, early onset | 354071 | 931 | 326002 | 2092 | |
| CC/S | Brca1 | breast cancer 1, early onset | 357654 | 932 | 350283 | 2093 | |
| CC/S | Brca1 | breast cancer 1, early onset | 393691 | 933 | 377294 | 2094 | |
| CC/S | Brca1 | breast cancer 1, early onset | 412061 | 934 | 397145 | 2095 | |
| CC/S | Brca1 | breast cancer 1, early onset | 461221 | 935 | 418548 | 2096 | |
| CC/S | Brca1 | breast cancer 1, early onset | 461798 | 936 | 417988 | 2097 | |
| CC/S | Brca1 | breast cancer 1, early onset | 468300 | 937 | 417148 | 2098 | |
| CC/S | Brca1 | breast cancer 1, early onset | 470026 | 938 | 419274 | 2099 | |
| CC/S | Brca1 | breast cancer 1, early onset | 471181 | 939 | 418960 | 2100 | |

TABLE 6-continued

Oncology Related Targets

| Cat. | Target | Target Description | ENST ID | Trans. SEQ ID NO | ENSP ID | Prot. SEQ ID NO | OPT. SEQ ID NO |
|---|---|---|---|---|---|---|---|
| CC/S | Brca1 | breast cancer 1, early onset | 476777 | 940 | 417554 | 2101 | |
| CC/S | Brca1 | breast cancer 1, early onset | 477152 | 941 | 419988 | 2102 | |
| CC/S | Brca1 | breast cancer 1, early onset | 478531 | 942 | 420412 | 2103 | |
| CC/S | Brca1 | breast cancer 1, early onset | 484087 | 943 | 419481 | 2104 | |
| CC/S | Brca1 | breast cancer 1, early onset | 489037 | 944 | 420781 | 2105 | |
| CC/S | Brca1 | breast cancer 1, early onset | 491747 | 945 | 420705 | 2106 | |
| CC/S | Brca1 | breast cancer 1, early onset | 492859 | 946 | 420253 | 2107 | |
| CC/S | Brca1 | breast cancer 1, early onset | 493795 | 947 | 418775 | 2108 | |
| CC/S | Brca1 | breast cancer 1, early onset | 493919 | 948 | 418819 | 2109 | |
| CC/S | Brca1 | breast cancer 1, early onset | 494123 | 949 | 419103 | 2110 | |
| CC/S | Brca1 | breast cancer 1, early onset | 497488 | 950 | 418986 | 2111 | |
| CC/S | c-Abl | c-abl oncogene 1, non-receptor tyrosine kinase | 318560 | 951 | 323315 | 2112 | |
| CC/S | c-Abl | c-abl oncogene 1, non-receptor tyrosine kinase | 372348 | 952 | 361423 | 2113 | |
| CC/S | c-Abl | c-abl oncogene 1, non-receptor tyrosine kinase | 393293 | 953 | 376971 | 2114 | |
| CC/S | c-Abl | c-abl oncogene 1, non-receptor tyrosine kinase | 438426 | 954 | 407756 | 2115 | |
| CC/S | c-Abl | c-abl oncogene 1, non-receptor tyrosine kinase | 444970 | 955 | 400412 | 2116 | |
| CC/S | CDC25A | cell division cycle 25 homolog A (S. pombe) | 302506 | 956 | 303706 | 2117 | |
| CC/S | CDC25A | cell division cycle 25 homolog A (S. pombe) | 351231 | 957 | 343166 | 2118 | |
| CC/S | CDC25A | cell division cycle 25 homolog A (S. pombe) | 437972 | 958 | 404285 | 2119 | |
| CC/S | CDC25B | cell division cycle 25 homolog B (S. pombe) | 245960 | 959 | 245960 | 2120 | |
| CC/S | CDC25B | cell division cycle 25 homolog B (S. pombe) | 340833 | 960 | 339170 | 2121 | |
| CC/S | CDC25B | cell division cycle 25 homolog B (S. pombe) | 344256 | 961 | 339125 | 2122 | |
| CC/S | CDC25B | cell division cycle 25 homolog B (S. pombe) | 379598 | 962 | 368918 | 2123 | |
| CC/S | CDC25B | cell division cycle 25 homolog B (S. pombe) | 439880 | 963 | 405972 | 2124 | |
| CC/S | CDC25C | cell division cycle 25 homolog C (S. pombe) | 323760 | 964 | 321656 | 2125 | |
| CC/S | CDC25C | cell division cycle 25 homolog C (S. pombe) | 348983 | 965 | 345205 | 2126 | |
| CC/S | CDC25C | cell division cycle 25 homolog C (S. pombe) | 356505 | 966 | 348898 | 2127 | |
| CC/S | CDC25C | cell division cycle 25 homolog C (S. pombe) | 357274 | 967 | 349821 | 2128 | |
| CC/S | CDC25C | cell division cycle 25 homolog C (S. pombe) | 415130 | 968 | 392631 | 2129 | |
| CC/S | CDC25C | cell division cycle 25 homolog C (S. pombe) | 503022 | 969 | 427251 | 2130 | |
| CC/S | CDC25C | cell division cycle 25 homolog C (S. pombe) | 513970 | 970 | 424795 | 2131 | |
| CC/S | CDC25C | cell division cycle 25 homolog C (S. pombe) | 534892 | 971 | 443196 | 2132 | |
| CC/S | CDK2 | cyclin-dependent kinase 2 | 266970 | 972 | 266970 | 2133 | |
| CC/S | CDK2 | cyclin-dependent kinase 2 | 354056 | 973 | 243067 | 2134 | |
| CC/S | CDK4 | cyclin-dependent kinase 4 | 257904 | 974 | 257904 | 2135 | |
| CC/S | CDK4 | cyclin-dependent kinase 4 | 312990 | 975 | 316889 | 2136 | |
| CC/S | CDK4 | cyclin-dependent kinase 4 | 540325 | 976 | 439076 | 2137 | |
| CC/S | CDK4 | cyclin-dependent kinase 4 | 552254 | 977 | 449179 | 2138 | |
| CC/S | CDK4 | cyclin-dependent kinase 4 | 552388 | 978 | 448963 | 2139 | |
| CC/S | CDK4 | cyclin-dependent kinase 4 | 552862 | 979 | 446763 | 2140 | |
| CC/S | CDK6 | cyclin-dependent kinase 6 | 265734 | 980 | 265734 | 2141 | |
| CC/S | CDK6 | cyclin-dependent kinase 6 | 424848 | 981 | 397087 | 2142 | |
| CC/S | Chk1 | checkpoint kinase 1 | 278916 | 982 | 278916 | 2143 | |
| CC/S | Chk1 | checkpoint kinase 1 | 428830 | 983 | 412504 | 2144 | |
| CC/S | Chk1 | checkpoint kinase 1 | 438015 | 984 | 388648 | 2145 | |
| CC/S | Chk1 | checkpoint kinase 1 | 524737 | 985 | 432890 | 2146 | |
| CC/S | Chk1 | checkpoint kinase 1 | 525396 | 986 | 434141 | 2147 | |
| CC/S | Chk1 | checkpoint kinase 1 | 526937 | 987 | 431815 | 2148 | |
| CC/S | Chk1 | checkpoint kinase 1 | 527013 | 988 | 431525 | 2149 | |
| CC/S | Chk1 | checkpoint kinase 1 | 534070 | 989 | 435371 | 2150 | |
| CC/S | Chk1 | checkpoint kinase 1 | 534685 | 990 | 432470 | 2151 | |
| CC/S | Chk1 | checkpoint kinase 1 | 544373 | 991 | 442317 | 2152 | |

TABLE 6-continued

Oncology Related Targets

| Cat. | Target | Target Description | ENST ID | Trans. SEQ ID NO | ENSP ID | Prot. SEQ ID NO | OPT. SEQ ID NO |
|---|---|---|---|---|---|---|---|
| CC/S | Chk2 | checkpoint kinase 2 | 328354 | 992 | 329178 | 2153 | |
| CC/S | Chk2 | checkpoint kinase 2 | 348295 | 993 | 329012 | 2154 | |
| CC/S | Chk2 | checkpoint kinase 2 | 382563 | 994 | 372003 | 2155 | |
| CC/S | Chk2 | checkpoint kinase 2 | 382565 | 995 | 372006 | 2156 | |
| CC/S | Chk2 | checkpoint kinase 2 | 382566 | 996 | 372007 | 2157 | |
| CC/S | Chk2 | checkpoint kinase 2 | 382578 | 997 | 372021 | 2158 | |
| CC/S | Chk2 | checkpoint kinase 2 | 382580 | 998 | 372023 | 2159 | |
| CC/S | Chk2 | checkpoint kinase 2 | 402731 | 999 | 384835 | 2160 | |
| CC/S | Chk2 | checkpoint kinase 2 | 403642 | 1000 | 384919 | 2161 | |
| CC/S | Chk2 | checkpoint kinase 2 | 404276 | 1001 | 385747 | 2162 | |
| CC/S | Chk2 | checkpoint kinase 2 | 405598 | 1002 | 386087 | 2163 | |
| CC/S | Chk2 | checkpoint kinase 2 | 544772 | 1003 | 442458 | 2164 | |
| CC/S | Claspin | claspin | 251195 | 1004 | 251195 | 2165 | |
| CC/S | Claspin | claspin | 318121 | 1005 | 312995 | 2166 | |
| CC/S | Claspin | claspin | 373220 | 1006 | 362317 | 2167 | |
| CC/S | Claspin | claspin | 544356 | 1007 | 442335 | 2168 | |
| CC/S | Cyclin A | cyclin A2 | 274026 | 1008 | 274026 | 2169 | |
| CC/S | Cyclin B | cyclin B1 | 256442 | 1009 | 256442 | 2170 | |
| CC/S | Cyclin B | cyclin B3 | 276014 | 1010 | 276014 | 2171 | |
| CC/S | Cyclin B | cyclin B2 | 288207 | 1011 | 288207 | 2172 | |
| CC/S | Cyclin B | cyclin B3 | 348603 | 1012 | 338682 | 2173 | |
| CC/S | Cyclin B | cyclin B3 | 376038 | 1013 | 365206 | 2174 | |
| CC/S | Cyclin B | cyclin B3 | 376042 | 1014 | 365210 | 2175 | |
| CC/S | Cyclin B | cyclin B3 | 396540 | 1015 | 379790 | 2176 | |
| CC/S | Cyclin B | cyclin B1 | 505500 | 1016 | 424588 | 2177 | |
| CC/S | Cyclin B | cyclin B1 | 506572 | 1017 | 423387 | 2178 | |
| CC/S | Cyclin D | cyclin D1 | 227507 | 1018 | 227507 | 2179 | |
| CC/S | Cyclin D | cyclin D2 | 261254 | 1019 | 261254 | 2180 | |
| CC/S | Cyclin D | cyclin D3 | 372987 | 1020 | 362078 | 2181 | |
| CC/S | Cyclin D | cyclin D3 | 372988 | 1021 | 362079 | 2182 | |
| CC/S | Cyclin D | cyclin D3 | 372991 | 1022 | 362082 | 2183 | |
| CC/S | Cyclin D | cyclin D3 | 414200 | 1023 | 397545 | 2184 | |
| CC/S | Cyclin D | cyclin D3 | 415497 | 1024 | 401595 | 2185 | |
| CC/S | Cyclin D | cyclin D3 | 505064 | 1025 | 425830 | 2186 | |
| CC/S | Cyclin D | cyclin D3 | 511642 | 1026 | 426212 | 2187 | |
| CC/S | Cyclin D | cyclin D1 | 542897 | 1027 | 441863 | 2188 | |
| CC/S | Cyclin E | cyclin E1 | 262643 | 1028 | 262643 | 2189 | |
| CC/S | Cyclin E | cyclin E2 | 308108 | 1029 | 309181 | 2190 | |
| CC/S | Cyclin E | cyclin E1 | 357943 | 1030 | 350625 | 2191 | |
| CC/S | Cyclin E | cyclin E2 | 396133 | 1031 | 379437 | 2192 | |
| CC/S | Cyclin E | cyclin E1 | 444983 | 1032 | 410179 | 2193 | |
| CC/S | Cyclin E | cyclin E2 | 520509 | 1033 | 429089 | 2194 | |
| CC/S | Cyclin E | cyclin E2 | 542725 | 1034 | 445726 | 2195 | |
| CC/S | DNA-PK | protein kinase, DNA-activated, catalytic polypeptide | 314191 | 1035 | 313420 | 2196 | |
| CC/S | DNA-PK | protein kinase, DNA-activated, catalytic polypeptide | 338368 | 1036 | 345182 | 2197 | |
| CC/S | E2F1/2/3/4/5/6 | E2F transcription factor 5, p130-binding | 256117 | 1037 | 256117 | 2198 | |
| CC/S | E2F1/2/3/4/5/6 | E2F transcription factor 6 | 307236 | 1038 | 302159 | 2199 | |
| CC/S | E2F1/2/3/4/5/6 | E2F transcription factor 1 | 343380 | 1039 | 345571 | 2200 | |
| CC/S | E2F1/2/3/4/5/6 | E2F transcription factor 3 | 346618 | 1040 | 262904 | 2201 | |
| CC/S | E2F1/2/3/4/5/6 | E2F transcription factor 2 | 361729 | 1041 | 355249 | 2202 | |
| CC/S | E2F1/2/3/4/5/6 | E2F transcription factor 6 | 362009 | 1042 | 355036 | 2203 | |
| CC/S | E2F1/2/3/4/5/6 | E2F transcription factor 3 | 378646 | 1043 | 367914 | 2204 | |
| CC/S | E2F1/2/3/4/5/6 | E2F transcription factor 4, p107/p130-binding | 379378 | 1044 | 368686 | 2205 | |
| CC/S | E2F1/2/3/4/5/6 | E2F transcription factor 6 | 381525 | 1045 | 370936 | 2206 | |
| CC/S | E2F1/2/3/4/5/6 | E2F transcription factor 5, p130-binding | 416274 | 1046 | 398124 | 2207 | |
| CC/S | E2F1/2/3/4/5/6 | E2F transcription factor 5, p130-binding | 418930 | 1047 | 414312 | 2208 | |
| CC/S | E2F1/2/3/4/5/6 | E2F transcription factor 5, p130-binding | 517476 | 1048 | 429120 | 2209 | |
| CC/S | E2F1/2/3/4/5/6 | E2F transcription factor 5, p130-binding | 518234 | 1049 | 429669 | 2210 | |

TABLE 6-continued

Oncology Related Targets

| Cat. | Target | Target Description | ENST ID | Trans. SEQ ID NO | ENSP ID | Prot. SEQ ID NO | OPT. SEQ ID NO |
|---|---|---|---|---|---|---|---|
| CC/S | E2F1/2/3/4/5/6 | E2F transcription factor 3 | 535432 | 1050 | 443418 | 2211 | |
| CC/S | E2F1/2/3/4/5/6 | E2F transcription factor 6 | 542100 | 1051 | 446315 | 2212 | |
| CC/S | E2F1/2/3/4/5/6 | E2F transcription factor 6 | 546212 | 1052 | 438864 | 2213 | |
| CC/S | FANCD2 | Fanconi anemia, complementation group D2 | 287647 | 1053 | 287647 | 2214 | |
| CC/S | FANCD2 | Fanconi anemia, complementation group D2 | 383806 | 1054 | 373317 | 2215 | |
| CC/S | FANCD2 | Fanconi anemia, complementation group D2 | 383807 | 1055 | 373318 | 2216 | |
| CC/S | FANCD2 | Fanconi anemia, complementation group D2 | 419585 | 1056 | 398754 | 2217 | |
| CC/S | FANCL | Fanconi anemia, complementation group L | 233741 | 1057 | 233741 | 2218 | |
| CC/S | FANCL | Fanconi anemia, complementation group L | 540646 | 1058 | 441431 | 2219 | |
| CC/S | GADD45 alpha | growth arrest and DNA-damage-inducible, alpha | 370986 | 1059 | 360025 | 2220 | |
| CC/S | GADD45 beta | growth arrest and DNA-damage-inducible, beta | 215631 | 1060 | 215631 | 2221 | |
| CC/S | GADD45 beta | growth arrest and DNA-damage-inducible, alpha | 370985 | 1061 | 360024 | 2222 | |
| CC/S | MDM2 | Mdm2 p53 binding protein homolog (mouse) | 258148 | 1062 | 258148 | 2223 | |
| CC/S | MDM2 | Mdm2 p53 binding protein homolog (mouse) | 258149 | 1063 | 258149 | 2224 | |
| CC/S | MDM2 | Mdm2 p53 binding protein homolog (mouse) | 299252 | 1064 | 299252 | 2225 | |
| CC/S | MDM2 | Mdm2 p53 binding protein homolog (mouse) | 311420 | 1065 | 310742 | 2226 | |
| CC/S | MDM2 | Mdm2 p53 binding protein homolog (mouse) | 311440 | 1066 | 311302 | 2227 | |
| CC/S | MDM2 | Mdm2 p53 binding protein homolog (mouse) | 348801 | 1067 | 335096 | 2228 | |
| CC/S | MDM2 | Mdm2 p53 binding protein homolog (mouse) | 350057 | 1068 | 266624 | 2229 | |
| CC/S | MDM2 | Mdm2 p53 binding protein homolog (mouse) | 356290 | 1069 | 348637 | 2230 | |
| CC/S | MDM2 | Mdm2 p53 binding protein homolog (mouse) | 358483 | 1070 | 351270 | 2231 | |
| CC/S | MDM2 | Mdm2 p53 binding protein homolog (mouse) | 360430 | 1071 | 353611 | 2232 | |
| CC/S | MDM2 | Mdm2 p53 binding protein homolog (mouse) | 393410 | 1072 | 377062 | 2233 | |
| CC/S | MDM2 | Mdm2 p53 binding protein homolog (mouse) | 393412 | 1073 | 377064 | 2234 | |
| CC/S | MDM2 | Mdm2 p53 binding protein homolog (mouse) | 393413 | 1074 | 377065 | 2235 | |
| CC/S | MDM2 | Mdm2 p53 binding protein homolog (mouse) | 393415 | 1075 | 377067 | 2236 | |
| CC/S | MDM2 | Mdm2 p53 binding protein homolog (mouse) | 428863 | 1076 | 410694 | 2237 | |
| CC/S | MDM2 | Mdm2 p53 binding protein homolog (mouse) | 462284 | 1077 | 417281 | 2238 | |
| CC/S | MDM2 | Mdm2 p53 binding protein homolog (mouse) | 517852 | 1078 | 430257 | 2239 | |
| CC/S | MDM2 | Mdm2 p53 binding protein homolog (mouse) | 539479 | 1079 | 444430 | 2240 | |
| CC/S | MDM2 | Mdm2 p53 binding protein homolog (mouse) | 540827 | 1080 | 440932 | 2241 | |
| CC/S | MDM2 | Mdm2 p53 binding protein homolog (mouse) | 544648 | 1081 | 443274 | 2242 | |
| CC/S | NFBD1 | mediator of DNA-damage checkpoint 1 | 376405 | 1082 | 365587 | 2243 | |
| CC/S | NFBD1 | mediator of DNA-damage checkpoint 1 | 376406 | 1083 | 365588 | 2244 | |
| CC/S | NFBD1 | mediator of DNA-damage checkpoint 1 | 383566 | 1084 | 373060 | 2245 | |
| CC/S | NFBD1 | mediator of DNA-damage checkpoint 1 | 412395 | 1085 | 392833 | 2246 | |

TABLE 6-continued

Oncology Related Targets

| Cat. | Target | Target Description | ENST ID | Trans. SEQ ID NO | ENSP ID | Prot. SEQ ID NO | OPT. SEQ ID NO |
|---|---|---|---|---|---|---|---|
| CC/S | NFBD1 | mediator of DNA-damage checkpoint 1 | 413973 | 1086 | 408831 | 2247 | |
| CC/S | NFBD1 | mediator of DNA-damage checkpoint 1 | 416368 | 1087 | 410383 | 2248 | |
| CC/S | NFBD1 | mediator of DNA-damage checkpoint 1 | 416571 | 1088 | 400979 | 2249 | |
| CC/S | NFBD1 | mediator of DNA-damage checkpoint 1 | 417033 | 1089 | 408962 | 2250 | |
| CC/S | NFBD1 | mediator of DNA-damage checkpoint 1 | 417228 | 1090 | 400305 | 2251 | |
| CC/S | NFBD1 | mediator of DNA-damage checkpoint 1 | 419172 | 1091 | 398474 | 2252 | |
| CC/S | NFBD1 | mediator of DNA-damage checkpoint 1 | 419675 | 1092 | 397642 | 2253 | |
| CC/S | NFBD1 | mediator of DNA-damage checkpoint 1 | 420019 | 1093 | 396484 | 2254 | |
| CC/S | NFBD1 | mediator of DNA-damage checkpoint 1 | 420320 | 1094 | 416511 | 2255 | |
| CC/S | NFBD1 | mediator of DNA-damage checkpoint 1 | 422104 | 1095 | 390375 | 2256 | |
| CC/S | NFBD1 | mediator of DNA-damage checkpoint 1 | 422195 | 1096 | 407703 | 2257 | |
| CC/S | NFBD1 | mediator of DNA-damage checkpoint 1 | 422266 | 1097 | 411310 | 2258 | |
| CC/S | NFBD1 | mediator of DNA-damage checkpoint 1 | 423726 | 1098 | 391230 | 2259 | |
| CC/S | NFBD1 | mediator of DNA-damage checkpoint 1 | 424437 | 1099 | 398151 | 2260 | |
| CC/S | NFBD1 | mediator of DNA-damage checkpoint 1 | 424507 | 1100 | 388355 | 2261 | |
| CC/S | NFBD1 | mediator of DNA-damage checkpoint 1 | 424638 | 1101 | 394074 | 2262 | |
| CC/S | NFBD1 | mediator of DNA-damage checkpoint 1 | 425029 | 1102 | 397126 | 2263 | |
| CC/S | NFBD1 | mediator of DNA-damage checkpoint 1 | 425072 | 1103 | 396989 | 2264 | |
| CC/S | NFBD1 | mediator of DNA-damage checkpoint 1 | 425790 | 1104 | 397021 | 2265 | |
| CC/S | NFBD1 | mediator of DNA-damage checkpoint 1 | 427406 | 1105 | 387429 | 2266 | |
| CC/S | NFBD1 | mediator of DNA-damage checkpoint 1 | 429610 | 1106 | 406850 | 2267 | |
| CC/S | NFBD1 | mediator of DNA-damage checkpoint 1 | 430358 | 1107 | 414163 | 2268 | |
| CC/S | NFBD1 | mediator of DNA-damage checkpoint 1 | 431441 | 1108 | 392784 | 2269 | |
| CC/S | NFBD1 | mediator of DNA-damage checkpoint 1 | 432998 | 1109 | 405991 | 2270 | |
| CC/S | NFBD1 | mediator of DNA-damage checkpoint 1 | 435664 | 1110 | 404318 | 2271 | |
| CC/S | NFBD1 | mediator of DNA-damage checkpoint 1 | 435797 | 1111 | 400677 | 2272 | |
| CC/S | NFBD1 | mediator of DNA-damage checkpoint 1 | 437759 | 1112 | 387743 | 2273 | |
| CC/S | NFBD1 | mediator of DNA-damage checkpoint 1 | 438165 | 1113 | 387706 | 2274 | |
| CC/S | NFBD1 | mediator of DNA-damage checkpoint 1 | 440369 | 1114 | 415212 | 2275 | |
| CC/S | NFBD1 | mediator of DNA-damage checkpoint 1 | 441397 | 1115 | 390489 | 2276 | |
| CC/S | NFBD1 | mediator of DNA-damage checkpoint 1 | 444412 | 1116 | 413610 | 2277 | |
| CC/S | NFBD1 | mediator of DNA-damage checkpoint 1 | 445130 | 1117 | 396124 | 2278 | |
| CC/S | NFBD1 | mediator of DNA-damage checkpoint 1 | 445764 | 1118 | 393886 | 2279 | |
| CC/S | NFBD1 | mediator of DNA-damage checkpoint 1 | 447192 | 1119 | 405806 | 2280 | |
| CC/S | NFBD1 | mediator of DNA-damage checkpoint 1 | 447640 | 1120 | 396389 | 2281 | |

TABLE 6-continued

Oncology Related Targets

| Cat. | Target | Target Description | ENST ID | Trans. SEQ ID NO | ENSP ID | Prot. SEQ ID NO | OPT. SEQ ID NO |
|---|---|---|---|---|---|---|---|
| CC/S | NFBD1 | mediator of DNA-damage checkpoint 1 | 448895 | 1121 | 396121 | 2282 | |
| CC/S | NFBD1 | mediator of DNA-damage checkpoint 1 | 449153 | 1122 | 409167 | 2283 | |
| CC/S | NFBD1 | mediator of DNA-damage checkpoint 1 | 450033 | 1123 | 390040 | 2284 | |
| CC/S | NFBD1 | mediator of DNA-damage checkpoint 1 | 452213 | 1124 | 404936 | 2285 | |
| CC/S | NFBD1 | mediator of DNA-damage checkpoint 1 | 455729 | 1125 | 404954 | 2286 | |
| CC/S | NFBD1 | mediator of DNA-damage checkpoint 1 | 456589 | 1126 | 405350 | 2287 | |
| CC/S | NFBD1 | mediator of DNA-damage checkpoint 1 | 546487 | 1127 | 448679 | 2288 | |
| CC/S | NFBD1 | mediator of DNA-damage checkpoint 1 | 546539 | 1128 | 448232 | 2289 | |
| CC/S | NFBD1 | mediator of DNA-damage checkpoint 1 | 547047 | 1129 | 449059 | 2290 | |
| CC/S | NFBD1 | mediator of DNA-damage checkpoint 1 | 547353 | 1130 | 447883 | 2291 | |
| CC/S | NFBD1 | mediator of DNA-damage checkpoint 1 | 547681 | 1131 | 447851 | 2292 | |
| CC/S | NFBD1 | mediator of DNA-damage checkpoint 1 | 547700 | 1132 | 449083 | 2293 | |
| CC/S | NFBD1 | mediator of DNA-damage checkpoint 1 | 547874 | 1133 | 447682 | 2294 | |
| CC/S | NFBD1 | mediator of DNA-damage checkpoint 1 | 548103 | 1134 | 449499 | 2295 | |
| CC/S | NFBD1 | mediator of DNA-damage checkpoint 1 | 548112 | 1135 | 448434 | 2296 | |
| CC/S | NFBD1 | mediator of DNA-damage checkpoint 1 | 548248 | 1136 | 448080 | 2297 | |
| CC/S | NFBD1 | mediator of DNA-damage checkpoint 1 | 548433 | 1137 | 449971 | 2298 | |
| CC/S | NFBD1 | mediator of DNA-damage checkpoint 1 | 548542 | 1138 | 446597 | 2299 | |
| CC/S | NFBD1 | mediator of DNA-damage checkpoint 1 | 548805 | 1139 | 446924 | 2300 | |
| CC/S | NFBD1 | mediator of DNA-damage checkpoint 1 | 548827 | 1140 | 449201 | 2301 | |
| CC/S | NFBD1 | mediator of DNA-damage checkpoint 1 | 548893 | 1141 | 447943 | 2302 | |
| CC/S | NFBD1 | mediator of DNA-damage checkpoint 1 | 548947 | 1142 | 447711 | 2303 | |
| CC/S | NFBD1 | mediator of DNA-damage checkpoint 1 | 549228 | 1143 | 447517 | 2304 | |
| CC/S | NFBD1 | mediator of DNA-damage checkpoint 1 | 549382 | 1144 | 449177 | 2305 | |
| CC/S | NFBD1 | mediator of DNA-damage checkpoint 1 | 549428 | 1145 | 447038 | 2306 | |
| CC/S | NFBD1 | mediator of DNA-damage checkpoint 1 | 549771 | 1146 | 448812 | 2307 | |
| CC/S | NFBD1 | mediator of DNA-damage checkpoint 1 | 550004 | 1147 | 447084 | 2308 | |
| CC/S | NFBD1 | mediator of DNA-damage checkpoint 1 | 550110 | 1148 | 446980 | 2309 | |
| CC/S | NFBD1 | mediator of DNA-damage checkpoint 1 | 550210 | 1149 | 447697 | 2310 | |
| CC/S | NFBD1 | mediator of DNA-damage checkpoint 1 | 550408 | 1150 | 447136 | 2311 | |
| CC/S | NFBD1 | mediator of DNA-damage checkpoint 1 | 550500 | 1151 | 450002 | 2312 | |
| CC/S | NFBD1 | mediator of DNA-damage checkpoint 1 | 550688 | 1152 | 448066 | 2313 | |
| CC/S | NFBD1 | mediator of DNA-damage checkpoint 1 | 551204 | 1153 | 447799 | 2314 | |
| CC/S | NFBD1 | mediator of DNA-damage checkpoint 1 | 551267 | 1154 | 450198 | 2315 | |
| CC/S | NFBD1 | mediator of DNA-damage checkpoint 1 | 551460 | 1155 | 449274 | 2316 | |
| CC/S | NFBD1 | mediator of DNA-damage checkpoint 1 | 551554 | 1156 | 448538 | 2317 | |

TABLE 6-continued

Oncology Related Targets

| Cat. | Target | Target Description | ENST ID | Trans. SEQ ID NO | ENSP ID | Prot. SEQ ID NO | OPT. SEQ ID NO |
|---|---|---|---|---|---|---|---|
| CC/S | NFBD1 | mediator of DNA-damage checkpoint 1 | 551621 | 1157 | 448285 | 2318 | |
| CC/S | NFBD1 | mediator of DNA-damage checkpoint 1 | 551740 | 1158 | 450037 | 2319 | |
| CC/S | NFBD1 | mediator of DNA-damage checkpoint 1 | 552263 | 1159 | 447069 | 2320 | |
| CC/S | NFBD1 | mediator of DNA-damage checkpoint 1 | 552349 | 1160 | 449892 | 2321 | |
| CC/S | NFBD1 | mediator of DNA-damage checkpoint 1 | 552474 | 1161 | 447771 | 2322 | |
| CC/S | NFBD1 | mediator of DNA-damage checkpoint 1 | 552522 | 1162 | 449936 | 2323 | |
| CC/S | NFBD1 | mediator of DNA-damage checkpoint 1 | 552776 | 1163 | 447825 | 2324 | |
| CC/S | NFBD1 | mediator of DNA-damage checkpoint 1 | 553047 | 1164 | 447247 | 2325 | |
| CC/S | NFBD1 | mediator of DNA-damage checkpoint 1 | 553048 | 1165 | 447787 | 2326 | |
| CC/S | NFBD1 | mediator of DNA-damage checkpoint 1 | 553130 | 1166 | 446809 | 2327 | |
| CC/S | NFBD1 | mediator of DNA-damage checkpoint 1 | 553196 | 1167 | 449586 | 2328 | |
| CC/S | Nibrin | nibrin | 265433 | 1168 | 265433 | 2329 | |
| CC/S | Nibrin | nibrin | 452387 | 1169 | 445213 | 2330 | |
| CC/S | p107 | retinoblastoma-like 1 (p107) | 344359 | 1170 | 343646 | 2331 | |
| CC/S | p107 | retinoblastoma-like 1 (p107) | 373664 | 1171 | 362768 | 2332 | |
| CC/S | p130 | retinoblastoma-like 2 (p130) | 262133 | 1172 | 262133 | 2333 | |
| CC/S | p130 | retinoblastoma-like 2 (p130) | 379935 | 1173 | 369267 | 2334 | |
| CC/S | p130 | retinoblastoma-like 2 (p130) | 544405 | 1174 | 443744 | 2335 | |
| CC/S | p130 | retinoblastoma-like 2 (p130) | 544545 | 1175 | 444685 | 2336 | |
| CC/S | p21 | P21 | NA | 1176 | NA | 2337 | |
| CC/S | PCNA | proliferating cell nuclear antigen | 379143 | 1177 | 368438 | 2338 | |
| CC/S | PCNA | proliferating cell nuclear antigen | 379160 | 1178 | 368458 | 2339 | |
| CC/S | RAD9 | RAD9 homolog A (S. pombe) | 307980 | 1179 | 311360 | 2340 | |
| CC/S | Rb protein | retinoblastoma 1 | 267163 | 1180 | 267163 | 2341 | |
| CC/S | Rb protein | retinoblastoma 1 | 467505 | 1181 | 434702 | 2342 | |
| CC/S | Rb protein | retinoblastoma 1 | 542917 | 1182 | 437642 | 2343 | |
| CC/S | SMC1 | structural maintenance of chromosomes 1A | 322213 | 1183 | 323421 | 2344 | |
| CC/S | SMC1 | structural maintenance of chromosomes 1A | 340213 | 1184 | 344906 | 2345 | |
| CC/S | SMC1 | structural maintenance of chromosomes 1A | 375340 | 1185 | 364489 | 2346 | |
| CC/S | SMC1 | structural maintenance of chromosomes 1A | 428014 | 1186 | 413509 | 2347 | |
| CC/S | USP1 | ubiquitin specific peptidase 1 | 339950 | 1187 | 343526 | 2348 | |
| CC/S | USP1 | ubiquitin specific peptidase 1 | 371146 | 1188 | 360188 | 2349 | |
| CC/S | USP1 | ubiquitin specific peptidase 1 | 452143 | 1189 | 403662 | 2350 | |
| M | 4EBP-1 | eukaryotic translation initiation factor 4E binding protein 1 | 338825 | 1190 | 340691 | 2351 | |
| M | ARNT | aryl hydrocarbon receptor nuclear translocator | 354396 | 1191 | 346372 | 2352 | |
| M | ARNT | aryl hydrocarbon receptor nuclear translocator | 358595 | 1192 | 351407 | 2353 | |
| M | ARNT | aryl hydrocarbon receptor nuclear translocator | 368975 | 1193 | 357971 | 2354 | |
| M | ARNT | aryl hydrocarbon receptor nuclear translocator | 394700 | 1194 | 378190 | 2355 | |
| M | ARNT | aryl hydrocarbon receptor nuclear translocator | 471844 | 1195 | 425899 | 2356 | |
| M | ARNT | aryl hydrocarbon receptor nuclear translocator | 505755 | 1196 | 427571 | 2357 | |
| M | ARNT | aryl hydrocarbon receptor nuclear translocator | 515192 | 1197 | 423851 | 2358 | |
| M | CAIX | carbonic anhydrase IX | 378357 | 1198 | 367608 | 2359 | |
| M | CAIX | carbonic anhydrase IX | 544074 | 1199 | 438541 | 2360 | |
| M | CBP | CREB binding protein | 262367 | 1200 | 262367 | 2361 | |
| M | CBP | CREB binding protein | 323508 | 1201 | 323550 | 2362 | |

TABLE 6-continued

Oncology Related Targets

| Cat. | Target | Target Description | ENST ID | Trans. SEQ ID NO | ENSP ID | Prot. SEQ ID NO | OPT. SEQ ID NO |
|---|---|---|---|---|---|---|---|
| M | CBP | CREB binding protein | 382070 | 1202 | 371502 | 2363 | |
| M | CBP | CREB binding protein | 543883 | 1203 | 441978 | 2364 | |
| M | CITED1 | Cbp/p300-interacting transactivator, with Glu/Asp-rich carboxy-terminal domain, 1 | 246139 | 1204 | 246139 | 2365 | |
| M | CITED1 | Cbp/p300-interacting transactivator, with Glu/Asp-rich carboxy-terminal domain, 1 | 373619 | 1205 | 362721 | 2366 | |
| M | CITED1 | Cbp/p300-interacting transactivator, with Glu/Asp-rich carboxy-terminal domain, 1 | 417400 | 1206 | 414781 | 2367 | |
| M | CITED1 | Cbp/p300-interacting transactivator, with Glu/Asp-rich carboxy-terminal domain, 1 | 427412 | 1207 | 391407 | 2368 | |
| M | CITED1 | Cbp/p300-interacting transactivator, with Glu/Asp-rich carboxy-terminal domain, 1 | 429794 | 1208 | 407496 | 2369 | |
| M | CITED1 | Cbp/p300-interacting transactivator, with Glu/Asp-rich carboxy-terminal domain, 1 | 431381 | 1209 | 388548 | 2370 | |
| M | CITED1 | Cbp/p300-interacting transactivator, with Glu/Asp-rich carboxy-terminal domain, 1 | 445983 | 1210 | 403274 | 2371 | |
| M | CITED1 | Cbp/p300-interacting transactivator, with Glu/Asp-rich carboxy-terminal domain, 1 | 450875 | 1211 | 405765 | 2372 | |
| M | CITED1 | Cbp/p300-interacting transactivator, with Glu/Asp-rich carboxy-terminal domain, 1 | 453707 | 1212 | 401764 | 2373 | |
| M | CITED2 | Cbp/p300-interacting transactivator, with Glu/Asp-rich carboxy-terminal domain, 2 | 367651 | 1213 | 356623 | 2374 | |
| M | CITED2 | Cbp/p300-interacting transactivator, with Glu/Asp-rich carboxy-terminal domain, 2 | 392312 | 1214 | 376126 | 2375 | |
| M | CITED2 | Cbp/p300-interacting transactivator, with Glu/Asp-rich carboxy-terminal domain, 2 | 536159 | 1215 | 442831 | 2376 | |
| M | CITED2 | Cbp/p300-interacting transactivator, with Glu/Asp-rich carboxy-terminal domain, 2 | 537332 | 1216 | 444198 | 2377 | |
| M | CITED4 | Cbp/p300-interacting transactivator, with Glu/Asp-rich carboxy-terminal domain, 4 | NA | 1217 | NA | 2378 | |
| M | CITED4 | Cbp/p300-interacting transactivator, with Glu/Asp-rich carboxy-terminal domain, 4 (CBP/p300 interacting transactivator with ED-rich tail) | 372638 | 1218 | 361721 | 2379 | |
| M | COMMD1 | copper metabolism (Murr1) domain containing 1 | 311832 | 1219 | 308236 | 2380 | |
| M | COMMD1 | copper metabolism (Murr1) domain containing 1 | 427417 | 1220 | 413207 | 2381 | |
| M | COMMD1 | copper metabolism (Murr1) domain containing 1 | 444166 | 1221 | 410050 | 2382 | |
| M | COMMD1 | copper metabolism (Murr1) domain containing 1 | 458337 | 1222 | 401236 | 2383 | |
| M | COMMD1 | copper metabolism (Murr1) domain containing 1 | 538736 | 1223 | 438961 | 2384 | |
| M | CREB | cAMP responsive element binding protein 1 | 236996 | 1224 | 236996 | 2385 | |
| M | CREB | cAMP responsive element binding protein 1 | 353267 | 1225 | 236995 | 2386 | |
| M | CREB | cAMP responsive element binding protein 3 | 353704 | 1226 | 342136 | 2387 | |
| M | CREB | cAMP responsive element binding protein 1 | 374397 | 1227 | 363518 | 2388 | |
| M | CREB | cAMP responsive element binding protein 1 | 430624 | 1228 | 405539 | 2389 | |
| M | CREB | cAMP responsive element binding protein 1 | 432329 | 1229 | 387699 | 2390 | |

TABLE 6-continued

Oncology Related Targets

| Cat. | Target | Target Description | ENST ID | Trans. SEQ ID NO | ENSP ID | Prot. SEQ ID NO | OPT. SEQ ID NO |
|---|---|---|---|---|---|---|---|
| M | CREB | cAMP responsive element binding protein 1 | 445803 | 1230 | 407227 | 2391 | |
| M | CREB | cAMP responsive element binding protein 1 | 452474 | 1231 | 392428 | 2392 | |
| M | CREB | cAMP responsive element binding protein 1 | 536726 | 1232 | 445892 | 2393 | |
| M | CREB | cAMP responsive element binding protein 1 | 539789 | 1233 | 440809 | 2394 | |
| M | eIF4E | eukaryotic translation initiation factor 4E | 280892 | 1234 | 280892 | 2395 | |
| M | eIF4E | eukaryotic translation initiation factor 4E | 450253 | 1235 | 389624 | 2396 | |
| M | HIF3-alpha | hypoxia inducible factor 3, alpha subunit | 244302 | 1236 | 244302 | 2397 | |
| M | HIF3-alpha | hypoxia inducible factor 3, alpha subunit | 291300 | 1237 | 291300 | 2398 | |
| M | FIH | hypoxia inducible factor 1, alpha subunit inhibitor (factor inhibiting HIF) | 299163 | 1238 | 299163 | 2399 | |
| M | HIF3-alpha) | hypoxia inducible factor 3, alpha subunit | 300862 | 1239 | 300862 | 2400 | |
| M | HIF3-alpha | hypoxia inducible factor 3, alpha subunit | 339613 | 1240 | 341877 | 2401 | |
| M | HIF3-alpha | hypoxia inducible factor 3, alpha subunit | 377670 | 1241 | 366898 | 2402 | |
| M | HIF3-alpha | hypoxia inducible factor 3, alpha subunit | 414707 | 1242 | 412808 | 2403 | |
| M | HIF3-alpha | hypoxia inducible factor 3, alpha subunit | 420102 | 1243 | 407771 | 2404 | |
| M | FIH (factor inhibiting HIF) | hypoxia inducible factor 1, alpha subunit inhibitor | 442724 | 1244 | 399734 | 2405 | |
| M | HIF3-alpha | hypoxia inducible factor 3, alpha subunit | 457771 | 1245 | 408008 | 2406 | |
| M | HIF3-alpha | hypoxia inducible factor 3, alpha subunit | 457865 | 1246 | 394052 | 2407 | |
| M | HIF3-alpha | hypoxia inducible factor 3, alpha subunit | 475432 | 1247 | 432578 | 2408 | |
| M | FIH (factor inhibiting HIF) | hypoxia inducible factor 1, alpha subunit inhibitor | 533589 | 1248 | 433360 | 2409 | |
| M | Grb2 | growth factor receptor-bound protein 2 | 316615 | 1249 | 317360 | 2410 | |
| M | Grb2 | growth factor receptor-bound protein 2 | 316804 | 1250 | 339007 | 2411 | |
| M | Grb2 | growth factor receptor-bound protein 2 | 392562 | 1251 | 376345 | 2412 | |
| M | Grb2 | growth factor receptor-bound protein 2 | 392564 | 1252 | 376347 | 2413 | |
| M | HNF4alpha | hepatocyte nuclear factor 4, alpha | 316099 | 1253 | 312987 | 2414 | |
| M | HNF4alpha | hepatocyte nuclear factor 4, alpha | 316673 | 1254 | 315180 | 2415 | |
| M | HNF4alpha | hepatocyte nuclear factor 4, alpha | 338692 | 1255 | 343807 | 2416 | |
| M | HNF4alpha | hepatocyte nuclear factor 4, alpha | 415691 | 1256 | 412111 | 2417 | |
| M | HNF4alpha | hepatocyte nuclear factor 4, alpha | 443598 | 1257 | 410911 | 2418 | |
| M | HNF4alpha | hepatocyte nuclear factor 4, alpha | 457232 | 1258 | 396216 | 2419 | |
| M | HNF4alpha2 | Homo sapiens hepatocyte nuclear factor 4, alpha (HNF4A), transcript variant 2, mRNA | NA | 1259 | NA | 2420 | |
| M | IBP3 | insulin-like growth factor binding protein 3 | 275521 | 1260 | 275521 | 2421 | |
| M | IBP3 | insulin-like growth factor binding protein 3 | 381083 | 1261 | 370473 | 2422 | |
| M | IBP3 | insulin-like growth factor binding protein 3 | 381086 | 1262 | 370476 | 2423 | |

TABLE 6-continued

Oncology Related Targets

| Cat. | Target | Target Description | ENST ID | Trans. SEQ ID NO | ENSP ID | Prot. SEQ ID NO | OPT. SEQ ID NO |
|---|---|---|---|---|---|---|---|
| M | IBP3 | insulin-like growth factor binding protein 3 | 417621 | 1263 | 399116 | 2424 | |
| M | IBP3 | insulin-like growth factor binding protein 3 | 428530 | 1264 | 390298 | 2425 | |
| M | IBP3 | insulin-like growth factor binding protein 3 | 433047 | 1265 | 404461 | 2426 | |
| M | IBP3 | insulin-like growth factor binding protein 3 | 438491 | 1266 | 393740 | 2427 | |
| M | IBP3 | insulin-like growth factor binding protein 3 | 442142 | 1267 | 392472 | 2428 | |
| M | IBP3 | insulin-like growth factor binding protein 3 | 545032 | 1268 | 439999 | 2429 | |
| M | JAB1 | COP9 constitutive photomorphogenic homolog subunit 5 (Arabidopsis) | 357849 | 1269 | 350512 | 2430 | |
| M | MNK1 | MAP kinase interacting serine/threonine kinase 1 | 341183 | 1270 | 339573 | 2431 | |
| M | MNK1 | MAP kinase interacting serine/threonine kinase 1 | 371944 | 1271 | 361012 | 2432 | |
| M | MNK1 | MAP kinase interacting serine/threonine kinase 1 | 371945 | 1272 | 361013 | 2433 | |
| M | MNK1 | MAP kinase interacting serine/threonine kinase 1 | 371946 | 1273 | 361014 | 2434 | |
| M | MNK1 | MAP kinase interacting serine/threonine kinase 1 | 428112 | 1274 | 411135 | 2435 | |
| M | MNK1 | MAP kinase interacting serine/threonine kinase 1 | 496619 | 1275 | 436709 | 2436 | |
| M | MNK1 | MAP kinase interacting serine/threonine kinase 1 | 545730 | 1276 | 440974 | 2437 | |
| M | MNK2 | MAP kinase interacting serine/threonine kinase 2 | 250896 | 1277 | 250896 | 2438 | |
| M | MNK2 | MAP kinase interacting serine/threonine kinase 2 | 309340 | 1278 | 309485 | 2439 | |
| M | MNK2 | MAP kinase interacting serine/threonine kinase 2 | 541165 | 1279 | 438904 | 2440 | |
| M | MNK2 | MAP kinase interacting serine/threonine kinase 2 | 545627 | 1280 | 441245 | 2441 | |
| M | p15(INK4A) | cyclin-dependent kinase inhibitor 2B (p15, inhibits CDK4) | 276925 | 1281 | 276925 | 2442 | |
| M | p15(INK4A) | cyclin-dependent kinase inhibitor 2B (p15, inhibits CDK4) | 380142 | 1282 | 369487 | 2443 | |
| M | p300 | E1A binding protein p300 | 263253 | 1283 | 263253 | 2444 | |
| M | Per1 | period homolog 1 (Drosophila) | 317276 | 1284 | 314420 | 2445 | |
| M | Per1 | period homolog 1 (Drosophila) | 354903 | 1285 | 346979 | 2446 | |
| M | RPS6 | ribosomal protein S6 | 315377 | 1286 | 369743 | 2447 | |
| M | RPS6 | ribosomal protein S6 | 380381 | 1287 | 369741 | 2448 | |
| M | RPS6 | ribosomal protein S6 | 380384 | 1288 | 369745 | 2449 | |
| M | RPS6 | ribosomal protein S6 | 380394 | 1289 | 369757 | 2450 | |
| M | SHARP1 | basic helix-loop-helix family, member e41 | NA | 1290 | NA | 2451 | |
| M | SHARP1 (BHLHE41) | basic helix-loop-helix family, member e41 | 242728 | 1291 | 242728 | 2452 | |
| M | SHARP1 (BHLHE41) | basic helix-loop-helix family, member e41 | 540731 | 1292 | 437369 | 2453 | |
| M | SRC1 | nuclear receptor coactivator 1 | 288599 | 1293 | 288599 | 2454 | |
| M | SRC1 | nuclear receptor coactivator 1 | 348332 | 1294 | 320940 | 2455 | |
| M | SRC1 | nuclear receptor coactivator 1 | 395856 | 1295 | 379197 | 2456 | |
| M | SRC1 | nuclear receptor coactivator 1 | 405141 | 1296 | 385097 | 2457 | |
| M | SRC1 | nuclear receptor coactivator 1 | 406961 | 1297 | 385216 | 2458 | |
| M | SRC1 | nuclear receptor coactivator 1 | 538539 | 1298 | 444039 | 2459 | |
| M | tuberin | tuberous sclerosis 2 | 219476 | 1299 | 219476 | 2460 | |
| M | tuberin | tuberous sclerosis 2 | 350773 | 1300 | 344383 | 2461 | |
| M | tuberin | tuberous sclerosis 2 | 353929 | 1301 | 248099 | 2462 | |
| M | tuberin | tuberous sclerosis 2 | 382538 | 1302 | 371978 | 2463 | |
| M | tuberin | tuberous sclerosis 2 | 401874 | 1303 | 384468 | 2464 | |
| M | tuberin | tuberous sclerosis 2 | 439673 | 1304 | 399232 | 2465 | |
| | AIFSH | apoptosis-inducing factor, short | NA | 1305 | NA | 2466 | |
| | Angiopoietin1 | Angiopoietin 1 | NA | 1306 | NA | 2467 | 2492 |
| | BMP2 CO | BMP2 CO | NA | 1307 | NA | 2468 | 2493 |

TABLE 6-continued

Oncology Related Targets

| Cat. | Target | Target Description | ENST ID | Trans. SEQ ID NO | ENSP ID | Prot. SEQ ID NO | OPT. SEQ ID NO |
|---|---|---|---|---|---|---|---|
| | c-MYC | v-myc myelocytomatosis viral oncogene homolog (avian) | NA | 1308 | NA | 2469 | |
| | COMMD1 | COMMD1 | NA | 1309 | NA | | |
| | COMMD1 NES deleted | COMMD1 with nuclear export seqences deleted | NA | | NA | 2470 | |
| | COMMD1 NES1 deleted and NLS added | COMMD1 with nuclear export sequences deleted and nuclear localization signals added | NA | | NA | 2471 | |
| | COMMD1 SV40 NLS | COMMD1 with SV40 and nuclear localization signals | NA | | NA | 2472 | |
| | COMMD1wt | COMMD1 wild-type | NA | | NA | 2473 | |
| | GLUT1 | solute carrier family 2 (facilitated glucose transporter), member 1 | NA | 1310 | NA | 2474 | |
| | Granulysin FL15 | Granulysin FL15 | NA | 1311 | NA | 2475 | |
| | Granulysin NS9 | Granulysin NS9 | NA | | NA | 2476 | 2494 |
| | Granulysin S9 | Granulysin S9 | NA | | NA | 2477 | 2495 |
| | HIF1 a | hypoxia inducible factor 1, alpha subunit (basic helix-loop-helix transcription factor) | NA | 1312 | NA | 2478 | |
| | IL15 | interleukin 15 | NA | 1313 | NA | 2479 | |
| | KGF | fibroblast growth factor 7, precursor; mature is 32-194 | NA | 1314 | NA | 2480 | |
| | MCT4 | solute carrier family 16, member 4 (monocarboxylic acid transporter 5) | NA | 1315 | NA | 2481 | 2496 |
| | MYC inhibitor D | MYC inhibitor D (OMOMyc) | NA | 1316 | NA | 2482 | |
| | MYC inhibitor D_90 | MYC inhibitor D_90 (OmoMyc_90) | NA | | NA | 2483 | |
| | C.A. caspase 3_cleavable | Constitutively active (C.A.) caspase 3 cleavable (RevCasp3_Cleavable) | NA | 1317 | NA | 2484 | |
| | C.A. caspase 3_uncleavable | Constitutively active (C.A.) caspase 3 uncleavable (RevCasp3_UnCleavable) | NA | 1318 | NA | 2485 | |
| | C.A. caspase 6 | Constitutively active (C.A.) caspase 6 (RevCasp6) | NA | 1319 | NA | 2486 | |
| | SIAh1 | siah E3 ubiquitin protein ligase 1 | NA | 1320 | NA | 2487 | |
| | HSV1-tk | Herpes simplex virus 1-thymidine kinase | | | | | |

Shown in Table 7, are familiar cancer syndromes, tumor suppressor genes, function of the tumor suppressor gene, chromosomal location, and tumor type observed. Signal-sensor polynucleotides of the present invention can be designed as a therapeutic for any of those listed in the table.

TABLE 7

Familial Cancer Syndrome Targets

| Familial Cancer Syndrome | Tumor Suppressor Gene | Function | Chromosomal Location | Tumor Types Observed |
|---|---|---|---|---|
| Li-Fraumeni Syndrome | P53 | cell cycle regulation, apoptosis | 17p13.1 | brain tumors, sarcomas, leukemia, breast cancer |

TABLE 7-continued

Familial Cancer Syndrome Targets

| Familial Cancer Syndrome | Tumor Suppressor Gene | Function | Chromosomal Location | Tumor Types Observed |
|---|---|---|---|---|
| Familial Retinoblastoma | RB1 | cell cycle regulation | 13q14.1-q14.2 | retinoblastoma, osteogenic sarcoma |
| Wilms Tumor | WT1 | transcriptional regulation | 11p13 | pediatric kidney cancer, most common form of childhood solid tumor |
| Neurofibromatosis Type 1 | NF1 | catalysis of RAS inactivation | 17q11.2 | neurofibromas, sarcomas, gliomas |
| Neurofibromatosis Type 2 | NF2 | linkage of cell membrane to actin cytoskeleton | 22q12.2 | Schwann cell tumors, astrocytomas, meningiomas, ependymonas |
| Familial Adenomatous Polyposis | APC | signaling through adhesion molecules to nucleus | 5q21-q22 | colon cancer |
| Tuberous sclerosis 1 | TSC1 | forms complex with TSC2 protein, inhibits signaling to downstream effectors of mTOR | 9q34 | seizures, mental retardation, facial angiofibromas |
| Tuberous sclerosis 2 | TSC2 | forms complex with TSC1 protein, inhibits signaling to downstream effectors of mTOR | 16p13.3 | benign growths (hamartomas) in many tissues, astrocytomas, rhabdomyosarcomas |
| Deleted in Pancreatic Carcinoma 4, Familial juvenile polyposis syndrome | DPC4, also known as SMAD4 | regulation of TGF-β/BMP signal transduction | 18q21.1 | pancreatic carcinoma, colon cancer |
| Deleted in Colorectal Carcinoma | DCC | transmembrane receptor involved in axonal guidance via netrins | 18q21.3 | colorectal cancer |
| Familial Breast Cancer | BRCA1 | functions in transcription, DNA binding, transcription coupled DNA repair, homologous recombination, chromosomal stability, ubiquitination of proteins, and centrosome replication | 17q21 | breast and ovarian cancer |
| Familial Breast Cancer | BRCA2 (FANCD1) | transcriptional regulation of genes involved in DNA repair and homologous recombination | 13q12.3 | breast and ovarian cancer |
| Cowden syndrome | PTEN | phosphoinositide 3-phosphatase, protein tyrosine phosphatase | 10q23.3 | gliomas, breast cancer, thyroid cancer, head & neck squamous carcinoma |
| Peutz-Jeghers Syndrome (PJS) | STK11 (serine-threonine kinase 11) | phosphorylates and activates AMP-activated kinase (AMPK), AMPK involved in stress responses, lipid and glucose metabolism | 19p13.3 | hyperpigmentation, multiple hamartomatous polyps, colorectal, breast and ovarian cancers |

TABLE 7-continued

Familial Cancer Syndrome Targets

| Familial Cancer Syndrome | Tumor Suppressor Gene | Function | Chromosomal Location | Tumor Types Observed |
|---|---|---|---|---|
| Hereditary Nonpolyposis Colon Cancer type 1, HNPCC1 | MSH2 | DNA mismatch repair | 2p22-p21 | colon cancer |
| Hereditary Nonpolyposis Colon Cancer type 2, HNPCC2 | MLH1 | DNA mismatch repair | 3p21.3 | colon cancer |
| Familial diffuse-type gastric cancer | CDH1 | cell-cell adhesion protein | 16q22.1 | gastric cancer, lobular breast cancer |
| von Hippel-Lindau Syndrome | VHL | regulation of transcription elongation through activation of a ubiquitin ligase complex | 3p26-p25 | renal cancers, hemangioblastomas, pheochromocytoma, retinal angioma |
| Familial Melanoma | CDKN2A | p16INK4 inhibits cell-cycle kinases CDK4 and CDK6; p14ARF binds the p53 stabilizing protein MDM2 | 9p21 | melanoma, pancreatic cancer, others |
| Gorlin Syndrome: Nevoid basal cell carcinoma syndrome (NBCCS) | PTCH (e.g., PTCH1, PTCH2) | transmembrane receptor for sonic hedgehog (shh), involved in early development through repression of action of smoothened | 9q22.3 | basal cell skin carcinoma |
| Multiple Endocrine Neoplasia Type 1 | MEN1 | intrastrand DNA crosslink repair | 11q13 | parathyroid and pituitary adenomas, islet cell tumors, carcinoid |

In additional to the above mentioned targets, the oncology-related polypeptides may include any "death signal" protein that can be recognized by active T cells of immune system. Such suicide signal proteins encoded by the sensor-signal polynucleotides can be selectively expressed in particular tissues or cells (e.g. cancer cells) through engineered microRNA binding sites and/or other regulatory elements as described herein. The group of proteins, when they are expressed on the surface of a caner cell, can prime T cell to induce T cell mediated immune response, thus killing the cancer cell. As a non-limiting example, a group of proteins that are known to present a "death signal", include, CD80, CD86, B7 and MHC II, etc.

Protein Cleavage Signals and Sites

In one embodiment, the oncology-related polypeptides of the present invention may include at least one protein cleavage signal containing at least one protein cleavage site. The protein cleavage site may be located at the N-terminus, the C-terminus, at any space between the N- and the C-termini such as, but not limited to, half-way between the N- and C-termini, between the N-terminus and the half way point, between the half way point and the C-terminus, and combinations thereof.

The oncology-related polypeptides of the present invention may include, but is not limited to, a proprotein convertase (or prohormone convertase), thrombin or Factor Xa protein cleavage signal. Proprotein convertases are a family of nine proteinases, comprising seven basic amino acid-specific subtilisin-like serine proteinases related to yeast kexin, known as prohormone convertase 1/3 (PC1/3), PC2, furin, PC4, PC5/6, paired basic amino-acid cleaving enzyme 4 (PACE4) and PC7, and two other subtilases that cleave at non-basic residues, called subtilisin kexin isozyme 1 (SKI-1) and proprotein convertase subtilisin kexin 9 (PCSK9). Non-limiting examples of protein cleavage signal amino acid sequences are listing in Table 8. In Table 8, "X" refers to any amino acid, "n" may be 0, 2, 4 or 6 amino acids and "*" refers to the protein cleavage site. In Table 8, SEQ ID NO: 2499 refers to when n=4 and SEQ ID NO: 2500 refers to when n=6.

TABLE 8

Protein Cleavage Site Sequences

| Protein Cleavage Signal | Amino Acid Cleavage Sequence | SEQ ID NO |
|---|---|---|
| Proprotein convertase | R-X-X-R* | 2497 |
| | R-X-K/R-R* | 2498 |
| | K/R-X-Xn-K/R* | 2499 or 2500 |
| Thrombin | L-V-P-R*-G-S | 2501 |
| | L-V-P-R* | 2502 |
| | A/F/G/I/L/T/V/M-A/F/G/I/L/T/V/W/A-P-R* | 2503 |

TABLE 8-continued

Protein Cleavage Site Sequences

| Protein Cleavage Signal | Amino Acid Cleavage Sequence | SEQ ID NO |
|---|---|---|
| Factor Xa | I-E-G-R* | 2504 |
| | I-D-G-R* | 2505 |
| | A-E-G-R* | 2506 |
| | A/F/G/I/L/T/V/M-D/E-G-R* | 2507 |

In one embodiment, the signal-sensor primary constructs and the mmRNA of the present invention may be engineered such that the primary construct or mmRNA contains at least one encoded protein cleavage signal. The encoded protein cleavage signal may be located before the start codon, after the start codon, before the coding region, within the coding region such as, but not limited to, half way in the coding region, between the start codon and the half way point, between the half way point and the stop codon, after the coding region, before the stop codon, between two stop codons, after the stop codon and combinations thereof.

In one embodiment, the signal-sensor primary constructs or mmRNA of the present invention may include at least one encoded protein cleavage signal containing at least one protein cleavage site. The encoded protein cleavage signal may include, but is not limited to, a proprotein convertase (or prohormone convertase), thrombin and/or Factor Xa protein cleavage signal. One of skill in the art may use Table 1 above or other known methods to determine the appropriate encoded protein cleavage signal to include in the signal-sensor primary constructs or mmRNA of the present invention. For example, starting with the signal of Table 8 and considering the codons of Table 1 one can design a signal for the signal-sensor primary construct which can produce a protein signal in the resulting oncology-related polypeptide.

In one embodiment, the oncology-related polypeptides of the present invention include at least one protein cleavage signal and/or site.

As a non-limiting example, U.S. Pat. No. 7,374,930 and U.S. Pub. No. 20090227660, herein incorporated by reference in their entireties, use a furin cleavage site to cleave the N-terminal methionine of GLP-1 in the expression product from the Golgi apparatus of the cells. In one embodiment, the polypeptides of the present invention include at least one protein cleavage signal and/or site with the proviso that the polypeptide is not GLP-1.

In one embodiment, the signal-sensor primary constructs or mmRNA of the present invention includes at least one encoded protein cleavage signal and/or site.

In one embodiment, the signal-sensor primary constructs or mmRNA of the present invention includes at least one encoded protein cleavage signal and/or site with the proviso that the signal-sensor primary construct or mmRNA does not encode GLP-1.

In one embodiment, the signal-sensor primary constructs or mmRNA of the present invention may include more than one coding region. Where multiple coding regions are present in the signal-sensor primary construct or mmRNA of the present invention, the multiple coding regions may be separated by encoded protein cleavage sites. As a non-limiting example, the signal-sensor primary construct or mmRNA may be signed in an ordered pattern. On such pattern follows AXBY form where A and B are coding regions which may be the same or different coding regions and/or may encode the same or different oncology-related polypeptides, and X and Y are encoded protein cleavage signals which may encode the same or different protein cleavage signals. A second such pattern follows the form AXYBZ where A and B are coding regions which may be the same or different coding regions and/or may encode the same or different oncology-related polypeptides, and X, Y and Z are encoded protein cleavage signals which may encode the same or different protein cleavage signals. A third pattern follows the form ABXCY where A, B and C are coding regions which may be the same or different coding regions and/or may encode the same or different oncology-related polypeptides, and X and Y are encoded protein cleavage signals which may encode the same or different protein cleavage signals.

In one embodiment, the oncology-related polypeptides, signal-sensor primary constructs and mmRNA can also contain sequences that encode protein cleavage sites so that the polypeptides, signal-sensor primary constructs and mmRNA can be released from a carrier region or a fusion partner by treatment with a specific protease for said protein cleavage site.

microRNA microRNAs (or miRNA) are 19-25 nucleotide long non-coding RNAs that bind to the 3'UTR of nucleic acid molecules and down-regulate gene expression either by reducing nucleic acid molecule stability or by inhibiting translation. The modified nucleic acids (mRNA), enhanced modified RNA or ribonucleic acids of the invention may comprise one or more microRNA target sequences, microRNA sequences, or microRNA seeds. Such sequences may correspond to any known microRNA such as those taught in US Publication US2005/0261218 and US Publication US2005/0059005, the contents of which are incorporated herein by reference in their entirety. As a non-limiting embodiment, known microRNAs, their sequences and their binding site sequences in the human genome are listed below in Table 9.

A microRNA sequence comprises a "seed" region, i.e., a sequence in the region of positions 2-8 of the mature microRNA, which sequence has perfect Watson-Crick complementarity to the miRNA target sequence. A microRNA seed may comprise positions 2-8 or 2-7 of the mature microRNA. In some embodiments, a microRNA seed may comprise 7 nucleotides (e.g., nucleotides 2-8 of the mature microRNA), wherein the seed-complementary site in the corresponding miRNA target is flanked by an adenine (A) opposed to microRNA position 1. In some embodiments, a microRNA seed may comprise 6 nucleotides (e.g., nucleotides 2-7 of the mature microRNA), wherein the seed-complementary site in the corresponding miRNA target is flanked by an adenine (A) opposed to microRNA position 1. See for example, Grimson A, Farh K K, Johnston W K, Garrett-Engele P, Lim L P, Bartel D P; Mol Cell. 2007 Jul. 6; 27(1):91-105. The bases of the microRNA seed have complete complementarity with the target sequence. By engineering microRNA target sequences into the 3'UTR of nucleic acids or mRNA of the invention one can target the molecule for degradation or reduced translation, provided the microRNA in question is available. This process will reduce the hazard of off target effects upon nucleic acid molecule delivery. Identification of microRNA, microRNA target regions, and their expression patterns and role in biology have been reported (Bonauer et al., Curr Drug Targets 2010 11:943-949; Anand and Cheresh Curr Opin Hematol 2011 18:171-176; Contreras and Rao Leukemia 2012 26:404-413 (2011 Dec. 20. doi: 10.1038/leu.2011.356); Bartel Cell 2009 136:215-233; Landgraf et al, Cell, 2007 129:1401-1414; Gentner and Naldini, Tissue Antigens. 2012 80:393-403 and all references therein; each of which is herein incorporated by reference in its entirety).

For example, if the signal-sensor polynucleotide is not intended to be delivered to the liver but ends up there, then miR-122, a microRNA abundant in liver, can inhibit the expression of the gene of interest if one or multiple target sites of miR-122 are engineered into the 3'UTR of the signal-sensor polynucleotide. Introduction of one or multiple binding sites for different microRNA can be engineered to further decrease the longevity, stability, and protein translation of a signal-sensor polynucleotide. As used herein, the term "microRNA site" refers to a microRNA target site or a microRNA recognition site, or any nucleotide sequence to which a microRNA binds or associates. It should be understood that "binding" may follow traditional Watson-Crick hybridization rules or may reflect any stable association of the microRNA with the target sequence at or adjacent to the microRNA site.

Conversely, for the purposes of the signal-sensor polynucleotides of the present invention, microRNA binding sites can be engineered out of (i.e. removed from) sequences in which they naturally occur in order to increase protein expression in specific tissues. For example, miR-122 binding sites may be removed to improve protein expression in the liver.

In one embodiment, signal-sensor polynucleotides may include at least one miRNA-binding site in the 3'UTR in order to direct cytotoxic or cytoprotective mRNA therapeutics to specific cells such as, but not limited to, normal and/or cancerous cells (e.g., HEP3B or SNU449). As a non-limiting example, a strong apoptotic signal and at least one miR-122a binding site is encoded by the signal-sensor polynucleotide where the at least one miR-122a binding site is located in the 3'UTR. As another non-limiting example, apoptosis inducing factor short isoform (AIFsh) and at least one miR-122a binding site is encoded by the signal-sensor polynucleotide where the at least one miR-122a binding site is located in the 3'UTR. As yet another non-limiting example, constitutively active (C.A.) caspase 6 and at least one miR-122a binding site is encoded by the signal-sensor polynucleotide where the at least one miR-122a binding site is located in the 3'UTR. As another non-limiting example, HSV1-tk and at least one miR-122a binding site is encoded by the signal-sensor polynucleotide where the at least one miR-122a binding site is located in the 3'UTR.

In another embodiment, signal-sensor polynucleotides may include three miRNA-binding sites in the 3'UTR in order to direct cytotoxic or cytoprotective mRNA therapeutics to specific cells such as, but not limited to, normal and/or cancerous cells (e.g., HEP3B or SNU449). As a non-limiting example, a strong apoptotic signal and three miR-122a binding sites are encoded by the signal-sensor polynucleotide where the three miR-122a binding sites are located in the 3'UTR. As another non-limiting example, apoptosis inducing factor short isoform (AIFsh) and three miR-122a binding sites are encoded by the signal-sensor polynucleotide where the three miR-122a binding sites are located in the 3'UTR. As yet another non-limiting example, constitutively active (C.A.) caspase 6 and three miR-122a binding sites are encoded by the signal-sensor polynucleotide where the three miR-122a binding sites are located in the 3'UTR. As another non-limiting example, HSV1-tk and three miR-122a binding sites are encoded by the signal-sensor polynucleotide where the three miR-122a binding sites are located in the 3'UTR.

Regulation of expression in multiple tissues can be accomplished through introduction or removal or one or several microRNA binding sites. Shown below in Table 10 are microRNAs which are differentially expressed in different tissues and cells, and often associated with different types of diseases (e.g. cancer cells). The decision of removal or insertion of microRNA binding sites, or any combination, is dependent on microRNA expression patterns and their profilings in cancer cells.

Examples of tissues where microRNA are known to regulate mRNA, and thereby protein expression, include, but are not limited to, liver (miR-122), muscle (miR-133, miR-206, miR-208), endothelial cells (miR-17-92, miR-126), myeloid cells (miR-142-3p, miR-142-5p, miR-16, miR-21, miR-223, miR-24, miR-27), nervous system (mir-124a, miR-9), pluripotent cells (miR-302, miR-367, miR-290, miR-371, miR-373), pancreatic islet cells (miR-375), adipose tissue (let-7, miR-30c), heart (miR-1d, miR-149), kidney (miR-192, miR-194, miR-204), and lung epithelial cells (let-7, miR-133, miR-126).

Specifically, microRNAs are known to be differentially expressed in immune cells (also called hematopoietic cells), such as antigen presenting cells (APCs) (e.g. dendritic cells and macrophages), macrophages, monocytes, B lymphocytes, T lymphocytes, granulocytes, natural killer cells, etc. Immune cell specific microRNAs are involved in immunogenicity, autoimmunity, the immune-response to infection, inflammation, as well as unwanted immune response after gene therapy and tissue/organ transplantation. Immune cells specific microRNAs also regulate many aspects of development, proliferation, differentiation and apoptosis of hematopoietic cells (immune cells). For example, miR-142 and miR-146 are exclusively expressed in the immune cells, particularly abundant in myeloid dendritic cells. Introducing the miR-142 binding site into the 3'-UTR of a signal-sensor polypeptide of the present invention can selectively suppress the gene expression in the antigen presenting cells through miR-142 mediated mRNA degradation, limiting antigen presentation in professional APCs (e.g. dendritic cells) and thereby preventing antigen-mediated immune response after gene delivery (see, Annoni A et al., blood, 2009, 114, 5152-5161, the content of which is herein incorporated by reference in its entirety.)

In one embodiment, microRNAs binding sites that are known to be expressed in immune cells, in particular, the antigen presenting cells, can be engineered into the signal-sensor polynucleotides to suppress the expression of the sensor-signal polynucleotide in APCs through microRNA mediated RNA degradation, subduing the antigen-mediated immune response, while the expression of the sensor-signal polynucleotide is maintained in non-immune cells where the immune cell specific microRNAs are not expressed. For example, to prevent the immunogenic reaction caused by a liver specific protein expression, the miR-122 binding site can be removed and the miR-142 (and/or mirR-146) binding sites can be engineered into the 3-UTR of the signal-sensor polynucleotide (e.g., see the constructs described in Example 38 and the experiment outlined in Examples 39 and 40).

To further drive the selective degradation and suppression of mRNA in APCs and macrophage, the signal-sensor polynucleotide may include another negative regulatory element in the 3-UTR, either alone or in combination with mir-142 and/or mir-146 binding sites. As a non-limiting example, one regulatory element is the Constitutive Decay Elements (CDEs).

Immune cells specific microRNAs include, but are not limited to, hsa-let-7a-2-3p, hsa-let-7a-3p, hsa-7a-5p, hsa-let-7c, hsa-let-7e-3p, hsa-let-7e-5p, hsa-let-7g-3p, hsa-let-7g-5p, hsa-let-7i-3p, hsa-let-7i-5p, miR-10a-3p, miR-10a-5p, miR-1184, hsa-let-7f-1-3p, hsa-let-7f-2-5p, hsa-let-7f-5p, miR-125b-1-3p, miR-125b-2-3p, miR-125b-5p, miR-1279, miR-130a-3p, miR-130a-5p, miR-132-3p, miR-132-5p, miR-142-3p, miR-142-5p, miR-143-3p, miR-143-5p, miR-146a-3p, miR-146a-5p, miR-146b-3p, miR-146b-5p, miR-147a, miR-147b, miR-148a-5p, miR-148a-3p, miR-150-3p, miR-150-5p, miR-151b, miR-155-3p, miR-155-5p, miR-15a-3p, miR-15a-5p, miR-15b-5p, miR-15b-3p, miR-16-1-3p, miR-16-2-3p, miR-16-5p, miR-17-5p, miR-181a-3p, miR-181a-5p, miR-181a-2-3p, miR-182-3p, miR-182-5p, miR-197-3p, miR-197-5p, miR-21-5p, miR-21-3p, miR-214-3p, miR-214-5p, miR-223-3p, miR-223-5p, miR-221-3p, miR-221-5p, miR-23b-3p, miR-23b-5p, miR-24-1-5p, miR-24-2-5p, miR-24-3p, miR-26a-1-3p, miR-26a-2-3p, miR-26a-5p, miR-26b-3p, miR-26b-5p, miR-27a-3p, miR-27a-5p, miR-27b-3p, miR-27b-5p, miR-28-3p, miR-28-5p, miR-2909, miR-29a-3p, miR-29a-5p, miR-29b-1-5p, miR-29b-2-5p, miR-29c-3p, miR-29c-5p, miR-30e-3p, miR-30e-5p, miR-331-5p, miR-339-3p, miR-339-5p, miR-345-3p, miR-345-5p, miR-346, miR-34a-3p, miR-34a-5p, miR-363-3p, miR-363-5p, miR-372, miR-377-3p, miR-377-5p, miR-493-3p, miR-493-5p, miR-542, miR-548b-5p, miR548c-5p, miR-548i, miR-548j, miR-548n, miR-574-3p, miR-598, miR-718, miR-935, miR-99a-3p, miR-99a-5p, miR-99b-3p and miR-99b-5p. Shown below in Table 11 are microRNAs that are enriched in specific types of immune cells. Furthermore, novel miroRNAs are discovered in the immune cells in the art through micro-array hybridization and microtome analysis (Jima D D et al, Blood, 2010, 116:e118-e127; Vaz C et al., BMC Genomics, 2010, 11,288, the content of each of which is incorporated herein by reference in its entirety).

MicroRNAs that are known to be expressed in the liver include, but are not limited to, miR-107, miR-122-3p, miR-122-5p, miR-1228-3p, miR-1228-5p, miR-1249, miR-129-5p, miR-1303, miR-151a-3p, miR-151a-5p, miR-152, miR-194-3p, miR-194-5p, miR-199a-3p, miR-199a-5p, miR-199b-3p, miR-199b-5p, miR-296-5p, miR-557, miR-581, miR-939-3p, miR-939-5p. microRNA binding sites from any liver specific microRNA can be introduced to or removed from the signal-sensor polynucleotides to regulate the expression of the signal-sensor polynucleotides in the liver. Liver specific microRNAs binding sites can be engineered alone or further in combination with immune cells (e.g. APCs) microRNA binding sites in order to prevent an immune reaction against protein expression in the liver.

MicroRNAs that are known to be expressed in the lung include, but are not limited to, let-7a-2-3p, let-7a-3p, let-7a-5p, miR-126-3p, miR-126-5p, miR-127-3p, miR-127-5p, miR-130a-3p, miR-130a-5p, miR-130b-3p, miR-130b-5p, miR-133a, miR-133b, miR-134, miR-18a-3p, miR-18a-5p, miR-18b-3p, miR-18b-5p, miR-24-1-5p, miR-24-2-5p, miR-24-3p, miR-296-3p, miR-296-5p, miR-32-3p, miR-337-3p, miR-337-5p, miR-381-3p, miR-381-5p. MicroRNA binding sites from any lung specific microRNA can be introduced to or removed from the signal-sensor polynucleotide to regulate the expression of the signal-sensor polynucleotide in the lung. Lung specific microRNAs binding sites can be engineered alone or further in combination with immune cells (e.g. APCs) microRNA binding sites in order to prevent an immune reaction against protein expression in the lung.

MicroRNAs that are known to be expressed in the heart include, but are not limited to, miR-1, miR-133a, miR-133b, miR-149-3p, miR-149-5p, miR-186-3p, miR-186-5p, miR-208a, miR-208b, miR-210, miR-296-3p, miR-320, miR-451a, miR-451b, miR-499a-3p, miR-499a-5p, miR-499b-3p, miR-499b-5p, miR-744-3p, miR-744-5p, miR-92b-3p and miR-92b-5p. microRNA binding sites from any heart specific microRNA can be introduced to or removed from the signal-sensor polynucleotides to regulate the expression of the signal-sensor polynucleotides in the heart. Heart specific microRNAs binding sites can be engineered alone or further in combination with immune cells (e.g. APCs) microRNA binding sites in order to prevent an immune reaction against protein expression in the heart.

MicroRNAs that are known to be expressed in the nervous system include, but are not limited to, miR-124-5p, miR-125a-3p, miR-125a-5p, miR-125b-1-3p, miR-125b-2-3p, miR-125b-5p, miR-1271-3p, miR-1271-5p, miR-128, miR-132-5p, miR-135a-3p, miR-135a-5p, miR-135b-3p, miR-135b-5p, miR-137, miR-139-5p, miR-139-3p, miR-149-3p, miR-149-5p, miR-153, miR-181c-3p, miR-181c-5p, miR-183-3p, miR-183-5p, miR-190a, miR-190b, miR-212-3p, miR-212-5p, miR-219-1-3p, miR-219-2-3p, miR-23a-3p, miR-23a-5p, miR-30a-5p, miR-30b-3p, miR-30b-5p, miR-30c-1-3p, miR-30c-2-3p, miR-30c-5p, miR-30d-3p, miR-30d-5p, miR-329, miR-342-3p, miR-3665, miR-3666, miR-380-3p, miR-380-5p, miR-383, miR-410, miR-425-3p, miR-425-5p, miR-454-3p, miR-454-5p, miR-483, miR-510, miR-516a-3p, miR-548b-5p, miR-548c-5p, miR-571, miR-7-1-3p, miR-7-2-3p, miR-7-5p, miR-802, miR-922, miR-9-3p and miR-9-5p. microRNAs enriched in the nervous system further include those specifically expressed in neurons, including, but not limited to, miR-132-3p, miR-132-3p, miR-148b-3p, miR-148b-5p, miR-151a-3p, miR-151a-5p, miR-212-3p, miR-212-5p, miR-320b, miR-320e, miR-323a-3p, miR-323a-5p, miR-324-5p, miR-325, miR-326, miR-328, miR-922 and those specifically expressed in glial cells, including, but not limited to, miR-1250, miR-219-1-3p, miR-219-2-3p, miR-219-5p, miR-23a-3p, miR-23a-5p, miR-3065-3p, miR-3065-5p, miR-30e-3p, miR-30e-5p, miR-32-5p, miR-338-5p, miR-657. microRNA binding sites from any CNS specific microRNA can be introduced to or removed from the signal-sensor polynucleotides to regulate the expression of the signal-sensor polynucleotide in the nervous system. Nervous system specific microRNAs binding sites can be engineered alone or further in combination with immune cells (e.g. APCs) microRNA binding sites in order to prevent an immune reaction against protein expression in the nervous system.

MicroRNAs that are known to be expressed in the pancreas include, but are not limited to, miR-105-3p, miR-105-5p, miR-184, miR-195-3p, miR-195-5p, miR-196a-3p, miR-196a-5p, miR-214-3p, miR-214-5p, miR-216a-3p, miR-216a-5p, miR-30a-3p, miR-33a-3p, miR-33a-5p, miR-375, miR-7-1-3p, miR-7-2-3p, miR-493-3p, miR-493-5p and miR-944. MicroRNA binding sites from any pancreas specific microRNA can be introduced to or removed from the signal-sensor polynucleotide to regulate the expression of the signal-sensor polynucleotide in the pancreas. Pancreas specific microRNAs binding sites can be engineered alone or further in combination with immune cells (e.g. APCs) microRNA binding sites in order to prevent immune reaction against protein expression in the pancreas.

MicroRNAs that are known to be expressed in the kidney further include, but are not limited to, miR-122-3p, miR-145-5p, miR-17-5p, miR-192-3p, miR-192-5p, miR-194-3p, miR-194-5p, miR-20a-3p, miR-20a-5p, miR-204-3p, miR-204-5p, miR-210, miR-216a-3p, miR-216a-5p, miR-296-3p, miR-30a-3p, miR-30a-5p, miR-30b-3p, miR-30b-5p, miR- 30c-1-3p, miR-30c-2-3p, miR30c-5p, miR-324-3p, miR-335-3p, miR-335-5p, miR-363-3p, miR-363-5p and miR-562. MicroRNA binding sites from any kidney specific microRNA can be introduced to or removed from the signal-sensor polynucleotide to regulate the expression of the signal-sensor polynucleotide in the kidney. Kidney specific microRNAs binding sites can be engineered alone or further in combination with immune cells (e.g. APCs) microRNA binding sites in order to prevent immune reaction against protein expression in the kidney.

MicroRNAs that are known to be expressed in the muscle further include, but are not limited to, let-7g-3p, let-7g-5p, miR-1, miR-1286, miR-133a, miR-133b, miR-140-3p, miR-143-3p, miR-143-5p, miR-145-3p, miR-145-5p, miR-188-3p, miR-188-5p, miR-206, miR-208a, miR-208b, miR-25-3p and miR-25-5p. MicroRNA binding sites from any muscle specific microRNA can be introduced to or removed from the signal-sensor polynucleotide to regulate the expression of the signal-sensor polynucleotide in the muscle. Muscle specific microRNAs binding sites can be engineered alone or further in combination with immune cells (e.g. APCs) microRNA binding sites in order to prevent an immune reaction against protein expression in the muscle.

MicroRNAs are differentially expressed in different types of cells, such as endothelial cells, epithelial cells and adipocytes. For example, microRNAs that are expressed in endothelial cells include, but are not limited to, let-7b-3p, let-7b-5p, miR-100-3p, miR-100-5p, miR-101-3p, miR-101-5p, miR-126-3p, miR-126-5p, miR-1236-3p, miR-1236-5p, miR-130a-3p, miR-130a-5p, miR-17-5p, miR-17-3p, miR-18a-3p, miR-18a-5p, miR-19a-3p, miR-19a-5p, miR-19b-1-5p, miR-19b-2-5p, miR-19b-3p, miR-20a-3p, miR-20a-5p, miR-217, miR-210, miR-21-3p, miR-21-5p, miR-221-3p, miR-221-5p, miR-222-3p, miR-222-5p, miR-23a-3p, miR-23a-5p, miR-296-5p, miR-361-3p, miR-361-5p, miR-421, miR-424-3p, miR-424-5p, miR-513a-5p, miR-92a-1-5p, miR-92a-2-5p, miR-92a-3p, miR-92b-3p and miR-92b-5p. Many novel microRNAs were discovered in endothelial cells from deep-sequencing analysis (Voellenkle C et al., RNA, 2012, 18, 472-484, herein incorporated by reference in its entirety). MicroRNA binding sites from any endothelial cell specific microRNA can be introduced to or removed from the signal-sensor polynucleotide in order to modulate the expression of the signal-sensor polynucleotide in the endothelial cells in various conditions.

For further example, microRNAs that are expressed in epithelial cells include, but are not limited to, let-7b-3p, let-7b-5p, miR-1246, miR-200a-3p, miR-200a-5p, miR-200b-3p, miR-200b-5p, miR-200c-3p, miR-200c-5p, miR-338-3p, miR-429, miR-451a, miR-451b, miR-494, miR-802 and miR-34a, miR-34b-5p, miR-34c-5p, miR-449a, miR-449b-3p, miR-449b-5p specific in respiratory ciliated epithelial cells; let-7 family, miR-133a, miR-133b, miR-126 specific in lung epithelial cells; miR-382-3p, miR-382-5p specific in renal epithelial cells and miR-762 specific in corneal epithelial cells. MicroRNA binding sites from any epithelial cell specific microRNA can be introduced to or removed from the signal-sensor polynucleotide in order to modulate the expression of the signal-sensor polynucleotide in the epithelial cells in various conditions.

In addition, a large group of microRNAs are enriched in embryonic stem cells, controlling stem cell self-renewal as well as the development and/or differentiation of various cell lineages, such as neural cells, cardiac, hematopoietic cells, skin cells, osteogenic cells and muscle cells (Kuppusamy K T et al., Curr. Mol Med, 2013, 13(5), 757-764; Vidigal J A and Ventura A, Semin Cancer Biol. 2012, 22(5-6), 428-436; Goff L A et al., PLoS One, 2009, 4:e7192; Morin R D et al., Genome Res, 2008, 18, 610-621; Yoo J K et al., Stem Cells Dev. 2012, 21(11), 2049-2057, each of which is herein incorporated by reference in its entirety). MicroRNAs abundant in embryonic stem cells include, but are not limited to, let-7a-2-3p, let-a-3p, let-7a-5p, let7d-3p, let-7d-5p, miR-103a-2-3p, miR-103a-5p, miR-106b-3p, miR-106b-5p, miR-1246, miR-1275, miR-138-1-3p, miR-138-2-3p, miR-138-5p, miR-154-3p, miR-154-5p, miR-200c-3p, miR-200c-5p, miR-290, miR-301a-3p, miR-301a-5p, miR-302a-3p, miR-302a-5p, miR-302b-3p, miR-302b-5p, miR-302c-3p, miR-302c-5p, miR-302d-3p, miR-302d-5p, miR-302e, miR-367-3p, miR-367-5p, miR-369-3p, miR-369-5p, miR-370, miR-371, miR-373, miR-380-5p, miR-423-3p, miR-423-5p, miR-486-5p, miR-520c-3p, miR-548e, miR-548f, miR-548g-3p, miR-548g-5p, miR-548i, miR-548k, miR-548l, miR-548m, miR-548n, miR-548o-3p, miR-548o-5p, miR-548p, miR-664a-3p, miR-664a-5p, miR-664b-3p, miR-664b-5p, miR-766-3p, miR-766-5p, miR-885-3p, miR-885-5p, miR-93-3p, miR-93-5p, miR-941, miR-96-3p, miR-96-5p, miR-99b-3p and miR-99b-5p. Many predicted novel microRNAs are discovered by deep sequencing in human embryonic stem cells (Morin R D et al., Genome Res, 2008, 18, 610-621; Goff L A et al., PLoS One, 2009, 4:e7192; Bar M et al., Stem cells, 2008, 26, 2496-2505, the content of each of which is incorporated herein by references in its entirety).

In one embodiment, the binding sites of embryonic stem cell specific microRNAs can be included in or removed from the 3-UTR of the signal-sensor polynucleotide to modulate the development and/or differentiation of embryonic stem cells, to inhibit the senescence of stem cells in a degenerative condition (e.g. degenerative diseases), or to stimulate the senescence and apoptosis of stem cells in a disease condition (e.g. cancer stem cell).

Many microRNA expression studies have been conducted, and are described in the art, to profile the differential expression of microRNAs in various cancer cells/tissues and other diseases. Some microRNAs are abnormally over-expressed in certain cancer cells and others are under-expressed. For example, microRNAs are differentially expressed in cancer cells (WO2008/154098, US2013/0059015, US2013/0042333, WO2011/157294); cancer stem cells (US2012/0053224); pancreatic cancers and diseases (US2009/0131348, US2011/0171646, US2010/0286232, U.S. Pat. No. 8,389,210); asthma and inflammation (U.S. Pat. No. 8,415,096); prostate cancer (US2013/0053264); hepatocellular carcinoma (WO2012/151212, US2012/0329672, WO2008/054828, U.S. Pat. No. 8,252,538); lung cancer cells (WO2011/076143, WO2013/033640, WO2009/070653, US2010/0323357); cutaneous T cell lymphoma (WO2013/011378); colorectal cancer cells (WO2011/0281756, WO2011/076142); cancer positive lymph nodes (WO2009/100430, US2009/0263803); nasopharyngeal carcinoma (EP2112235); chronic obstructive pulmonary disease (US2012/0264626, US2013/0053263); thyroid cancer (WO2013/066678); ovarian cancer cells (US2012/0309645, WO2011/095623); breast cancer cells (WO2008/154098, WO2007/081740, US2012/0214699), leukemia and lymphoma (WO2008/073915, US2009/0092974, US2012/0316081, US2012/0283310, WO2010/018563, the content of each of which is incorporated herein by reference in their entirety).

Specifically, microRNA sites that are over-expressed in certain cancer and/or tumor cells can be removed from the 3-UTR of the signal-sensor polynucleotide encoding the oncology-related polypeptide, restoring the expression suppressed by the over-expressed microRNAs in cancer cells, thus ameliorating the corresponsive biological function, for instance, transcription stimulation and/or repression, cell cycle arrest, apoptosis and cell death. Normal cells and tissues, wherein microRNA expression is not up-regulated, will remain unaffected.

MicroRNA can also regulate complex biological processes such as angiogenesis (miR-132) (Anand and Cheresh Curr Opin Hematol 2011 18:171-176). In the signal-sensor polynucleotides of the invention, binding sites for microRNAs that are involved in such processes may be removed or introduced, in order to tailor the expression of the signal-sensor polynucleotides expression to biologically relevant cell types or to the context of relevant biological processes. In this context, the signal-sensor polynucleotide are defined as auxotrophic signal-sensor polynucleotides.

Table 9 is a non-exhaustive listing of miRs and miR binding sites (miR BS) and their sequences which may be used with the present invention.

TABLE 9

Mirs and mir binding sites

| microRNA | mir SEQ ID | BS SEQ ID |
|---|---|---|
| hsa-let-7a-2-3p | 2508 | 3529 |
| hsa-let-7a-3p | 2509 | 3530 |
| hsa-let-7a-5p | 2510 | 3531 |
| hsa-let-7b-3p | 2511 | 3532 |
| hsa-let-7b-5p | 2512 | 3533 |
| hsa-let-7c | 2513 | 3534 |
| hsa-let-7d-3p | 2514 | 3535 |
| hsa-let-7d-5p | 2515 | 3536 |
| hsa-let-7e-3p | 2516 | 3537 |
| hsa-let-7e-5p | 2517 | 3538 |
| hsa-let-7f-1-3p | 2518 | 3539 |
| hsa-let-7f-2-3p | 2519 | 3540 |
| hsa-let-7f-5p | 2520 | 3541 |
| hsa-let-7g-3p | 2521 | 3542 |
| hsa-let-7g-5p | 2522 | 3543 |
| hsa-let-7i-3p | 2523 | 3544 |
| hsa-let-7i-5p | 2524 | 3545 |
| hsa-miR-1 | 2525 | 3546 |
| hsa-miR-100-3p | 2526 | 3547 |
| hsa-miR-100-5p | 2527 | 3548 |
| hsa-miR-101-3p | 2528 | 3549 |
| hsa-miR-101-5p | 2529 | 3550 |
| hsa-miR-103a-2-5p | 2530 | 3551 |
| hsa-miR-103a-3p | 2531 | 3552 |
| hsa-miR-103b | 2532 | 3553 |
| hsa-miR-105-3p | 2533 | 3554 |
| hsa-miR-105-5p | 2534 | 3555 |
| hsa-miR-106a-3p | 2535 | 3556 |
| hsa-miR-106a-5p | 2536 | 3557 |
| hsa-miR-106b-3p | 2537 | 3558 |
| hsa-miR-106b-5p | 2538 | 3559 |
| hsa-miR-107 | 2539 | 3560 |
| hsa-miR-10a-3p | 2540 | 3561 |
| hsa-miR-10a-5p | 2541 | 3562 |
| hsa-miR-10b-3p | 2542 | 3563 |
| hsa-miR-10b-5p | 2543 | 3564 |
| hsa-miR-1178-3p | 2544 | 3565 |
| hsa-miR-1178-5p | 2545 | 3566 |
| hsa-miR-1179 | 2546 | 3567 |
| hsa-miR-1180 | 2547 | 3568 |
| hsa-miR-1181 | 2548 | 3569 |
| hsa-miR-1182 | 2549 | 3570 |
| hsa-miR-1183 | 2550 | 3571 |
| hsa-miR-1184 | 2551 | 3572 |
| hsa-miR-1185-1-3p | 2552 | 3573 |
| hsa-miR-1185-2-3p | 2553 | 3574 |
| hsa-miR-1185-5p | 2554 | 3575 |
| hsa-miR-1193 | 2555 | 3576 |
| hsa-miR-1197 | 2556 | 3577 |
| hsa-miR-1200 | 2557 | 3578 |

TABLE 9-continued

Mirs and mir binding sites

| microRNA | mir SEQ ID | BS SEQ ID |
|---|---|---|
| hsa-miR-1202 | 2558 | 3579 |
| hsa-miR-1203 | 2559 | 3580 |
| hsa-miR-1204 | 2560 | 3581 |
| hsa-miR-1205 | 2561 | 3582 |
| hsa-miR-1206 | 2562 | 3583 |
| hsa-miR-1207-3p | 2563 | 3584 |
| hsa-miR-1207-5p | 2564 | 3585 |
| hsa-miR-1208 | 2565 | 3586 |
| hsa-miR-122-3p | 2566 | 3587 |
| hsa-miR-1224-3p | 2567 | 3588 |
| hsa-miR-1224-5p | 2568 | 3589 |
| hsa-miR-1225-3p | 2569 | 3590 |
| hsa-miR-1225-5p | 2570 | 3591 |
| hsa-miR-122-5p | 2571 | 3592 |
| hsa-miR-1226-3p | 2572 | 3593 |
| hsa-miR-1226-5p | 2573 | 3594 |
| hsa-miR-1227-3p | 2574 | 3595 |
| hsa-miR-1227-5p | 2575 | 3596 |
| hsa-miR-1228-3p | 2576 | 3597 |
| hsa-miR-1228-5p | 2577 | 3598 |
| hsa-miR-1229-3p | 2578 | 3599 |
| hsa-miR-1229-5p | 2579 | 3600 |
| hsa-miR-1231 | 2580 | 3601 |
| hsa-miR-1233-1-5p | 2581 | 3602 |
| hsa-miR-1233-3p | 2582 | 3603 |
| hsa-miR-1234-3p | 2583 | 3604 |
| hsa-miR-1234-5p | 2584 | 3605 |
| hsa-miR-1236-3p | 2585 | 3606 |
| hsa-miR-1236-5p | 2586 | 3607 |
| hsa-miR-1237-3p | 2587 | 3608 |
| hsa-miR-1237-5p | 2588 | 3609 |
| hsa-miR-1238-3p | 2589 | 3610 |
| hsa-miR-1238-5p | 2590 | 3611 |
| hsa-miR-1243 | 2591 | 3612 |
| hsa-miR-124-3p | 2592 | 3613 |
| hsa-miR-1244 | 2593 | 3614 |
| hsa-miR-1245a | 2594 | 3615 |
| hsa-miR-1245b-3p | 2595 | 3616 |
| hsa-miR-1245b-5p | 2596 | 3617 |
| hsa-miR-124-5p | 2597 | 3618 |
| hsa-miR-1246 | 2598 | 3619 |
| hsa-miR-1247-3p | 2599 | 3620 |
| hsa-miR-1247-5p | 2600 | 3621 |
| hsa-miR-1248 | 2601 | 3622 |
| hsa-miR-1249 | 2602 | 3623 |
| hsa-miR-1250 | 2603 | 3624 |
| hsa-miR-1251 | 2604 | 3625 |
| hsa-miR-1252 | 2605 | 3626 |
| hsa-miR-1253 | 2606 | 3627 |
| hsa-miR-1254 | 2607 | 3628 |
| hsa-miR-1255a | 2608 | 3629 |
| hsa-miR-1255b-2-3p | 2609 | 3630 |
| hsa-miR-1255b-5p | 2610 | 3631 |
| hsa-miR-1256 | 2611 | 3632 |
| hsa-miR-1257 | 2612 | 3633 |
| hsa-miR-1258 | 2613 | 3634 |
| hsa-miR-125a-3p | 2614 | 3635 |
| hsa-miR-125a-5p | 2615 | 3636 |
| hsa-miR-125b-1-3p | 2616 | 3637 |
| hsa-miR-125b-2-3p | 2617 | 3638 |
| hsa-miR-125b-5p | 2618 | 3639 |
| hsa-miR-1260a | 2619 | 3640 |
| hsa-miR-1260b | 2620 | 3641 |
| hsa-miR-1261 | 2621 | 3642 |
| hsa-miR-1262 | 2622 | 3643 |
| hsa-miR-1263 | 2623 | 3644 |
| hsa-miR-126-3p | 2624 | 3645 |
| hsa-miR-1264 | 2625 | 3646 |
| hsa-miR-1265 | 2626 | 3647 |
| hsa-miR-126-5p | 2627 | 3648 |
| hsa-miR-1266 | 2628 | 3649 |
| hsa-miR-1267 | 2629 | 3650 |
| hsa-miR-1268a | 2630 | 3651 |
| hsa-miR-1268b | 2631 | 3652 |
| hsa-miR-1269a | 2632 | 3653 |

TABLE 9-continued

Mirs and mir binding sites

| microRNA | mir SEQ ID | BS SEQ ID |
|---|---|---|
| hsa-miR-1269b | 2633 | 3654 |
| hsa-miR-1270 | 2634 | 3655 |
| hsa-miR-1271-3p | 2635 | 3656 |
| hsa-miR-1271-5p | 2636 | 3657 |
| hsa-miR-1272 | 2637 | 3658 |
| hsa-miR-1273a | 2638 | 3659 |
| hsa-miR-1273c | 2639 | 3660 |
| hsa-miR-1273d | 2640 | 3661 |
| hsa-miR-1273e | 2641 | 3662 |
| hsa-miR-1273f | 2642 | 3663 |
| hsa-miR-1273g-3p | 2643 | 3664 |
| hsa-miR-1273g-5p | 2644 | 3665 |
| hsa-miR-127-3p | 2645 | 3666 |
| hsa-miR-1275 | 2646 | 3667 |
| hsa-miR-127-5p | 2647 | 3668 |
| hsa-miR-1276 | 2648 | 3669 |
| hsa-miR-1277-3p | 2649 | 3670 |
| hsa-miR-1277-5p | 2650 | 3671 |
| hsa-miR-1278 | 2651 | 3672 |
| hsa-miR-1279 | 2652 | 3673 |
| hsa-miR-128 | 2653 | 3674 |
| hsa-miR-1281 | 2654 | 3675 |
| hsa-miR-1282 | 2655 | 3676 |
| hsa-miR-1283 | 2656 | 3677 |
| hsa-miR-1284 | 2657 | 3678 |
| hsa-miR-1285-3p | 2658 | 3679 |
| hsa-miR-1285-5p | 2659 | 3680 |
| hsa-miR-1286 | 2660 | 3681 |
| hsa-miR-1287 | 2661 | 3682 |
| hsa-miR-1288 | 2662 | 3683 |
| hsa-miR-1289 | 2663 | 3684 |
| hsa-miR-1290 | 2664 | 3685 |
| hsa-miR-1291 | 2665 | 3686 |
| hsa-miR-129-1-3p | 2666 | 3687 |
| hsa-miR-1292-3p | 2667 | 3688 |
| hsa-miR-129-2-3p | 2668 | 3689 |
| hsa-miR-1292-5p | 2669 | 3690 |
| hsa-miR-1293 | 2670 | 3691 |
| hsa-miR-1294 | 2671 | 3692 |
| hsa-miR-1295a | 2672 | 3693 |
| hsa-miR-1295b-3p | 2673 | 3694 |
| hsa-miR-1295b-5p | 2674 | 3695 |
| hsa-miR-129-5p | 2675 | 3696 |
| hsa-miR-1296 | 2676 | 3697 |
| hsa-miR-1297 | 2677 | 3698 |
| hsa-miR-1298 | 2678 | 3699 |
| hsa-miR-1299 | 2679 | 3700 |
| hsa-miR-1301 | 2680 | 3701 |
| hsa-miR-1302 | 2681 | 3702 |
| hsa-miR-1303 | 2682 | 3703 |
| hsa-miR-1304-3p | 2683 | 3704 |
| hsa-miR-1304-5p | 2684 | 3705 |
| hsa-miR-1305 | 2685 | 3706 |
| hsa-miR-1306-3p | 2686 | 3707 |
| hsa-miR-1306-5p | 2687 | 3708 |
| hsa-miR-1307-3p | 2688 | 3709 |
| hsa-miR-1307-5p | 2689 | 3710 |
| hsa-miR-130a-3p | 2690 | 3711 |
| hsa-miR-130a-5p | 2691 | 3712 |
| hsa-miR-130b-3p | 2692 | 3713 |
| hsa-miR-130b-5p | 2693 | 3714 |
| hsa-miR-1321 | 2694 | 3715 |
| hsa-miR-1322 | 2695 | 3716 |
| hsa-miR-1323 | 2696 | 3717 |
| hsa-miR-132-3p | 2697 | 3718 |
| hsa-miR-1324 | 2698 | 3719 |
| hsa-miR-132-5p | 2699 | 3720 |
| hsa-miR-133a | 2700 | 3721 |
| hsa-miR-133b | 2701 | 3722 |
| hsa-miR-134 | 2702 | 3723 |
| hsa-miR-1343 | 2703 | 3724 |
| hsa-miR-135a-3p | 2704 | 3725 |
| hsa-miR-135a-5p | 2705 | 3726 |
| hsa-miR-135b-3p | 2706 | 3727 |
| hsa-miR-135b-5p | 2707 | 3728 |
| hsa-miR-136-3p | 2708 | 3729 |
| hsa-miR-136-5p | 2709 | 3730 |
| hsa-miR-137 | 2710 | 3731 |
| hsa-miR-138-1-3p | 2711 | 3732 |
| hsa-miR-138-2-3p | 2712 | 3733 |
| hsa-miR-138-5p | 2713 | 3734 |
| hsa-miR-139-3p | 2714 | 3735 |
| hsa-miR-139-5p | 2715 | 3736 |
| hsa-miR-140-3p | 2716 | 3737 |
| hsa-miR-140-5p | 2717 | 3738 |
| hsa-miR-141-3p | 2718 | 3739 |
| hsa-miR-141-5p | 2719 | 3740 |
| hsa-miR-142-3p | 2720 | 3741 |
| hsa-miR-142-5p | 2721 | 3742 |
| hsa-miR-143-3p | 2722 | 3743 |
| hsa-miR-143-5p | 2723 | 3744 |
| hsa-miR-144-3p | 2724 | 3745 |
| hsa-miR-144-5p | 2725 | 3746 |
| hsa-miR-145-3p | 2726 | 3747 |
| hsa-miR-145-5p | 2727 | 3748 |
| hsa-miR-1468 | 2728 | 3749 |
| hsa-miR-1469 | 2729 | 3750 |
| hsa-miR-146a-3p | 2730 | 3751 |
| hsa-miR-146a-5p | 2731 | 3752 |
| hsa-miR-146b-3p | 2732 | 3753 |
| hsa-miR-146b-5p | 2733 | 3754 |
| hsa-miR-1470 | 2734 | 3755 |
| hsa-miR-1471 | 2735 | 3756 |
| hsa-miR-147a | 2736 | 3757 |
| hsa-miR-147b | 2737 | 3758 |
| hsa-miR-148a-3p | 2738 | 3759 |
| hsa-miR-148a-5p | 2739 | 3760 |
| hsa-miR-148b-3p | 2740 | 3761 |
| hsa-miR-148b-5p | 2741 | 3762 |
| hsa-miR-149-3p | 2742 | 3763 |
| hsa-miR-149-5p | 2743 | 3764 |
| hsa-miR-150-3p | 2744 | 3765 |
| hsa-miR-150-5p | 2745 | 3766 |
| hsa-miR-151a-3p | 2746 | 3767 |
| hsa-miR-151a-5p | 2747 | 3768 |
| hsa-miR-151b | 2748 | 3769 |
| hsa-miR-152 | 2749 | 3770 |
| hsa-miR-153 | 2750 | 3771 |
| hsa-miR-1537 | 2751 | 3772 |
| hsa-miR-1538 | 2752 | 3773 |
| hsa-miR-1539 | 2753 | 3774 |
| hsa-miR-154-3p | 2754 | 3775 |
| hsa-miR-154-5p | 2755 | 3776 |
| hsa-miR-155-3p | 2756 | 3777 |
| hsa-miR-155-5p | 2757 | 3778 |
| hsa-miR-1587 | 2758 | 3779 |
| hsa-miR-15a-3p | 2759 | 3780 |
| hsa-miR-15a-5p | 2760 | 3781 |
| hsa-miR-15b-3p | 2761 | 3782 |
| hsa-miR-15b-5p | 2762 | 3783 |
| hsa-miR-16-1-3p | 2763 | 3784 |
| hsa-miR-16-2-3p | 2764 | 3785 |
| hsa-miR-16-5p | 2765 | 3786 |
| hsa-miR-17-3p | 2766 | 3787 |
| hsa-miR-17-5p | 2767 | 3788 |
| hsa-miR-181a-2-3p | 2768 | 3789 |
| hsa-miR-181a-3p | 2769 | 3790 |
| hsa-miR-181a-5p | 2770 | 3791 |
| hsa-miR-181b-3p | 2771 | 3792 |
| hsa-miR-181b-5p | 2772 | 3793 |
| hsa-miR-181c-3p | 2773 | 3794 |
| hsa-miR-181c-5p | 2774 | 3795 |
| hsa-miR-181d | 2775 | 3796 |
| hsa-miR-182-3p | 2776 | 3797 |
| hsa-miR-1825 | 2777 | 3798 |
| hsa-miR-182-5p | 2778 | 3799 |
| hsa-miR-1827 | 2779 | 3800 |
| hsa-miR-183-3p | 2780 | 3801 |
| hsa-miR-183-5p | 2781 | 3802 |
| hsa-miR-184 | 2782 | 3803 |

TABLE 9-continued

Mirs and mir binding sites

| microRNA | mir SEQ ID | BS SEQ ID |
|---|---|---|
| hsa-miR-185-3p | 2783 | 3804 |
| hsa-miR-185-5p | 2784 | 3805 |
| hsa-miR-186-3p | 2785 | 3806 |
| hsa-miR-186-5p | 2786 | 3807 |
| hsa-miR-187-3p | 2787 | 3808 |
| hsa-miR-187-5p | 2788 | 3809 |
| hsa-miR-188-3p | 2789 | 3810 |
| hsa-miR-188-5p | 2790 | 3811 |
| hsa-miR-18a-3p | 2791 | 3812 |
| hsa-miR-18a-5p | 2792 | 3813 |
| hsa-miR-18b-3p | 2793 | 3814 |
| hsa-miR-18b-5p | 2794 | 3815 |
| hsa-miR-1908 | 2795 | 3816 |
| hsa-miR-1909-3p | 2796 | 3817 |
| hsa-miR-1909-5p | 2797 | 3818 |
| hsa-miR-190a | 2798 | 3819 |
| hsa-miR-190b | 2799 | 3820 |
| hsa-miR-1910 | 2800 | 3821 |
| hsa-miR-1911-3p | 2801 | 3822 |
| hsa-miR-1911-5p | 2802 | 3823 |
| hsa-miR-1912 | 2803 | 3824 |
| hsa-miR-1913 | 2804 | 3825 |
| hsa-miR-191-3p | 2805 | 3826 |
| hsa-miR-1914-3p | 2806 | 3827 |
| hsa-miR-1914-5p | 2807 | 3828 |
| hsa-miR-1915-3p | 2808 | 3829 |
| hsa-miR-1915-5p | 2809 | 3830 |
| hsa-miR-191-5p | 2810 | 3831 |
| hsa-miR-192-3p | 2811 | 3832 |
| hsa-miR-192-5p | 2812 | 3833 |
| hsa-miR-193a-3p | 2813 | 3834 |
| hsa-miR-193a-5p | 2814 | 3835 |
| hsa-miR-193b-3p | 2815 | 3836 |
| hsa-miR-193b-5p | 2816 | 3837 |
| hsa-miR-194-3p | 2817 | 3838 |
| hsa-miR-194-5p | 2818 | 3839 |
| hsa-miR-195-3p | 2819 | 3840 |
| hsa-miR-195-5p | 2820 | 3841 |
| hsa-miR-196a-3p | 2821 | 3842 |
| hsa-miR-196a-5p | 2822 | 3843 |
| hsa-miR-196b-3p | 2823 | 3844 |
| hsa-miR-196b-5p | 2824 | 3845 |
| hsa-miR-1972 | 2825 | 3846 |
| hsa-miR-1973 | 2826 | 3847 |
| hsa-miR-197-3p | 2827 | 3848 |
| hsa-miR-197-5p | 2828 | 3849 |
| hsa-miR-1976 | 2829 | 3850 |
| hsa-miR-198 | 2830 | 3851 |
| hsa-miR-199a-3p | 2831 | 3852 |
| hsa-miR-199a-5p | 2832 | 3853 |
| hsa-miR-199b-3p | 2833 | 3854 |
| hsa-miR-199b-5p | 2834 | 3855 |
| hsa-miR-19a-3p | 2835 | 3856 |
| hsa-miR-19a-5p | 2836 | 3857 |
| hsa-miR-19b-1-5p | 2837 | 3858 |
| hsa-miR-19b-2-5p | 2838 | 3859 |
| hsa-miR-19b-3p | 2839 | 3860 |
| hsa-miR-200a-3p | 2840 | 3861 |
| hsa-miR-200a-5p | 2841 | 3862 |
| hsa-miR-200b-3p | 2842 | 3863 |
| hsa-miR-200b-5p | 2843 | 3864 |
| hsa-miR-200c-3p | 2844 | 3865 |
| hsa-miR-200c-5p | 2845 | 3866 |
| hsa-miR-202-3p | 2846 | 3867 |
| hsa-miR-202-5p | 2847 | 3868 |
| hsa-miR-203a | 2848 | 3869 |
| hsa-miR-203b-3p | 2849 | 3870 |
| hsa-miR-203b-5p | 2850 | 3871 |
| hsa-miR-204-3p | 2851 | 3872 |
| hsa-miR-204-5p | 2852 | 3873 |
| hsa-miR-2052 | 2853 | 3874 |
| hsa-miR-2053 | 2854 | 3875 |
| hsa-miR-205-3p | 2855 | 3876 |
| hsa-miR-2054 | 2856 | 3877 |
| hsa-miR-205-5p | 2857 | 3878 |
| hsa-miR-206 | 2858 | 3879 |
| hsa-miR-208a | 2859 | 3880 |
| hsa-miR-208b | 2860 | 3881 |
| hsa-miR-20a-3p | 2861 | 3882 |
| hsa-miR-20a-5p | 2862 | 3883 |
| hsa-miR-20b-3p | 2863 | 3884 |
| hsa-miR-20b-5p | 2864 | 3885 |
| hsa-miR-210 | 2865 | 3886 |
| hsa-miR-2110 | 2866 | 3887 |
| hsa-miR-2113 | 2867 | 3888 |
| hsa-miR-211-3p | 2868 | 3889 |
| hsa-miR-2114-3p | 2869 | 3890 |
| hsa-miR-2114-5p | 2870 | 3891 |
| hsa-miR-2115-3p | 2871 | 3892 |
| hsa-miR-2115-5p | 2872 | 3893 |
| hsa-miR-211-5p | 2873 | 3894 |
| hsa-miR-2116-3p | 2874 | 3895 |
| hsa-miR-2116-5p | 2875 | 3896 |
| hsa-miR-2117 | 2876 | 3897 |
| hsa-miR-212-3p | 2877 | 3898 |
| hsa-miR-212-5p | 2878 | 3899 |
| hsa-miR-21-3p | 2879 | 3900 |
| hsa-miR-214-3p | 2880 | 3901 |
| hsa-miR-214-5p | 2881 | 3902 |
| hsa-miR-215 | 2882 | 3903 |
| hsa-miR-21-5p | 2883 | 3904 |
| hsa-miR-216a-3p | 2884 | 3905 |
| hsa-miR-216a-5p | 2885 | 3906 |
| hsa-miR-216b | 2886 | 3907 |
| hsa-miR-217 | 2887 | 3908 |
| hsa-miR-218-1-3p | 2888 | 3909 |
| hsa-miR-218-2-3p | 2889 | 3910 |
| hsa-miR-218-5p | 2890 | 3911 |
| hsa-miR-219-1-3p | 2891 | 3912 |
| hsa-miR-219-2-3p | 2892 | 3913 |
| hsa-miR-219-5p | 2893 | 3914 |
| hsa-miR-221-3p | 2894 | 3915 |
| hsa-miR-221-5p | 2895 | 3916 |
| hsa-miR-222-3p | 2896 | 3917 |
| hsa-miR-222-5p | 2897 | 3918 |
| hsa-miR-223-3p | 2898 | 3919 |
| hsa-miR-223-5p | 2899 | 3920 |
| hsa-miR-22-3p | 2900 | 3921 |
| hsa-miR-224-3p | 2901 | 3922 |
| hsa-miR-224-5p | 2902 | 3923 |
| hsa-miR-22-5p | 2903 | 3924 |
| hsa-miR-2276 | 2904 | 3925 |
| hsa-miR-2277-3p | 2905 | 3926 |
| hsa-miR-2277-5p | 2906 | 3927 |
| hsa-miR-2278 | 2907 | 3928 |
| hsa-miR-2355-3p | 2908 | 3929 |
| hsa-miR-2355-5p | 2909 | 3930 |
| hsa-miR-2392 | 2910 | 3931 |
| hsa-miR-23a-3p | 2911 | 3932 |
| hsa-miR-23a-5p | 2912 | 3933 |
| hsa-miR-23b-3p | 2913 | 3934 |
| hsa-miR-23b-5p | 2914 | 3935 |
| hsa-miR-23c | 2915 | 3936 |
| hsa-miR-24-1-5p | 2916 | 3937 |
| hsa-miR-24-2-5p | 2917 | 3938 |
| hsa-miR-24-3p | 2918 | 3939 |
| hsa-miR-2467-3p | 2919 | 3940 |
| hsa-miR-2467-5p | 2920 | 3941 |
| hsa-miR-25-3p | 2921 | 3942 |
| hsa-miR-25-5p | 2922 | 3943 |
| hsa-miR-2681-3p | 2923 | 3944 |
| hsa-miR-2681-5p | 2924 | 3945 |
| hsa-miR-2682-3p | 2925 | 3946 |
| hsa-miR-2682-5p | 2926 | 3947 |
| hsa-miR-26a-1-3p | 2927 | 3948 |
| hsa-miR-26a-2-3p | 2928 | 3949 |
| hsa-miR-26a-5p | 2929 | 3950 |
| hsa-miR-26b-3p | 2930 | 3951 |
| hsa-miR-26b-5p | 2931 | 3952 |
| hsa-miR-27a-3p | 2932 | 3953 |

TABLE 9-continued

Mirs and mir binding sites

| microRNA | mir SEQ ID | BS SEQ ID |
|---|---|---|
| hsa-miR-27a-5p | 2933 | 3954 |
| hsa-miR-27b-3p | 2934 | 3955 |
| hsa-miR-27b-5p | 2935 | 3956 |
| hsa-miR-28-3p | 2936 | 3957 |
| hsa-miR-28-5p | 2937 | 3958 |
| hsa-miR-2861 | 2938 | 3959 |
| hsa-miR-2909 | 2939 | 3960 |
| hsa-miR-296-3p | 2940 | 3961 |
| hsa-miR-2964a-3p | 2941 | 3962 |
| hsa-miR-2964a-5p | 2942 | 3963 |
| hsa-miR-296-5p | 2943 | 3964 |
| hsa-miR-297 | 2944 | 3965 |
| hsa-miR-298 | 2945 | 3966 |
| hsa-miR-299-3p | 2946 | 3967 |
| hsa-miR-299-5p | 2947 | 3968 |
| hsa-miR-29a-3p | 2948 | 3969 |
| hsa-miR-29a-5p | 2949 | 3970 |
| hsa-miR-29b-1-5p | 2950 | 3971 |
| hsa-miR-29b-2-5p | 2951 | 3972 |
| hsa-miR-29b-3p | 2952 | 3973 |
| hsa-miR-29c-3p | 2953 | 3974 |
| hsa-miR-29c-5p | 2954 | 3975 |
| hsa-miR-300 | 2955 | 3976 |
| hsa-miR-301a-3p | 2956 | 3977 |
| hsa-miR-301a-5p | 2957 | 3978 |
| hsa-miR-301b | 2958 | 3979 |
| hsa-miR-302a-3p | 2959 | 3980 |
| hsa-miR-302a-5p | 2960 | 3981 |
| hsa-miR-302b-3p | 2961 | 3982 |
| hsa-miR-302b-5p | 2962 | 3983 |
| hsa-miR-302c-3p | 2963 | 3984 |
| hsa-miR-302c-5p | 2964 | 3985 |
| hsa-miR-302d-3p | 2965 | 3986 |
| hsa-miR-302d-5p | 2966 | 3987 |
| hsa-miR-302e | 2967 | 3988 |
| hsa-miR-302f | 2968 | 3989 |
| hsa-miR-3064-3p | 2969 | 3990 |
| hsa-miR-3064-5p | 2970 | 3991 |
| hsa-miR-3065-3p | 2971 | 3992 |
| hsa-miR-3065-5p | 2972 | 3993 |
| hsa-miR-3074-3p | 2973 | 3994 |
| hsa-miR-3074-5p | 2974 | 3995 |
| hsa-miR-30a-3p | 2975 | 3996 |
| hsa-miR-30a-5p | 2976 | 3997 |
| hsa-miR-30b-3p | 2977 | 3998 |
| hsa-miR-30b-5p | 2978 | 3999 |
| hsa-miR-30c-1-3p | 2979 | 4000 |
| hsa-miR-30c-2-3p | 2980 | 4001 |
| hsa-miR-30c-5p | 2981 | 4002 |
| hsa-miR-30d-3p | 2982 | 4003 |
| hsa-miR-30d-5p | 2983 | 4004 |
| hsa-miR-30e-3p | 2984 | 4005 |
| hsa-miR-30e-5p | 2985 | 4006 |
| hsa-miR-3115 | 2986 | 4007 |
| hsa-miR-3116 | 2987 | 4008 |
| hsa-miR-3117-3p | 2988 | 4009 |
| hsa-miR-3117-5p | 2989 | 4010 |
| hsa-miR-3118 | 2990 | 4011 |
| hsa-miR-3119 | 2991 | 4012 |
| hsa-miR-3120-3p | 2992 | 4013 |
| hsa-miR-3120-5p | 2993 | 4014 |
| hsa-miR-3121-3p | 2994 | 4015 |
| hsa-miR-3121-5p | 2995 | 4016 |
| hsa-miR-3122 | 2996 | 4017 |
| hsa-miR-3123 | 2997 | 4018 |
| hsa-miR-3124-3p | 2998 | 4019 |
| hsa-miR-3124-5p | 2999 | 4020 |
| hsa-miR-3125 | 3000 | 4021 |
| hsa-miR-3126-3p | 3001 | 4022 |
| hsa-miR-3126-5p | 3002 | 4023 |
| hsa-miR-3127-3p | 3003 | 4024 |
| hsa-miR-3127-5p | 3004 | 4025 |
| hsa-miR-3128 | 3005 | 4026 |
| hsa-miR-3129-3p | 3006 | 4027 |
| hsa-miR-3129-5p | 3007 | 4028 |
| hsa-miR-3130-3p | 3008 | 4029 |
| hsa-miR-3130-5p | 3009 | 4030 |
| hsa-miR-3131 | 3010 | 4031 |
| hsa-miR-3132 | 3011 | 4032 |
| hsa-miR-3133 | 3012 | 4033 |
| hsa-miR-3134 | 3013 | 4034 |
| hsa-miR-3135a | 3014 | 4035 |
| hsa-miR-3135b | 3015 | 4036 |
| hsa-miR-3136-3p | 3016 | 4037 |
| hsa-miR-3136-5p | 3017 | 4038 |
| hsa-miR-3137 | 3018 | 4039 |
| hsa-miR-3138 | 3019 | 4040 |
| hsa-miR-3139 | 3020 | 4041 |
| hsa-miR-31-3p | 3021 | 4042 |
| hsa-miR-3140-3p | 3022 | 4043 |
| hsa-miR-3140-5p | 3023 | 4044 |
| hsa-miR-3141 | 3024 | 4045 |
| hsa-miR-3142 | 3025 | 4046 |
| hsa-miR-3143 | 3026 | 4047 |
| hsa-miR-3144-3p | 3027 | 4048 |
| hsa-miR-3144-5p | 3028 | 4049 |
| hsa-miR-3145-3p | 3029 | 4050 |
| hsa-miR-3145-5p | 3030 | 4051 |
| hsa-miR-3146 | 3031 | 4052 |
| hsa-miR-3147 | 3032 | 4053 |
| hsa-miR-3148 | 3033 | 4054 |
| hsa-miR-3149 | 3034 | 4055 |
| hsa-miR-3150a-3p | 3035 | 4056 |
| hsa-miR-3150a-5p | 3036 | 4057 |
| hsa-miR-3150b-3p | 3037 | 4058 |
| hsa-miR-3150b-5p | 3038 | 4059 |
| hsa-miR-3151 | 3039 | 4060 |
| hsa-miR-3152-3p | 3040 | 4061 |
| hsa-miR-3152-5p | 3041 | 4062 |
| hsa-miR-3153 | 3042 | 4063 |
| hsa-miR-3154 | 3043 | 4064 |
| hsa-miR-3155a | 3044 | 4065 |
| hsa-miR-3155b | 3045 | 4066 |
| hsa-miR-3156-3p | 3046 | 4067 |
| hsa-miR-3156-5p | 3047 | 4068 |
| hsa-miR-3157-3p | 3048 | 4069 |
| hsa-miR-3157-5p | 3049 | 4070 |
| hsa-miR-3158-3p | 3050 | 4071 |
| hsa-miR-3158-5p | 3051 | 4072 |
| hsa-miR-3159 | 3052 | 4073 |
| hsa-miR-31-5p | 3053 | 4074 |
| hsa-miR-3160-3p | 3054 | 4075 |
| hsa-miR-3160-5p | 3055 | 4076 |
| hsa-miR-3161 | 3056 | 4077 |
| hsa-miR-3162-3p | 3057 | 4078 |
| hsa-miR-3162-5p | 3058 | 4079 |
| hsa-miR-3163 | 3059 | 4080 |
| hsa-miR-3164 | 3060 | 4081 |
| hsa-miR-3165 | 3061 | 4082 |
| hsa-miR-3166 | 3062 | 4083 |
| hsa-miR-3167 | 3063 | 4084 |
| hsa-miR-3168 | 3064 | 4085 |
| hsa-miR-3169 | 3065 | 4086 |
| hsa-miR-3170 | 3066 | 4087 |
| hsa-miR-3171 | 3067 | 4088 |
| hsa-miR-3173-3p | 3068 | 4089 |
| hsa-miR-3173-5p | 3069 | 4090 |
| hsa-miR-3174 | 3070 | 4091 |
| hsa-miR-3175 | 3071 | 4092 |
| hsa-miR-3176 | 3072 | 4093 |
| hsa-miR-3177-3p | 3073 | 4094 |
| hsa-miR-3177-5p | 3074 | 4095 |
| hsa-miR-3178 | 3075 | 4096 |
| hsa-miR-3179 | 3076 | 4097 |
| hsa-miR-3180 | 3077 | 4098 |
| hsa-miR-3180-3p | 3078 | 4099 |
| hsa-miR-3180-5p | 3079 | 4100 |
| hsa-miR-3181 | 3080 | 4101 |
| hsa-miR-3182 | 3081 | 4102 |
| hsa-miR-3183 | 3082 | 4103 |

TABLE 9-continued

Mirs and mir binding sites

| microRNA | mir SEQ ID | BS SEQ ID |
|---|---|---|
| hsa-miR-3184-3p | 3083 | 4104 |
| hsa-miR-3184-5p | 3084 | 4105 |
| hsa-miR-3185 | 3085 | 4106 |
| hsa-miR-3186-3p | 3086 | 4107 |
| hsa-miR-3186-5p | 3087 | 4108 |
| hsa-miR-3187-3p | 3088 | 4109 |
| hsa-miR-3187-5p | 3089 | 4110 |
| hsa-miR-3188 | 3090 | 4111 |
| hsa-miR-3189-3p | 3091 | 4112 |
| hsa-miR-3189-5p | 3092 | 4113 |
| hsa-miR-3190-3p | 3093 | 4114 |
| hsa-miR-3190-5p | 3094 | 4115 |
| hsa-miR-3191-3p | 3095 | 4116 |
| hsa-miR-3191-5p | 3096 | 4117 |
| hsa-miR-3192 | 3097 | 4118 |
| hsa-miR-3193 | 3098 | 4119 |
| hsa-miR-3194-3p | 3099 | 4120 |
| hsa-miR-3194-5p | 3100 | 4121 |
| hsa-miR-3195 | 3101 | 4122 |
| hsa-miR-3196 | 3102 | 4123 |
| hsa-miR-3197 | 3103 | 4124 |
| hsa-miR-3198 | 3104 | 4125 |
| hsa-miR-3199 | 3105 | 4126 |
| hsa-miR-3200-3p | 3106 | 4127 |
| hsa-miR-3200-5p | 3107 | 4128 |
| hsa-miR-3201 | 3108 | 4129 |
| hsa-miR-3202 | 3109 | 4130 |
| hsa-miR-320a | 3110 | 4131 |
| hsa-miR-320b | 3111 | 4132 |
| hsa-miR-320c | 3112 | 4133 |
| hsa-miR-320d | 3113 | 4134 |
| hsa-miR-320e | 3114 | 4135 |
| hsa-miR-323a-3p | 3115 | 4136 |
| hsa-miR-323a-5p | 3116 | 4137 |
| hsa-miR-323b-3p | 3117 | 4138 |
| hsa-miR-323b-5p | 3118 | 4139 |
| hsa-miR-32-3p | 3119 | 4140 |
| hsa-miR-324-3p | 3120 | 4141 |
| hsa-miR-324-5p | 3121 | 4142 |
| hsa-miR-325 | 3122 | 4143 |
| hsa-miR-32-5p | 3123 | 4144 |
| hsa-miR-326 | 3124 | 4145 |
| hsa-miR-328 | 3125 | 4146 |
| hsa-miR-329 | 3126 | 4147 |
| hsa-miR-330-3p | 3127 | 4148 |
| hsa-miR-330-5p | 3128 | 4149 |
| hsa-miR-331-3p | 3129 | 4150 |
| hsa-miR-331-5p | 3130 | 4151 |
| hsa-miR-335-3p | 3131 | 4152 |
| hsa-miR-335-5p | 3132 | 4153 |
| hsa-miR-337-3p | 3133 | 4154 |
| hsa-miR-337-5p | 3134 | 4155 |
| hsa-miR-338-3p | 3135 | 4156 |
| hsa-miR-338-5p | 3136 | 4157 |
| hsa-miR-339-3p | 3137 | 4158 |
| hsa-miR-339-5p | 3138 | 4159 |
| hsa-miR-33a-3p | 3139 | 4160 |
| hsa-miR-33a-5p | 3140 | 4161 |
| hsa-miR-33b-3p | 3141 | 4162 |
| hsa-miR-33b-5p | 3142 | 4163 |
| hsa-miR-340-3p | 3143 | 4164 |
| hsa-miR-340-5p | 3144 | 4165 |
| hsa-miR-342-3p | 3145 | 4166 |
| hsa-miR-342-5p | 3146 | 4167 |
| hsa-miR-345-3p | 3147 | 4168 |
| hsa-miR-345-5p | 3148 | 4169 |
| hsa-miR-346 | 3149 | 4170 |
| hsa-miR-34a-3p | 3150 | 4171 |
| hsa-miR-34a-5p | 3151 | 4172 |
| hsa-miR-34b-3p | 3152 | 4173 |
| hsa-miR-34b-5p | 3153 | 4174 |
| hsa-miR-34c-3p | 3154 | 4175 |
| hsa-miR-34c-5p | 3155 | 4176 |
| hsa-miR-3529-3p | 3156 | 4177 |
| hsa-miR-3529-5p | 3157 | 4178 |
| hsa-miR-3591-3p | 3158 | 4179 |
| hsa-miR-3591-5p | 3159 | 4180 |
| hsa-miR-3605-3p | 3160 | 4181 |
| hsa-miR-3605-5p | 3161 | 4182 |
| hsa-miR-3606-3p | 3162 | 4183 |
| hsa-miR-3606-5p | 3163 | 4184 |
| hsa-miR-3607-3p | 3164 | 4185 |
| hsa-miR-3607-5p | 3165 | 4186 |
| hsa-miR-3609 | 3166 | 4187 |
| hsa-miR-3610 | 3167 | 4188 |
| hsa-miR-3611 | 3168 | 4189 |
| hsa-miR-3612 | 3169 | 4190 |
| hsa-miR-3613-3p | 3170 | 4191 |
| hsa-miR-3613-5p | 3171 | 4192 |
| hsa-miR-361-3p | 3172 | 4193 |
| hsa-miR-3614-3p | 3173 | 4194 |
| hsa-miR-3614-5p | 3174 | 4195 |
| hsa-miR-3615 | 3175 | 4196 |
| hsa-miR-361-5p | 3176 | 4197 |
| hsa-miR-3616-3p | 3177 | 4198 |
| hsa-miR-3616-5p | 3178 | 4199 |
| hsa-miR-3617-3p | 3179 | 4200 |
| hsa-miR-3617-5p | 3180 | 4201 |
| hsa-miR-3618 | 3181 | 4202 |
| hsa-miR-3619-3p | 3182 | 4203 |
| hsa-miR-3619-5p | 3183 | 4204 |
| hsa-miR-3620-3p | 3184 | 4205 |
| hsa-miR-3620-5p | 3185 | 4206 |
| hsa-miR-3621 | 3186 | 4207 |
| hsa-miR-3622a-3p | 3187 | 4208 |
| hsa-miR-3622a-5p | 3188 | 4209 |
| hsa-miR-3622b-3p | 3189 | 4210 |
| hsa-miR-3622b-5p | 3190 | 4211 |
| hsa-miR-362-3p | 3191 | 4212 |
| hsa-miR-362-5p | 3192 | 4213 |
| hsa-miR-363-3p | 3193 | 4214 |
| hsa-miR-363-5p | 3194 | 4215 |
| hsa-miR-3646 | 3195 | 4216 |
| hsa-miR-3648 | 3196 | 4217 |
| hsa-miR-3649 | 3197 | 4218 |
| hsa-miR-3650 | 3198 | 4219 |
| hsa-miR-3651 | 3199 | 4220 |
| hsa-miR-3652 | 3200 | 4221 |
| hsa-miR-3653 | 3201 | 4222 |
| hsa-miR-3654 | 3202 | 4223 |
| hsa-miR-3655 | 3203 | 4224 |
| hsa-miR-3656 | 3204 | 4225 |
| hsa-miR-3657 | 3205 | 4226 |
| hsa-miR-3658 | 3206 | 4227 |
| hsa-miR-3659 | 3207 | 4228 |
| hsa-miR-365a-3p | 3208 | 4229 |
| hsa-miR-365a-5p | 3209 | 4230 |
| hsa-miR-365b-3p | 3210 | 4231 |
| hsa-miR-365b-5p | 3211 | 4232 |
| hsa-miR-3660 | 3212 | 4233 |
| hsa-miR-3661 | 3213 | 4234 |
| hsa-miR-3662 | 3214 | 4235 |
| hsa-miR-3663-3p | 3215 | 4236 |
| hsa-miR-3663-5p | 3216 | 4237 |
| hsa-miR-3664-3p | 3217 | 4238 |
| hsa-miR-3664-5p | 3218 | 4239 |
| hsa-miR-3665 | 3219 | 4240 |
| hsa-miR-3666 | 3220 | 4241 |
| hsa-miR-3667-3p | 3221 | 4242 |
| hsa-miR-3667-5p | 3222 | 4243 |
| hsa-miR-3668 | 3223 | 4244 |
| hsa-miR-3669 | 3224 | 4245 |
| hsa-miR-3670 | 3225 | 4246 |
| hsa-miR-3671 | 3226 | 4247 |
| hsa-miR-3672 | 3227 | 4248 |
| hsa-miR-3673 | 3228 | 4249 |
| hsa-miR-367-3p | 3229 | 4250 |
| hsa-miR-3674 | 3230 | 4251 |
| hsa-miR-3675-3p | 3231 | 4252 |
| hsa-miR-3675-5p | 3232 | 4253 |

TABLE 9-continued

Mirs and mir binding sites

| microRNA | mir SEQ ID | BS SEQ ID |
|---|---|---|
| hsa-miR-367-5p | 3233 | 4254 |
| hsa-miR-3676-3p | 3234 | 4255 |
| hsa-miR-3676-5p | 3235 | 4256 |
| hsa-miR-3677-3p | 3236 | 4257 |
| hsa-miR-3677-5p | 3237 | 4258 |
| hsa-miR-3678-3p | 3238 | 4259 |
| hsa-miR-3678-5p | 3239 | 4260 |
| hsa-miR-3679-3p | 3240 | 4261 |
| hsa-miR-3679-5p | 3241 | 4262 |
| hsa-miR-3680-3p | 3242 | 4263 |
| hsa-miR-3680-5p | 3243 | 4264 |
| hsa-miR-3681-3p | 3244 | 4265 |
| hsa-miR-3681-5p | 3245 | 4266 |
| hsa-miR-3682-3p | 3246 | 4267 |
| hsa-miR-3682-5p | 3247 | 4268 |
| hsa-miR-3683 | 3248 | 4269 |
| hsa-miR-3684 | 3249 | 4270 |
| hsa-miR-3685 | 3250 | 4271 |
| hsa-miR-3686 | 3251 | 4272 |
| hsa-miR-3687 | 3252 | 4273 |
| hsa-miR-3688-3p | 3253 | 4274 |
| hsa-miR-3688-5p | 3254 | 4275 |
| hsa-miR-3689a-3p | 3255 | 4276 |
| hsa-miR-3689a-5p | 3256 | 4277 |
| hsa-miR-3689b-3p | 3257 | 4278 |
| hsa-miR-3689b-5p | 3258 | 4279 |
| hsa-miR-3689c | 3259 | 4280 |
| hsa-miR-3689d | 3260 | 4281 |
| hsa-miR-3689e | 3261 | 4282 |
| hsa-miR-3689f | 3262 | 4283 |
| hsa-miR-3690 | 3263 | 4284 |
| hsa-miR-3691-3p | 3264 | 4285 |
| hsa-miR-3691-5p | 3265 | 4286 |
| hsa-miR-3692-3p | 3266 | 4287 |
| hsa-miR-3692-5p | 3267 | 4288 |
| hsa-miR-369-3p | 3268 | 4289 |
| hsa-miR-369-5p | 3269 | 4290 |
| hsa-miR-370 | 3270 | 4291 |
| hsa-miR-3713 | 3271 | 4292 |
| hsa-miR-3714 | 3272 | 4293 |
| hsa-miR-371a-3p | 3273 | 4294 |
| hsa-miR-371a-5p | 3274 | 4295 |
| hsa-miR-371b-3p | 3275 | 4296 |
| hsa-miR-371b-5p | 3276 | 4297 |
| hsa-miR-372 | 3277 | 4298 |
| hsa-miR-373-3p | 3278 | 4299 |
| hsa-miR-373-5p | 3279 | 4300 |
| hsa-miR-374a-3p | 3280 | 4301 |
| hsa-miR-374a-5p | 3281 | 4302 |
| hsa-miR-374b-3p | 3282 | 4303 |
| hsa-miR-374b-5p | 3283 | 4304 |
| hsa-miR-374c-3p | 3284 | 4305 |
| hsa-miR-374c-5p | 3285 | 4306 |
| hsa-miR-375 | 3286 | 4307 |
| hsa-miR-376a-2-5p | 3287 | 4308 |
| hsa-miR-376a-3p | 3288 | 4309 |
| hsa-miR-376a-5p | 3289 | 4310 |
| hsa-miR-376b-3p | 3290 | 4311 |
| hsa-miR-376b-5p | 3291 | 4312 |
| hsa-miR-376c-3p | 3292 | 4313 |
| hsa-miR-376c-5p | 3293 | 4314 |
| hsa-miR-377-3p | 3294 | 4315 |
| hsa-miR-377-5p | 3295 | 4316 |
| hsa-miR-378a-3p | 3296 | 4317 |
| hsa-miR-378a-5p | 3297 | 4318 |
| hsa-miR-378b | 3298 | 4319 |
| hsa-miR-378c | 3299 | 4320 |
| hsa-miR-378d | 3300 | 4321 |
| hsa-miR-378e | 3301 | 4322 |
| hsa-miR-378f | 3302 | 4323 |
| hsa-miR-378g | 3303 | 4324 |
| hsa-miR-378h | 3304 | 4325 |
| hsa-miR-378i | 3305 | 4326 |
| hsa-miR-378j | 3306 | 4327 |
| hsa-miR-379-3p | 3307 | 4328 |
| hsa-miR-379-5p | 3308 | 4329 |
| hsa-miR-380-3p | 3309 | 4330 |
| hsa-miR-380-5p | 3310 | 4331 |
| hsa-miR-381-3p | 3311 | 4332 |
| hsa-miR-381-5p | 3312 | 4333 |
| hsa-miR-382-3p | 3313 | 4334 |
| hsa-miR-382-5p | 3314 | 4335 |
| hsa-miR-383 | 3315 | 4336 |
| hsa-miR-384 | 3316 | 4337 |
| hsa-miR-3907 | 3317 | 4338 |
| hsa-miR-3908 | 3318 | 4339 |
| hsa-miR-3909 | 3319 | 4340 |
| hsa-miR-3910 | 3320 | 4341 |
| hsa-miR-3911 | 3321 | 4342 |
| hsa-miR-3912 | 3322 | 4343 |
| hsa-miR-3913-3p | 3323 | 4344 |
| hsa-miR-3913-5p | 3324 | 4345 |
| hsa-miR-3914 | 3325 | 4346 |
| hsa-miR-3915 | 3326 | 4347 |
| hsa-miR-3916 | 3327 | 4348 |
| hsa-miR-3917 | 3328 | 4349 |
| hsa-miR-3918 | 3329 | 4350 |
| hsa-miR-3919 | 3330 | 4351 |
| hsa-miR-3920 | 3331 | 4352 |
| hsa-miR-3921 | 3332 | 4353 |
| hsa-miR-3922-3p | 3333 | 4354 |
| hsa-miR-3922-5p | 3334 | 4355 |
| hsa-miR-3923 | 3335 | 4356 |
| hsa-miR-3924 | 3336 | 4357 |
| hsa-miR-3925-3p | 3337 | 4358 |
| hsa-miR-3925-5p | 3338 | 4359 |
| hsa-miR-3926 | 3339 | 4360 |
| hsa-miR-3927-3p | 3340 | 4361 |
| hsa-miR-3927-5p | 3341 | 4362 |
| hsa-miR-3928 | 3342 | 4363 |
| hsa-miR-3929 | 3343 | 4364 |
| hsa-miR-3934-3p | 3344 | 4365 |
| hsa-miR-3934-5p | 3345 | 4366 |
| hsa-miR-3935 | 3346 | 4367 |
| hsa-miR-3936 | 3347 | 4368 |
| hsa-miR-3937 | 3348 | 4369 |
| hsa-miR-3938 | 3349 | 4370 |
| hsa-miR-3939 | 3350 | 4371 |
| hsa-miR-3940-3p | 3351 | 4372 |
| hsa-miR-3940-5p | 3352 | 4373 |
| hsa-miR-3941 | 3353 | 4374 |
| hsa-miR-3942-3p | 3354 | 4375 |
| hsa-miR-3942-5p | 3355 | 4376 |
| hsa-miR-3943 | 3356 | 4377 |
| hsa-miR-3944-3p | 3357 | 4378 |
| hsa-miR-3944-5p | 3358 | 4379 |
| hsa-miR-3945 | 3359 | 4380 |
| hsa-miR-3960 | 3360 | 4381 |
| hsa-miR-3972 | 3361 | 4382 |
| hsa-miR-3973 | 3362 | 4383 |
| hsa-miR-3974 | 3363 | 4384 |
| hsa-miR-3975 | 3364 | 4385 |
| hsa-miR-3976 | 3365 | 4386 |
| hsa-miR-3977 | 3366 | 4387 |
| hsa-miR-3978 | 3367 | 4388 |
| hsa-miR-409-3p | 3368 | 4389 |
| hsa-miR-409-5p | 3369 | 4390 |
| hsa-miR-410 | 3370 | 4391 |
| hsa-miR-411-3p | 3371 | 4392 |
| hsa-miR-411-5p | 3372 | 4393 |
| hsa-miR-412 | 3373 | 4394 |
| hsa-miR-421 | 3374 | 4395 |
| hsa-miR-422a | 3375 | 4396 |
| hsa-miR-423-3p | 3376 | 4397 |
| hsa-miR-423-5p | 3377 | 4398 |
| hsa-miR-424-3p | 3378 | 4399 |
| hsa-miR-424-5p | 3379 | 4400 |
| hsa-miR-4251 | 3380 | 4401 |
| hsa-miR-4252 | 3381 | 4402 |
| hsa-miR-4253 | 3382 | 4403 |

TABLE 9-continued

Mirs and mir binding sites

| microRNA | mir SEQ ID | BS SEQ ID |
|---|---|---|
| hsa-miR-425-3p | 3383 | 4404 |
| hsa-miR-4254 | 3384 | 4405 |
| hsa-miR-4255 | 3385 | 4406 |
| hsa-miR-425-5p | 3386 | 4407 |
| hsa-miR-4256 | 3387 | 4408 |
| hsa-miR-4257 | 3388 | 4409 |
| hsa-miR-4258 | 3389 | 4410 |
| hsa-miR-4259 | 3390 | 4411 |
| hsa-miR-4260 | 3391 | 4412 |
| hsa-miR-4261 | 3392 | 4413 |
| hsa-miR-4262 | 3393 | 4414 |
| hsa-miR-4263 | 3394 | 4415 |
| hsa-miR-4264 | 3395 | 4416 |
| hsa-miR-4265 | 3396 | 4417 |
| hsa-miR-4266 | 3397 | 4418 |
| hsa-miR-4267 | 3398 | 4419 |
| hsa-miR-4268 | 3399 | 4420 |
| hsa-miR-4269 | 3400 | 4421 |
| hsa-miR-4270 | 3401 | 4422 |
| hsa-miR-4271 | 3402 | 4423 |
| hsa-miR-4272 | 3403 | 4424 |
| hsa-miR-4273 | 3404 | 4425 |
| hsa-miR-4274 | 3405 | 4426 |
| hsa-miR-4275 | 3406 | 4427 |
| hsa-miR-4276 | 3407 | 4428 |
| hsa-miR-4277 | 3408 | 4429 |
| hsa-miR-4278 | 3409 | 4430 |
| hsa-miR-4279 | 3410 | 4431 |
| hsa-miR-4280 | 3411 | 4432 |
| hsa-miR-4281 | 3412 | 4433 |
| hsa-miR-4282 | 3413 | 4434 |
| hsa-miR-4283 | 3414 | 4435 |
| hsa-miR-4284 | 3415 | 4436 |
| hsa-miR-4285 | 3416 | 4437 |
| hsa-miR-4286 | 3417 | 4438 |
| hsa-miR-4287 | 3418 | 4439 |
| hsa-miR-4288 | 3419 | 4440 |
| hsa-miR-4289 | 3420 | 4441 |
| hsa-miR-429 | 3421 | 4442 |
| hsa-miR-4290 | 3422 | 4443 |
| hsa-miR-4291 | 3423 | 4444 |
| hsa-miR-4292 | 3424 | 4445 |
| hsa-miR-4293 | 3425 | 4446 |
| hsa-miR-4294 | 3426 | 4447 |
| hsa-miR-4295 | 3427 | 4448 |
| hsa-miR-4296 | 3428 | 4449 |
| hsa-miR-4297 | 3429 | 4450 |
| hsa-miR-4298 | 3430 | 4451 |
| hsa-miR-4299 | 3431 | 4452 |
| hsa-miR-4300 | 3432 | 4453 |
| hsa-miR-4301 | 3433 | 4454 |
| hsa-miR-4302 | 3434 | 4455 |
| hsa-miR-4303 | 3435 | 4456 |
| hsa-miR-4304 | 3436 | 4457 |
| hsa-miR-4305 | 3437 | 4458 |
| hsa-miR-4306 | 3438 | 4459 |
| hsa-miR-4307 | 3439 | 4460 |
| hsa-miR-4308 | 3440 | 4461 |
| hsa-miR-4309 | 3441 | 4462 |
| hsa-miR-4310 | 3442 | 4463 |
| hsa-miR-4311 | 3443 | 4464 |
| hsa-miR-4312 | 3444 | 4465 |
| hsa-miR-4313 | 3445 | 4466 |
| hsa-miR-431-3p | 3446 | 4467 |
| hsa-miR-4314 | 3447 | 4468 |
| hsa-miR-4315 | 3448 | 4469 |
| hsa-miR-431-5p | 3449 | 4470 |
| hsa-miR-4316 | 3450 | 4471 |
| hsa-miR-4317 | 3451 | 4472 |
| hsa-miR-4318 | 3452 | 4473 |
| hsa-miR-4319 | 3453 | 4474 |
| hsa-miR-4320 | 3454 | 4475 |
| hsa-miR-4321 | 3455 | 4476 |
| hsa-miR-4322 | 3456 | 4477 |
| hsa-miR-4323 | 3457 | 4478 |
| hsa-miR-432-3p | 3458 | 4479 |
| hsa-miR-4324 | 3459 | 4480 |
| hsa-miR-4325 | 3460 | 4481 |
| hsa-miR-432-5p | 3461 | 4482 |
| hsa-miR-4326 | 3462 | 4483 |
| hsa-miR-4327 | 3463 | 4484 |
| hsa-miR-4328 | 3464 | 4485 |
| hsa-miR-4329 | 3465 | 4486 |
| hsa-miR-433 | 3466 | 4487 |
| hsa-miR-4330 | 3467 | 4488 |
| hsa-miR-4417 | 3468 | 4489 |
| hsa-miR-4418 | 3469 | 4490 |
| hsa-miR-4419a | 3470 | 4491 |
| hsa-miR-4419b | 3471 | 4492 |
| hsa-miR-4420 | 3472 | 4493 |
| hsa-miR-4421 | 3473 | 4494 |
| hsa-miR-4422 | 3474 | 4495 |
| hsa-miR-4423-3p | 3475 | 4496 |
| hsa-miR-4423-5p | 3476 | 4497 |
| hsa-miR-4424 | 3477 | 4498 |
| hsa-miR-4425 | 3478 | 4499 |
| hsa-miR-4426 | 3479 | 4500 |
| hsa-miR-4427 | 3480 | 4501 |
| hsa-miR-4428 | 3481 | 4502 |
| hsa-miR-4429 | 3482 | 4503 |
| hsa-miR-4430 | 3483 | 4504 |
| hsa-miR-4431 | 3484 | 4505 |
| hsa-miR-4432 | 3485 | 4506 |
| hsa-miR-4433-3p | 3486 | 4507 |
| hsa-miR-4433-5p | 3487 | 4508 |
| hsa-miR-4434 | 3488 | 4509 |
| hsa-miR-4435 | 3489 | 4510 |
| hsa-miR-4436a | 3490 | 4511 |
| hsa-miR-4436b-3p | 3491 | 4512 |
| hsa-miR-4436b-5p | 3492 | 4513 |
| hsa-miR-4437 | 3493 | 4514 |
| hsa-miR-4438 | 3494 | 4515 |
| hsa-miR-4439 | 3495 | 4516 |
| hsa-miR-4440 | 3496 | 4517 |
| hsa-miR-4441 | 3497 | 4518 |
| hsa-miR-4442 | 3498 | 4519 |
| hsa-miR-4443 | 3499 | 4520 |
| hsa-miR-4444 | 3500 | 4521 |
| hsa-miR-4445-3p | 3501 | 4522 |
| hsa-miR-4445-5p | 3502 | 4523 |
| hsa-miR-4446-3p | 3503 | 4524 |
| hsa-miR-4446-5p | 3504 | 4525 |
| hsa-miR-4447 | 3505 | 4526 |
| hsa-miR-4448 | 3506 | 4527 |
| hsa-miR-4449 | 3507 | 4528 |
| hsa-miR-4450 | 3508 | 4529 |
| hsa-miR-4451 | 3509 | 4530 |
| hsa-miR-4452 | 3510 | 4531 |
| hsa-miR-4453 | 3511 | 4532 |
| hsa-miR-4454 | 3512 | 4533 |
| hsa-miR-4455 | 3513 | 4534 |
| hsa-miR-4456 | 3514 | 4535 |
| hsa-miR-4457 | 3515 | 4536 |
| hsa-miR-4458 | 3516 | 4537 |
| hsa-miR-4459 | 3517 | 4538 |
| hsa-miR-4460 | 3518 | 4539 |
| hsa-miR-4461 | 3519 | 4540 |
| hsa-miR-4462 | 3520 | 4541 |
| hsa-miR-4463 | 3521 | 4542 |
| hsa-miR-4464 | 3522 | 4543 |
| hsa-miR-4465 | 3523 | 4544 |
| hsa-miR-4466 | 3524 | 4545 |
| hsa-miR-4467 | 3525 | 4546 |
| hsa-miR-4468 | 3526 | 4547 |
| hsa-miR-4469 | 3527 | 4548 |
| hsa-miR-4470 | 3528 | 4549 |
| hsa-miR-4471 | 4550 | 5571 |
| hsa-miR-4472 | 4551 | 5572 |
| hsa-miR-4473 | 4552 | 5573 |
| hsa-miR-4474-3p | 4553 | 5574 |

TABLE 9-continued

Mirs and mir binding sites

| microRNA | mir SEQ ID | BS SEQ ID |
|---|---|---|
| hsa-miR-4474-5p | 4554 | 5575 |
| hsa-miR-4475 | 4555 | 5576 |
| hsa-miR-4476 | 4556 | 5577 |
| hsa-miR-4477a | 4557 | 5578 |
| hsa-miR-4477b | 4558 | 5579 |
| hsa-miR-4478 | 4559 | 5580 |
| hsa-miR-4479 | 4560 | 5581 |
| hsa-miR-448 | 4561 | 5582 |
| hsa-miR-4480 | 4562 | 5583 |
| hsa-miR-4481 | 4563 | 5584 |
| hsa-miR-4482-3p | 4564 | 5585 |
| hsa-miR-4482-5p | 4565 | 5586 |
| hsa-miR-4483 | 4566 | 5587 |
| hsa-miR-4484 | 4567 | 5588 |
| hsa-miR-4485 | 4568 | 5589 |
| hsa-miR-4486 | 4569 | 5590 |
| hsa-miR-4487 | 4570 | 5591 |
| hsa-miR-4488 | 4571 | 5592 |
| hsa-miR-4489 | 4572 | 5593 |
| hsa-miR-4490 | 4573 | 5594 |
| hsa-miR-4491 | 4574 | 5595 |
| hsa-miR-4492 | 4575 | 5596 |
| hsa-miR-4493 | 4576 | 5597 |
| hsa-miR-4494 | 4577 | 5598 |
| hsa-miR-4495 | 4578 | 5599 |
| hsa-miR-4496 | 4579 | 5600 |
| hsa-miR-4497 | 4580 | 5601 |
| hsa-miR-4498 | 4581 | 5602 |
| hsa-miR-4499 | 4582 | 5603 |
| hsa-miR-449a | 4583 | 5604 |
| hsa-miR-449b-3p | 4584 | 5605 |
| hsa-miR-449b-5p | 4585 | 5606 |
| hsa-miR-449c-3p | 4586 | 5607 |
| hsa-miR-449c-5p | 4587 | 5608 |
| hsa-miR-4500 | 4588 | 5609 |
| hsa-miR-4501 | 4589 | 5610 |
| hsa-miR-4502 | 4590 | 5611 |
| hsa-miR-4503 | 4591 | 5612 |
| hsa-miR-4504 | 4592 | 5613 |
| hsa-miR-4505 | 4593 | 5614 |
| hsa-miR-4506 | 4594 | 5615 |
| hsa-miR-4507 | 4595 | 5616 |
| hsa-miR-4508 | 4596 | 5617 |
| hsa-miR-4509 | 4597 | 5618 |
| hsa-miR-450a-3p | 4598 | 5619 |
| hsa-miR-450a-5p | 4599 | 5620 |
| hsa-miR-450b-3p | 4600 | 5621 |
| hsa-miR-450b-5p | 4601 | 5622 |
| hsa-miR-4510 | 4602 | 5623 |
| hsa-miR-4511 | 4603 | 5624 |
| hsa-miR-4512 | 4604 | 5625 |
| hsa-miR-4513 | 4605 | 5626 |
| hsa-miR-4514 | 4606 | 5627 |
| hsa-miR-4515 | 4607 | 5628 |
| hsa-miR-4516 | 4608 | 5629 |
| hsa-miR-4517 | 4609 | 5630 |
| hsa-miR-4518 | 4610 | 5631 |
| hsa-miR-4519 | 4611 | 5632 |
| hsa-miR-451a | 4612 | 5633 |
| hsa-miR-451b | 4613 | 5634 |
| hsa-miR-4520a-3p | 4614 | 5635 |
| hsa-miR-4520a-5p | 4615 | 5636 |
| hsa-miR-4520b-3p | 4616 | 5637 |
| hsa-miR-4520b-5p | 4617 | 5638 |
| hsa-miR-4521 | 4618 | 5639 |
| hsa-miR-4522 | 4619 | 5640 |
| hsa-miR-4523 | 4620 | 5641 |
| hsa-miR-452-3p | 4621 | 5642 |
| hsa-miR-4524a-3p | 4622 | 5643 |
| hsa-miR-4524a-5p | 4623 | 5644 |
| hsa-miR-4524b-3p | 4624 | 5645 |
| hsa-miR-4524b-5p | 4625 | 5646 |
| hsa-miR-4525 | 4626 | 5647 |
| hsa-miR-452-5p | 4627 | 5648 |
| hsa-miR-4526 | 4628 | 5649 |
| hsa-miR-4527 | 4629 | 5650 |
| hsa-miR-4528 | 4630 | 5651 |
| hsa-miR-4529-3p | 4631 | 5652 |
| hsa-miR-4529-5p | 4632 | 5653 |
| hsa-miR-4530 | 4633 | 5654 |
| hsa-miR-4531 | 4634 | 5655 |
| hsa-miR-4532 | 4635 | 5656 |
| hsa-miR-4533 | 4636 | 5657 |
| hsa-miR-4534 | 4637 | 5658 |
| hsa-miR-4535 | 4638 | 5659 |
| hsa-miR-4536-3p | 4639 | 5660 |
| hsa-miR-4536-5p | 4640 | 5661 |
| hsa-miR-4537 | 4641 | 5662 |
| hsa-miR-4538 | 4642 | 5663 |
| hsa-miR-4539 | 4643 | 5664 |
| hsa-miR-4540 | 4644 | 5665 |
| hsa-miR-454-3p | 4645 | 5666 |
| hsa-miR-454-5p | 4646 | 5667 |
| hsa-miR-455-3p | 4647 | 5668 |
| hsa-miR-455-5p | 4648 | 5669 |
| hsa-miR-4632-3p | 4649 | 5670 |
| hsa-miR-4632-5p | 4650 | 5671 |
| hsa-miR-4633-3p | 4651 | 5672 |
| hsa-miR-4633-5p | 4652 | 5673 |
| hsa-miR-4634 | 4653 | 5674 |
| hsa-miR-4635 | 4654 | 5675 |
| hsa-miR-4636 | 4655 | 5676 |
| hsa-miR-4637 | 4656 | 5677 |
| hsa-miR-4638-3p | 4657 | 5678 |
| hsa-miR-4638-5p | 4658 | 5679 |
| hsa-miR-4639-3p | 4659 | 5680 |
| hsa-miR-4639-5p | 4660 | 5681 |
| hsa-miR-4640-3p | 4661 | 5682 |
| hsa-miR-4640-5p | 4662 | 5683 |
| hsa-miR-4641 | 4663 | 5684 |
| hsa-miR-4642 | 4664 | 5685 |
| hsa-miR-4643 | 4665 | 5686 |
| hsa-miR-4644 | 4666 | 5687 |
| hsa-miR-4645-3p | 4667 | 5688 |
| hsa-miR-4645-5p | 4668 | 5689 |
| hsa-miR-4646-3p | 4669 | 5690 |
| hsa-miR-4646-5p | 4670 | 5691 |
| hsa-miR-4647 | 4671 | 5692 |
| hsa-miR-4648 | 4672 | 5693 |
| hsa-miR-4649-3p | 4673 | 5694 |
| hsa-miR-4649-5p | 4674 | 5695 |
| hsa-miR-4650-3p | 4675 | 5696 |
| hsa-miR-4650-5p | 4676 | 5697 |
| hsa-miR-4651 | 4677 | 5698 |
| hsa-miR-4652-3p | 4678 | 5699 |
| hsa-miR-4652-5p | 4679 | 5700 |
| hsa-miR-4653-3p | 4680 | 5701 |
| hsa-miR-4653-5p | 4681 | 5702 |
| hsa-miR-4654 | 4682 | 5703 |
| hsa-miR-4655-3p | 4683 | 5704 |
| hsa-miR-4655-5p | 4684 | 5705 |
| hsa-miR-4656 | 4685 | 5706 |
| hsa-miR-4657 | 4686 | 5707 |
| hsa-miR-4658 | 4687 | 5708 |
| hsa-miR-4659a-3p | 4688 | 5709 |
| hsa-miR-4659a-5p | 4689 | 5710 |
| hsa-miR-4659b-3p | 4690 | 5711 |
| hsa-miR-4659b-5p | 4691 | 5712 |
| hsa-miR-466 | 4692 | 5713 |
| hsa-miR-4660 | 4693 | 5714 |
| hsa-miR-4661-3p | 4694 | 5715 |
| hsa-miR-4661-5p | 4695 | 5716 |
| hsa-miR-4662a-3p | 4696 | 5717 |
| hsa-miR-4662a-5p | 4697 | 5718 |
| hsa-miR-4662b | 4698 | 5719 |
| hsa-miR-4663 | 4699 | 5720 |
| hsa-miR-4664-3p | 4700 | 5721 |
| hsa-miR-4664-5p | 4701 | 5722 |
| hsa-miR-4665-3p | 4702 | 5723 |
| hsa-miR-4665-5p | 4703 | 5724 |

TABLE 9-continued

Mirs and mir binding sites

| microRNA | mir SEQ ID | BS SEQ ID |
|---|---|---|
| hsa-miR-4666a-3p | 4704 | 5725 |
| hsa-miR-4666a-5p | 4705 | 5726 |
| hsa-miR-4666b | 4706 | 5727 |
| hsa-miR-4667-3p | 4707 | 5728 |
| hsa-miR-4667-5p | 4708 | 5729 |
| hsa-miR-4668-3p | 4709 | 5730 |
| hsa-miR-4668-5p | 4710 | 5731 |
| hsa-miR-4669 | 4711 | 5732 |
| hsa-miR-4670-3p | 4712 | 5733 |
| hsa-miR-4670-5p | 4713 | 5734 |
| hsa-miR-4671-3p | 4714 | 5735 |
| hsa-miR-4671-5p | 4715 | 5736 |
| hsa-miR-4672 | 4716 | 5737 |
| hsa-miR-4673 | 4717 | 5738 |
| hsa-miR-4674 | 4718 | 5739 |
| hsa-miR-4675 | 4719 | 5740 |
| hsa-miR-4676-3p | 4720 | 5741 |
| hsa-miR-4676-5p | 4721 | 5742 |
| hsa-miR-4677-3p | 4722 | 5743 |
| hsa-miR-4677-5p | 4723 | 5744 |
| hsa-miR-4678 | 4724 | 5745 |
| hsa-miR-4679 | 4725 | 5746 |
| hsa-miR-4680-3p | 4726 | 5747 |
| hsa-miR-4680-5p | 4727 | 5748 |
| hsa-miR-4681 | 4728 | 5749 |
| hsa-miR-4682 | 4729 | 5750 |
| hsa-miR-4683 | 4730 | 5751 |
| hsa-miR-4684-3p | 4731 | 5752 |
| hsa-miR-4684-5p | 4732 | 5753 |
| hsa-miR-4685-3p | 4733 | 5754 |
| hsa-miR-4685-5p | 4734 | 5755 |
| hsa-miR-4686 | 4735 | 5756 |
| hsa-miR-4687-3p | 4736 | 5757 |
| hsa-miR-4687-5p | 4737 | 5758 |
| hsa-miR-4688 | 4738 | 5759 |
| hsa-miR-4689 | 4739 | 5760 |
| hsa-miR-4690-3p | 4740 | 5761 |
| hsa-miR-4690-5p | 4741 | 5762 |
| hsa-miR-4691-3p | 4742 | 5763 |
| hsa-miR-4691-5p | 4743 | 5764 |
| hsa-miR-4692 | 4744 | 5765 |
| hsa-miR-4693-3p | 4745 | 5766 |
| hsa-miR-4693-5p | 4746 | 5767 |
| hsa-miR-4694-3p | 4747 | 5768 |
| hsa-miR-4694-5p | 4748 | 5769 |
| hsa-miR-4695-3p | 4749 | 5770 |
| hsa-miR-4695-5p | 4750 | 5771 |
| hsa-miR-4696 | 4751 | 5772 |
| hsa-miR-4697-3p | 4752 | 5773 |
| hsa-miR-4697-5p | 4753 | 5774 |
| hsa-miR-4698 | 4754 | 5775 |
| hsa-miR-4699-3p | 4755 | 5776 |
| hsa-miR-4699-5p | 4756 | 5777 |
| hsa-miR-4700-3p | 4757 | 5778 |
| hsa-miR-4700-5p | 4758 | 5779 |
| hsa-miR-4701-3p | 4759 | 5780 |
| hsa-miR-4701-5p | 4760 | 5781 |
| hsa-miR-4703-3p | 4761 | 5782 |
| hsa-miR-4703-5p | 4762 | 5783 |
| hsa-miR-4704-3p | 4763 | 5784 |
| hsa-miR-4704-5p | 4764 | 5785 |
| hsa-miR-4705 | 4765 | 5786 |
| hsa-miR-4706 | 4766 | 5787 |
| hsa-miR-4707-3p | 4767 | 5788 |
| hsa-miR-4707-5p | 4768 | 5789 |
| hsa-miR-4708-3p | 4769 | 5790 |
| hsa-miR-4708-5p | 4770 | 5791 |
| hsa-miR-4709-3p | 4771 | 5792 |
| hsa-miR-4709-5p | 4772 | 5793 |
| hsa-miR-4710 | 4773 | 5794 |
| hsa-miR-4711-3p | 4774 | 5795 |
| hsa-miR-4711-5p | 4775 | 5796 |
| hsa-miR-4712-3p | 4776 | 5797 |
| hsa-miR-4712-5p | 4777 | 5798 |
| hsa-miR-4713-3p | 4778 | 5799 |
| hsa-miR-4713-5p | 4779 | 5800 |
| hsa-miR-4714-3p | 4780 | 5801 |
| hsa-miR-4714-5p | 4781 | 5802 |
| hsa-miR-4715-3p | 4782 | 5803 |
| hsa-miR-4715-5p | 4783 | 5804 |
| hsa-miR-4716-3p | 4784 | 5805 |
| hsa-miR-4716-5p | 4785 | 5806 |
| hsa-miR-4717-3p | 4786 | 5807 |
| hsa-miR-4717-5p | 4787 | 5808 |
| hsa-miR-4718 | 4788 | 5809 |
| hsa-miR-4719 | 4789 | 5810 |
| hsa-miR-4720-3p | 4790 | 5811 |
| hsa-miR-4720-5p | 4791 | 5812 |
| hsa-miR-4721 | 4792 | 5813 |
| hsa-miR-4722-3p | 4793 | 5814 |
| hsa-miR-4722-5p | 4794 | 5815 |
| hsa-miR-4723-3p | 4795 | 5816 |
| hsa-miR-4723-5p | 4796 | 5817 |
| hsa-miR-4724-3p | 4797 | 5818 |
| hsa-miR-4724-5p | 4798 | 5819 |
| hsa-miR-4725-3p | 4799 | 5820 |
| hsa-miR-4725-5p | 4800 | 5821 |
| hsa-miR-4726-3p | 4801 | 5822 |
| hsa-miR-4726-5p | 4802 | 5823 |
| hsa-miR-4727-3p | 4803 | 5824 |
| hsa-miR-4727-5p | 4804 | 5825 |
| hsa-miR-4728-3p | 4805 | 5826 |
| hsa-miR-4728-5p | 4806 | 5827 |
| hsa-miR-4729 | 4807 | 5828 |
| hsa-miR-4730 | 4808 | 5829 |
| hsa-miR-4731-3p | 4809 | 5830 |
| hsa-miR-4731-5p | 4810 | 5831 |
| hsa-miR-4732-3p | 4811 | 5832 |
| hsa-miR-4732-5p | 4812 | 5833 |
| hsa-miR-4733-3p | 4813 | 5834 |
| hsa-miR-4733-5p | 4814 | 5835 |
| hsa-miR-4734 | 4815 | 5836 |
| hsa-miR-4735-3p | 4816 | 5837 |
| hsa-miR-4735-5p | 4817 | 5838 |
| hsa-miR-4736 | 4818 | 5839 |
| hsa-miR-4737 | 4819 | 5840 |
| hsa-miR-4738-3p | 4820 | 5841 |
| hsa-miR-4738-5p | 4821 | 5842 |
| hsa-miR-4739 | 4822 | 5843 |
| hsa-miR-4740-3p | 4823 | 5844 |
| hsa-miR-4740-5p | 4824 | 5845 |
| hsa-miR-4741 | 4825 | 5846 |
| hsa-miR-4742-3p | 4826 | 5847 |
| hsa-miR-4742-5p | 4827 | 5848 |
| hsa-miR-4743-3p | 4828 | 5849 |
| hsa-miR-4743-5p | 4829 | 5850 |
| hsa-miR-4744 | 4830 | 5851 |
| hsa-miR-4745-3p | 4831 | 5852 |
| hsa-miR-4745-5p | 4832 | 5853 |
| hsa-miR-4746-3p | 4833 | 5854 |
| hsa-miR-4746-5p | 4834 | 5855 |
| hsa-miR-4747-3p | 4835 | 5856 |
| hsa-miR-4747-5p | 4836 | 5857 |
| hsa-miR-4748 | 4837 | 5858 |
| hsa-miR-4749-3p | 4838 | 5859 |
| hsa-miR-4749-5p | 4839 | 5860 |
| hsa-miR-4750-3p | 4840 | 5861 |
| hsa-miR-4750-5p | 4841 | 5862 |
| hsa-miR-4751 | 4842 | 5863 |
| hsa-miR-4752 | 4843 | 5864 |
| hsa-miR-4753-3p | 4844 | 5865 |
| hsa-miR-4753-5p | 4845 | 5866 |
| hsa-miR-4754 | 4846 | 5867 |
| hsa-miR-4755-3p | 4847 | 5868 |
| hsa-miR-4755-5p | 4848 | 5869 |
| hsa-miR-4756-3p | 4849 | 5870 |
| hsa-miR-4756-5p | 4850 | 5871 |
| hsa-miR-4757-3p | 4851 | 5872 |
| hsa-miR-4757-5p | 4852 | 5873 |
| hsa-miR-4758-3p | 4853 | 5874 |

TABLE 9-continued

Mirs and mir binding sites

| microRNA | mir SEQ ID | BS SEQ ID |
|---|---|---|
| hsa-miR-4758-5p | 4854 | 5875 |
| hsa-miR-4759 | 4855 | 5876 |
| hsa-miR-4760-3p | 4856 | 5877 |
| hsa-miR-4760-5p | 4857 | 5878 |
| hsa-miR-4761-3p | 4858 | 5879 |
| hsa-miR-4761-5p | 4859 | 5880 |
| hsa-miR-4762-3p | 4860 | 5881 |
| hsa-miR-4762-5p | 4861 | 5882 |
| hsa-miR-4763-3p | 4862 | 5883 |
| hsa-miR-4763-5p | 4863 | 5884 |
| hsa-miR-4764-3p | 4864 | 5885 |
| hsa-miR-4764-5p | 4865 | 5886 |
| hsa-miR-4765 | 4866 | 5887 |
| hsa-miR-4766-3p | 4867 | 5888 |
| hsa-miR-4766-5p | 4868 | 5889 |
| hsa-miR-4767 | 4869 | 5890 |
| hsa-miR-4768-3p | 4870 | 5891 |
| hsa-miR-4768-5p | 4871 | 5892 |
| hsa-miR-4769-3p | 4872 | 5893 |
| hsa-miR-4769-5p | 4873 | 5894 |
| hsa-miR-4770 | 4874 | 5895 |
| hsa-miR-4771 | 4875 | 5896 |
| hsa-miR-4772-3p | 4876 | 5897 |
| hsa-miR-4772-5p | 4877 | 5898 |
| hsa-miR-4773 | 4878 | 5899 |
| hsa-miR-4774-3p | 4879 | 5900 |
| hsa-miR-4774-5p | 4880 | 5901 |
| hsa-miR-4775 | 4881 | 5902 |
| hsa-miR-4776-3p | 4882 | 5903 |
| hsa-miR-4776-5p | 4883 | 5904 |
| hsa-miR-4777-3p | 4884 | 5905 |
| hsa-miR-4777-5p | 4885 | 5906 |
| hsa-miR-4778-3p | 4886 | 5907 |
| hsa-miR-4778-5p | 4887 | 5908 |
| hsa-miR-4779 | 4888 | 5909 |
| hsa-miR-4780 | 4889 | 5910 |
| hsa-miR-4781-3p | 4890 | 5911 |
| hsa-miR-4781-5p | 4891 | 5912 |
| hsa-miR-4782-3p | 4892 | 5913 |
| hsa-miR-4782-5p | 4893 | 5914 |
| hsa-miR-4783-3p | 4894 | 5915 |
| hsa-miR-4783-5p | 4895 | 5916 |
| hsa-miR-4784 | 4896 | 5917 |
| hsa-miR-4785 | 4897 | 5918 |
| hsa-miR-4786-3p | 4898 | 5919 |
| hsa-miR-4786-5p | 4899 | 5920 |
| hsa-miR-4787-3p | 4900 | 5921 |
| hsa-miR-4787-5p | 4901 | 5922 |
| hsa-miR-4788 | 4902 | 5923 |
| hsa-miR-4789-3p | 4903 | 5924 |
| hsa-miR-4789-5p | 4904 | 5925 |
| hsa-miR-4790-3p | 4905 | 5926 |
| hsa-miR-4790-5p | 4906 | 5927 |
| hsa-miR-4791 | 4907 | 5928 |
| hsa-miR-4792 | 4908 | 5929 |
| hsa-miR-4793-3p | 4909 | 5930 |
| hsa-miR-4793-5p | 4910 | 5931 |
| hsa-miR-4794 | 4911 | 5932 |
| hsa-miR-4795-3p | 4912 | 5933 |
| hsa-miR-4795-5p | 4913 | 5934 |
| hsa-miR-4796-3p | 4914 | 5935 |
| hsa-miR-4796-5p | 4915 | 5936 |
| hsa-miR-4797-3p | 4916 | 5937 |
| hsa-miR-4797-5p | 4917 | 5938 |
| hsa-miR-4798-3p | 4918 | 5939 |
| hsa-miR-4798-5p | 4919 | 5940 |
| hsa-miR-4799-3p | 4920 | 5941 |
| hsa-miR-4799-5p | 4921 | 5942 |
| hsa-miR-4800-3p | 4922 | 5943 |
| hsa-miR-4800-5p | 4923 | 5944 |
| hsa-miR-4801 | 4924 | 5945 |
| hsa-miR-4802-3p | 4925 | 5946 |
| hsa-miR-4802-5p | 4926 | 5947 |
| hsa-miR-4803 | 4927 | 5948 |
| hsa-miR-4804-3p | 4928 | 5949 |
| hsa-miR-4804-5p | 4929 | 5950 |
| hsa-miR-483-3p | 4930 | 5951 |
| hsa-miR-483-5p | 4931 | 5952 |
| hsa-miR-484 | 4932 | 5953 |
| hsa-miR-485-3p | 4933 | 5954 |
| hsa-miR-485-5p | 4934 | 5955 |
| hsa-miR-486-3p | 4935 | 5956 |
| hsa-miR-486-5p | 4936 | 5957 |
| hsa-miR-487a | 4937 | 5958 |
| hsa-miR-487b | 4938 | 5959 |
| hsa-miR-488-3p | 4939 | 5960 |
| hsa-miR-488-5p | 4940 | 5961 |
| hsa-miR-489 | 4941 | 5962 |
| hsa-miR-490-3p | 4942 | 5963 |
| hsa-miR-490-5p | 4943 | 5964 |
| hsa-miR-491-3p | 4944 | 5965 |
| hsa-miR-491-5p | 4945 | 5966 |
| hsa-miR-492 | 4946 | 5967 |
| hsa-miR-493-3p | 4947 | 5968 |
| hsa-miR-493-5p | 4948 | 5969 |
| hsa-miR-494 | 4949 | 5970 |
| hsa-miR-495-3p | 4950 | 5971 |
| hsa-miR-495-5p | 4951 | 5972 |
| hsa-miR-496 | 4952 | 5973 |
| hsa-miR-497-3p | 4953 | 5974 |
| hsa-miR-497-5p | 4954 | 5975 |
| hsa-miR-498 | 4955 | 5976 |
| hsa-miR-4999-3p | 4956 | 5977 |
| hsa-miR-4999-5p | 4957 | 5978 |
| hsa-miR-499a-3p | 4958 | 5979 |
| hsa-miR-499a-5p | 4959 | 5980 |
| hsa-miR-499b-3p | 4960 | 5981 |
| hsa-miR-499b-5p | 4961 | 5982 |
| hsa-miR-5000-3p | 4962 | 5983 |
| hsa-miR-5000-5p | 4963 | 5984 |
| hsa-miR-5001-3p | 4964 | 5985 |
| hsa-miR-5001-5p | 4965 | 5986 |
| hsa-miR-5002-3p | 4966 | 5987 |
| hsa-miR-5002-5p | 4967 | 5988 |
| hsa-miR-5003-3p | 4968 | 5989 |
| hsa-miR-5003-5p | 4969 | 5990 |
| hsa-miR-5004-3p | 4970 | 5991 |
| hsa-miR-5004-5p | 4971 | 5992 |
| hsa-miR-5006-3p | 4972 | 5993 |
| hsa-miR-5006-5p | 4973 | 5994 |
| hsa-miR-5007-3p | 4974 | 5995 |
| hsa-miR-5007-5p | 4975 | 5996 |
| hsa-miR-5008-3p | 4976 | 5997 |
| hsa-miR-5008-5p | 4977 | 5998 |
| hsa-miR-5009-3p | 4978 | 5999 |
| hsa-miR-5009-5p | 4979 | 6000 |
| hsa-miR-500a-3p | 4980 | 6001 |
| hsa-miR-500a-5p | 4981 | 6002 |
| hsa-miR-500b | 4982 | 6003 |
| hsa-miR-5010-3p | 4983 | 6004 |
| hsa-miR-5010-5p | 4984 | 6005 |
| hsa-miR-5011-3p | 4985 | 6006 |
| hsa-miR-5011-5p | 4986 | 6007 |
| hsa-miR-501-3p | 4987 | 6008 |
| hsa-miR-501-5p | 4988 | 6009 |
| hsa-miR-502-3p | 4989 | 6010 |
| hsa-miR-502-5p | 4990 | 6011 |
| hsa-miR-503-3p | 4991 | 6012 |
| hsa-miR-503-5p | 4992 | 6013 |
| hsa-miR-504 | 4993 | 6014 |
| hsa-miR-5047 | 4994 | 6015 |
| hsa-miR-505-3p | 4995 | 6016 |
| hsa-miR-505-5p | 4996 | 6017 |
| hsa-miR-506-3p | 4997 | 6018 |
| hsa-miR-506-5p | 4998 | 6019 |
| hsa-miR-507 | 4999 | 6020 |
| hsa-miR-508-3p | 5000 | 6021 |
| hsa-miR-508-5p | 5001 | 6022 |
| hsa-miR-5087 | 5002 | 6023 |
| hsa-miR-5088 | 5003 | 6024 |

TABLE 9-continued

Mirs and mir binding sites

| microRNA | mir SEQ ID | BS SEQ ID |
|---|---|---|
| hsa-miR-5089-3p | 5004 | 6025 |
| hsa-miR-5089-5p | 5005 | 6026 |
| hsa-miR-5090 | 5006 | 6027 |
| hsa-miR-5091 | 5007 | 6028 |
| hsa-miR-5092 | 5008 | 6029 |
| hsa-miR-5093 | 5009 | 6030 |
| hsa-miR-509-3-5p | 5010 | 6031 |
| hsa-miR-509-3p | 5011 | 6032 |
| hsa-miR-5094 | 5012 | 6033 |
| hsa-miR-5095 | 5013 | 6034 |
| hsa-miR-509-5p | 5014 | 6035 |
| hsa-miR-5096 | 5015 | 6036 |
| hsa-miR-510 | 5016 | 6037 |
| hsa-miR-5100 | 5017 | 6038 |
| hsa-miR-511 | 5018 | 6039 |
| hsa-miR-512-3p | 5019 | 6040 |
| hsa-miR-512-5p | 5020 | 6041 |
| hsa-miR-513a-3p | 5021 | 6042 |
| hsa-miR-513a-5p | 5022 | 6043 |
| hsa-miR-513b | 5023 | 6044 |
| hsa-miR-513c-3p | 5024 | 6045 |
| hsa-miR-513c-5p | 5025 | 6046 |
| hsa-miR-514a-3p | 5026 | 6047 |
| hsa-miR-514a-5p | 5027 | 6048 |
| hsa-miR-514b-3p | 5028 | 6049 |
| hsa-miR-514b-5p | 5029 | 6050 |
| hsa-miR-515-3p | 5030 | 6051 |
| hsa-miR-515-5p | 5031 | 6052 |
| hsa-miR-516a-3p | 5032 | 6053 |
| hsa-miR-516a-5p | 5033 | 6054 |
| hsa-miR-516b-3p | 5034 | 6055 |
| hsa-miR-516b-5p | 5035 | 6056 |
| hsa-miR-517-5p | 5036 | 6057 |
| hsa-miR-517a-3p | 5037 | 6058 |
| hsa-miR-517b-3p | 5038 | 6059 |
| hsa-miR-517c-3p | 5039 | 6060 |
| hsa-miR-5186 | 5040 | 6061 |
| hsa-miR-5187-3p | 5041 | 6062 |
| hsa-miR-5187-5p | 5042 | 6063 |
| hsa-miR-5188 | 5043 | 6064 |
| hsa-miR-5189 | 5044 | 6065 |
| hsa-miR-518a-3p | 5045 | 6066 |
| hsa-miR-518a-5p | 5046 | 6067 |
| hsa-miR-518b | 5047 | 6068 |
| hsa-miR-518c-3p | 5048 | 6069 |
| hsa-miR-518c-5p | 5049 | 6070 |
| hsa-miR-518d-3p | 5050 | 6071 |
| hsa-miR-518d-5p | 5051 | 6072 |
| hsa-miR-518e-3p | 5052 | 6073 |
| hsa-miR-518e-5p | 5053 | 6074 |
| hsa-miR-518f-3p | 5054 | 6075 |
| hsa-miR-518f-5p | 5055 | 6076 |
| hsa-miR-5190 | 5056 | 6077 |
| hsa-miR-5191 | 5057 | 6078 |
| hsa-miR-5192 | 5058 | 6079 |
| hsa-miR-5193 | 5059 | 6080 |
| hsa-miR-5194 | 5060 | 6081 |
| hsa-miR-5195-3p | 5061 | 6082 |
| hsa-miR-5195-5p | 5062 | 6083 |
| hsa-miR-5196-3p | 5063 | 6084 |
| hsa-miR-5196-5p | 5064 | 6085 |
| hsa-miR-5197-3p | 5065 | 6086 |
| hsa-miR-5197-5p | 5066 | 6087 |
| hsa-miR-519a-3p | 5067 | 6088 |
| hsa-miR-519a-5p | 5068 | 6089 |
| hsa-miR-519b-3p | 5069 | 6090 |
| hsa-miR-519b-5p | 5070 | 6091 |
| hsa-miR-519c-3p | 5071 | 6092 |
| hsa-miR-519c-5p | 5072 | 6093 |
| hsa-miR-519d | 5073 | 6094 |
| hsa-miR-519e-3p | 5074 | 6095 |
| hsa-miR-519e-5p | 5075 | 6096 |
| hsa-miR-520a-3p | 5076 | 6097 |
| hsa-miR-520a-5p | 5077 | 6098 |
| hsa-miR-520b | 5078 | 6099 |
| hsa-miR-520c-3p | 5079 | 6100 |
| hsa-miR-520c-5p | 5080 | 6101 |
| hsa-miR-520d-3p | 5081 | 6102 |
| hsa-miR-520d-5p | 5082 | 6103 |
| hsa-miR-520e | 5083 | 6104 |
| hsa-miR-520f | 5084 | 6105 |
| hsa-miR-520g | 5085 | 6106 |
| hsa-miR-520h | 5086 | 6107 |
| hsa-miR-521 | 5087 | 6108 |
| hsa-miR-522-3p | 5088 | 6109 |
| hsa-miR-522-5p | 5089 | 6110 |
| hsa-miR-523-3p | 5090 | 6111 |
| hsa-miR-523-5p | 5091 | 6112 |
| hsa-miR-524-3p | 5092 | 6113 |
| hsa-miR-524-5p | 5093 | 6114 |
| hsa-miR-525-3p | 5094 | 6115 |
| hsa-miR-525-5p | 5095 | 6116 |
| hsa-miR-526a | 5096 | 6117 |
| hsa-miR-526b-3p | 5097 | 6118 |
| hsa-miR-526b-5p | 5098 | 6119 |
| hsa-miR-527 | 5099 | 6120 |
| hsa-miR-532-3p | 5100 | 6121 |
| hsa-miR-532-5p | 5101 | 6122 |
| hsa-miR-539-3p | 5102 | 6123 |
| hsa-miR-539-5p | 5103 | 6124 |
| hsa-miR-541-3p | 5104 | 6125 |
| hsa-miR-541-5p | 5105 | 6126 |
| hsa-miR-542-3p | 5106 | 6127 |
| hsa-miR-542-5p | 5107 | 6128 |
| hsa-miR-543 | 5108 | 6129 |
| hsa-miR-544a | 5109 | 6130 |
| hsa-miR-544b | 5110 | 6131 |
| hsa-miR-545-3p | 5111 | 6132 |
| hsa-miR-545-5p | 5112 | 6133 |
| hsa-miR-548 | 5113 | 6134 |
| hsa-miR-548-3p | 5114 | 6135 |
| hsa-miR-548-5p | 5115 | 6136 |
| hsa-miR-548a | 5116 | 6137 |
| hsa-miR-548a-3p | 5117 | 6138 |
| hsa-miR-548a-5p | 5118 | 6139 |
| hsa-miR-548aa | 5119 | 6140 |
| hsa-miR-548ab | 5120 | 6141 |
| hsa-miR-548ac | 5121 | 6142 |
| hsa-miR-548ad | 5122 | 6143 |
| hsa-miR-548ae | 5123 | 6144 |
| hsa-miR-548ag | 5124 | 6145 |
| hsa-miR-548ah-3p | 5125 | 6146 |
| hsa-miR-548ah-5p | 5126 | 6147 |
| hsa-miR-548ai | 5127 | 6148 |
| hsa-miR-548aj-3p | 5128 | 6149 |
| hsa-miR-548aj-5p | 5129 | 6150 |
| hsa-miR-548ak | 5130 | 6151 |
| hsa-miR-548al | 5131 | 6152 |
| hsa-miR-548am-3p | 5132 | 6153 |
| hsa-miR-548am-5p | 5133 | 6154 |
| hsa-miR-548an | 5134 | 6155 |
| hsa-miR-548ao-3p | 5135 | 6156 |
| hsa-miR-548ao-5p | 5136 | 6157 |
| hsa-miR-548ap-3p | 5137 | 6158 |
| hsa-miR-548ap-5p | 5138 | 6159 |
| hsa-miR-548aq-3p | 5139 | 6160 |
| hsa-miR-548aq-5p | 5140 | 6161 |
| hsa-miR-548ar-3p | 5141 | 6162 |
| hsa-miR-548ar-5p | 5142 | 6163 |
| hsa-miR-548as-3p | 5143 | 6164 |
| hsa-miR-548as-5p | 5144 | 6165 |
| hsa-miR-548at-3p | 5145 | 6166 |
| hsa-miR-548at-5p | 5146 | 6167 |
| hsa-miR-548au-3p | 5147 | 6168 |
| hsa-miR-548au-5p | 5148 | 6169 |
| hsa-miR-548av-3p | 5149 | 6170 |
| hsa-miR-548av-5p | 5150 | 6171 |
| hsa-miR-548aw | 5151 | 6172 |
| hsa-miR-548ay-3p | 5152 | 6173 |
| hsa-miR-548ay-5p | 5153 | 6174 |

TABLE 9-continued

Mirs and mir binding sites

| microRNA | mir SEQ ID | BS SEQ ID |
|---|---|---|
| hsa-miR-548az-3p | 5154 | 6175 |
| hsa-miR-548az-5p | 5155 | 6176 |
| hsa-miR-548b-3p | 5156 | 6177 |
| hsa-miR-548b-5p | 5157 | 6178 |
| hsa-miR-548c-3p | 5158 | 6179 |
| hsa-miR-548c-5p | 5159 | 6180 |
| hsa-miR-548d-3p | 5160 | 6181 |
| hsa-miR-548d-5p | 5161 | 6182 |
| hsa-miR-548e | 5162 | 6183 |
| hsa-miR-548f | 5163 | 6184 |
| hsa-miR-548g-3p | 5164 | 6185 |
| hsa-miR-548g-5p | 5165 | 6186 |
| hsa-miR-548h-3p | 5166 | 6187 |
| hsa-miR-548h-5p | 5167 | 6188 |
| hsa-miR-548i | 5168 | 6189 |
| hsa-miR-548j | 5169 | 6190 |
| hsa-miR-548k | 5170 | 6191 |
| hsa-miR-548l | 5171 | 6192 |
| hsa-miR-548m | 5172 | 6193 |
| hsa-miR-548n | 5173 | 6194 |
| hsa-miR-548o-3p | 5174 | 6195 |
| hsa-miR-548o-5p | 5175 | 6196 |
| hsa-miR-548p | 5176 | 6197 |
| hsa-miR-548q | 5177 | 6198 |
| hsa-miR-548s | 5178 | 6199 |
| hsa-miR-548t-3p | 5179 | 6200 |
| hsa-miR-548t-5p | 5180 | 6201 |
| hsa-miR-548u | 5181 | 6202 |
| hsa-miR-548w | 5182 | 6203 |
| hsa-miR-548y | 5183 | 6204 |
| hsa-miR-548z | 5184 | 6205 |
| hsa-miR-549a | 5185 | 6206 |
| hsa-miR-550a-3-5p | 5186 | 6207 |
| hsa-miR-550a-3p | 5187 | 6208 |
| hsa-miR-550a-5p | 5188 | 6209 |
| hsa-miR-550b-2-5p | 5189 | 6210 |
| hsa-miR-550b-3p | 5190 | 6211 |
| hsa-miR-551a | 5191 | 6212 |
| hsa-miR-551b-3p | 5192 | 6213 |
| hsa-miR-551b-5p | 5193 | 6214 |
| hsa-miR-552 | 5194 | 6215 |
| hsa-miR-553 | 5195 | 6216 |
| hsa-miR-554 | 5196 | 6217 |
| hsa-miR-555 | 5197 | 6218 |
| hsa-miR-556-3p | 5198 | 6219 |
| hsa-miR-556-5p | 5199 | 6220 |
| hsa-miR-557 | 5200 | 6221 |
| hsa-miR-5571-3p | 5201 | 6222 |
| hsa-miR-5571-5p | 5202 | 6223 |
| hsa-miR-5572 | 5203 | 6224 |
| hsa-miR-5579-3p | 5204 | 6225 |
| hsa-miR-5579-5p | 5205 | 6226 |
| hsa-miR-558 | 5206 | 6227 |
| hsa-miR-5580-3p | 5207 | 6228 |
| hsa-miR-5580-5p | 5208 | 6229 |
| hsa-miR-5581-3p | 5209 | 6230 |
| hsa-miR-5581-5p | 5210 | 6231 |
| hsa-miR-5582-3p | 5211 | 6232 |
| hsa-miR-5582-5p | 5212 | 6233 |
| hsa-miR-5583-3p | 5213 | 6234 |
| hsa-miR-5583-5p | 5214 | 6235 |
| hsa-miR-5584-3p | 5215 | 6236 |
| hsa-miR-5584-5p | 5216 | 6237 |
| hsa-miR-5585-3p | 5217 | 6238 |
| hsa-miR-5585-5p | 5218 | 6239 |
| hsa-miR-5586-3p | 5219 | 6240 |
| hsa-miR-5586-5p | 5220 | 6241 |
| hsa-miR-5587-3p | 5221 | 6242 |
| hsa-miR-5587-5p | 5222 | 6243 |
| hsa-miR-5588-3p | 5223 | 6244 |
| hsa-miR-5588-5p | 5224 | 6245 |
| hsa-miR-5589-3p | 5225 | 6246 |
| hsa-miR-5589-5p | 5226 | 6247 |
| hsa-miR-559 | 5227 | 6248 |
| hsa-miR-5590-3p | 5228 | 6249 |
| hsa-miR-5590-5p | 5229 | 6250 |
| hsa-miR-5591-3p | 5230 | 6251 |
| hsa-miR-5591-5p | 5231 | 6252 |
| hsa-miR-561-3p | 5232 | 6253 |
| hsa-miR-561-5p | 5233 | 6254 |
| hsa-miR-562 | 5234 | 6255 |
| hsa-miR-563 | 5235 | 6256 |
| hsa-miR-564 | 5236 | 6257 |
| hsa-miR-566 | 5237 | 6258 |
| hsa-miR-567 | 5238 | 6259 |
| hsa-miR-568 | 5239 | 6260 |
| hsa-miR-5680 | 5240 | 6261 |
| hsa-miR-5681a | 5241 | 6262 |
| hsa-miR-5681b | 5242 | 6263 |
| hsa-miR-5682 | 5243 | 6264 |
| hsa-miR-5683 | 5244 | 6265 |
| hsa-miR-5684 | 5245 | 6266 |
| hsa-miR-5685 | 5246 | 6267 |
| hsa-miR-5686 | 5247 | 6268 |
| hsa-miR-5687 | 5248 | 6269 |
| hsa-miR-5688 | 5249 | 6270 |
| hsa-miR-5689 | 5250 | 6271 |
| hsa-miR-569 | 5251 | 6272 |
| hsa-miR-5690 | 5252 | 6273 |
| hsa-miR-5691 | 5253 | 6274 |
| hsa-miR-5692a | 5254 | 6275 |
| hsa-miR-5692b | 5255 | 6276 |
| hsa-miR-5692c | 5256 | 6277 |
| hsa-miR-5693 | 5257 | 6278 |
| hsa-miR-5694 | 5258 | 6279 |
| hsa-miR-5695 | 5259 | 6280 |
| hsa-miR-5696 | 5260 | 6281 |
| hsa-miR-5697 | 5261 | 6282 |
| hsa-miR-5698 | 5262 | 6283 |
| hsa-miR-5699 | 5263 | 6284 |
| hsa-miR-5700 | 5264 | 6285 |
| hsa-miR-5701 | 5265 | 6286 |
| hsa-miR-5702 | 5266 | 6287 |
| hsa-miR-5703 | 5267 | 6288 |
| hsa-miR-570-3p | 5268 | 6289 |
| hsa-miR-5704 | 5269 | 6290 |
| hsa-miR-5705 | 5270 | 6291 |
| hsa-miR-570-5p | 5271 | 6292 |
| hsa-miR-5706 | 5272 | 6293 |
| hsa-miR-5707 | 5273 | 6294 |
| hsa-miR-5708 | 5274 | 6295 |
| hsa-miR-571 | 5275 | 6296 |
| hsa-miR-572 | 5276 | 6297 |
| hsa-miR-573 | 5277 | 6298 |
| hsa-miR-5739 | 5278 | 6299 |
| hsa-miR-574-3p | 5279 | 6300 |
| hsa-miR-574-5p | 5280 | 6301 |
| hsa-miR-575 | 5281 | 6302 |
| hsa-miR-576-3p | 5282 | 6303 |
| hsa-miR-576-5p | 5283 | 6304 |
| hsa-miR-577 | 5284 | 6305 |
| hsa-miR-578 | 5285 | 6306 |
| hsa-miR-5787 | 5286 | 6307 |
| hsa-miR-579 | 5287 | 6308 |
| hsa-miR-580 | 5288 | 6309 |
| hsa-miR-581 | 5289 | 6310 |
| hsa-miR-582-3p | 5290 | 6311 |
| hsa-miR-582-5p | 5291 | 6312 |
| hsa-miR-583 | 5292 | 6313 |
| hsa-miR-584-3p | 5293 | 6314 |
| hsa-miR-584-5p | 5294 | 6315 |
| hsa-miR-585 | 5295 | 6316 |
| hsa-miR-586 | 5296 | 6317 |
| hsa-miR-587 | 5297 | 6318 |
| hsa-miR-588 | 5298 | 6319 |
| hsa-miR-589-3p | 5299 | 6320 |
| hsa-miR-589-5p | 5300 | 6321 |
| hsa-miR-590-3p | 5301 | 6322 |
| hsa-miR-590-5p | 5302 | 6323 |
| hsa-miR-591 | 5303 | 6324 |

TABLE 9-continued

Mirs and mir binding sites

| microRNA | mir SEQ ID | BS SEQ ID |
| --- | --- | --- |
| hsa-miR-592 | 5304 | 6325 |
| hsa-miR-593-3p | 5305 | 6326 |
| hsa-miR-593-5p | 5306 | 6327 |
| hsa-miR-595 | 5307 | 6328 |
| hsa-miR-596 | 5308 | 6329 |
| hsa-miR-597 | 5309 | 6330 |
| hsa-miR-598 | 5310 | 6331 |
| hsa-miR-599 | 5311 | 6332 |
| hsa-miR-600 | 5312 | 6333 |
| hsa-miR-601 | 5313 | 6334 |
| hsa-miR-602 | 5314 | 6335 |
| hsa-miR-603 | 5315 | 6336 |
| hsa-miR-604 | 5316 | 6337 |
| hsa-miR-605 | 5317 | 6338 |
| hsa-miR-606 | 5318 | 6339 |
| hsa-miR-6068 | 5319 | 6340 |
| hsa-miR-6069 | 5320 | 6341 |
| hsa-miR-607 | 5321 | 6342 |
| hsa-miR-6070 | 5322 | 6343 |
| hsa-miR-6071 | 5323 | 6344 |
| hsa-miR-6072 | 5324 | 6345 |
| hsa-miR-6073 | 5325 | 6346 |
| hsa-miR-6074 | 5326 | 6347 |
| hsa-miR-6075 | 5327 | 6348 |
| hsa-miR-6076 | 5328 | 6349 |
| hsa-miR-6077 | 5329 | 6350 |
| hsa-miR-6078 | 5330 | 6351 |
| hsa-miR-6079 | 5331 | 6352 |
| hsa-miR-608 | 5332 | 6353 |
| hsa-miR-6080 | 5333 | 6354 |
| hsa-miR-6081 | 5334 | 6355 |
| hsa-miR-6082 | 5335 | 6356 |
| hsa-miR-6083 | 5336 | 6357 |
| hsa-miR-6084 | 5337 | 6358 |
| hsa-miR-6085 | 5338 | 6359 |
| hsa-miR-6086 | 5339 | 6360 |
| hsa-miR-6087 | 5340 | 6361 |
| hsa-miR-6088 | 5341 | 6362 |
| hsa-miR-6089 | 5342 | 6363 |
| hsa-miR-609 | 5343 | 6364 |
| hsa-miR-6090 | 5344 | 6365 |
| hsa-miR-610 | 5345 | 6366 |
| hsa-miR-611 | 5346 | 6367 |
| hsa-miR-612 | 5347 | 6368 |
| hsa-miR-6124 | 5348 | 6369 |
| hsa-miR-6125 | 5349 | 6370 |
| hsa-miR-6126 | 5350 | 6371 |
| hsa-miR-6127 | 5351 | 6372 |
| hsa-miR-6128 | 5352 | 6373 |
| hsa-miR-6129 | 5353 | 6374 |
| hsa-miR-613 | 5354 | 6375 |
| hsa-miR-6130 | 5355 | 6376 |
| hsa-miR-6131 | 5356 | 6377 |
| hsa-miR-6132 | 5357 | 6378 |
| hsa-miR-6133 | 5358 | 6379 |
| hsa-miR-6134 | 5359 | 6380 |
| hsa-miR-614 | 5360 | 6381 |
| hsa-miR-615-3p | 5361 | 6382 |
| hsa-miR-615-5p | 5362 | 6383 |
| hsa-miR-616-3p | 5363 | 6384 |
| hsa-miR-6165 | 5364 | 6385 |
| hsa-miR-616-5p | 5365 | 6386 |
| hsa-miR-617 | 5366 | 6387 |
| hsa-miR-618 | 5367 | 6388 |
| hsa-miR-619 | 5368 | 6389 |
| hsa-miR-620 | 5369 | 6390 |
| hsa-miR-621 | 5370 | 6391 |
| hsa-miR-622 | 5371 | 6392 |
| hsa-miR-623 | 5372 | 6393 |
| hsa-miR-624-3p | 5373 | 6394 |
| hsa-miR-624-5p | 5374 | 6395 |
| hsa-miR-625-3p | 5375 | 6396 |
| hsa-miR-625-5p | 5376 | 6397 |
| hsa-miR-626 | 5377 | 6398 |
| hsa-miR-627 | 5378 | 6399 |
| hsa-miR-628-3p | 5379 | 6400 |
| hsa-miR-628-5p | 5380 | 6401 |
| hsa-miR-629-3p | 5381 | 6402 |
| hsa-miR-629-5p | 5382 | 6403 |
| hsa-miR-630 | 5383 | 6404 |
| hsa-miR-631 | 5384 | 6405 |
| hsa-miR-632 | 5385 | 6406 |
| hsa-miR-633 | 5386 | 6407 |
| hsa-miR-634 | 5387 | 6408 |
| hsa-miR-635 | 5388 | 6409 |
| hsa-miR-636 | 5389 | 6410 |
| hsa-miR-637 | 5390 | 6411 |
| hsa-miR-638 | 5391 | 6412 |
| hsa-miR-639 | 5392 | 6413 |
| hsa-miR-640 | 5393 | 6414 |
| hsa-miR-641 | 5394 | 6415 |
| hsa-miR-642a-3p | 5395 | 6416 |
| hsa-miR-642a-5p | 5396 | 6417 |
| hsa-miR-642b-3p | 5397 | 6418 |
| hsa-miR-642b-5p | 5398 | 6419 |
| hsa-miR-643 | 5399 | 6420 |
| hsa-miR-644a | 5400 | 6421 |
| hsa-miR-645 | 5401 | 6422 |
| hsa-miR-646 | 5402 | 6423 |
| hsa-miR-647 | 5403 | 6424 |
| hsa-miR-648 | 5404 | 6425 |
| hsa-miR-649 | 5405 | 6426 |
| hsa-miR-6499-3p | 5406 | 6427 |
| hsa-miR-6499-5p | 5407 | 6428 |
| hsa-miR-650 | 5408 | 6429 |
| hsa-miR-6500-3p | 5409 | 6430 |
| hsa-miR-6500-5p | 5410 | 6431 |
| hsa-miR-6501-3p | 5411 | 6432 |
| hsa-miR-6501-5p | 5412 | 6433 |
| hsa-miR-6502-3p | 5413 | 6434 |
| hsa-miR-6502-5p | 5414 | 6435 |
| hsa-miR-6503-3p | 5415 | 6436 |
| hsa-miR-6503-5p | 5416 | 6437 |
| hsa-miR-6504-3p | 5417 | 6438 |
| hsa-miR-6504-5p | 5418 | 6439 |
| hsa-miR-6505-3p | 5419 | 6440 |
| hsa-miR-6505-5p | 5420 | 6441 |
| hsa-miR-6506-3p | 5421 | 6442 |
| hsa-miR-6506-5p | 5422 | 6443 |
| hsa-miR-6507-3p | 5423 | 6444 |
| hsa-miR-6507-5p | 5424 | 6445 |
| hsa-miR-6508-3p | 5425 | 6446 |
| hsa-miR-6508-5p | 5426 | 6447 |
| hsa-miR-6509-3p | 5427 | 6448 |
| hsa-miR-6509-5p | 5428 | 6449 |
| hsa-miR-651 | 5429 | 6450 |
| hsa-miR-6510-3p | 5430 | 6451 |
| hsa-miR-6510-5p | 5431 | 6452 |
| hsa-miR-6511a-3p | 5432 | 6453 |
| hsa-miR-6511a-5p | 5433 | 6454 |
| hsa-miR-6511b-3p | 5434 | 6455 |
| hsa-miR-6511b-5p | 5435 | 6456 |
| hsa-miR-6512-3p | 5436 | 6457 |
| hsa-miR-6512-5p | 5437 | 6458 |
| hsa-miR-6513-3p | 5438 | 6459 |
| hsa-miR-6513-5p | 5439 | 6460 |
| hsa-miR-6514-3p | 5440 | 6461 |
| hsa-miR-6514-5p | 5441 | 6462 |
| hsa-miR-6515-3p | 5442 | 6463 |
| hsa-miR-6515-5p | 5443 | 6464 |
| hsa-miR-652-3p | 5444 | 6465 |
| hsa-miR-652-5p | 5445 | 6466 |
| hsa-miR-653 | 5446 | 6467 |
| hsa-miR-654-3p | 5447 | 6468 |
| hsa-miR-654-5p | 5448 | 6469 |
| hsa-miR-655 | 5449 | 6470 |
| hsa-miR-656 | 5450 | 6471 |
| hsa-miR-657 | 5451 | 6472 |
| hsa-miR-658 | 5452 | 6473 |
| hsa-miR-659-3p | 5453 | 6474 |

TABLE 9-continued

Mirs and mir binding sites

| microRNA | mir SEQ ID | BS SEQ ID |
|---|---|---|
| hsa-miR-659-5p | 5454 | 6475 |
| hsa-miR-660-3p | 5455 | 6476 |
| hsa-miR-660-5p | 5456 | 6477 |
| hsa-miR-661 | 5457 | 6478 |
| hsa-miR-662 | 5458 | 6479 |
| hsa-miR-663a | 5459 | 6480 |
| hsa-miR-663b | 5460 | 6481 |
| hsa-miR-664a-3p | 5461 | 6482 |
| hsa-miR-664a-5p | 5462 | 6483 |
| hsa-miR-664b-3p | 5463 | 6484 |
| hsa-miR-664b-5p | 5464 | 6485 |
| hsa-miR-665 | 5465 | 6486 |
| hsa-miR-668 | 5466 | 6487 |
| hsa-miR-670 | 5467 | 6488 |
| hsa-miR-671-3p | 5468 | 6489 |
| hsa-miR-6715a-3p | 5469 | 6490 |
| hsa-miR-6715b-3p | 5470 | 6491 |
| hsa-miR-6715b-5p | 5471 | 6492 |
| hsa-miR-671-5p | 5472 | 6493 |
| hsa-miR-6716-3p | 5473 | 6494 |
| hsa-miR-6716-5p | 5474 | 6495 |
| hsa-miR-6717-5p | 5475 | 6496 |
| hsa-miR-6718-5p | 5476 | 6497 |
| hsa-miR-6719-3p | 5477 | 6498 |
| hsa-miR-6720-3p | 5478 | 6499 |
| hsa-miR-6721-5p | 5479 | 6500 |
| hsa-miR-6722-3p | 5480 | 6501 |
| hsa-miR-6722-5p | 5481 | 6502 |
| hsa-miR-6723-5p | 5482 | 6503 |
| hsa-miR-6724-5p | 5483 | 6504 |
| hsa-miR-675-3p | 5484 | 6505 |
| hsa-miR-675-5p | 5485 | 6506 |
| hsa-miR-676-3p | 5486 | 6507 |
| hsa-miR-676-5p | 5487 | 6508 |
| hsa-miR-708-3p | 5488 | 6509 |
| hsa-miR-708-5p | 5489 | 6510 |
| hsa-miR-711 | 5490 | 6511 |
| hsa-miR-7-1-3p | 5491 | 6512 |
| hsa-miR-718 | 5492 | 6513 |
| hsa-miR-7-2-3p | 5493 | 6514 |
| hsa-miR-744-3p | 5494 | 6515 |
| hsa-miR-744-5p | 5495 | 6516 |
| hsa-miR-758-3p | 5496 | 6517 |
| hsa-miR-758-5p | 5497 | 6518 |
| hsa-miR-759 | 5498 | 6519 |
| hsa-miR-7-5p | 5499 | 6520 |
| hsa-miR-760 | 5500 | 6521 |
| hsa-miR-761 | 5501 | 6522 |
| hsa-miR-762 | 5502 | 6523 |
| hsa-miR-764 | 5503 | 6524 |
| hsa-miR-765 | 5504 | 6525 |
| hsa-miR-766-3p | 5505 | 6526 |
| hsa-miR-766-5p | 5506 | 6527 |
| hsa-miR-767-3p | 5507 | 6528 |
| hsa-miR-767-5p | 5508 | 6529 |
| hsa-miR-769-3p | 5509 | 6530 |
| hsa-miR-769-5p | 5510 | 6531 |
| hsa-miR-770-5p | 5511 | 6532 |
| hsa-miR-802 | 5512 | 6533 |
| hsa-miR-873-3p | 5513 | 6534 |
| hsa-miR-873-5p | 5514 | 6535 |
| hsa-miR-874 | 5515 | 6536 |
| hsa-miR-875-3p | 5516 | 6537 |
| hsa-miR-875-5p | 5517 | 6538 |
| hsa-miR-876-3p | 5518 | 6539 |
| hsa-miR-876-5p | 5519 | 6540 |
| hsa-miR-877-3p | 5520 | 6541 |
| hsa-miR-877-5p | 5521 | 6542 |
| hsa-miR-885-3p | 5522 | 6543 |
| hsa-miR-885-5p | 5523 | 6544 |
| hsa-miR-887 | 5524 | 6545 |
| hsa-miR-888-3p | 5525 | 6546 |
| hsa-miR-888-5p | 5526 | 6547 |
| hsa-miR-889 | 5527 | 6548 |
| hsa-miR-890 | 5528 | 6549 |
| hsa-miR-891a | 5529 | 6550 |
| hsa-miR-891b | 5530 | 6551 |
| hsa-miR-892a | 5531 | 6552 |
| hsa-miR-892b | 5532 | 6553 |
| hsa-miR-892c-3p | 5533 | 6554 |
| hsa-miR-892c-5p | 5534 | 6555 |
| hsa-miR-920 | 5535 | 6556 |
| hsa-miR-921 | 5536 | 6557 |
| hsa-miR-922 | 5537 | 6558 |
| hsa-miR-924 | 5538 | 6559 |
| hsa-miR-92a-1-5p | 5539 | 6560 |
| hsa-miR-92a-2-5p | 5540 | 6561 |
| hsa-miR-92a-3p | 5541 | 6562 |
| hsa-miR-92b-3p | 5542 | 6563 |
| hsa-miR-92b-5p | 5543 | 6564 |
| hsa-miR-933 | 5544 | 6565 |
| hsa-miR-93-3p | 5545 | 6566 |
| hsa-miR-934 | 5546 | 6567 |
| hsa-miR-935 | 5547 | 6568 |
| hsa-miR-93-5p | 5548 | 6569 |
| hsa-miR-936 | 5549 | 6570 |
| hsa-miR-937-3p | 5550 | 6571 |
| hsa-miR-937-5p | 5551 | 6572 |
| hsa-miR-938 | 5552 | 6573 |
| hsa-miR-939-3p | 5553 | 6574 |
| hsa-miR-939-5p | 5554 | 6575 |
| hsa-miR-9-3p | 5555 | 6576 |
| hsa-miR-940 | 5556 | 6577 |
| hsa-miR-941 | 5557 | 6578 |
| hsa-miR-942 | 5558 | 6579 |
| hsa-miR-943 | 5559 | 6580 |
| hsa-miR-944 | 5560 | 6581 |
| hsa-miR-95 | 5561 | 6582 |
| hsa-miR-9-5p | 5562 | 6583 |
| hsa-miR-96-3p | 5563 | 6584 |
| hsa-miR-96-5p | 5564 | 6585 |
| hsa-miR-98-3p | 5565 | 6586 |
| hsa-miR-98-5p | 5566 | 6587 |
| hsa-miR-99a-3p | 5567 | 6588 |
| hsa-miR-99a-5p | 5568 | 6589 |
| hsa-miR-99b-3p | 5569 | 6590 |
| hsa-miR-99b-5p | 5570 | 6591 |

As shown in Table 10, microRNAs are differentially expressed in different tissues and cells, and often associated with different types of diseases (e.g. cancer cells). The decision of removal or insertion of microRNA binding sites, or any combination, is dependent on microRNA expression patterns and their profilings in cancer cells. In Table 10, "HCC" represents hepatocellular carcinoma, "ALL" stands for acute lymphoblastic leukemia, "RCC" stands for renal cell carcinoma, "CLL" stands for chromic lymphocytic leukemia and "MALT" stands for mucosa-associated lymphoid tissue.

TABLE 10 mirs, tissues/cell expression and diseases

| microRNA | mir SEQ ID | BS SEQ ID | Tissues/cells | Associated Disease | Biological Function |
|---|---|---|---|---|---|
| hsa-let-7a-2-3p | 2508 | 3529 | Embryonic stem cells, lung, myeloid cells | inflammatory, various cancers (lung, cervical, breast, pancreatic, etc) | tumor suppressor |
| hsa-let-7a-3p | 2509 | 3530 | Embryonic stem cells, lung | inflammatory, various cancers (lung, cervical, breast, pancreatic, etc) | tumor suppressor |
| hsa-let-7a-5p | 2510 | 3531 | Embryonic stem cells, lung | inflammatory, various cancers (lung, cervical, breast, pancreatic, etc) | tumor suppressor |
| hsa-let-7b-3p | 2511 | 3532 | epithelial cells, endothelial cells (vascular) | lung cancer, colorectal cancer, cervical cancer, inflammation and immune response after infection | tumor angiogenesis |
| hsa-let-7b-5p | 2512 | 3533 | epithelial cells, endothelial cells (vascular) | cervical cancer, inflammation and immune response after infection | tumor angiogenesis |
| hsa-let-7c | 2513 | 3534 | dendritic cells | various cacners (cervical, pancreatic, lung, esopphageal, etc) | tumor suppressor, apoptosis |
| hsa-let-7d-3p | 2514 | 3535 | embryonic stem cells | associated with various cancer cells | tumor suppressor |
| hsa-let-7d-5p | 2515 | 3536 | embryonic stem cells | associated with various cancer cells | tumor suppressor |
| hsa-let-7e-3p | 2516 | 3537 | immune cells | various cancer cells, autoimmunity, endotoxin tolerance | tumor suppressor |
| hsa-let-7e-5p | 2517 | 3538 | immune cells | various cancer cells | tumor suppressor |
| hsa-let-7f-1-3p | 2518 | 3539 | immune cells (T cells) | various cancer cells | tumor suppressor |
| hsa-let-7f-2-3p | 2519 | 3540 | immune cells (T cells) | various cancer cells | tumor suppressor |
| hsa-let-7f-5p | 2520 | 3541 | immune cells (T cells) | Various cancer cells | tumor suppressor |
| hsa-let-7g-3p | 2521 | 3542 | hematopoietic cells, adipose, smooth muscle cells | various cancer cells (lung, breast, etc) | tumor suppressor |
| hsa-let-7g-5p | 2522 | 3543 | hematopoietic cells, adipose, smooth muscle cells | various cancer cells (lung, breast, etc) | tumor suppressor |
| hsa-let-7i-3p | 2523 | 3544 | immune cells | chronic lymphocyte leukimia | tumor suppressor |
| hsa-let-7i-5p | 2524 | 3545 | immune cells | chronic lymphocyte leukimia | tumor suppressor |
| hsa-miR-1 | 2525 | 3546 | muscle, heart | | angiogenesis, cell proliferation (myogenesis) |
| hsa-miR-100-3p | 2526 | 3547 | hematopoietic cells, endothelial cells | gastric cancer, pancreatic cancer | tumor angiogenesis |
| hsa-miR-100-5p | 2527 | 3548 | hematopoietic cells, endothelial cells | gastric cancer, pancreatic cancer | tumor angiogenesis |

TABLE 10-continued mirs, tissues/cell expression and diseases

| microRNA | mir SEQ ID | BS SEQ ID | Tissues/cells | Associated Disease | Biological Function |
|---|---|---|---|---|---|
| hsa-miR-101-3p | 2528 | 3549 | endothelial cells | various cancers (breast, non-small cell lung, colon, gastric, pancreatic, bladder, etc); lupus erythematosus | angiogenesis |
| hsa-miR-101-5p | 2529 | 3550 | endothelial cells | various cancers (breast, non-small cell lung, colon, gastric, pancreatic, bladder, etc); lupus erythematosus | angiogenesis |
| hsa-miR-103a-2-5p | 2530 | 3551 | embryonic stem cells, many tissues/cells | various cancers (endometrial, neuroblastoma, colorectal, breast, liver, etc) | oncogene, cell growth |
| hsa-miR-103a-3p | 2531 | 3552 | embryonic stem cells, many tissues/cells | various cancers (endometrial, neuroblastoma, colorectal, breast, liver, etc) | oncogene, cell growth |
| hsa-miR-103b | 2532 | 3553 | Many tissues/cells | various cancers (endometrial, neuroblastoma, colorectal, breast, liver, etc) | oncogene, cell growth |
| hsa-miR-105-3p | 2533 | 3554 | pancreatic cells | | |
| hsa-miR-105-5p | 2534 | 3555 | pancreatic cells | | |
| hsa-miR-106a-3p | 2535 | 3556 | osteogenic cells | osteocarcoma, other cancers | cell differentiation |
| hsa-miR-106a-5p | 2536 | 3557 | osteogenic cells | osteocarcoma, other cancers | cell differentiation |
| hsa-miR-106b-3p | 2537 | 3558 | embryonic stem cells | various cancers (non-small lung cancer, gastric cancer, HCC, gliomas, etc) | oncogene |
| hsa-miR-106b-5p | 2538 | 3559 | embryonic stem cells | various cancers (non-small lung cancer, gastric cancer, HCC, gliomas, etc) | oncogene |
| hsa-miR-107 | 2539 | 3560 | many tissues, brain hepatocytes/liver | breast cancer, pituitary adenoma, obesity/diabetes | |
| hsa-miR-10a-3p | 2540 | 3561 | hematopoeitic cells | acute myeoid leukemia | oncogene, cell growth |
| hsa-miR-10a-5p | 2541 | 3562 | hematopoeitic cells | acute myeoid leukemia | oncogene, cell growth |
| hsa-miR-10b-3p | 2542 | 3563 | multiple tissues and cells | various cancers (breast, ovarian, glioblastoma, pancreatc ductal adenocarcinoma, gastric, etc) | oncogene |
| hsa-miR-10b-5p | 2543 | 3564 | multiple tissues and cells | various cancers (breast, ovarian, glioblastoma, pancreatc ductal adenocarcinoma, gastric, etc) | oncogene |

TABLE 10-continued mirs, tissues/cell expression and diseases

| microRNA | mir SEQ ID | BS SEQ ID | Tissues/cells | Associated Disease | Biological Function |
|---|---|---|---|---|---|
| hsa-miR-1178-3p | 2544 | 3565 | | osteocarcoma | |
| hsa-miR-1178-5p | 2545 | 3566 | | osteocarcoma | |
| hsa-miR-1179 | 2546 | 3567 | | osteocarcoma | |
| hsa-miR-1180 | 2547 | 3568 | discovered in sarcoma, no expression data | | |
| hsa-miR-1181 | 2548 | 3569 | | downregulated in ovarian cancer cells, associated with HCV infection in hepatocytes | |
| hsa-miR-1182 | 2549 | 3570 | placenta | | |
| hsa-miR-1183 | 2550 | 3571 | | associated with rectal cancer | |
| hsa-miR-1184 | 2551 | 3572 | Hematopoietic cells | downregulated in oral leukoplakia (OLK) | |
| hsa-miR-1185-1-3p | 2552 | 3573 | placenta | | |
| hsa-miR-1185-2-3p | 2553 | 3574 | placenta | | |
| hsa-miR-1185-5p | 2554 | 3575 | placenta | | |
| hsa-miR-1193 | 2555 | 3576 | | melanoma | |
| hsa-miR-1197 | 2556 | 3577 | | neublastoma | |
| hsa-miR-1200 | 2557 | 3578 | | chronic lynphocytic leukemia | |
| hsa-miR-1202 | 2558 | 3579 | | chronic lynphocytic leukemia, downregulated in ovarian cancer cells | |
| hsa-miR-1203 | 2559 | 3580 | | in the chromosome 8q24 region, cancer cells | |
| hsa-miR-1204 | 2560 | 3581 | | in the chromosome 8q24 region, cancer cells | |
| hsa-miR-1205 | 2561 | 3582 | | in the chromosome 8q24 region, cancer cells | |
| hsa-miR-1206 | 2562 | 3583 | | in the chromosome 8q24 region, cancer cells | |
| hsa-miR-1207-3p | 2563 | 3584 | | in the chromosome 8q24 region, cancer cells | |
| hsa-miR-1207-5p | 2564 | 3585 | | in the chromosome 8q24 region, cancer cells | |
| hsa-miR-1208 | 2565 | 3586 | | in the chromosome 8q24 region, cancer cells | |
| hsa-miR-122-3p | 2566 | 3587 | kidney, liver/hepatocytes | Renal Cell Carcinoma (RCC), cancer cells | lipid metabolism |
| hsa-miR-1224-3p | 2567 | 3588 | | Lupus nephritis | |
| hsa-miR-1224-5p | 2568 | 3589 | | rectal cancer | |
| hsa-miR-1225-3p | 2569 | 3590 | | adrenal pheochromocytomas; upregulated in MITF KnockDown melanocytes | |

TABLE 10-continued mirs, tissues/cell expression and diseases

| microRNA | mir SEQ ID | BS SEQ ID | Tissues/cells | Associated Disease | Biological Function |
|---|---|---|---|---|---|
| hsa-miR-1225-5p | 2570 | 3591 | | prostate cancer | |
| hsa-miR-122-5p | 2571 | 3592 | liver/hepatocytes | cancer cells | lipid metabolism |
| hsa-miR-1226-3p | 2572 | 3593 | discovered in a mirtron screening | | |
| hsa-miR-1226-5p | 2573 | 3594 | discovered in a mirtron screening | | |
| hsa-miR-1227-3p | 2574 | 3595 | cartilage/chondrocytes | | |
| hsa-miR-1227-5p | 2575 | 3596 | cartilage/chondrocytes | | |
| hsa-miR-1228-3p | 2576 | 3597 | liver (hepatocytes) | Hepatocellular carcinoma (HCC) | anti-apoptosis |
| hsa-miR-1228-5p | 2577 | 3598 | liver (hepatocytes) | Hepatocellular carcinoma (HCC) | anti-apoptosis |
| hsa-miR-1229-3p | 2578 | 3599 | discovered in a mirtron screening | | |
| hsa-miR-1229-5p | 2579 | 3600 | discovered in a mirtron screening | | |
| hsa-miR-1231 | 2580 | 3601 | | HCC | |
| hsa-miR-1233-1-5p | 2581 | 3602 | serum | | |
| hsa-miR-1233-3p | 2582 | 3603 | serum | | |
| hsa-miR-1234-3p | 2583 | 3604 | discovered in embryonic stem cell | | |
| hsa-miR-1234-5p | 2584 | 3605 | discovered in embryonic stem cell | | |
| hsa-miR-1236-3p | 2585 | 3606 | lymphatic endothelial cells | | target to VEGFR-3 |
| hsa-miR-1236-5p | 2586 | 3607 | lymphatic endothelial cells | | target to VEGFR-3 |
| hsa-miR-1237-3p | 2587 | 3608 | esophageal cell line KYSE-150R | | |
| hsa-miR-1237-5p | 2588 | 3609 | esophageal cell line KYSE-150R | | |
| hsa-miR-1238-3p | 2589 | 3610 | | colorectal cancer | |
| hsa-miR-1238-5p | 2590 | 3611 | | colorectal cancer | |
| hsa-miR-1243 | 2591 | 3612 | discovered in embryonic stem cells | | |
| hsa-miR-124-3p | 2592 | 3613 | brain, plasma (exosomal) | glioma | cell differentiation |
| hsa-miR-1244 | 2593 | 3614 | discovered in embryonic stem cells | | |
| hsa-miR-1245a | 2594 | 3615 | discovered in embryonic stem cells | | |
| hsa-miR-1245b-3p | 2595 | 3616 | discovered in embryonic stem cells | | |
| hsa-miR-1245b-5p | 2596 | 3617 | discovered in embryonic stem cells | | |
| hsa-miR-124-5p | 2597 | 3618 | brain, Plasma (circulating) | upregulated in heart dysfunction, glioma | cell differentiation |
| hsa-miR-1246 | 2598 | 3619 | embryonic stem cells, epithelial cells | | |
| hsa-miR-1247-3p | 2599 | 3620 | embryoid body cells | | |
| hsa-miR-1247-5p | 2600 | 3621 | embryoid body cells | | |
| hsa-miR-1248 | 2601 | 3622 | | | component of SnoRNAs |
| hsa-miR-1249 | 2602 | 3623 | liver (hepatocytes) | | |
| hsa-miR-1250 | 2603 | 3624 | oligodendrocytes | | |
| hsa-miR-1251 | 2604 | 3625 | discovered in embryonic stem cells | | |
| hsa-miR-1252 | 2605 | 3626 | discovered in embryonic stem cells | | |

TABLE 10-continued mirs, tissues/cell expression and diseases

| microRNA | mir SEQ ID | BS SEQ ID | Tissues/cells | Associated Disease | Biological Function |
|---|---|---|---|---|---|
| hsa-miR-1253 | 2606 | 3627 | discovered in embryonic stem cells | | |
| hsa-miR-1254 | 2607 | 3628 | embryonic stem cells | | |
| hsa-miR-1255a | 2608 | 3629 | discovered in embryonic stem cells | | |
| hsa-miR-1255b-2-3p | 2609 | 3630 | discovered in embryonic stem cells | | |
| hsa-miR-1255b-5p | 2610 | 3631 | discovered in embryonic stem cells | | |
| hsa-miR-1256 | 2611 | 3632 | discovered in embryonic stem cells | prostate cancer | |
| hsa-miR-1257 | 2612 | 3633 | discovered in embryonic stem cells | liposarcoma (soft tissue sarcoma) | |
| hsa-miR-1258 | 2613 | 3634 | discovered in embryonic stem cells | breast cancer and lung cancer | |
| hsa-miR-125a-3p | 2614 | 3635 | brain, hematopoietic cells | various cancer (prostate, HCC, etc) | cell proliferation and differentiation |
| hsa-miR-125a-5p | 2615 | 3636 | brain, hematopoietic cells | various cancer (prostate, HCC, etc) | cell proliferation and differentiation |
| hsa-miR-125b-1-3p | 2616 | 3637 | hematopoietic cells (monocytes), brain(neuron) | various cancer (prostate, HCC, etc) | oncogene, cell differentiation |
| hsa-miR-125b-2-3p | 2617 | 3638 | hematopoietic cells (monocytes), brain(neuron) | various cancer (prostate, HCC, etc) | oncogene, cell differentiation |
| hsa-miR-125b-5p | 2618 | 3639 | hematopoietic cells, brain (neuron) | various cancer (cutaneous T cell lymphoma, prostate, HCC, etc) | oncogene, cell differentiation |
| hsa-miR-1260a | 2619 | 3640 | periodontal tissue | | |
| hsa-miR-1260b | 2620 | 3641 | periodontal tissue | | |
| hsa-miR-1261 | 2621 | 3642 | embryonic stem cells | | |
| hsa-miR-1262 | 2622 | 3643 | embryoid body cells | | |
| hsa-miR-1263 | 2623 | 3644 | discovered in embryonic stem cells | | |
| hsa-miR-126-3p | 2624 | 3645 | endothelial cells, lung | B-lieage ALL | angiogenesis |
| hsa-miR-1264 | 2625 | 3646 | discovered in embryonic stem cells | | |
| hsa-miR-1265 | 2626 | 3647 | discovered in embryonic stem cells | | |
| hsa-miR-126-5p | 2627 | 3648 | endothelial cells, lung | breast cancer, B-lieage ALL | angiogenesis |
| hsa-miR-1266 | 2628 | 3649 | embryonic stem cells | | |
| hsa-miR-1267 | 2629 | 3650 | discovered in embryonic stem cells | | |
| hsa-miR-1268a | 2630 | 3651 | embryonic stem cells | | |
| hsa-miR-1268b | 2631 | 3652 | embryonic stem cells | | |
| hsa-miR-1269a | 2632 | 3653 | embryoid body cells | | |
| hsa-miR-1269b | 2633 | 3654 | embryoid body cells | | |

TABLE 10-continued mirs, tissues/cell expression and diseases

| microRNA | mir SEQ ID | BS SEQ ID | Tissues/cells | Associated Disease | Biological Function |
|---|---|---|---|---|---|
| hsa-miR-1270 | 2634 | 3655 | discovered in embryonic stem cells | | |
| hsa-miR-1271-3p | 2635 | 3656 | brain | Hepatocellular carcinoma (HCC) | Suppress GPC-3 in HCC |
| hsa-miR-1271-5p | 2636 | 3657 | brain | Hepatocellular carcinoma (HCC) | Suppress GPC-3 in HCC |
| hsa-miR-1272 | 2637 | 3658 | embryonic stem cells | | |
| hsa-miR-1273a | 2638 | 3659 | discovered in embryonic stem cells | | |
| hsa-miR-1273c | 2639 | 3660 | | colorectal cancer | |
| hsa-miR-1273d | 2640 | 3661 | discovered in embryonic stem cells | | |
| hsa-miR-1273e | 2641 | 3662 | | solid tumor cells | |
| hsa-miR-1273f | 2642 | 3663 | | cervical cancer | |
| hsa-miR-1273g-3p | 2643 | 3664 | | cervical cancer | |
| hsa-miR-1273g-5p | 2644 | 3665 | | cervical cancer | |
| hsa-miR-127-3p | 2645 | 3666 | lung, placenta | | |
| hsa-miR-1275 | 2646 | 3667 | embryonic stem cells | gastric carcinoma | |
| hsa-miR-127-5p | 2647 | 3668 | lung, placenta (islet) | | |
| hsa-miR-1276 | 2648 | 3669 | discovered in embryonic stem cells | | |
| hsa-miR-1277-3p | 2649 | 3670 | embryoid body cells | | |
| hsa-miR-1277-5p | 2650 | 3671 | embryoid body cells | | |
| hsa-miR-1278 | 2651 | 3672 | discovered in embryonic stem cells | | |
| hsa-miR-1279 | 2652 | 3673 | monocytes | | |
| hsa-miR-128 | 2653 | 3674 | glioblast, brain | B-lieage ALL | target to neurofibrominlin neuron |
| hsa-miR-1281 | 2654 | 3675 | | muscle invasive bladder cancer | |
| hsa-miR-1282 | 2655 | 3676 | discovered in embryonic stem cells | | |
| hsa-miR-1283 | 2656 | 3677 | placenta | | |
| hsa-miR-1284 | 2657 | 3678 | | lung cancer | |
| hsa-miR-1285-3p | 2658 | 3679 | | various cancer cells | inhibit P53 expression |
| hsa-miR-1285-5p | 2659 | 3680 | | various cancer cells | inhibit P53 expression |
| hsa-miR-1286 | 2660 | 3681 | smooth muscle | esophageal cancer | |
| hsa-miR-1287 | 2661 | 3682 | embryoid body cells | breast cancer | |
| hsa-miR-1288 | 2662 | 3683 | discovered in embryonic stem cells | | |
| hsa-miR-1289 | 2663 | 3684 | multiple cell types | | |
| hsa-miR-1290 | 2664 | 3685 | embryoid body cells | gastric carcinoma | |
| hsa-miR-1291 | 2665 | 3686 | hepatocytes | | component of SnoRNAs |
| hsa-miR-129-1-3p | 2666 | 3687 | multiple cell types | HCC cancer cells | |
| hsa-miR-1292-3p | 2667 | 3688 | | | |
| hsa-miR-129-2-3p | 2668 | 3689 | multiple cell types | various cancer cells | |
| hsa-miR-1292-5p | 2669 | 3690 | | | |
| hsa-miR-1293 | 2670 | 3691 | discovered in embryonic stem cells | | |
| hsa-miR-1294 | 2671 | 3692 | discovered in embryonic stem cells | | |
| hsa-miR-1295a | 2672 | 3693 | | tumor cells (follicular lymphoma) | |

TABLE 10-continued mirs, tissues/cell expression and diseases

| microRNA | mir SEQ ID | BS SEQ ID | Tissues/cells | Associated Disease | Biological Function |
|---|---|---|---|---|---|
| hsa-miR-1295b-3p | 2673 | 3694 | | tumor cells (follicular lymphoma) | |
| hsa-miR-1295b-5p | 2674 | 3695 | | tumor cells (follicular lymphoma) | |
| hsa-miR-129-5p | 2675 | 3696 | liver (hepatocytes) | HCC, thyroid cancer | cell death in cancer cell |
| hsa-miR-1296 | 2676 | 3697 | | breast cancer | |
| hsa-miR-1297 | 2677 | 3698 | discovered in embryonic stem cells | | |
| hsa-miR-1298 | 2678 | 3699 | | | |
| hsa-miR-1299 | 2679 | 3700 | discovered in embryonic stem cells | | |
| hsa-miR-1301 | 2680 | 3701 | | breast cancer | |
| hsa-miR-1302 | 2681 | 3702 | | | |
| hsa-miR-1303 | 2682 | 3703 | hepatocyte | colorectal cancer, liver cancer | |
| hsa-miR-1304-3p | 2683 | 3704 | | | dental development |
| hsa-miR-1304-5p | 2684 | 3705 | | | dental development |
| hsa-miR-1305 | 2685 | 3706 | discovered in embryonic stem cells | | |
| hsa-miR-1306-3p | 2686 | 3707 | discovered in embryonic stem cells | | |
| hsa-miR-1306-5p | 2687 | 3708 | discovered in embryonic stem cells | | |
| hsa-miR-1307-3p | 2688 | 3709 | discovered in embryonic stem cells | | |
| hsa-miR-1307-5p | 2689 | 3710 | discovered in embryonic stem cells | | |
| hsa-miR-130a-3p | 2690 | 3711 | lung, monocytes, vascular endothelial cells | various cancers (basal cell carcinoma, HCC, ovarian, etc), drug resistance | pro-angiogenic |
| hsa-miR-130a-5p | 2691 | 3712 | lung, monocytes, vascular endothelial cells | various cancers (basal cell carcinoma, HCC, ovarian, etc), drug resistance | pro-angiogenic |
| hsa-miR-130b-3p | 2692 | 3713 | Lung, epidermal cells (keratinocytes) | various cancers (gastric, rena cell carcinoma) | cell proliferation/senescence |
| hsa-miR-130b-5p | 2693 | 3714 | Lung, epidermal cells (keratinocytes) | various cancers (gastric, rena cell carcinoma) | cell proliferation/senescence |
| hsa-miR-1321 | 2694 | 3715 | | neuroblastoma | |
| hsa-miR-1322 | 2695 | 3716 | | neuroblastoma | |
| hsa-miR-1323 | 2696 | 3717 | placenta | neuroblastoma | |
| hsa-miR-132-3p | 2697 | 3718 | Brain (neuron), immune cells | | |
| hsa-miR-1324 | 2698 | 3719 | | neuroblastoma | |
| hsa-miR-132-5p | 2699 | 3720 | brain (neuron), immune cells | | |
| hsa-miR-133a | 2700 | 3721 | muscle, heart, epithelial cells (lung) | heart failure, esophageal cancer | myogenesis |
| hsa-miR-133b | 2701 | 3722 | muscle, heart, epithelial cells (lung) | heart failure, esophageal cancer | myogenesis |

TABLE 10-continued mirs, tissues/cell expression and diseases

| microRNA | mir SEQ ID | BS SEQ ID | Tissues/cells | Associated Disease | Biological Function |
|---|---|---|---|---|---|
| hsa-miR-134 | 2702 | 3723 | lung (epithelial) | non-samll cell lung cancer, pulmonary embolism | |
| hsa-miR-1343 | 2703 | 3724 | | breast cancer cells | |
| hsa-miR-135a-3p | 2704 | 3725 | brain, other tissues | various cancer cells (lung, breast, colorectal, HCC, etc) | tumor suppressor |
| hsa-miR-135a-5p | 2705 | 3726 | brain, other tissues | various cancer cells (lung, breast, colorectal, HCC, etc) | tumor suppressor |
| hsa-miR-135b-3p | 2706 | 3727 | brain, placenta, other tissues | various cancers (gastric, mammary, neuroblastomas, pancreatic, etc) | |
| hsa-miR-135b-5p | 2707 | 3728 | brain, placenta, other tissues | various cancers (gastric, mammary, neuroblastomas, pancreatic, etc) | |
| hsa-miR-136-3p | 2708 | 3729 | stem cells, placenta | glioma | tumor suppressor |
| hsa-miR-136-5p | 2709 | 3730 | stem cells, placenta | glioma | tumor suppressor |
| hsa-miR-137 | 2710 | 3731 | brain | various cancers (glioblastoma, breast, gastric etc), Alzheimer's disease | inhibiting cancer cell proliferation and migration |
| hsa-miR-138-1-3p | 2711 | 3732 | stem cells, epidermal cells (keratinocytes) | arious cancer cells, downregulated in HCC | cell proliferation/senescence |
| hsa-miR-138-2-3p | 2712 | 3733 | stem cells | arious cancer cells, downregulated in HCC | |
| hsa-miR-138-5p | 2713 | 3734 | stem cells | arious cancer cells, downregulated in HCC | |
| hsa-miR-139-3p | 2714 | 3735 | hematocytes, brain | various cancer cells (colorectal, gastric, ovarian) | repress cancer metastasis |
| hsa-miR-139-5p | 2715 | 3736 | hematocytes, brain | various cancer cells (colorectal, gastric, ovarian) | repress cancer metastasis |
| hsa-miR-140-3p | 2716 | 3737 | airway smooth muscle | Virus infection, cancers | |
| hsa-miR-140-5p | 2717 | 3738 | cartilage (chondrocytes) | csncers | |
| hsa-miR-141-3p | 2718 | 3739 | Many tissues/cells | various cancer cells (HCC, prostate, kidney, etc) | cell differentiation |
| hsa-miR-141-5p | 2719 | 3740 | Many tissues/cells | various cancer cells (HCC, prostate, kidney, etc) | cell differentiation |
| hsa-miR-142-3p | 2720 | 3741 | meyloid cells, hematopoiesis, APC cells | | immune response |
| hsa-miR-142-5p | 2721 | 3742 | meyloid cells, hematopoiesis, APC cells | | immune response |
| hsa-miR-143-3p | 2722 | 3743 | vascular smooth muscle | pre-B-cell acute lymphocytic leukemia, virus infection | |
| hsa-miR-143-5p | 2723 | 3744 | vascular smooth muscle, T-cells | virus infection | |

TABLE 10-continued mirs, tissues/cell expression and diseases

| microRNA | mir SEQ ID | BS SEQ ID | Tissues/cells | Associated Disease | Biological Function |
|---|---|---|---|---|---|
| hsa-miR-144-3p | 2724 | 3745 | erythroid | various cancers (lung, colorectal, etc) | cell differentiation |
| hsa-miR-144-5p | 2725 | 3746 | erythroid | various cancers (lung, colorectal, etc) | cell differentiation |
| hsa-miR-145-3p | 2726 | 3747 | kidney, cartilage, vascular smooth muscle | T-cell lupus | tumor suppressor |
| hsa-miR-145-5p | 2727 | 3748 | kidney, cartilage, vascular smooth muscle | T-cell lupus | tumor suppressor |
| hsa-miR-1468 | 2728 | 3749 | | lung cancer | |
| hsa-miR-1469 | 2729 | 3750 | | tumor cell (follicular lymphoma), rectal cancer | |
| hsa-miR-146a-3p | 2730 | 3751 | immune cells, hematopoiesis | various cancers, endotoxin tolerance | |
| hsa-miR-146a-5p | 2731 | 3752 | immune cells, hematopoiesis | various cancers, endotoxin tolerance | |
| hsa-miR-146b-3p | 2732 | 3753 | immune cells | various cancers | |
| hsa-miR-146b-5p | 2733 | 3754 | Embryonic stem cells | various cancers (glioma) | tumor invation, migration |
| hsa-miR-1470 | 2734 | 3755 | | | |
| hsa-miR-1471 | 2735 | 3756 | | tumor cell (follicular lymphoma), rectal cancer | |
| hsa-miR-147a | 2736 | 3757 | Macrophage | inflammatory response | |
| hsa-miR-147b | 2737 | 3758 | Macrophage | inflammatory response | |
| hsa-miR-148a-3p | 2738 | 3759 | hematopoietic cells | CLL, T-lineage ALL | |
| hsa-miR-148a-5p | 2739 | 3760 | hematopoietic cells | CLL, T-lineage ALL | |
| hsa-miR-148b-3p | 2740 | 3761 | neuron | | |
| hsa-miR-148b-5p | 2741 | 3762 | neuron | | |
| hsa-miR-149-3p | 2742 | 3763 | heart, brain | various cancers (glioma, colorectal, gastric, etc) | |
| hsa-miR-149-5p | 2743 | 3764 | heart, brain | various cancers (glioma, colorectal, gastric, etc) | |
| hsa-miR-150-3p | 2744 | 3765 | hematopoietic cells (lymphoid) | circulating plasma (acute myeloid leukemia) | |
| hsa-miR-150-5p | 2745 | 3766 | hematopoietic cells (lymphoid) | circulating plasma (acute myeloid leukemia) | |
| hsa-miR-151a-3p | 2746 | 3767 | neuron, fetal liver | | |
| hsa-miR-151a-5p | 2747 | 3768 | neuron, fetal liver | | |
| hsa-miR-151b | 2748 | 3769 | immune cells (B-cells) | | |
| hsa-miR-152 | 2749 | 3770 | liver | | |
| hsa-miR-153 | 2750 | 3771 | brain | | |
| hsa-miR-1537 | 2751 | 3772 | | | |
| hsa-miR-1538 | 2752 | 3773 | blood | Cancer cells | |
| hsa-miR-1539 | 2753 | 3774 | esophageal cell line KYSE-150R | | |
| hsa-miR-154-3p | 2754 | 3775 | embryonic stem cells | | |
| hsa-miR-154-5p | 2755 | 3776 | embryonic stem cells | | |
| hsa-miR-155-3p | 2756 | 3777 | T/B cells, monocytes, breast | various cancers (CLL, B cell lymphoma, breast, lung, ovarian, cervical, | |

TABLE 10-continued mirs, tissues/cell expression and diseases

| microRNA | mir SEQ ID | BS SEQ ID | Tissues/cells | Associated Disease | Biological Function |
|---|---|---|---|---|---|
| hsa-miR-155-5p | 2757 | 3778 | T/B cells, monocytes, breast | colorectal, prostate) various cancers (CLL, B cell lymphoma, breast, lung, ovarian, cervical, colorectal, prostate) | |
| hsa-miR-1587 | 2758 | 3779 | identified in B-cells | | |
| hsa-miR-15a-3p | 2759 | 3780 | blood, lymphocyte, hematopoietic tissues (spleen) | | cell cycle, proliferation |
| hsa-miR-15a-5p | 2760 | 3781 | blood, lymphocyte, hematopoietic tissues (spleen) | | cell cycle, proliferation |
| hsa-miR-15b-3p | 2761 | 3782 | blood, lymphocyte, hematopoietic tissues (spleen) | | cell cycle, proliferation |
| hsa-miR-15b-5p | 2762 | 3783 | blood, lymphocyte, hematopoietic tissues (spleen) | | cell cycle, proliferation |
| hsa-miR-16-1-3p | 2763 | 3784 | embryonic stem cells, blood, hematopoietic tissues (spleen) | | |
| hsa-miR-16-2-3p | 2764 | 3785 | blood, lymphocyte, hematopoietic tissues (spleen) | | |
| hsa-miR-16-5p | 2765 | 3786 | Many tissues, blood | | |
| hsa-miR-17-3p | 2766 | 3787 | embryonic stem cells, endothelial cells, | | tumor angiogenesis |
| hsa-miR-17-5p | 2767 | 3788 | endothelial cells, kidney, breast; | | tumor angiogenesis |
| hsa-miR-181a-2-3p | 2768 | 3789 | glioblast, stem cells | | |
| hsa-miR-181a-3p | 2769 | 3790 | glioblast, myeloid cells, Embryonic stem cells | | |
| hsa-miR-181a-5p | 2770 | 3791 | glioblast, myeloid cells, Embryonic stem cells | | |
| hsa-miR-181b-3p | 2771 | 3792 | glioblast, Embryonic stem cells, epidermal (keratinocytes) | | cell proliferation/senescence |
| hsa-miR-181b-5p | 2772 | 3793 | glioblast, Embryonic stem cells, epidermal (keratinocytes) | | cell proliferation/senescence |
| hsa-miR-181c-3p | 2773 | 3794 | brain, stem cells/progenitor | variou cance cells (gliobasltoma, basal cell carcinoma, prostate) | cell differentiation |
| hsa-miR-181c-5p | 2774 | 3795 | brain, stem cells/progenitor | variou cance cells (gliobasltoma, basal cell carcinoma, prostate) | cell differentiation |
| hsa-miR-181d | 2775 | 3796 | glia cells | | |
| hsa-miR-182-3p | 2776 | 3797 | immune cells | autoimmune | immune response |
| hsa-miR-1825 | 2777 | 3798 | discovered in a MiRDeep screening | | |
| hsa-miR-182-5p | 2778 | 3799 | lung, immune cells | autoimmune | immune response |
| hsa-miR-1827 | 2779 | 3800 | | small cell lung cancer | |
| hsa-miR-183-3p | 2780 | 3801 | brain | | |
| hsa-miR-183-5p | 2781 | 3802 | brain | | |
| hsa-miR-184 | 2782 | 3803 | blood, tongue, pancreas (islet) | | |
| hsa-miR-185-3p | 2783 | 3804 | | | |

TABLE 10-continued mirs, tissues/cell expression and diseases

| microRNA | mir SEQ ID | BS SEQ ID | Tissues/cells | Associated Disease | Biological Function |
|---|---|---|---|---|---|
| hsa-miR-185-5p | 2784 | 3805 | | | |
| hsa-miR-186-3p | 2785 | 3806 | osteoblasts, heart | various cancer cells | |
| hsa-miR-186-5p | 2786 | 3807 | osteoblasts, heart | various cancer cells | |
| hsa-miR-187-3p | 2787 | 3808 | | thyroid tumor | |
| hsa-miR-187-5p | 2788 | 3809 | | thyroid tumor | |
| hsa-miR-188-3p | 2789 | 3810 | irway smooth muscle, central nervous system | | |
| hsa-miR-188-5p | 2790 | 3811 | irway smooth muscle, central nervous system | | |
| hsa-miR-18a-3p | 2791 | 3812 | endothelial cells, lung | | |
| hsa-miR-18a-5p | 2792 | 3813 | endothelial cells, lung | | |
| hsa-miR-18b-3p | 2793 | 3814 | lung | | |
| hsa-miR-18b-5p | 2794 | 3815 | lung | | |
| hsa-miR-1908 | 2795 | 3816 | | breast cancer | |
| hsa-miR-1909-3p | 2796 | 3817 | | rectal cancer | |
| hsa-miR-1909-5p | 2797 | 3818 | | rectal cancer | |
| hsa-miR-190a | 2798 | 3819 | brain | | |
| hsa-miR-190b | 2799 | 3820 | brain | | |
| hsa-miR-1910 | 2800 | 3821 | embryonic stem cells | | |
| hsa-miR-1911-3p | 2801 | 3822 | embryonic stem cells, neural precursor | | |
| hsa-miR-1911-5p | 2802 | 3823 | embryonic stem cells, neural precursor | | |
| hsa-miR-1912 | 2803 | 3824 | embryonic stem cells, neural precursor | | |
| hsa-miR-1913 | 2804 | 3825 | embryonic stem cells | | |
| hsa-miR-191-3p | 2805 | 3826 | | chroninc lymphocyte leukimia, B-lieage ALL | |
| hsa-miR-1914-3p | 2806 | 3827 | embryonic stem cells | | |
| hsa-miR-1914-5p | 2807 | 3828 | embryonic stem cells | | |
| hsa-miR-1915-3p | 2808 | 3829 | embryonic stem cells | | |
| hsa-miR-1915-5p | 2809 | 3830 | embryonic stem cells | | |
| hsa-miR-191-5p | 2810 | 3831 | | chroninc lymphocyte leukimia, B-lieage ALL | |
| hsa-miR-192-3p | 2811 | 3832 | kidney | | |
| hsa-miR-192-5p | 2812 | 3833 | kidney | | |
| hsa-miR-193a-3p | 2813 | 3834 | many tissues/cells | various cancer cells (lung, osteoblastoma, ALL, follicular lymphoma, etc) | tumor suppressor, proliferation |
| hsa-miR-193a-5p | 2814 | 3835 | many tissues/cells | various cancer cells (lung, osteoblastoma, ALL, follicular lymphoma, etc) | tumor suppressor, proliferation |
| hsa-miR-193b-3p | 2815 | 3836 | many tissues/cells, semen | arious cancer cells (prostate, breast, melanoma, myeloma, non small cell lung, etc)follicular lymphoma) | tumor suppressor |
| hsa-miR-193b-5p | 2816 | 3837 | many tissues/cells, semen | arious cancer cells (prostate, | tumor suppressor |

TABLE 10-continued mirs, tissues/cell expression and diseases

| microRNA | mir SEQ ID | BS SEQ ID | Tissues/cells | Associated Disease | Biological Function |
|---|---|---|---|---|---|
| | | | | breast, melanoma, myeloma, non small cell lung, etc) follicular lymphoma) | |
| hsa-miR-194-3p | 2817 | 3838 | kidney, liver | various cancers | |
| hsa-miR-194-5p | 2818 | 3839 | kidney, liver | various cancers | |
| hsa-miR-195-3p | 2819 | 3840 | breast, pancreas (islet) | | |
| hsa-miR-195-5p | 2820 | 3841 | breast, pancreas (islet) | | |
| hsa-miR-196a-3p | 2821 | 3842 | pancreatic cells, endometrial tissues, mesenchymal stem cells | various cancer cells (pancreatic, osteosarcoma, endometrial, AML etc) | oncogenic, tumor suppressor |
| hsa-miR-196a-5p | 2822 | 3843 | pancreatic cells, endometrial tissues, mesenchymal stem cells | various cancer cells (pancreatic, osteosarcoma, endometrial, AML etc) | oncogenic, tumor suppressor |
| hsa-miR-196b-3p | 2823 | 3844 | endometrial tissues | glioblastoma | apoptosis |
| hsa-miR-196b-5p | 2824 | 3845 | endometrial tissues | glioblastoma | apoptosis |
| hsa-miR-1972 | 2825 | 3846 | | acute lymphoblastic leukemia | |
| hsa-miR-1973 | 2826 | 3847 | | acute lymphoblastic leukemia | |
| hsa-miR-197-3p | 2827 | 3848 | blood (myeloid), other tissues/cells | various cancers (thyroid tumor, leukemia, etc) | |
| hsa-miR-197-5p | 2828 | 3849 | blood (myeloid), other tissues/cells | various cancers (thyroid tumor, leukemia, etc) | |
| hsa-miR-1976 | 2829 | 3850 | | acute lymphoblastic leukemia | |
| hsa-miR-198 | 2830 | 3851 | central nevous system (CNS) | | |
| hsa-miR-199a-3p | 2831 | 3852 | liver, embryoid body cells, cardiomyocytes | | |
| hsa-miR-199a-5p | 2832 | 3853 | liver, cardiomyocytes | | |
| hsa-miR-199b-3p | 2833 | 3854 | liver, osteoblast | various cancers | osteogenesis |
| hsa-miR-199b-5p | 2834 | 3855 | liver, osteoblast | various cancers | osteogenesis |
| hsa-miR-19a-3p | 2835 | 3856 | endothelial cells | | tumor angiogenesis |
| hsa-miR-19a-5p | 2836 | 3857 | endothelial cells | | tumor angiogenesis |
| hsa-miR-19b-1-5p | 2837 | 3858 | endothelial cells | | tumor angiogenesis |
| hsa-miR-19b-2-5p | 2838 | 3859 | endothelial cells | | tumor angiogenesis |
| hsa-miR-19b-3p | 2839 | 3860 | endothelial cells | | tumor angiogenesis |
| hsa-miR-200a-3p | 2840 | 3861 | epithelial cells, many other tissues | various cancers (breast, cervical, bladder, etc) | tumor progression and metastasis |
| hsa-miR-200a-5p | 2841 | 3862 | epithelial cells, many other tissues | various cancers (breast, cervical, bladder, etc) | tumor progression and metastasis |
| hsa-miR-200b-3p | 2842 | 3863 | epithelial cells, many other tissues | | tumor progression and metastasis |
| hsa-miR-200b-5p | 2843 | 3864 | epithelial cells, many other tissues | | tumor progression and metastasis |
| hsa-miR-200c-3p | 2844 | 3865 | epithelial cells, many other tissues, embryonic stem cells | | tumor progression and metastasis |

TABLE 10-continued mirs, tissues/cell expression and diseases

| microRNA | mir SEQ ID | BS SEQ ID | Tissues/cells | Associated Disease | Biological Function |
|---|---|---|---|---|---|
| hsa-miR-200c-5p | 2845 | 3866 | epithelial cells, many other tissues, embryonic stem cells | | tumor progression and metastasis |
| hsa-miR-202-3p | 2846 | 3867 | blood | lymphomagenesis, other cancers | |
| hsa-miR-202-5p | 2847 | 3868 | blood | lymphomagenesis, other cancers | |
| hsa-miR-203a | 2848 | 3869 | skin (epithelium) | psoriasis, autoimmune | |
| hsa-miR-203b-3p | 2849 | 3870 | skin specific (epithelium) | psoriasis, autoimmune | |
| hsa-miR-203b-5p | 2850 | 3871 | skin specific (epithelium) | psoriasis, autoimmune | |
| hsa-miR-204-3p | 2851 | 3872 | adipose, other tissues/cells, kidney | various cancers | tumor metastasis |
| hsa-miR-204-5p | 2852 | 3873 | adipose, other tissues/cells, kidney | various cancers | tumor metastasis |
| hsa-miR-2052 | 2853 | 3874 | | | |
| hsa-miR-2053 | 2854 | 3875 | | | |
| hsa-miR-205-3p | 2855 | 3876 | blood (plasma) | various cancer cells (breast, glioma, melanoma, endometrial, etc) | |
| hsa-miR-2054 | 2856 | 3877 | | | |
| hsa-miR-205-5p | 2857 | 3878 | blood (plasma) | various cancer cells (breast, glioma, melanoma, endometrial, etc) | |
| hsa-miR-206 | 2858 | 3879 | muscle (cardiac and skeletal) | | myogenesis |
| hsa-miR-208a | 2859 | 3880 | heart (cardiomyocyte), muscle | cardiac defects | |
| hsa-miR-208b | 2860 | 3881 | heart (cardiomyocyte), muscle | cardiac defects | |
| hsa-miR-20a-3p | 2861 | 3882 | endothelial cells, kidney, osteogenic cells | | |
| hsa-miR-20a-5p | 2862 | 3883 | endothelial cells, kidney, osteogenic cells | | |
| hsa-miR-20b-3p | 2863 | 3884 | osteogenic cells | | |
| hsa-miR-20b-5p | 2864 | 3885 | osteogenic cells | | |
| hsa-miR-210 | 2865 | 3886 | kidney, heart, vascular endothelial cells | RCC, B-cell lymphocytes | angiogenesis |
| hsa-miR-2110 | 2866 | 3887 | | rectal cancer | |
| hsa-miR-2113 | 2867 | 3888 | embryonic stem cells | | |
| hsa-miR-211-3p | 2868 | 3889 | melanocytes | melanoma and other cancers | |
| hsa-miR-2114-3p | 2869 | 3890 | ovary, female reproductuve tract | | |
| hsa-miR-2114-5p | 2870 | 3891 | ovary, female reproductuve tract | | |
| hsa-miR-2115-3p | 2871 | 3892 | female reproductive tract | ovarian cancer | |
| hsa-miR-2115-5p | 2872 | 3893 | female reproductive tract | ovarian cancer | |
| hsa-miR-211-5p | 2873 | 3894 | melanocytes | melanoma and other cancers | |
| hsa-miR-2116-3p | 2874 | 3895 | | live cancer (hepatocytes) and ovarian cancer | |
| hsa-miR-2116-5p | 2875 | 3896 | | live cancer (hepatocytes) and ovarian cancer | |
| hsa-miR-2117 | 2876 | 3897 | | ovarian cancer | |
| hsa-miR-212-3p | 2877 | 3898 | brain (neuron), spleen | lymphoma | |

TABLE 10-continued mirs, tissues/cell expression and diseases

| microRNA | mir SEQ ID | BS SEQ ID | Tissues/cells | Associated Disease | Biological Function |
|---|---|---|---|---|---|
| hsa-miR-212-5p | 2878 | 3899 | brain (neuron), spleen | lymphoma | |
| hsa-miR-21-3p | 2879 | 3900 | glioblast, Blood (meyloid cells), liver, vascular endothelial cells | autoimmune, heart diseases, cancers | |
| hsa-miR-214-3p | 2880 | 3901 | immune cerlls, pancreas | varioua cancers (melanoma, pancreatic, ovarian) | immune response |
| hsa-miR-214-5p | 2881 | 3902 | immune cells, pancreas | varioua cancers (melanoma, pancreatic, ovarian) | immune response |
| hsa-miR-215 | 2882 | 3903 | many tissues/cells | various cancers (renal, colon, osteosarcoma) | cell cycle arrest/p53 inducible |
| hsa-miR-21-5p | 2883 | 3904 | blood (myeloid cells), liver, endothelial cells | autoimmune, heart diseases, cancers | |
| hsa-miR-216a-3p | 2884 | 3905 | kidney, pancreas | | |
| hsa-miR-216a-5p | 2885 | 3906 | kidney, pancreas | | |
| hsa-miR-216b | 2886 | 3907 | | cancers | senescence |
| hsa-miR-217 | 2887 | 3908 | endothelial cells | various cancer cells (pancreas, kidney, breast) | |
| hsa-miR-218-1-3p | 2888 | 3909 | endothelial cells | various cancer cells (gastric tumor, bladder, cervical, etc) | |
| hsa-miR-218-2-3p | 2889 | 3910 | | various cancer cells (gastric tumor, bladder, cervical, etc) | |
| hsa-miR-218-5p | 2890 | 3911 | | various cancer cells (gastric tumor, bladder, cervical, etc) | |
| hsa-miR-219-1-3p | 2891 | 3912 | brain, oligodendrocytes | | |
| hsa-miR-219-2-3p | 2892 | 3913 | brain, oligodendrocytes | | |
| hsa-miR-219-5p | 2893 | 3914 | brain, oligodendrocytes | | |
| hsa-miR-221-3p | 2894 | 3915 | endothelial cells, immune cells | leukemia and other cancers | angiogenesis/vasculogenesis |
| hsa-miR-221-5p | 2895 | 3916 | endothelial cells, immune cells | leukemia and other cancers | angiogenesis/vasculogenesis |
| hsa-miR-222-3p | 2896 | 3917 | endothelial cells | various cancers | angiogenesis |
| hsa-miR-222-5p | 2897 | 3918 | endothelial cells | various cancers | angiogenesis |
| hsa-miR-223-3p | 2898 | 3919 | meyloid cells | leukemia | |
| hsa-miR-223-5p | 2899 | 3920 | meyloid cells | leukemia | |
| hsa-miR-22-3p | 2900 | 3921 | many tissues/cells | various cancers | tumorigenesis |
| hsa-miR-224-3p | 2901 | 3922 | blood (plasma), ovary | cancers and inflammation | |
| hsa-miR-224-5p | 2902 | 3923 | blood (plasma), ovary | cancers and inflammation | |
| hsa-miR-22-5p | 2903 | 3924 | many tissues/cells | Various cancers | tumorigenesis |
| hsa-miR-2276 | 2904 | 3925 | | breast cancer | |
| hsa-miR-2277-3p | 2905 | 3926 | female reproductive tract | | |
| hsa-miR-2277-5p | 2906 | 3927 | female reproductive tract | | |
| hsa-miR-2278 | 2907 | 3928 | | breast cancer | |
| hsa-miR-2355-3p | 2908 | 3929 | embryonic stem cells | | |
| hsa-miR-2355-5p | 2909 | 3930 | embryonic stem cells | | |
| hsa-miR-2392 | 2910 | 3931 | identified in B-cells | | |
| hsa-miR-23a-3p | 2911 | 3932 | brain (astrocyte), endothelial cells, blood(erythroid) | Cancers | |

TABLE 10-continued mirs, tissues/cell expression and diseases

| microRNA | mir SEQ ID | BS SEQ ID | Tissues/cells | Associated Disease | Biological Function |
|---|---|---|---|---|---|
| hsa-miR-23a-5p | 2912 | 3933 | brain (astrocyte), endothelial cells, blood (erythroid) | cancers | |
| hsa-miR-23b-3p | 2913 | 3934 | blood, meyloid cells | cancers (renal cancer, glioblastoma, prostate, etc) and autoimmune | |
| hsa-miR-23b-5p | 2914 | 3935 | blood, meyloid cells | cancers (glioblastoma, prostate, etc) and autoimmune | |
| hsa-miR-23c | 2915 | 3936 | | cervical cancer | |
| hsa-miR-24-1-5p | 2916 | 3937 | lung, meyloid cells | | |
| hsa-miR-24-2-5p | 2917 | 3938 | lung, meyloid cells | | |
| hsa-miR-24-3p | 2918 | 3939 | lung, meyloid cells | | |
| hsa-miR-2467-3p | 2919 | 3940 | | breast cancer | |
| hsa-miR-2467-5p | 2920 | 3941 | | breast cancer | |
| hsa-miR-25-3p | 2921 | 3942 | embryonic stem cells, airway smooth muscle | | |
| hsa-miR-25-5p | 2922 | 3943 | embryonic stem cells, airway smooth muscle | | |
| hsa-miR-2681-3p | 2923 | 3944 | | breast cancer | |
| hsa-miR-2681-5p | 2924 | 3945 | | breast cancer | |
| hsa-miR-2682-3p | 2925 | 3946 | | | |
| hsa-miR-2682-5p | 2926 | 3947 | | | |
| hsa-miR-26a-1-3p | 2927 | 3948 | embryonic stem cells, blood, other tissues | CLL and other cancers | cell cycle and differentiation |
| hsa-miR-26a-2-3p | 2928 | 3949 | blood, other tissues | CLL and other cancers | cell cycle and differentiation |
| hsa-miR-26a-5p | 2929 | 3950 | blood, other tissues | CLL and other cancers | cell cycle and differentiation |
| hsa-miR-26b-3p | 2930 | 3951 | hematopoietic cells | | |
| hsa-miR-26b-5p | 2931 | 3952 | hematopoietic cells | | |
| hsa-miR-27a-3p | 2932 | 3953 | meyloid cells | various cancer cells | |
| hsa-miR-27a-5p | 2933 | 3954 | meyloid cells | various cancer cells | |
| hsa-miR-27b-3p | 2934 | 3955 | meyloid cells, vascular endothelial cells | various cancer cells | pro-angiogenic |
| hsa-miR-27b-5p | 2935 | 3956 | meyloid cells, vascular endothelial cells | various cancer cells | pro-angiogenic |
| hsa-miR-28-3p | 2936 | 3957 | blood (immune cells) | B/T cell lymphoma | |
| hsa-miR-28-5p | 2937 | 3958 | blood (immune cells) | B/T cell lymphoma | |
| hsa-miR-2861 | 2938 | 3959 | osteoblasts | basal cell carcinoma | |
| hsa-miR-2909 | 2939 | 3960 | T-Lymphocytes | | |
| hsa-miR-296-3p | 2940 | 3961 | kidney, heart, lung, entothelial cells | | angiogenesis |
| hsa-miR-2964a-3p | 2941 | 3962 | | | |
| hsa-miR-2964a-5p | 2942 | 3963 | | | |
| hsa-miR-296-5p | 2943 | 3964 | lung, liver, endothelial cells | | angiogenesis |
| hsa-miR-297 | 2944 | 3965 | oocyte and prostate | | |
| hsa-miR-298 | 2945 | 3966 | | breast cancer | |
| hsa-miR-299-3p | 2946 | 3967 | | myeloid leukaemia, hepatoma, breast cancer | |
| hsa-miR-299-5p | 2947 | 3968 | | myeloid leukaemia, hepatoma, breast cancer | |
| hsa-miR-29a-3p | 2948 | 3969 | immuno system | CLL, other cancers, neurodegenerative disease | tumor suppression, immune modulation |

TABLE 10-continued mirs, tissues/cell expression and diseases

| microRNA | mir SEQ ID | BS SEQ ID | Tissues/cells | Associated Disease | Biological Function |
|---|---|---|---|---|---|
| hsa-miR-29a-5p | 2949 | 3970 | immuno system | CLL, other cancers, neurodegenerative disease | tumor suppression, immune modulation |
| hsa-miR-29b-1-5p | 2950 | 3971 | immuno system | CLL, other cancers, neurodegenerative disease | tumor suppression, immune modulation |
| hsa-miR-29b-2-5p | 2951 | 3972 | immuno system | CLL, other cancers | tumor suppression, immune modulation |
| hsa-miR-29b-3p | 2952 | 3973 | immuno system | CLL, other cancers | tumor suppression, immune modulation |
| hsa-miR-29c-3p | 2953 | 3974 | immuno system | CLL, other cancers | tumor suppression, immune modulation |
| hsa-miR-29c-5p | 2954 | 3975 | immuno system | CLL, other cancers | tumor suppression, immune modulation |
| hsa-miR-300 | 2955 | 3976 | osteoblast | Bladder cancer | |
| hsa-miR-301a-3p | 2956 | 3977 | embryonic stem cells | | |
| hsa-miR-301a-5p | 2957 | 3978 | embryonic stem cells | | |
| hsa-miR-301b | 2958 | 3979 | | esophageal adenocarcinoma, colonic cancer | |
| hsa-miR-302a-3p | 2959 | 3980 | embryonic stem cells, lipid metabolism | | lipid metabolism |
| hsa-miR-302a-5p | 2960 | 3981 | embryonic stem cells, lipid metabolism | | lipid metabolism |
| hsa-miR-302b-3p | 2961 | 3982 | embryonic stem cells | | |
| hsa-miR-302b-5p | 2962 | 3983 | embryonic stem cells | | |
| hsa-miR-302c-3p | 2963 | 3984 | embryonic stem cells | | |
| hsa-miR-302c-5p | 2964 | 3985 | embryonic stem cells | | |
| hsa-miR-302d-3p | 2965 | 3986 | embryonic stem cells | | |
| hsa-miR-302d-5p | 2966 | 3987 | embryonic stem cells | | |
| hsa-miR-302e | 2967 | 3988 | embryoid body cells | | |
| hsa-miR-302f | 2968 | 3989 | | gastric cancer | |
| hsa-miR-3064-3p | 2969 | 3990 | | | |
| hsa-miR-3064-5p | 2970 | 3991 | | | |
| hsa-miR-3065-3p | 2971 | 3992 | oligodendrocytes | anti-virus response | |
| hsa-miR-3065-5p | 2972 | 3993 | oligodendrocytes | solid tumors | |
| hsa-miR-3074-3p | 2973 | 3994 | | various cancer (melanoma, breast) | |
| hsa-miR-3074-5p | 2974 | 3995 | | various cancer (melanoma, breast) | |
| hsa-miR-30a-3p | 2975 | 3996 | kidney, pancreatic cells | various cancers | autophagy |
| hsa-miR-30a-5p | 2976 | 3997 | CNS (prefrontal cortex), other tissues | glioma, colon carcinoma | autophagy |
| hsa-miR-30b-3p | 2977 | 3998 | kidney, adipose, CNS (prefrontal cortex) | | |

TABLE 10-continued mirs, tissues/cell expression and diseases

| microRNA | mir SEQ ID | BS SEQ ID | Tissues/cells | Associated Disease | Biological Function |
|---|---|---|---|---|---|
| hsa-miR-30b-5p | 2978 | 3999 | kidney, adipose, CNS (prefrontal cortex) | | |
| hsa-miR-30c-1-3p | 2979 | 4000 | kidney, adipose, CNS (prefrontal cortex) | | |
| hsa-miR-30c-2-3p | 2980 | 4001 | kidney, adipose, CNS (prefrontal cortex) | | |
| hsa-miR-30c-5p | 2981 | 4002 | kidney, adipose, CNS (prefrontal cortex) | | |
| hsa-miR-30d-3p | 2982 | 4003 | CNS (prefrontal cortex | | |
| hsa-miR-30d-5p | 2983 | 4004 | CNS (prefrontal cortex, embryoid body cells | | |
| hsa-miR-30e-3p | 2984 | 4005 | myeloid cells, glia cells | | |
| hsa-miR-30e-5p | 2985 | 4006 | myeloid cells, glia cells | | |
| hsa-miR-3115 | 2986 | 4007 | | various cancer (melanoma, breast tumor) | |
| hsa-miR-3116 | 2987 | 4008 | discovered in the melanoma miRNAome | | |
| hsa-miR-3117-3p | 2988 | 4009 | discovered in the melanoma miRNAome | | |
| hsa-miR-3117-5p | 2989 | 4010 | discovered in the melanoma miRNAome | | |
| hsa-miR-3118 | 2990 | 4011 | discovered in the melanoma miRNAome | | |
| hsa-miR-3119 | 2991 | 4012 | discovered in the melanoma miRNAome | | |
| hsa-miR-3120-3p | 2992 | 4013 | discovered in the melanoma miRNAome | breast tumor | |
| hsa-miR-3120-5p | 2993 | 4014 | discovered in the melanoma miRNAome | breast tumor | |
| hsa-miR-3121-3p | 2994 | 4015 | discovered in the melanoma miRNAome | breast tumor | |
| hsa-miR-3121-5p | 2995 | 4016 | discovered in the melanoma miRNAome | breast tumor | |
| hsa-miR-3122 | 2996 | 4017 | discovered in the melanoma miRNAome | | |
| hsa-miR-3123 | 2997 | 4018 | discovered in the melanoma miRNAome | | |
| hsa-miR-3124-3p | 2998 | 4019 | discovered in the melanoma miRNAome, ovary | breast tumor | |
| hsa-miR-3124-5p | 2999 | 4020 | discovered in the melanoma miRNAome, ovary | breast tumor | |
| hsa-miR-3125 | 3000 | 4021 | discovered in the melanoma miRNAome | | |
| hsa-miR-3126-3p | 3001 | 4022 | discovered in the melanoma miRNAome, ovary | breast tumor | |
| hsa-miR-3126-5p | 3002 | 4023 | discovered in the melanoma miRNAome, ovary | breast tumor | |

TABLE 10-continued mirs, tissues/cell expression and diseases

| microRNA | mir SEQ ID | BS SEQ ID | Tissues/cells | Associated Disease | Biological Function |
|---|---|---|---|---|---|
| hsa-miR-3127-3p | 3003 | 4024 | discovered in the melanoma miRNAome | breast tumor | |
| hsa-miR-3127-5p | 3004 | 4025 | discovered in the melanoma miRNAome | breast tumor | |
| hsa-miR-3128 | 3005 | 4026 | discovered in the melanoma miRNAome | breast tumor | |
| hsa-miR-3129-3p | 3006 | 4027 | discovered in the melanoma miRNAome, ovary | breast tumor | |
| hsa-miR-3129-5p | 3007 | 4028 | discovered in the melanoma miRNAome, ovary | breast tumor | |
| hsa-miR-3130-3p | 3008 | 4029 | discovered in the melanoma miRNAome, ovary | breast tumor | |
| hsa-miR-3130-5p | 3009 | 4030 | discovered in the melanoma miRNAome, ovary | breast tumor | |
| hsa-miR-3131 | 3010 | 4031 | discovered in the melanoma miRNAome | breast tumor | |
| hsa-miR-3132 | 3011 | 4032 | discovered in the melanoma miRNAome | | |
| hsa-miR-3133 | 3012 | 4033 | discovered in the melanoma miRNAome | | |
| hsa-miR-3134 | 3013 | 4034 | discovered in the melanoma miRNAome | | |
| hsa-miR-3135a | 3014 | 4035 | discovered in the melanoma miRNAome | | |
| hsa-miR-3135b | 3015 | 4036 | discovered in B cells | | |
| hsa-miR-3136-3p | 3016 | 4037 | discovered in the melanoma miRNAome | lymphoblastic leukaemia and breast tumor | |
| hsa-miR-3136-5p | 3017 | 4038 | discovered in the melanoma miRNAome | lymphoblastic leukaemia and breast tumor | |
| hsa-miR-3137 | 3018 | 4039 | discovered in the melanoma miRNAome | | |
| hsa-miR-3138 | 3019 | 4040 | discovered in the melanoma miRNAome, ovary | | |
| hsa-miR-3139 | 3020 | 4041 | discovered in the melanoma miRNAome | | |
| hsa-miR-31-3p | 3021 | 4042 | | | |
| hsa-miR-3140-3p | 3022 | 4043 | discovered in the melanoma miRNAome, ovary | lymphoblastic leukaemia and breast tumor | |
| hsa-miR-3140-5p | 3023 | 4044 | discovered in the melanoma miRNAome, ovary | lymphoblastic leukaemia and breast tumor | |
| hsa-miR-3141 | 3024 | 4045 | discovered in the melanoma miRNAome | | |
| hsa-miR-3142 | 3025 | 4046 | discovered in the melanoma miRNAome; immune cells | | |
| hsa-miR-3143 | 3026 | 4047 | discovered in the melanoma miRNAome | breast tumor | |
| hsa-miR-3144-3p | 3027 | 4048 | discovered in the melanoma miRNAome, ovary | | |

TABLE 10-continued mirs, tissues/cell expression and diseases

| microRNA | mir SEQ ID | BS SEQ ID | Tissues/cells | Associated Disease | Biological Function |
|---|---|---|---|---|---|
| hsa-miR-3144-5p | 3028 | 4049 | discovered in the melanoma miRNAome, ovary | | |
| hsa-miR-3145-3p | 3029 | 4050 | discovered in the melanoma miRNAome | breast tumor | |
| hsa-miR-3145-5p | 3030 | 4051 | discovered in the melanoma miRNAome | breast tumor | |
| hsa-miR-3146 | 3031 | 4052 | discovered in the melanoma miRNAome | breast tumor | |
| hsa-miR-3147 | 3032 | 4053 | discovered in the melanoma miRNAome | | |
| hsa-miR-3148 | 3033 | 4054 | discovered in the melanoma miRNAome | | |
| hsa-miR-3149 | 3034 | 4055 | discovered in the melanoma miRNAome, ovary | | |
| hsa-miR-3150a-3p | 3035 | 4056 | discovered in the melanoma miRNAome | breast tumor | |
| hsa-miR-3150a-5p | 3036 | 4057 | discovered in the melanoma miRNAome | breast tumor | |
| hsa-miR-3150b-3p | 3037 | 4058 | discovered in the melanoma miRNAome | breast tumor and lymphoblastic leukaemia | |
| hsa-miR-3150b-5p | 3038 | 4059 | discovered in the melanoma miRNAome | breast tumor and lymphoblastic leukaemia | |
| hsa-miR-3151 | 3039 | 4060 | discovered in the melanoma miRNAome | lymphoblastic leukaemia | |
| hsa-miR-3152-3p | 3040 | 4061 | discovered in the melanoma miRNAome, ovary | breast tumor | |
| hsa-miR-3152-5p | 3041 | 4062 | discovered in the melanoma miRNAome, ovary | breast tumor | |
| hsa-miR-3153 | 3042 | 4063 | discovered in the melanoma miRNAome | | |
| hsa-miR-3154 | 3043 | 4064 | discovered in the melanoma miRNAome | lymphoblastic leukaemia | |
| hsa-miR-3155a | 3044 | 4065 | discovered in the melanoma miRNAome | | |
| hsa-miR-3155b | 3045 | 4066 | discovered in B cells | | |
| hsa-miR-3156-3p | 3046 | 4067 | discovered in the melanoma miRNAome | breast tumor | |
| hsa-miR-3156-5p | 3047 | 4068 | discovered in the melanoma miRNAome | breast tumor | |
| hsa-miR-3157-3p | 3048 | 4069 | discovered in the melanoma miRNAome | breast tumor | |
| hsa-miR-3157-5p | 3049 | 4070 | discovered in the melanoma miRNAome | breast tumor | |
| hsa-miR-3158-3p | 3050 | 4071 | discovered in the melanoma miRNAome, ovary | breast tumor | |
| hsa-miR-3158-5p | 3051 | 4072 | discovered in the melanoma miRNAome, ovary | breast tumor | |
| hsa-miR-3159 | 3052 | 4073 | discovered in the melanoma miRNAome | | |

TABLE 10-continued mirs, tissues/cell expression and diseases

| microRNA | mir SEQ ID | BS SEQ ID | Tissues/cells | Associated Disease | Biological Function |
|---|---|---|---|---|---|
| hsa-miR-31-5p | 3053 | 4074 | | various cancer cells (breast, lung, prostate) | |
| hsa-miR-3160-3p | 3054 | 4075 | discovered in the melanoma miRNAome | breast tumor | |
| hsa-miR-3160-5p | 3055 | 4076 | discovered in the melanoma miRNAome | breast tumor | |
| hsa-miR-3161 | 3056 | 4077 | discovered in the melanoma miRNAome | | |
| hsa-miR-3162-3p | 3057 | 4078 | discovered in the melanoma miRNAome | breast tumor | |
| hsa-miR-3162-5p | 3058 | 4079 | discovered in the melanoma miRNAome | breast tumor | |
| hsa-miR-3163 | 3059 | 4080 | discovered in the melanoma miRNAome | | |
| hsa-miR-3164 | 3060 | 4081 | discovered in the melanoma miRNAome | | |
| hsa-miR-3165 | 3061 | 4082 | discovered in the melanoma miRNAome | breast tumor | |
| hsa-miR-3166 | 3062 | 4083 | discovered in the melanoma miRNAome | | |
| hsa-miR-3167 | 3063 | 4084 | discovered in the melanoma miRNAome, ovary | | |
| hsa-miR-3168 | 3064 | 4085 | discovered in the melanoma miRNAome | | |
| hsa-miR-3169 | 3065 | 4086 | discovered in the melanoma miRNAome | | |
| hsa-miR-3170 | 3066 | 4087 | discovered in the melanoma miRNAome | breast tumor | |
| hsa-miR-3171 | 3067 | 4088 | discovered in the melanoma miRNAome, ovary | | |
| hsa-miR-3173-3p | 3068 | 4089 | discovered in the melanoma miRNAome | breast tumor | |
| hsa-miR-3173-5p | 3069 | 4090 | discovered in the melanoma miRNAome | breast tumor | |
| hsa-miR-3174 | 3070 | 4091 | discovered in the melanoma miRNAome | | |
| hsa-miR-3175 | 3071 | 4092 | discovered in the melanoma miRNAome, ovary | breast tumor | |
| hsa-miR-3176 | 3072 | 4093 | discovered in the melanoma miRNAome | breast tumor | |
| hsa-miR-3177-3p | 3073 | 4094 | discovered in the melanoma miRNAome | breast tumor and lymphoblastic leukaemia | |
| hsa-miR-3177-5p | 3074 | 4095 | discovered in the melanoma miRNAome | breast tumor and lymphoblastic leukaemia | |
| hsa-miR-3178 | 3075 | 4096 | discovered in the melanoma miRNAome | | |
| hsa-miR-3179 | 3076 | 4097 | discovered in the melanoma miRNAome | | |

TABLE 10-continued mirs, tissues/cell expression and diseases

| microRNA | mir SEQ ID | BS SEQ ID | Tissues/cells | Associated Disease | Biological Function |
|---|---|---|---|---|---|
| hsa-miR-3180 | 3077 | 4098 | discovered in the melanoma miRNAome, ovary | breast tumor | |
| hsa-miR-3180-3p | 3078 | 4099 | discovered in breast tumor | | |
| hsa-miR-3180-5p | 3079 | 4100 | discovered in breast tumor | | |
| hsa-miR-3181 | 3080 | 4101 | discovered in the melanoma miRNAome | | |
| hsa-miR-3182 | 3081 | 4102 | discovered in the melanoma miRNAome | | |
| hsa-miR-3183 | 3082 | 4103 | discovered in the melanoma miRNAome | | |
| hsa-miR-3184-3p | 3083 | 4104 | discovered in the melanoma miRNAome | | |
| hsa-miR-3184-5p | 3084 | 4105 | discovered in the melanoma miRNAome | | |
| hsa-miR-3185 | 3085 | 4106 | discovered in the melanoma miRNAome | | |
| hsa-miR-3186-3p | 3086 | 4107 | discovered in the melanoma miRNAome, ovary | | |
| hsa-miR-3186-5p | 3087 | 4108 | discovered in the melanoma miRNAome, ovary | | |
| hsa-miR-3187-3p | 3088 | 4109 | discovered in the melanoma miRNAome | breast tumor | |
| hsa-miR-3187-5p | 3089 | 4110 | discovered in the melanoma miRNAome | breast tumor | |
| hsa-miR-3188 | 3090 | 4111 | discovered in the melanoma miRNAome | | |
| hsa-miR-3189-3p | 3091 | 4112 | discovered in the melanoma miRNAome | breast tumor | |
| hsa-miR-3189-5p | 3092 | 4113 | discovered in the melanoma miRNAome | breast tumor | |
| hsa-miR-3190-3p | 3093 | 4114 | discovered in the melanoma miRNAome | lymphoblastic leukaemia | |
| hsa-miR-3190-5p | 3094 | 4115 | discovered in the melanoma miRNAome | lymphoblastic leukaemia | |
| hsa-miR-3191-3p | 3095 | 4116 | discovered in the melanoma miRNAome | | |
| hsa-miR-3191-5p | 3096 | 4117 | discovered in the melanoma miRNAome | | |
| hsa-miR-3192 | 3097 | 4118 | discovered in the melanoma miRNAome | breast tumor | |
| hsa-miR-3193 | 3098 | 4119 | discovered in the melanoma miRNAome | | |
| hsa-miR-3194-3p | 3099 | 4120 | discovered in the melanoma miRNAome | breast tumor | |
| hsa-miR-3194-5p | 3100 | 4121 | discovered in the melanoma miRNAome | breast tumor | |
| hsa-miR-3195 | 3101 | 4122 | discovered in the melanoma miRNAome | | |

TABLE 10-continued mirs, tissues/cell expression and diseases

| microRNA | mir SEQ ID | BS SEQ ID | Tissues/cells | Associated Disease | Biological Function |
|---|---|---|---|---|---|
| hsa-miR-3196 | 3102 | 4123 | | basal cell carcinoma | |
| hsa-miR-3197 | 3103 | 4124 | discovered in the melanoma miRNAome | | |
| hsa-miR-3198 | 3104 | 4125 | discovered in the melanoma miRNAome | breast tumor | |
| hsa-miR-3199 | 3105 | 4126 | discovered in the melanoma miRNAome | | |
| hsa-miR-3200-3p | 3106 | 4127 | discovered in the melanoma miRNAome, ovary | breast tumor | |
| hsa-miR-3200-5p | 3107 | 4128 | discovered in the melanoma miRNAome, ovary | breast tumor | |
| hsa-miR-3201 | 3108 | 4129 | discovered in the melanoma miRNAome, | | |
| hsa-miR-3202 | 3109 | 4130 | discovered in the melanoma miRNAome, epithelial cell BEAS2B | | |
| hsa-miR-320a | 3110 | 4131 | blood, heart (myocardiac) | colon cancer cells, heart disease | |
| hsa-miR-320b | 3111 | 4132 | central nevous system | | |
| hsa-miR-320c | 3112 | 4133 | chondrocyte | | cartilage metabolism |
| hsa-miR-320d | 3113 | 4134 | | cancer stem cells | |
| hsa-miR-320e | 3114 | 4135 | neural cells | | |
| hsa-miR-323a-3p | 3115 | 4136 | neurons | myeloid leukaemia, mudulla thyroid carcinoma | |
| hsa-miR-323a-5p | 3116 | 4137 | neurons | myeloid leukaemia, mudulla thyroid carcinoma | |
| hsa-miR-323b-3p | 3117 | 4138 | | myeloid leukaemia | |
| hsa-miR-323b-5p | 3118 | 4139 | | myeloid leukaemia | |
| hsa-miR-32-3p | 3119 | 4140 | blood, glia | various cancers (lung, kidney, prostate, etc), virus infection | |
| hsa-miR-324-3p | 3120 | 4141 | kidney | | |
| hsa-miR-324-5p | 3121 | 4142 | neurons | tumor cells | |
| hsa-miR-325 | 3122 | 4143 | neurons, placenta | | |
| hsa-miR-32-5p | 3123 | 4144 | blood, glia | various cancers (lung, kidney, prostate, etc), virus infection | |
| hsa-miR-326 | 3124 | 4145 | neurons | tumor cells | |
| hsa-miR-328 | 3125 | 4146 | neuron, blood | tumor cells | |
| hsa-miR-329 | 3126 | 4147 | brain and platele | | |
| hsa-miR-330-3p | 3127 | 4148 | | various cancers (prostate, glioblastoma, colorectal) | |
| hsa-miR-330-5p | 3128 | 4149 | | various cancers (prostate, glioblastoma, colorectal) | |
| hsa-miR-331-3p | 3129 | 4150 | | gastric cancer | |
| hsa-miR-331-5p | 3130 | 4151 | lymphocytes | | |
| hsa-miR-335-3p | 3131 | 4152 | kidney, breast | RCC, multiple myeloma | |
| hsa-miR-335-5p | 3132 | 4153 | kidney, breast | RCC, multiple myeloma | |
| hsa-miR-337-3p | 3133 | 4154 | lung | gastric cancer | |

TABLE 10-continued mirs, tissues/cell expression and diseases

| microRNA | mir SEQ ID | BS SEQ ID | Tissues/cells | Associated Disease | Biological Function |
|---|---|---|---|---|---|
| hsa-miR-337-5p | 3134 | 4155 | lung | | |
| hsa-miR-338-3p | 3135 | 4156 | epithelial cells, oligodendrocytes | gastric, rectal cancer cells, osteosarcoma | |
| hsa-miR-338-5p | 3136 | 4157 | oligodendrocytes | gastric cancer | |
| hsa-miR-339-3p | 3137 | 4158 | immune cell | | |
| hsa-miR-339-5p | 3138 | 4159 | immune cell | | |
| hsa-miR-33a-3p | 3139 | 4160 | pancreatic islet, lipid metabolism | | lipid metabolism |
| hsa-miR-33a-5p | 3140 | 4161 | pancreatic islet, lipid metabolism | | lipid metabolism |
| hsa-miR-33b-3p | 3141 | 4162 | lipid metabolism | | lipid metabolism |
| hsa-miR-33b-5p | 3142 | 4163 | lipid metabolism | | lipid metabolism |
| hsa-miR-340-3p | 3143 | 4164 | | various cancers | |
| hsa-miR-340-5p | 3144 | 4165 | embryoid body cells | | |
| hsa-miR-342-3p | 3145 | 4166 | brain, circulating plasma | multiple myeloma, other cancers | |
| hsa-miR-342-5p | 3146 | 4167 | circulating plasma | multiple myeloma, other cancers | |
| hsa-miR-345-3p | 3147 | 4168 | hematopoietic cells | follicular lymphoma, other cancers | |
| hsa-miR-345-5p | 3148 | 4169 | hematopoietic cells | follicular lymphoma, other cancers | |
| hsa-miR-346 | 3149 | 4170 | immume cells | cancers and autoimmune | |
| hsa-miR-34a-3p | 3150 | 4171 | breast, meyloid cells, ciliated epithelial cells | gastric cancer, CLL, other | tumor suppressor, p53 inducible |
| hsa-miR-34a-5p | 3151 | 4172 | breast, meyloid cells, ciliated epithelial cells | gastric cancer, CLL, other | tumor suppressor, p53 inducible |
| hsa-miR-34b-3p | 3152 | 4173 | ciliated epithelial cells | various cancers | tumor suppressor, p53 inducible |
| hsa-miR-34b-5p | 3153 | 4174 | ciliated epithelial cells | various cancers | tumor suppressor, p53 inducible |
| hsa-miR-34c-3p | 3154 | 4175 | ciliated epithelial cells, placenta | various cancers | tumor suppressor, p53 inducible |
| hsa-miR-34c-5p | 3155 | 4176 | ciliated epithelial cells, placenta | various cancers | tumor suppressor, p53 inducible |
| hsa-miR-3529-3p | 3156 | 4177 | discovered in breast tumor | | |
| hsa-miR-3529-5p | 3157 | 4178 | discovered in breast tumor | | |
| hsa-miR-3591-3p | 3158 | 4179 | discovered in breast tumor | | |
| hsa-miR-3591-5p | 3159 | 4180 | discovered in breast tumor | | |
| hsa-miR-3605-3p | 3160 | 4181 | discovered in reprodcutive tracts | | |
| hsa-miR-3605-5p | 3161 | 4182 | discovered in reprodcutive tracts | | |
| hsa-miR-3606-3p | 3162 | 4183 | discovered in cervical tumors | | |
| hsa-miR-3606-5p | 3163 | 4184 | discovered in cervical tumors | | |
| hsa-miR-3607-3p | 3164 | 4185 | discovered in cervical tumors | | |
| hsa-miR-3607-5p | 3165 | 4186 | discovered in cervical tumors | | |
| hsa-miR-3609 | 3166 | 4187 | discovered in cervical tumors | | |
| hsa-miR-3610 | 3167 | 4188 | discovered in cervical tumors | | |

TABLE 10-continued mirs, tissues/cell expression and diseases

| microRNA | mir SEQ ID | BS SEQ ID | Tissues/cells | Associated Disease | Biological Function |
|---|---|---|---|---|---|
| hsa-miR-3611 | 3168 | 4189 | discovered in cervical tumors | | |
| hsa-miR-3612 | 3169 | 4190 | discovered in cervical tumors | | |
| hsa-miR-3613-3p | 3170 | 4191 | discovered in cervical tumors | | |
| hsa-miR-3613-5p | 3171 | 4192 | discovered in cervical tumors | | |
| hsa-miR-361-3p | 3172 | 4193 | blood, endothelial cells | | |
| hsa-miR-3614-3p | 3173 | 4194 | discovered in cervical and breast tumors | | |
| hsa-miR-3614-5p | 3174 | 4195 | discovered in cervical and breast tumors | | |
| hsa-miR-3615 | 3175 | 4196 | discovered in cervical tumors | | |
| hsa-miR-361-5p | 3176 | 4197 | endothelial cells | | |
| hsa-miR-3616-3p | 3177 | 4198 | discovered in cervical tumors | | |
| hsa-miR-3616-5p | 3178 | 4199 | discovered in cervical tumors | | |
| hsa-miR-3617-3p | 3179 | 4200 | discovered in cervical tumors and psoriasis | | |
| hsa-miR-3617-5p | 3180 | 4201 | discovered in cervical tumors and psoriasis | | |
| hsa-miR-3618 | 3181 | 4202 | discovered in cervical tumors | | |
| hsa-miR-3619-3p | 3182 | 4203 | discovered in breast tumors | | |
| hsa-miR-3619-5p | 3183 | 4204 | discovered in breast tumors | | |
| hsa-miR-3620-3p | 3184 | 4205 | discovered in cervical tumors | | |
| hsa-miR-3620-5p | 3185 | 4206 | discovered in cervical tumors | | |
| hsa-miR-3621 | 3186 | 4207 | discovered in cervical tumors | | |
| hsa-miR-3622a-3p | 3187 | 4208 | discovered in breast tumors | | |
| hsa-miR-3622a-5p | 3188 | 4209 | discovered in breast tumors | | |
| hsa-miR-3622b-3p | 3189 | 4210 | discovered in cervical tumors | | |
| hsa-miR-3622b-5p | 3190 | 4211 | discovered in cervical tumors | | |
| hsa-miR-362-3p | 3191 | 4212 | | melanoma | |
| hsa-miR-362-5p | 3192 | 4213 | | melanoma | |
| hsa-miR-363-3p | 3193 | 4214 | kidney stem cell, blood cells | | |
| hsa-miR-363-5p | 3194 | 4215 | kidney stem cell, blood cells | | |
| hsa-miR-3646 | 3195 | 4216 | discovered in solid tumor | | |
| hsa-miR-3648 | 3196 | 4217 | discovered in solid tumor | | |
| hsa-miR-3649 | 3197 | 4218 | discovered in solid tumor | | |
| hsa-miR-3650 | 3198 | 4219 | discovered in solid tumor | | |
| hsa-miR-3651 | 3199 | 4220 | discovered in solid tumor | | |
| hsa-miR-3652 | 3200 | 4221 | discovered in solid tumor | | |
| hsa-miR-3653 | 3201 | 4222 | discovered in solid tumor | | |
| hsa-miR-3654 | 3202 | 4223 | discovered in solid tumor | | |
| hsa-miR-3655 | 3203 | 4224 | discovered in solid tumor | | |

TABLE 10-continued mirs, tissues/cell expression and diseases

| microRNA | mir SEQ ID | BS SEQ ID | Tissues/cells | Associated Disease | Biological Function |
|---|---|---|---|---|---|
| hsa-miR-3656 | 3204 | 4225 | discovered in solid tumor | | |
| hsa-miR-3657 | 3205 | 4226 | discovered in solid tumor | | |
| hsa-miR-3658 | 3206 | 4227 | discovered in solid tumor | | |
| hsa-miR-3659 | 3207 | 4228 | discovered in breast tumors | | |
| hsa-miR-365a-3p | 3208 | 4229 | | various cancer cells (Immune cells, lung, colon, endometriotic) | apoptosis |
| hsa-miR-365a-5p | 3209 | 4230 | | various cancer cells (Immune cells, lung, colon, endometriotic)) | apoptosis |
| hsa-miR-365b-3p | 3210 | 4231 | | various cancers (retinoblastoma, colon, endometriotic) | apoptosis |
| hsa-miR-365b-5p | 3211 | 4232 | | various cancers (colon, endometriotic) | apoptosis |
| hsa-miR-3660 | 3212 | 4233 | discovered in breast tumors | | |
| hsa-miR-3661 | 3213 | 4234 | discovered in breast tumors | | |
| hsa-miR-3662 | 3214 | 4235 | | | |
| hsa-miR-3663-3p | 3215 | 4236 | | | |
| hsa-miR-3663-5p | 3216 | 4237 | | | |
| hsa-miR-3664-3p | 3217 | 4238 | discovered in breast tumors | | |
| hsa-miR-3664-5p | 3218 | 4239 | discovered in breast tumors | | |
| hsa-miR-3665 | 3219 | 4240 | brain | | |
| hsa-miR-3666 | 3220 | 4241 | brain | | |
| hsa-miR-3667-3p | 3221 | 4242 | discovered in peripheral blood | | |
| hsa-miR-3667-5p | 3222 | 4243 | discovered in peripheral blood | | |
| hsa-miR-3668 | 3223 | 4244 | discovered in peripheral blood | | |
| hsa-miR-3669 | 3224 | 4245 | discovered in peripheral blood | | |
| hsa-miR-3670 | 3225 | 4246 | discovered in peripheral blood | | |
| hsa-miR-3671 | 3226 | 4247 | discovered in peripheral blood | | |
| hsa-miR-3672 | 3227 | 4248 | discovered in peripheral blood | | |
| hsa-miR-3673 | 3228 | 4249 | discovered in peripheral blood | | |
| hsa-miR-367-3p | 3229 | 4250 | embryonic stem cells | | reprogramming |
| hsa-miR-3674 | 3230 | 4251 | discovered in peripheral blood | | |
| hsa-miR-3675-3p | 3231 | 4252 | discovered in peripheral blood | | |
| hsa-miR-3675-5p | 3232 | 4253 | discovered in peripheral blood | | |
| hsa-miR-367-5p | 3233 | 4254 | embryonic stem cells | | reprogramming |
| hsa-miR-3676-3p | 3234 | 4255 | discovered in peripheral blood | | |
| hsa-miR-3676-5p | 3235 | 4256 | discovered in peripheral blood | | |
| hsa-miR-3677-3p | 3236 | 4257 | discovered in peripheral blood | | |
| hsa-miR-3677-5p | 3237 | 4258 | discovered in peripheral blood | | |
| hsa-miR-3678-3p | 3238 | 4259 | discovered in peripheral blood | | |

TABLE 10-continued mirs, tissues/cell expression and diseases

| microRNA | mir SEQ ID | BS SEQ ID | Tissues/cells | Associated Disease | Biological Function |
|---|---|---|---|---|---|
| hsa-miR-3678-5p | 3239 | 4260 | discovered in peripheral blood | | |
| hsa-miR-3679-3p | 3240 | 4261 | discovered in peripheral blood | | |
| hsa-miR-3679-5p | 3241 | 4262 | discovered in peripheral blood | | |
| hsa-miR-3680-3p | 3242 | 4263 | discovered in peripheral blood | | |
| hsa-miR-3680-5p | 3243 | 4264 | discovered in peripheral blood | | |
| hsa-miR-3681-3p | 3244 | 4265 | discovered in peripheral blood | | |
| hsa-miR-3681-5p | 3245 | 4266 | discovered in peripheral blood | | |
| hsa-miR-3682-3p | 3246 | 4267 | discovered in peripheral blood | | |
| hsa-miR-3682-5p | 3247 | 4268 | discovered in peripheral blood | | |
| hsa-miR-3683 | 3248 | 4269 | discovered in peripheral blood | | |
| hsa-miR-3684 | 3249 | 4270 | discovered in peripheral blood | | |
| hsa-miR-3685 | 3250 | 4271 | discovered in peripheral blood | | |
| hsa-miR-3686 | 3251 | 4272 | discovered in peripheral blood | | |
| hsa-miR-3687 | 3252 | 4273 | discovered in peripheral blood | | |
| hsa-miR-3688-3p | 3253 | 4274 | discovered in breast tumor | | |
| hsa-miR-3688-5p | 3254 | 4275 | discovered in breast tumor | | |
| hsa-miR-3689a-3p | 3255 | 4276 | discovered in female reproductuve tract | | |
| hsa-miR-3689a-5p | 3256 | 4277 | discovered in female reproductuve tract and peripheral blood | | |
| hsa-miR-3689b-3p | 3257 | 4278 | discovered in female reproductuve tract and peripheral blood | | |
| hsa-miR-3689b-5p | 3258 | 4279 | discovered in female reproductuve tract | | |
| hsa-miR-3689c | 3259 | 4280 | discovered in B cells | | |
| hsa-miR-3689d | 3260 | 4281 | discovered in B cells | | |
| hsa-miR-3689e | 3261 | 4282 | discovered in B cells | | |
| hsa-miR-3689f | 3262 | 4283 | discovered in B cells | | |
| hsa-miR-3690 | 3263 | 4284 | discovered in peripheral blood | | |
| hsa-miR-3691-3p | 3264 | 4285 | discovered in peripheral blood | | |
| hsa-miR-3691-5p | 3265 | 4286 | discovered in peripheral blood | | |
| hsa-miR-3692-3p | 3266 | 4287 | discovered in peripheral blood | | |
| hsa-miR-3692-5p | 3267 | 4288 | discovered in peripheral blood | | |
| hsa-miR-369-3p | 3268 | 4289 | stem cells | | reprogramming |
| hsa-miR-369-5p | 3269 | 4290 | stem cells | | reprogramming |
| hsa-miR-370 | 3270 | 4291 | | acute meyloid leukaemia and other cancers | tumor suppressor, lipid metabolism |

TABLE 10-continued mirs, tissues/cell expression and diseases

| microRNA | mir SEQ ID | BS SEQ ID | Tissues/cells | Associated Disease | Biological Function |
|---|---|---|---|---|---|
| hsa-miR-3713 | 3271 | 4292 | discovered in neuroblastoma | | |
| hsa-miR-3714 | 3272 | 4293 | discovered in neuroblastoma | | |
| hsa-miR-371a-3p | 3273 | 4294 | serum | | |
| hsa-miR-371a-5p | 3274 | 4295 | serum | | |
| hsa-miR-371b-3p | 3275 | 4296 | serum | | |
| hsa-miR-371b-5p | 3276 | 4297 | serum | | |
| hsa-miR-372 | 3277 | 4298 | hematopoietic cells, lung, placental (blood) | | |
| hsa-miR-373-3p | 3278 | 4299 | | breast cancer | |
| hsa-miR-373-5p | 3279 | 4300 | | breast cancer | |
| hsa-miR-374a-3p | 3280 | 4301 | muscle (myoblasts) | breast and lung cancer | myogenic differentiation |
| hsa-miR-374a-5p | 3281 | 4302 | muscle (myoblasts) | breast and lung cancer | myogenic differentiation |
| hsa-miR-374b-3p | 3282 | 4303 | muscle (myoblasts) | | myogenic differentiation |
| hsa-miR-374b-5p | 3283 | 4304 | muscle (myoblasts) | | myogenic differentiation |
| hsa-miR-374c-3p | 3284 | 4305 | muscle (myoblasts) | | myogenic differentiation |
| hsa-miR-374c-5p | 3285 | 4306 | muscle (myoblasts) | | myogenic differentiation |
| hsa-miR-375 | 3286 | 4307 | pancreas (islet) | | |
| hsa-miR-376a-2-5p | 3287 | 4308 | regulatory miRs for hematopoietic cells (erythroid, platelet, lympho) | | |
| hsa-miR-376a-3p | 3288 | 4309 | regulatory miRs for hematopoietic cells (erythroid, platelet, lympho) | | |
| hsa-miR-376a-5p | 3289 | 4310 | regulatory miRs for hematopoietic cells (erythroid, platelet, lympho) | | |
| hsa-miR-376b-3p | 3290 | 4311 | blood | various cancer cells | autophagy |
| hsa-miR-376b-5p | 3291 | 4312 | blood | various cancer cells | autophagy |
| hsa-miR-376c-3p | 3292 | 4313 | trophoblast | various cancer cells | cell proliferatio |
| hsa-miR-376c-5p | 3293 | 4314 | trophoblast | various cancer cells | cell proliferatio |
| hsa-miR-377-3p | 3294 | 4315 | hematopoietic cells | | |
| hsa-miR-377-5p | 3295 | 4316 | hematopoietic cells | | |
| hsa-miR-378a-3p | 3296 | 4317 | ovary, lipid metabolism | | |
| hsa-miR-378a-5p | 3297 | 4318 | ovary, placenta/trophoblast, lipid metabolism | | |
| hsa-miR-378b | 3298 | 4319 | lipid metabolism | | |
| hsa-miR-378c | 3299 | 4320 | lipid metabolism | | |
| hsa-miR-378d | 3300 | 4321 | lipid metabolism | | |
| hsa-miR-378e | 3301 | 4322 | lipid metabolism | | |
| hsa-miR-378f | 3302 | 4323 | lipid metabolism | | |
| hsa-miR-378g | 3303 | 4324 | lipid metabolism | | |
| hsa-miR-378h | 3304 | 4325 | lipid metabolism | | |
| hsa-miR-378i | 3305 | 4326 | lipid metabolism | | |
| hsa-miR-378j | 3306 | 4327 | lipid metabolism | | |
| hsa-miR-379-3p | 3307 | 4328 | | various cancers (breast, hepatocytes, colon) | |
| hsa-miR-379-5p | 3308 | 4329 | | various cancers (breast, hepatocytes, colon) | |

TABLE 10-continued mirs, tissues/cell expression and diseases

| microRNA | mir SEQ ID | BS SEQ ID | Tissues/cells | Associated Disease | Biological Function |
|---|---|---|---|---|---|
| hsa-miR-380-3p | 3309 | 4330 | brain | neuroblastoma | |
| hsa-miR-380-5p | 3310 | 4331 | brain, embryonic stem cells | neuroblastoma | |
| hsa-miR-381-3p | 3311 | 4332 | chondrogenesis, lung, brain | | |
| hsa-miR-381-5p | 3312 | 4333 | chondrogenesis, lung, brain | | |
| hsa-miR-382-3p | 3313 | 4334 | renal epithelial cells | | |
| hsa-miR-382-5p | 3314 | 4335 | renal epithelial cells | | |
| hsa-miR-383 | 3315 | 4336 | testes, brain (medulla) | | |
| hsa-miR-384 | 3316 | 4337 | epithelial cells | | |
| hsa-miR-3907 | 3317 | 4338 | discovered in female reproductive tract | | |
| hsa-miR-3908 | 3318 | 4339 | discovered in female reproductive tract | | |
| hsa-miR-3909 | 3319 | 4340 | discovered in female reproductive tract | | |
| hsa-miR-3910 | 3320 | 4341 | discovered in female reproductive tract | | |
| hsa-miR-3911 | 3321 | 4342 | discovered in breast tumor and female reproductive tract | | |
| hsa-miR-3912 | 3322 | 4343 | discovered in female reproductive tract | | |
| hsa-miR-3913-3p | 3323 | 4344 | discovered in breast tumor and female reproductive tract | | |
| hsa-miR-3913-5p | 3324 | 4345 | discovered in breast tumor and female reproductive tract | | |
| hsa-miR-3914 | 3325 | 4346 | discovered in breast tumor and female reproductive tract | | |
| hsa-miR-3915 | 3326 | 4347 | discovered in female reproductive tract | | |
| hsa-miR-3916 | 3327 | 4348 | discovered in female reproductive tract | | |
| hsa-miR-3917 | 3328 | 4349 | discovered in female reproductive tract | | |
| hsa-miR-3918 | 3329 | 4350 | discovered in female reproductive tract | | |
| hsa-miR-3919 | 3330 | 4351 | discovered in female reproductive tract | | |
| hsa-miR-3920 | 3331 | 4352 | discovered in female reproductive tract | | |
| hsa-miR-3921 | 3332 | 4353 | discovered in female reproductive tract | | |
| hsa-miR-3922-3p | 3333 | 4354 | discovered in breast tumor and female reproductive tract | | |
| hsa-miR-3922-5p | 3334 | 4355 | discovered in breast tumor and female reproductive tract | | |
| hsa-miR-3923 | 3335 | 4356 | discovered in female reproductive tract | | |
| hsa-miR-3924 | 3336 | 4357 | discovered in female reproductive tract | | |

TABLE 10-continued mirs, tissues/cell expression and diseases

| microRNA | mir SEQ ID | BS SEQ ID | Tissues/cells | Associated Disease | Biological Function |
|---|---|---|---|---|---|
| hsa-miR-3925-3p | 3337 | 4358 | discovered in breast tumor and female reproductive tract | | |
| hsa-miR-3925-5p | 3338 | 4359 | discovered in breast tumor and female reproductive tract | | |
| hsa-miR-3926 | 3339 | 4360 | discovered in female reproductive tract | | |
| hsa-miR-3927-3p | 3340 | 4361 | discovered in female reproductive tract and psoriasis | | |
| hsa-miR-3927-5p | 3341 | 4362 | discovered in female reproductive tract and psoriasis | | |
| hsa-miR-3928 | 3342 | 4363 | discovered in female reproductive tract | | |
| hsa-miR-3929 | 3343 | 4364 | discovered in female reproductive tract | | |
| hsa-miR-3934-3p | 3344 | 4365 | discovered in abnormal skin (psoriasis) | | |
| hsa-miR-3934-5p | 3345 | 4366 | discovered in abnormal skin (psoriasis) | | |
| hsa-miR-3935 | 3346 | 4367 | | | |
| hsa-miR-3936 | 3347 | 4368 | discovered in breast tumor and lymphoblastic leukaemia | | |
| hsa-miR-3937 | 3348 | 4369 | | | |
| hsa-miR-3938 | 3349 | 4370 | | | |
| hsa-miR-3939 | 3350 | 4371 | | | |
| hsa-miR-3940-3p | 3351 | 4372 | discovered in breast tumor | | |
| hsa-miR-3940-5p | 3352 | 4373 | discovered in breast tumor | | |
| hsa-miR-3941 | 3353 | 4374 | | | |
| hsa-miR-3942-3p | 3354 | 4375 | discovered in breast tumor and lymphoblastic leukaemia | | |
| hsa-miR-3942-5p | 3355 | 4376 | discovered in breast tumor and lymphoblastic leukaemia | | |
| hsa-miR-3943 | 3356 | 4377 | | | |
| hsa-miR-3944-3p | 3357 | 4378 | discovered in breast tumor | | |
| hsa-miR-3944-5p | 3358 | 4379 | discovered in breast tumor | | |
| hsa-miR-3945 | 3359 | 4380 | | | |
| hsa-miR-3960 | 3360 | 4381 | osteoblast | | |
| hsa-miR-3972 | 3361 | 4382 | discovered in Acute Myeloid Leukaemia | | |
| hsa-miR-3973 | 3362 | 4383 | discovered in Acute Myeloid Leukaemia | | |
| hsa-miR-3974 | 3363 | 4384 | discovered in Acute Myeloid Leukaemia | | |
| hsa-miR-3975 | 3364 | 4385 | discovered in Acute Myeloid Leukaemia | | |
| hsa-miR-3976 | 3365 | 4386 | discovered in Acute Myeloid Leukaemia | | |
| hsa-miR-3977 | 3366 | 4387 | discovered in Acute Myeloid Leukaemia | | |
| hsa-miR-3978 | 3367 | 4388 | discovered in Acute Myeloid Leukaemia | | |
| hsa-miR-409-3p | 3368 | 4389 | | gastric cancer | |
| hsa-miR-409-5p | 3369 | 4390 | | gastric cancer | |
| hsa-miR-410 | 3370 | 4391 | brain | glioma | |
| hsa-miR-411-3p | 3371 | 4392 | | Glioblastoma others | |

TABLE 10-continued mirs, tissues/cell expression and diseases

| microRNA | mir SEQ ID | BS SEQ ID | Tissues/cells | Associated Disease | Biological Function |
|---|---|---|---|---|---|
| hsa-miR-411-5p | 3372 | 4393 | | Glioblastoma others | |
| hsa-miR-412 | 3373 | 4394 | | upregulated in lung cancer | |
| hsa-miR-421 | 3374 | 4395 | endothelial cells | gastric cancer, HCC | |
| hsa-miR-422a | 3375 | 4396 | circulating microRNA (in plasma) | | |
| hsa-miR-423-3p | 3376 | 4397 | embryonic stem cells | | |
| hsa-miR-423-5p | 3377 | 4398 | heart, embryonic stem cells | | |
| hsa-miR-424-3p | 3378 | 4399 | endothelial cells | various cancers (e.g B-lieage ALL), cardiac diseases | pro-angiogenic |
| hsa-miR-424-5p | 3379 | 4400 | endothelial cells | various cancers (e.g B-lieage ALL), cardiac diseases | pro-angiogenic |
| hsa-miR-4251 | 3380 | 4401 | discovered in embryonic stem cells and neural precusors | | |
| hsa-miR-4252 | 3381 | 4402 | discovered in embryonic stem cells and neural precusors | | |
| hsa-miR-4253 | 3382 | 4403 | discovered in embryonic stem cells and neural precusors | | |
| hsa-miR-425-3p | 3383 | 4404 | brain | ovarian cancer, brain tumor | |
| hsa-miR-4254 | 3384 | 4405 | discovered in embryonic stem cells and neural precusors | | |
| hsa-miR-4255 | 3385 | 4406 | discovered in embryonic stem cells and neural precusors | | |
| hsa-miR-425-5p | 3386 | 4407 | brain | B-lieage ALL, brain tumor | |
| hsa-miR-4256 | 3387 | 4408 | discovered in embryonic stem cells and neural precusors | | |
| hsa-miR-4257 | 3388 | 4409 | discovered in embryonic stem cells and neural precusors | | |
| hsa-miR-4258 | 3389 | 4410 | discovered in embryonic stem cells and neural precusors | | |
| hsa-miR-4259 | 3390 | 4411 | discovered in embryonic stem cells and neural precusors | | |
| hsa-miR-4260 | 3391 | 4412 | discovered in embryonic stem cells and neural precusors | | |
| hsa-miR-4261 | 3392 | 4413 | discovered in embryonic stem cells and neural precusors | | |
| hsa-miR-4262 | 3393 | 4414 | discovered in embryonic stem cells and neural precusors | | |

TABLE 10-continued mirs, tissues/cell expression and diseases

| microRNA | mir SEQ ID | BS SEQ ID | Tissues/cells | Associated Disease | Biological Function |
|---|---|---|---|---|---|
| hsa-miR-4263 | 3394 | 4415 | discovered in embryonic stem cells and neural precusors | | |
| hsa-miR-4264 | 3395 | 4416 | discovered in embryonic stem cells and neural precusors | | |
| hsa-miR-4265 | 3396 | 4417 | discovered in embryonic stem cells and neural precusors | | |
| hsa-miR-4266 | 3397 | 4418 | discovered in embryonic stem cells and neural precusors | | |
| hsa-miR-4267 | 3398 | 4419 | discovered in embryonic stem cells and neural precusors | | |
| hsa-miR-4268 | 3399 | 4420 | discovered in embryonic stem cells and neural precusors | | |
| hsa-miR-4269 | 3400 | 4421 | discovered in embryonic stem cells and neural precusors | | |
| hsa-miR-4270 | 3401 | 4422 | discovered in embryonic stem cells and neural precusors | | |
| hsa-miR-4271 | 3402 | 4423 | discovered in embryonic stem cells and neural precusors | | |
| hsa-miR-4272 | 3403 | 4424 | discovered in embryonic stem cells and neural precusors | | |
| hsa-miR-4273 | 3404 | 4425 | | | |
| hsa-miR-4274 | 3405 | 4426 | discovered in embryonic stem cells and neural precusors | | |
| hsa-miR-4275 | 3406 | 4427 | discovered in embryonic stem cells and neural precusors | | |
| hsa-miR-4276 | 3407 | 4428 | discovered in embryonic stem cells and neural precusors | | |
| hsa-miR-4277 | 3408 | 4429 | discovered in embryonic stem cells and neural precusors | | |
| hsa-miR-4278 | 3409 | 4430 | discovered in embryonic stem cells and neural precusors | | |
| hsa-miR-4279 | 3410 | 4431 | discovered in embryonic stem cells and neural precusors | | |
| hsa-miR-4280 | 3411 | 4432 | discovered in embryonic stem cells and neural precusors | | |
| hsa-miR-4281 | 3412 | 4433 | discovered in embryonic stem cells and neural precusors | | |

TABLE 10-continued mirs, tissues/cell expression and diseases

| microRNA | mir SEQ ID | BS SEQ ID | Tissues/cells | Associated Disease | Biological Function |
|---|---|---|---|---|---|
| hsa-miR-4282 | 3413 | 4434 | discovered in embryonic stem cells and neural precusors | | |
| hsa-miR-4283 | 3414 | 4435 | discovered in embryonic stem cells and neural precusors | | |
| hsa-miR-4284 | 3415 | 4436 | discovered in embryonic stem cells and neural precusors | | |
| hsa-miR-4285 | 3416 | 4437 | discovered in embryonic stem cells and neural precusors | | |
| hsa-miR-4286 | 3417 | 4438 | discovered in embryonic stem cells and neural precusors | | |
| hsa-miR-4287 | 3418 | 4439 | discovered in embryonic stem cells and neural precusors | | |
| hsa-miR-4288 | 3419 | 4440 | discovered in embryonic stem cells and neural precusors | | |
| hsa-miR-4289 | 3420 | 4441 | discovered in embryonic stem cells and neural precusors | | |
| hsa-miR-429 | 3421 | 4442 | Epithelial cells | various cancers (colorectal, endometrial, gastric, ovarian etc) | |
| hsa-miR-4290 | 3422 | 4443 | discovered in embryonic stem cells and neural precusors | | |
| hsa-miR-4291 | 3423 | 4444 | discovered in embryonic stem cells and neural precusors | | |
| hsa-miR-4292 | 3424 | 4445 | discovered in embryonic stem cells and neural precusors | | |
| hsa-miR-4293 | 3425 | 4446 | discovered in embryonic stem cells and neural precusors | | |
| hsa-miR-4294 | 3426 | 4447 | discovered in embryonic stem cells and neural precusors | | |
| hsa-miR-4295 | 3427 | 4448 | discovered in embryonic stem cells and neural precusors | | |
| hsa-miR-4296 | 3428 | 4449 | discovered in embryonic stem cells and neural precusors | | |
| hsa-miR-4297 | 3429 | 4450 | discovered in embryonic stem cells and neural precusors | | |
| hsa-miR-4298 | 3430 | 4451 | discovered in embryonic stem cells and neural precusors | | |

TABLE 10-continued mirs, tissues/cell expression and diseases

| microRNA | mir SEQ ID | BS SEQ ID | Tissues/cells | Associated Disease | Biological Function |
|---|---|---|---|---|---|
| hsa-miR-4299 | 3431 | 4452 | discovered in embryonic stem cells and neural precursors | | |
| hsa-miR-4300 | 3432 | 4453 | discovered in embryonic stem cells and neural precursors | | |
| hsa-miR-4301 | 3433 | 4454 | discovered in embryonic stem cells and neural precursors | | |
| hsa-miR-4302 | 3434 | 4455 | discovered in embryonic stem cells and neural precursors | | |
| hsa-miR-4303 | 3435 | 4456 | discovered in embryonic stem cells and neural precursors | | |
| hsa-miR-4304 | 3436 | 4457 | discovered in embryonic stem cells and neural precursors | | |
| hsa-miR-4305 | 3437 | 4458 | discovered in embryonic stem cells and neural precursors | | |
| hsa-miR-4306 | 3438 | 4459 | discovered in embryonic stem cells and neural precursors | | |
| hsa-miR-4307 | 3439 | 4460 | discovered in embryonic stem cells and neural precursors | | |
| hsa-miR-4308 | 3440 | 4461 | discovered in embryonic stem cells and neural precursors | | |
| hsa-miR-4309 | 3441 | 4462 | discovered in embryonic stem cells and neural precursors | | |
| hsa-miR-4310 | 3442 | 4463 | discovered in embryonic stem cells and neural precursors | | |
| hsa-miR-4311 | 3443 | 4464 | discovered in embryonic stem cells and neural precursors | | |
| hsa-miR-4312 | 3444 | 4465 | discovered in embryonic stem cells and neural precursors | | |
| hsa-miR-4313 | 3445 | 4466 | discovered in embryonic stem cells and neural precursors | | |
| hsa-miR-431-3p | 3446 | 4467 | | Cancers (follicular lymphoma) | |
| hsa-miR-4314 | 3447 | 4468 | discovered in embryonic stem cells and neural precursors | | |
| hsa-miR-4315 | 3448 | 4469 | discovered in embryonic stem cells and neural precusors | | |
| hsa-miR-431-5p | 3449 | 4470 | | Cancers (follicular lymphoma) | |

TABLE 10-continued mirs, tissues/cell expression and diseases

| microRNA | mir SEQ ID | BS SEQ ID | Tissues/cells | Associated Disease | Biological Function |
|---|---|---|---|---|---|
| hsa-miR-4316 | 3450 | 4471 | discovered in embryonic stem cells and neural precursors | | |
| hsa-miR-4317 | 3451 | 4472 | discovered in embryonic stem cells and neural precusors | | |
| hsa-miR-4318 | 3452 | 4473 | discovered in embryonic stem cells and neural precusors | | |
| hsa-miR-4319 | 3453 | 4474 | discovered in embryonic stem cells and neural precusors | | |
| hsa-miR-4320 | 3454 | 4475 | discovered in embryonic stem cells and neural precusors | | |
| hsa-miR-4321 | 3455 | 4476 | discovered in embryonic stem cells and neural precusors | | |
| hsa-miR-4322 | 3456 | 4477 | discovered in embryonic stem cells and neural precusors | | |
| hsa-miR-4323 | 3457 | 4478 | discovered in embryonic stem cells and neural precusors | | |
| hsa-miR-432-3p | 3458 | 4479 | myoblast | | myogenic differentiation |
| hsa-miR-4324 | 3459 | 4480 | discovered in embryonic stem cells and neural precusors | | |
| hsa-miR-4325 | 3460 | 4481 | discovered in embryonic stem cells and neural precusors | | |
| hsa-miR-432-5p | 3461 | 4482 | myoblast | | myogenic differentiation |
| hsa-miR-4326 | 3462 | 4483 | discovered in embryonic stem cells and neural precusors | | |
| hsa-miR-4327 | 3463 | 4484 | discovered in embryonic stem cells and neural precusors | | |
| hsa-miR-4328 | 3464 | 4485 | discovered in embryonic stem cells and neural precusors | | |
| hsa-miR-4329 | 3465 | 4486 | discovered in embryonic stem cells and neural precusors | | |
| hsa-miR-433 | 3466 | 4487 | | various diseases (cancer, Parkinson's, Chondrodysplasia) | |
| hsa-miR-4330 | 3467 | 4488 | discovered in embryonic stem cells and neural precusors | | |
| hsa-miR-4417 | 3468 | 4489 | discovered in B cells | | |
| hsa-miR-4418 | 3469 | 4490 | discovered in B cells | | |
| hsa-miR-4419a | 3470 | 4491 | discovered in B cells | | |

TABLE 10-continued mirs, tissues/cell expression and diseases

| microRNA | mir SEQ ID | BS SEQ ID | Tissues/cells | Associated Disease | Biological Function |
|---|---|---|---|---|---|
| hsa-miR-4419b | 3471 | 4492 | discovered in B cells | | |
| hsa-miR-4420 | 3472 | 4493 | discovered in B cells | | |
| hsa-miR-4421 | 3473 | 4494 | discovered in B cells | | |
| hsa-miR-4422 | 3474 | 4495 | discovered in breast tumor and B cells | | |
| hsa-miR-4423-3p | 3475 | 4496 | discovered in breast tumor, B cells and skin(psoriasis) | | |
| hsa-miR-4423-5p | 3476 | 4497 | discovered in breast tumor B cells and skin(psoriasis) | | |
| hsa-miR-4424 | 3477 | 4498 | discovered in B cells | | |
| hsa-miR-4425 | 3478 | 4499 | discovered in B cells | | |
| hsa-miR-4426 | 3479 | 4500 | discovered in B cells | | |
| hsa-miR-4427 | 3480 | 4501 | discovered in B cells | | |
| hsa-miR-4428 | 3481 | 4502 | discovered in B cells | | |
| hsa-miR-4429 | 3482 | 4503 | discovered in B cells | | |
| hsa-miR-4430 | 3483 | 4504 | discovered in B cells | | |
| hsa-miR-4431 | 3484 | 4505 | discovered in B cells | | |
| hsa-miR-4432 | 3485 | 4506 | discovered in B cells | | |
| hsa-miR-4433-3p | 3486 | 4507 | discovered in B cells | | |
| hsa-miR-4433-5p | 3487 | 4508 | discovered in B cells | | |
| hsa-miR-4434 | 3488 | 4509 | discovered in B cells | | |
| hsa-miR-4435 | 3489 | 4510 | discovered in B cells | | |
| hsa-miR-4436a | 3490 | 4511 | discovered in breast tumor and B cells | | |
| hsa-miR-4436b-3p | 3491 | 4512 | discovered in breast tumor | | |
| hsa-miR-4436b-5p | 3492 | 4513 | discovered in breast tumor | | |
| hsa-miR-4437 | 3493 | 4514 | discovered in B cells | | |
| hsa-miR-4438 | 3494 | 4515 | discovered in B cells | | |
| hsa-miR-4439 | 3495 | 4516 | discovered in B cells | | |
| hsa-miR-4440 | 3496 | 4517 | discovered in B cells | | |
| hsa-miR-4441 | 3497 | 4518 | discovered in B cells | | |
| hsa-miR-4442 | 3498 | 4519 | discovered in B cells | | |
| hsa-miR-4443 | 3499 | 4520 | discovered in B cells | | |
| hsa-miR-4444 | 3500 | 4521 | discovered in B cells | | |
| hsa-miR-4445-3p | 3501 | 4522 | discovered in B cells | | |
| hsa-miR-4445-5p | 3502 | 4523 | discovered in B cells | | |
| hsa-miR-4446-3p | 3503 | 4524 | discovered in breast tumor and B cells | | |
| hsa-miR-4446-5p | 3504 | 4525 | discovered in breast tumor and B cells | | |
| hsa-miR-4447 | 3505 | 4526 | discovered in B cells | | |
| hsa-miR-4448 | 3506 | 4527 | discovered in B cells | | |

TABLE 10-continued mirs, tissues/cell expression and diseases

| microRNA | mir SEQ ID | BS SEQ ID | Tissues/cells | Associated Disease | Biological Function |
|---|---|---|---|---|---|
| hsa-miR-4449 | 3507 | 4528 | discovered in B cells | | |
| hsa-miR-4450 | 3508 | 4529 | discovered in B cells | | |
| hsa-miR-4451 | 3509 | 4530 | discovered in B cells | | |
| hsa-miR-4452 | 3510 | 4531 | discovered in B cells | | |
| hsa-miR-4453 | 3511 | 4532 | discovered in B cells | | |
| hsa-miR-4454 | 3512 | 4533 | discovered in B cells | | |
| hsa-miR-4455 | 3513 | 4534 | discovered in B cells | | |
| hsa-miR-4456 | 3514 | 4535 | discovered in B cells | | |
| hsa-miR-4457 | 3515 | 4536 | discovered in B cells | | |
| hsa-miR-4458 | 3516 | 4537 | discovered in B cells | | |
| hsa-miR-4459 | 3517 | 4538 | discovered in B cells | | |
| hsa-miR-4460 | 3518 | 4539 | discovered in B cells | | |
| hsa-miR-4461 | 3519 | 4540 | discovered in B cells | | |
| hsa-miR-4462 | 3520 | 4541 | discovered in B cells | | |
| hsa-miR-4463 | 3521 | 4542 | discovered in B cells | | |
| hsa-miR-4464 | 3522 | 4543 | discovered in B cells | | |
| hsa-miR-4465 | 3523 | 4544 | discovered in B cells | | |
| hsa-miR-4466 | 3524 | 4545 | discovered in B cells | | |
| hsa-miR-4467 | 3525 | 4546 | discovered in breast tumor and B cells | | |
| hsa-miR-4468 | 3526 | 4547 | discovered in B cells | | |
| hsa-miR-4469 | 3527 | 4548 | discovered in breast tumor and B cells | | |
| hsa-miR-4470 | 3528 | 4549 | discovered in B cells | | |
| hsa-miR-4471 | 4550 | 5571 | discovered in breast tumor and B cells | | |
| hsa-miR-4472 | 4551 | 5572 | discovered in B cells | | |
| hsa-miR-4473 | 4552 | 5573 | discovered in B cells | | |
| hsa-miR-4474-3p | 4553 | 5574 | discovered in breast tumor, lymphoblastic leukaemia and B cells | | |
| hsa-miR-4474-5p | 4554 | 5575 | discovered in breast tumor, lymphoblastic leukaemia and B cells | | |
| hsa-miR-4475 | 4555 | 5576 | discovered in B cells | | |
| hsa-miR-4476 | 4556 | 5577 | discovered in B cells | | |
| hsa-miR-4477a | 4557 | 5578 | discovered in B cells | | |
| hsa-miR-4477b | 4558 | 5579 | discovered in B cells | | |
| hsa-miR-4478 | 4559 | 5580 | discovered in B cells | | |
| hsa-miR-4479 | 4560 | 5581 | discovered in B cells | | |

TABLE 10-continued mirs, tissues/cell expression and diseases

| microRNA | mir SEQ ID | BS SEQ ID | Tissues/cells | Associated Disease | Biological Function |
|---|---|---|---|---|---|
| hsa-miR-448 | 4561 | 5582 | liver (hepatocytes) | HCC | |
| hsa-miR-4480 | 4562 | 5583 | discovered in B cells | | |
| hsa-miR-4481 | 4563 | 5584 | discovered in B cells | | |
| hsa-miR-4482-3p | 4564 | 5585 | discovered in B cells | | |
| hsa-miR-4482-5p | 4565 | 5586 | discovered in B cells | | |
| hsa-miR-4483 | 4566 | 5587 | discovered in B cells | | |
| hsa-miR-4484 | 4567 | 5588 | discovered in B cells | | |
| hsa-miR-4485 | 4568 | 5589 | discovered in B cells | | |
| hsa-miR-4486 | 4569 | 5590 | discovered in B cells | | |
| hsa-miR-4487 | 4570 | 5591 | discovered in B cells | | |
| hsa-miR-4488 | 4571 | 5592 | discovered in B cells | | |
| hsa-miR-4489 | 4572 | 5593 | discovered in breast tumor and B cells | | |
| hsa-miR-4490 | 4573 | 5594 | discovered in B cells | | |
| hsa-miR-4491 | 4574 | 5595 | discovered in B cells | | |
| hsa-miR-4492 | 4575 | 5596 | discovered in B cells | | |
| hsa-miR-4493 | 4576 | 5597 | discovered in B cells | | |
| hsa-miR-4494 | 4577 | 5598 | discovered in B cells | | |
| hsa-miR-4495 | 4578 | 5599 | discovered in B cells | | |
| hsa-miR-4496 | 4579 | 5600 | discovered in B cells | | |
| hsa-miR-4497 | 4580 | 5601 | discovered in B cells | | |
| hsa-miR-4498 | 4581 | 5602 | discovered in B cells | | |
| hsa-miR-4499 | 4582 | 5603 | discovered in B cells | | |
| hsa-miR-449a | 4583 | 5604 | chondrocytes, ciliated epithelial cells | lung, colonic, ovarian cancer | cell cycle progression and proliferation |
| hsa-miR-449b-3p | 4584 | 5605 | ciliated epithelial cells, other tissues | various cancer cells | cell cycle progression and proliferation |
| hsa-miR-449b-5p | 4585 | 5606 | ciliated epithelial cells, other tissues | various cancer cells | cell cycle progression and proliferation |
| hsa-miR-449c-3p | 4586 | 5607 | | epithelial ovarian cancer cells | |
| hsa-miR-449c-5p | 4587 | 5608 | | epithelial ovarian cancer cells | |
| hsa-miR-4500 | 4588 | 5609 | discovered in B cells | | |
| hsa-miR-4501 | 4589 | 5610 | discovered in B cells | | |
| hsa-miR-4502 | 4590 | 5611 | discovered in B cells | | |
| hsa-miR-4503 | 4591 | 5612 | discovered in B cells | | |
| hsa-miR-4504 | 4592 | 5613 | discovered in B cells | | |
| hsa-miR-4505 | 4593 | 5614 | discovered in B cells | | |
| hsa-miR-4506 | 4594 | 5615 | discovered in B cells | | |
| hsa-miR-4507 | 4595 | 5616 | discovered in B cells | | |
| hsa-miR-4508 | 4596 | 5617 | discovered in B cells | | |

TABLE 10-continued mirs, tissues/cell expression and diseases

| microRNA | mir SEQ ID | BS SEQ ID | Tissues/cells | Associated Disease | Biological Function |
|---|---|---|---|---|---|
| hsa-miR-4509 | 4597 | 5618 | discovered in B cells | | |
| hsa-miR-450a-3p | 4598 | 5619 | | | |
| hsa-miR-450a-5p | 4599 | 5620 | | | |
| hsa-miR-450b-3p | 4600 | 5621 | | | |
| hsa-miR-450b-5p | 4601 | 5622 | | | |
| hsa-miR-4510 | 4602 | 5623 | discovered in B cells | | |
| hsa-miR-4511 | 4603 | 5624 | discovered in B cells | | |
| hsa-miR-4512 | 4604 | 5625 | discovered in B cells | | |
| hsa-miR-4513 | 4605 | 5626 | discovered in B cells | | |
| hsa-miR-4514 | 4606 | 5627 | discovered in B cells | | |
| hsa-miR-4515 | 4607 | 5628 | discovered in B cells | | |
| hsa-miR-4516 | 4608 | 5629 | discovered in B cells | | |
| hsa-miR-4517 | 4609 | 5630 | discovered in B cells | | |
| hsa-miR-4518 | 4610 | 5631 | discovered in B cells | | |
| hsa-miR-4519 | 4611 | 5632 | discovered in B cells | | |
| hsa-miR-451a | 4612 | 5633 | heart, central nevous system, epithelial cells | | |
| hsa-miR-451b | 4613 | 5634 | heart, central nevous system, epithelial cells | | |
| hsa-miR-4520a-3p | 4614 | 5635 | discovered in breast tumor and B cells, skin (psoriasis) | | |
| hsa-miR-4520a-5p | 4615 | 5636 | discovered in breast tumor and B cells, skin (psoriasis) | | |
| hsa-miR-4520b-3p | 4616 | 5637 | discovered in breast tumor | | |
| hsa-miR-4520b-5p | 4617 | 5638 | discovered in breast tumor | | |
| hsa-miR-4521 | 4618 | 5639 | discovered in B cells | | |
| hsa-miR-4522 | 4619 | 5640 | discovered in B cells | | |
| hsa-miR-4523 | 4620 | 5641 | discovered in B cells | | |
| hsa-miR-452-3p | 4621 | 5642 | myoblast | bladder cancer and others | |
| hsa-miR-4524a-3p | 4622 | 5643 | discovered in breast tumor and B cells, skin (psoriasis) | | |
| hsa-miR-4524a-5p | 4623 | 5644 | discovered in breast tumor and B cells, skin (psoriasis) | | |
| hsa-miR-4524b-3p | 4624 | 5645 | discovered in breast tumor and B cells, skin (psoriasis) | | |
| hsa-miR-4524b-5p | 4625 | 5646 | discovered in breast tumor and B cells, skin (psoriasis) | | |
| hsa-miR-4525 | 4626 | 5647 | discovered in B cells | | |
| hsa-miR-452-5p | 4627 | 5648 | myoblast | bladder cancer and others | |
| hsa-miR-4526 | 4628 | 5649 | discovered in breast tumor and B cells | | |
| hsa-miR-4527 | 4629 | 5650 | discovered in B cells | | |
| hsa-miR-4528 | 4630 | 5651 | discovered in B cells | | |
| hsa-miR-4529-3p | 4631 | 5652 | discovered in breast tumor and B cells | | |

TABLE 10-continued mirs, tissues/cell expression and diseases

| microRNA | mir SEQ ID | BS SEQ ID | Tissues/cells | Associated Disease | Biological Function |
|---|---|---|---|---|---|
| hsa-miR-4529-5p | 4632 | 5653 | discovered in breast tumor and B cells | | |
| hsa-miR-4530 | 4633 | 5654 | discovered in B cells | | |
| hsa-miR-4531 | 4634 | 5655 | discovered in B cells | | |
| hsa-miR-4532 | 4635 | 5656 | discovered in B cells | | |
| hsa-miR-4533 | 4636 | 5657 | discovered in B cells | | |
| hsa-miR-4534 | 4637 | 5658 | discovered in B cells | | |
| hsa-miR-4535 | 4638 | 5659 | discovered in B cells | | |
| hsa-miR-4536-3p | 4639 | 5660 | discovered in B cells | | |
| hsa-miR-4536-5p | 4640 | 5661 | discovered in B cells | | |
| hsa-miR-4537 | 4641 | 5662 | discovered in B cells | | |
| hsa-miR-4538 | 4642 | 5663 | discovered in B cells | | |
| hsa-miR-4539 | 4643 | 5664 | discovered in B cells | | |
| hsa-miR-4540 | 4644 | 5665 | discovered in B cells | | |
| hsa-miR-454-3p | 4645 | 5666 | embryoid body cells, central nevous system, monocytes | | |
| hsa-miR-454-5p | 4646 | 5667 | embryoid body cells, central nevous system, monocytes | | |
| hsa-miR-455-3p | 4647 | 5668 | | basal cell carcinoma, other cancers | |
| hsa-miR-455-5p | 4648 | 5669 | | basal cell carcinoma, other cancers | |
| hsa-miR-4632-3p | 4649 | 5670 | discovred in breast tumor | | |
| hsa-miR-4632-5p | 4650 | 5671 | discovered in breast tumor | | |
| hsa-miR-4633-3p | 4651 | 5672 | discovered in breast tumor | | |
| hsa-miR-4633-5p | 4652 | 5673 | discovered in breast tumor | | |
| hsa-miR-4634 | 4653 | 5674 | discovered in breast tumor | | |
| hsa-miR-4635 | 4654 | 5675 | discovered in breast tumor | | |
| hsa-miR-4636 | 4655 | 5676 | discovered in breast tumor | | |
| hsa-miR-4637 | 4656 | 5677 | discovered in breast tumor and lymphoblastic leukaemia | | |
| hsa-miR-4638-3p | 4657 | 5678 | discovered in breast tumor | | |
| hsa-miR-4638-5p | 4658 | 5679 | discovered in breast tumor | | |
| hsa-miR-4639-3p | 4659 | 5680 | discovered in breast tumor | | |
| hsa-miR-4639-5p | 4660 | 5681 | discovered in breast tumor | | |
| hsa-miR-4640-3p | 4661 | 5682 | discovered in breast tumor | | |
| hsa-miR-4640-5p | 4662 | 5683 | discovered in breast tumor | | |
| hsa-miR-4641 | 4663 | 5684 | discovered in breast tumor | | |
| hsa-miR-4642 | 4664 | 5685 | discovered in breast tumor | | |

TABLE 10-continued mirs, tissues/cell expression and diseases

| microRNA | mir SEQ ID | BS SEQ ID | Tissues/cells | Associated Disease | Biological Function |
|---|---|---|---|---|---|
| hsa-miR-4643 | 4665 | 5686 | discovered in breast tumor | | |
| hsa-miR-4644 | 4666 | 5687 | discovered in breast tumor | | |
| hsa-miR-4645-3p | 4667 | 5688 | discovered in breast tumor | | |
| hsa-miR-4645-5p | 4668 | 5689 | discovered in breast tumor | | |
| hsa-miR-4646-3p | 4669 | 5690 | discovered in breast tumor | | |
| hsa-miR-4646-5p | 4670 | 5691 | discovered in breast tumor | | |
| hsa-miR-4647 | 4671 | 5692 | discovered in breast tumor | | |
| hsa-miR-4648 | 4672 | 5693 | discovered in breast tumor | | |
| hsa-miR-4649-3p | 4673 | 5694 | discovered in breast tumor | | |
| hsa-miR-4649-5p | 4674 | 5695 | discovered in breast tumor | | |
| hsa-miR-4650-3p | 4675 | 5696 | discovered in breast tumor | | |
| hsa-miR-4650-5p | 4676 | 5697 | discovered in breast tumor | | |
| hsa-miR-4651 | 4677 | 5698 | discovered in breast tumor | | |
| hsa-miR-4652-3p | 4678 | 5699 | discovered in breast tumor | | |
| hsa-miR-4652-5p | 4679 | 5700 | discovered in breast tumor | | |
| hsa-miR-4653-3p | 4680 | 5701 | discovered in breast tumor | | |
| hsa-miR-4653-5p | 4681 | 5702 | discovered in breast tumor | | |
| hsa-miR-4654 | 4682 | 5703 | discovered in breast tumor | | |
| hsa-miR-4655-3p | 4683 | 5704 | discovered in breast tumor | | |
| hsa-miR-4655-5p | 4684 | 5705 | discovered in breast tumor | | |
| hsa-miR-4656 | 4685 | 5706 | discovered in breast tumor | | |
| hsa-miR-4657 | 4686 | 5707 | discovered in breast tumor | | |
| hsa-miR-4658 | 4687 | 5708 | discovered in breast tumor | | |
| hsa-miR-4659a-3p | 4688 | 5709 | discovered in breast tumor | | |
| hsa-miR-4659a-5p | 4689 | 5710 | discovered in breast tumor | | |
| hsa-miR-4659b-3p | 4690 | 5711 | discovered in breast tumor | | |
| hsa-miR-4659b-5p | 4691 | 5712 | discovered in breast tumor | | |
| hsa-miR-466 | 4692 | 5713 | | | |
| hsa-miR-4660 | 4693 | 5714 | discovered in breast tumor | | |
| hsa-miR-4661-3p | 4694 | 5715 | discovered in breast tumor | | |
| hsa-miR-4661-5p | 4695 | 5716 | discovered in breast tumor | | |
| hsa-miR-4662a-3p | 4696 | 5717 | discovered in breast tumor, psoriasis | | |
| hsa-miR-4662a-5p | 4697 | 5718 | discovered in breast tumor, psoriasis | | |
| hsa-miR-4662b | 4698 | 5719 | discovered in breast tumor | | |
| hsa-miR-4663 | 4699 | 5720 | discovered in breast tumor | | |
| hsa-miR-4664-3p | 4700 | 5721 | discovered in breast tumor | | |
| hsa-miR-4664-5p | 4701 | 5722 | discovered in breast tumor | | |

TABLE 10-continued mirs, tissues/cell expression and diseases

| microRNA | mir SEQ ID | BS SEQ ID | Tissues/cells | Associated Disease | Biological Function |
|---|---|---|---|---|---|
| hsa-miR-4665-3p | 4702 | 5723 | discovered in breast tumor | | |
| hsa-miR-4665-5p | 4703 | 5724 | discovered in breast tumor | | |
| hsa-miR-4666a-3p | 4704 | 5725 | discovered in breast tumor | | |
| hsa-miR-4666a-5p | 4705 | 5726 | discovered in breast tumor | | |
| hsa-miR-4666b | 4706 | 5727 | | | |
| hsa-miR-4667-3p | 4707 | 5728 | discovered in breast tumor | | |
| hsa-miR-4667-5p | 4708 | 5729 | discovered in breast tumor | | |
| hsa-miR-4668-3p | 4709 | 5730 | discovered in breast tumor | | |
| hsa-miR-4668-5p | 4710 | 5731 | discovered in breast tumor | | |
| hsa-miR-4669 | 4711 | 5732 | discovered in breast tumor | | |
| hsa-miR-4670-3p | 4712 | 5733 | discovered in breast tumor | | |
| hsa-miR-4670-5p | 4713 | 5734 | discovered in breast tumor | | |
| hsa-miR-4671-3p | 4714 | 5735 | discovered in breast tumor | | |
| hsa-miR-4671-5p | 4715 | 5736 | discovered in breast tumor | | |
| hsa-miR-4672 | 4716 | 5737 | discovered in breast tumor | | |
| hsa-miR-4673 | 4717 | 5738 | discovered in breast tumor | | |
| hsa-miR-4674 | 4718 | 5739 | discovered in breast tumor | | |
| hsa-miR-4675 | 4719 | 5740 | discovered in breast tumor | | |
| hsa-miR-4676-3p | 4720 | 5741 | discovered in breast tumor | | |
| hsa-miR-4676-5p | 4721 | 5742 | discovered in breast tumor | | |
| hsa-miR-4677-3p | 4722 | 5743 | discovered in breast tumor, psoriasis | | |
| hsa-miR-4677-5p | 4723 | 5744 | discovered in breast tumor, psoriasis | | |
| hsa-miR-4678 | 4724 | 5745 | discovered in breast tumor | | |
| hsa-miR-4679 | 4725 | 5746 | discovered in breast tumor | | |
| hsa-miR-4680-3p | 4726 | 5747 | discovered in breast tumor | | |
| hsa-miR-4680-5p | 4727 | 5748 | discovered in breast tumor | | |
| hsa-miR-4681 | 4728 | 5749 | discovered in breast tumor | | |
| hsa-miR-4682 | 4729 | 5750 | discovered in breast tumor | | |
| hsa-miR-4683 | 4730 | 5751 | discovered in breast tumor | | |
| hsa-miR-4684-3p | 4731 | 5752 | discovered in breast tumor | | |
| hsa-miR-4684-5p | 4732 | 5753 | discovered in breast tumor | | |
| hsa-miR-4685-3p | 4733 | 5754 | discovered in breast tumor | | |
| hsa-miR-4685-5p | 4734 | 5755 | discovered in breast tumor | | |
| hsa-miR-4686 | 4735 | 5756 | discovered in breast tumor | | |
| hsa-miR-4687-3p | 4736 | 5757 | discovered in breast tumor | | |
| hsa-miR-4687-5p | 4737 | 5758 | discovered in breast tumor | | |
| hsa-miR-4688 | 4738 | 5759 | discovered in breast tumor | | |

TABLE 10-continued mirs, tissues/cell expression and diseases

| microRNA | mir SEQ ID | BS SEQ ID | Tissues/cells | Associated Disease | Biological Function |
|---|---|---|---|---|---|
| hsa-miR-4689 | 4739 | 5760 | discovered in breast tumor | | |
| hsa-miR-4690-3p | 4740 | 5761 | discovered in breast tumor | | |
| hsa-miR-4690-5p | 4741 | 5762 | discovered in breast tumor | | |
| hsa-miR-4691-3p | 4742 | 5763 | discovered in breast tumor | | |
| hsa-miR-4691-5p | 4743 | 5764 | discovered in breast tumor | | |
| hsa-miR-4692 | 4744 | 5765 | discovered in breast tumor | | |
| hsa-miR-4693-3p | 4745 | 5766 | discovered in breast tumor | | |
| hsa-miR-4693-5p | 4746 | 5767 | discovered in breast tumor | | |
| hsa-miR-4694-3p | 4747 | 5768 | discovered in breast tumor | | |
| hsa-miR-4694-5p | 4748 | 5769 | discovered in breast tumor | | |
| hsa-miR-4695-3p | 4749 | 5770 | discovered in breast tumor | | |
| hsa-miR-4695-5p | 4750 | 5771 | discovered in breast tumor | | |
| hsa-miR-4696 | 4751 | 5772 | discovered in breast tumor | | |
| hsa-miR-4697-3p | 4752 | 5773 | discovered in breast tumor | | |
| hsa-miR-4697-5p | 4753 | 5774 | discovered in breast tumor | | |
| hsa-miR-4698 | 4754 | 5775 | discovered in breast tumor | | |
| hsa-miR-4699-3p | 4755 | 5776 | discovered in breast tumor | | |
| hsa-miR-4699-5p | 4756 | 5777 | discovered in breast tumor | | |
| hsa-miR-4700-3p | 4757 | 5778 | discovered in breast tumor | | |
| hsa-miR-4700-5p | 4758 | 5779 | discovered in breast tumor | | |
| hsa-miR-4701-3p | 4759 | 5780 | discovered in breast tumor | | |
| hsa-miR-4701-5p | 4760 | 5781 | discovered in breast tumor | | |
| hsa-miR-4703-3p | 4761 | 5782 | discovered in breast tumor | | |
| hsa-miR-4703-5p | 4762 | 5783 | discovered in breast tumor | | |
| hsa-miR-4704-3p | 4763 | 5784 | discovered in breast tumor | | |
| hsa-miR-4704-5p | 4764 | 5785 | discovered in breast tumor | | |
| hsa-miR-4705 | 4765 | 5786 | discovered in breast tumor | | |
| hsa-miR-4706 | 4766 | 5787 | discovered in breast tumor | | |
| hsa-miR-4707-3p | 4767 | 5788 | discovered in breast tumor | | |
| hsa-miR-4707-5p | 4768 | 5789 | discovered in breast tumor | | |
| hsa-miR-4708-3p | 4769 | 5790 | discovered in breast tumor | | |
| hsa-miR-4708-5p | 4770 | 5791 | discovered in breast tumor | | |
| hsa-miR-4709-3p | 4771 | 5792 | discovered in breast tumor | | |
| hsa-miR-4709-5p | 4772 | 5793 | discovered in breast tumor | | |
| hsa-miR-4710 | 4773 | 5794 | discovered in breast tumor | | |
| hsa-miR-4711-3p | 4774 | 5795 | discovered in breast tumor | | |
| hsa-miR-4711-5p | 4775 | 5796 | discovered in breast tumor | | |

TABLE 10-continued mirs, tissues/cell expression and diseases

| microRNA | mir SEQ ID | BS SEQ ID | Tissues/cells | Associated Disease | Biological Function |
|---|---|---|---|---|---|
| hsa-miR-4712-3p | 4776 | 5797 | discovered in breast tumor | | |
| hsa-miR-4712-5p | 4777 | 5798 | discovered in breast tumor | | |
| hsa-miR-4713-3p | 4778 | 5799 | discovered in breast tumor | | |
| hsa-miR-4713-5p | 4779 | 5800 | discovered in breast tumor | | |
| hsa-miR-4714-3p | 4780 | 5801 | discovered in breast tumor | | |
| hsa-miR-4714-5p | 4781 | 5802 | discovered in breast tumor | | |
| hsa-miR-4715-3p | 4782 | 5803 | discovered in breast tumor | | |
| hsa-miR-4715-5p | 4783 | 5804 | discovered in breast tumor | | |
| hsa-miR-4716-3p | 4784 | 5805 | discovered in breast tumor | | |
| hsa-miR-4716-5p | 4785 | 5806 | discovered in breast tumor | | |
| hsa-miR-4717-3p | 4786 | 5807 | discovered in breast tumor | | |
| hsa-miR-4717-5p | 4787 | 5808 | discovered in breast tumor | | |
| hsa-miR-4718 | 4788 | 5809 | discovered in breast tumor | | |
| hsa-miR-4719 | 4789 | 5810 | discovered in breast tumor | | |
| hsa-miR-4720-3p | 4790 | 5811 | discovered in breast tumor | | |
| hsa-miR-4720-5p | 4791 | 5812 | discovered in breast tumor | | |
| hsa-miR-4721 | 4792 | 5813 | discovered in breast tumor | | |
| hsa-miR-4722-3p | 4793 | 5814 | discovered in breast tumor | | |
| hsa-miR-4722-5p | 4794 | 5815 | discovered in breast tumor | | |
| hsa-miR-4723-3p | 4795 | 5816 | discovered in breast tumor | | |
| hsa-miR-4723-5p | 4796 | 5817 | discovered in breast tumor | | |
| hsa-miR-4724-3p | 4797 | 5818 | discovered in breast tumor | | |
| hsa-miR-4724-5p | 4798 | 5819 | discovered in breast tumor | | |
| hsa-miR-4725-3p | 4799 | 5820 | discovered in breast tumor | | |
| hsa-miR-4725-5p | 4800 | 5821 | discovered in breast tumor | | |
| hsa-miR-4726-3p | 4801 | 5822 | discovered in breast tumor | | |
| hsa-miR-4726-5p | 4802 | 5823 | discovered in breast tumor | | |
| hsa-miR-4727-3p | 4803 | 5824 | discovered in breast tumor | | |
| hsa-miR-4727-5p | 4804 | 5825 | discovered in breast tumor | | |
| hsa-miR-4728-3p | 4805 | 5826 | discovered in breast tumor | | |
| hsa-miR-4728-5p | 4806 | 5827 | discovered in breast tumor | | |
| hsa-miR-4729 | 4807 | 5828 | discovered in breast tumor | | |
| hsa-miR-4730 | 4808 | 5829 | discovered in breast tumor | | |
| hsa-miR-4731-3p | 4809 | 5830 | discovered in breast tumor | | |
| hsa-miR-4731-5p | 4810 | 5831 | discovered in breast tumor | | |
| hsa-miR-4732-3p | 4811 | 5832 | discovered in breast tumor | | |
| hsa-miR-4732-5p | 4812 | 5833 | discovered in breast tumor | | |

TABLE 10-continued mirs, tissues/cell expression and diseases

| microRNA | mir SEQ ID | BS SEQ ID | Tissues/cells | Associated Disease | Biological Function |
|---|---|---|---|---|---|
| hsa-miR-4733-3p | 4813 | 5834 | discovered in breast tumor | | |
| hsa-miR-4733-5p | 4814 | 5835 | discovered in breast tumor | | |
| hsa-miR-4734 | 4815 | 5836 | discovered in breast tumor | | |
| hsa-miR-4735-3p | 4816 | 5837 | discovered in breast tumor | | |
| hsa-miR-4735-5p | 4817 | 5838 | discovered in breast tumor | | |
| hsa-miR-4736 | 4818 | 5839 | discovered in breast tumor | | |
| hsa-miR-4737 | 4819 | 5840 | discovered in breast tumor | | |
| hsa-miR-4738-3p | 4820 | 5841 | discovered in breast tumor | | |
| hsa-miR-4738-5p | 4821 | 5842 | discovered in breast tumor | | |
| hsa-miR-4739 | 4822 | 5843 | discovered in breast tumor | | |
| hsa-miR-4740-3p | 4823 | 5844 | discovered in breast tumor | | |
| hsa-miR-4740-5p | 4824 | 5845 | discovered in breast tumor | | |
| hsa-miR-4741 | 4825 | 5846 | discovered in breast tumor, psoriasis | | |
| hsa-miR-4742-3p | 4826 | 5847 | discovered in breast tumor, psoriasis | | |
| hsa-miR-4742-5p | 4827 | 5848 | discovered in breast tumor | | |
| hsa-miR-4743-3p | 4828 | 5849 | discovered in breast tumor | | |
| hsa-miR-4743-5p | 4829 | 5850 | discovered in breast tumor | | |
| hsa-miR-4744 | 4830 | 5851 | discovered in breast tumor | | |
| hsa-miR-4745-3p | 4831 | 5852 | discovered in breast tumor | | |
| hsa-miR-4745-5p | 4832 | 5853 | discovered in breast tumor | | |
| hsa-miR-4746-3p | 4833 | 5854 | discovered in breast tumor | | |
| hsa-miR-4746-5p | 4834 | 5855 | discovered in breast tumor | | |
| hsa-miR-4747-3p | 4835 | 5856 | discovered in breast tumor | | |
| hsa-miR-4747-5p | 4836 | 5857 | discovered in breast tumor | | |
| hsa-miR-4748 | 4837 | 5858 | discovered in breast tumor | | |
| hsa-miR-4749-3p | 4838 | 5859 | discovered in breast tumor | | |
| hsa-miR-4749-5p | 4839 | 5860 | discovered in breast tumor | | |
| hsa-miR-4750-3p | 4840 | 5861 | discovered in breast tumor | | |
| hsa-miR-4750-5p | 4841 | 5862 | discovered in breast tumor | | |
| hsa-miR-4751 | 4842 | 5863 | discovered in breast tumor | | |
| hsa-miR-4752 | 4843 | 5864 | discovered in breast tumor | | |
| hsa-miR-4753-3p | 4844 | 5865 | discovered in breast tumor | | |
| hsa-miR-4753-5p | 4845 | 5866 | discovered in breast tumor | | |
| hsa-miR-4754 | 4846 | 5867 | discovered in breast tumor | | |
| hsa-miR-4755-3p | 4847 | 5868 | discovered in breast tumor | | |
| hsa-miR-4755-5p | 4848 | 5869 | discovered in breast tumor | | |
| hsa-miR-4756-3p | 4849 | 5870 | discovered in breast tumor | | |

TABLE 10-continued mirs, tissues/cell expression and diseases

| microRNA | mir SEQ ID | BS SEQ ID | Tissues/cells | Associated Disease | Biological Function |
|---|---|---|---|---|---|
| hsa-miR-4756-5p | 4850 | 5871 | discovered in breast tumor | | |
| hsa-miR-4757-3p | 4851 | 5872 | discovered in breast tumor | | |
| hsa-miR-4757-5p | 4852 | 5873 | discovered in breast tumor | | |
| hsa-miR-4758-3p | 4853 | 5874 | discovered in breast tumor | | |
| hsa-miR-4758-5p | 4854 | 5875 | discovered in breast tumor | | |
| hsa-miR-4759 | 4855 | 5876 | discovered in breast tumor | | |
| hsa-miR-4760-3p | 4856 | 5877 | discovered in breast tumor | | |
| hsa-miR-4760-5p | 4857 | 5878 | discovered in breast tumor | | |
| hsa-miR-4761-3p | 4858 | 5879 | discovered in breast tumor | | |
| hsa-miR-4761-5p | 4859 | 5880 | discovered in breast tumor | | |
| hsa-miR-4762-3p | 4860 | 5881 | discovered in breast tumor | | |
| hsa-miR-4762-5p | 4861 | 5882 | discovered in breast tumor | | |
| hsa-miR-4763-3p | 4862 | 5883 | discovered in breast tumor | | |
| hsa-miR-4763-5p | 4863 | 5884 | discovered in breast tumor | | |
| hsa-miR-4764-3p | 4864 | 5885 | discovered in breast tumor | | |
| hsa-miR-4764-5p | 4865 | 5886 | discovered in breast tumor | | |
| hsa-miR-4765 | 4866 | 5887 | discovered in breast tumor | | |
| hsa-miR-4766-3p | 4867 | 5888 | discovered in breast tumor | | |
| hsa-miR-4766-5p | 4868 | 5889 | discovered in breast tumor | | |
| hsa-miR-4767 | 4869 | 5890 | discovered in breast tumor | | |
| hsa-miR-4768-3p | 4870 | 5891 | discovered in breast tumor | | |
| hsa-miR-4768-5p | 4871 | 5892 | discovered in breast tumor | | |
| hsa-miR-4769-3p | 4872 | 5893 | discovered in breast tumor | | |
| hsa-miR-4769-5p | 4873 | 5894 | discovered in breast tumor | | |
| hsa-miR-4770 | 4874 | 5895 | discovered in breast tumor | | |
| hsa-miR-4771 | 4875 | 5896 | discovered in breast tumor | | |
| hsa-miR-4772-3p | 4876 | 5897 | discovered in breast tumor, blood monoclear cells | energy metabolism/ obesity | |
| hsa-miR-4772-5p | 4877 | 5898 | discovered in breast tumor, blood monoclear cells | energy metabolism/ obesity | |
| hsa-miR-4773 | 4878 | 5899 | discovered in breast tumor | | |
| hsa-miR-4774-3p | 4879 | 5900 | discovered in breast tumor and Lymphoblastic leukemia | | |
| hsa-miR-4774-5p | 4880 | 5901 | discovered in breast tumor and Lymphoblastic leukemia | | |
| hsa-miR-4775 | 4881 | 5902 | discovered in breast tumor | | |
| hsa-miR-4776-3p | 4882 | 5903 | discovered in breast tumor | | |
| hsa-miR-4776-5p | 4883 | 5904 | discovered in breast tumor | | |

TABLE 10-continued mirs, tissues/cell expression and diseases

| microRNA | mir SEQ ID | BS SEQ ID | Tissues/cells | Associated Disease | Biological Function |
|---|---|---|---|---|---|
| hsa-miR-4777-3p | 4884 | 5905 | discovered in breast tumor | | |
| hsa-miR-4777-5p | 4885 | 5906 | discovered in breast tumor | | |
| hsa-miR-4778-3p | 4886 | 5907 | discovered in breast tumor | | |
| hsa-miR-4778-5p | 4887 | 5908 | discovered in breast tumor | | |
| hsa-miR-4779 | 4888 | 5909 | discovered in breast tumor | | |
| hsa-miR-4780 | 4889 | 5910 | discovered in breast tumor | | |
| hsa-miR-4781-3p | 4890 | 5911 | discovered in breast tumor | | |
| hsa-miR-4781-5p | 4891 | 5912 | discovered in breast tumor | | |
| hsa-miR-4782-3p | 4892 | 5913 | discovered in breast tumor | | |
| hsa-miR-4782-5p | 4893 | 5914 | discovered in breast tumor | | |
| hsa-miR-4783-3p | 4894 | 5915 | discovered in breast tumor | | |
| hsa-miR-4783-5p | 4895 | 5916 | discovered in breast tumor | | |
| hsa-miR-4784 | 4896 | 5917 | discovered in breast tumor | | |
| hsa-miR-4785 | 4897 | 5918 | discovered in breast tumor | | |
| hsa-miR-4786-3p | 4898 | 5919 | discovered in breast tumor | | |
| hsa-miR-4786-5p | 4899 | 5920 | discovered in breast tumor | | |
| hsa-miR-4787-3p | 4900 | 5921 | discovered in breast tumor | | |
| hsa-miR-4787-5p | 4901 | 5922 | discovered in breast tumor | | |
| hsa-miR-4788 | 4902 | 5923 | discovered in breast tumor | | |
| hsa-miR-4789-3p | 4903 | 5924 | discovered in breast tumor | | |
| hsa-miR-4789-5p | 4904 | 5925 | discovered in breast tumor | | |
| hsa-miR-4790-3p | 4905 | 5926 | discovered in breast tumor | | |
| hsa-miR-4790-5p | 4906 | 5927 | discovered in breast tumor | | |
| hsa-miR-4791 | 4907 | 5928 | discovered in breast tumor | | |
| hsa-miR-4792 | 4908 | 5929 | discovered in breast tumor | | |
| hsa-miR-4793-3p | 4909 | 5930 | discovered in breast tumor | | |
| hsa-miR-4793-5p | 4910 | 5931 | discovered in breast tumor | | |
| hsa-miR-4794 | 4911 | 5932 | discovered in breast tumor | | |
| hsa-miR-4795-3p | 4912 | 5933 | discovered in breast tumor | | |
| hsa-miR-4795-5p | 4913 | 5934 | discovered in breast tumor | | |
| hsa-miR-4796-3p | 4914 | 5935 | discovered in breast tumor | | |
| hsa-miR-4796-5p | 4915 | 5936 | discovered in breast tumor | | |
| hsa-miR-4797-3p | 4916 | 5937 | discovered in breast tumor | | |
| hsa-miR-4797-5p | 4917 | 5938 | discovered in breast tumor | | |
| hsa-miR-4798-3p | 4918 | 5939 | discovered in breast tumor | | |
| hsa-miR-4798-5p | 4919 | 5940 | discovered in breast tumor | | |
| hsa-miR-4799-3p | 4920 | 5941 | discovered in breast tumor | | |

TABLE 10-continued mirs, tissues/cell expression and diseases

| microRNA | mir SEQ ID | BS SEQ ID | Tissues/cells | Associated Disease | Biological Function |
|---|---|---|---|---|---|
| hsa-miR-4799-5p | 4921 | 5942 | discovered in breast tumor | | |
| hsa-miR-4800-3p | 4922 | 5943 | discovered in breast tumor | | |
| hsa-miR-4800-5p | 4923 | 5944 | discovered in breast tumor | | |
| hsa-miR-4801 | 4924 | 5945 | discovered in breast tumor | | |
| hsa-miR-4802-3p | 4925 | 5946 | discovered in breast tumor, psoriasis | | |
| hsa-miR-4802-5p | 4926 | 5947 | discovered in breast tumor, psoriasis | | |
| hsa-miR-4803 | 4927 | 5948 | discovered in breast tumor | | |
| hsa-miR-4804-3p | 4928 | 5949 | discovered in breast tumor | | |
| hsa-miR-4804-5p | 4929 | 5950 | discovered in breast tumor | | |
| hsa-miR-483-3p | 4930 | 5951 | | aderonocortical carcinoma, rectal/pancreatic cancer, proliferation of wounded epithelial cells | oncogenic |
| hsa-miR-483-5p | 4931 | 5952 | cartilage (chondrocyte), fetal brain | aderonocortical carcinoma | angiogenesis |
| hsa-miR-484 | 4932 | 5953 | | | mitochondrial network |
| hsa-miR-485-3p | 4933 | 5954 | | | |
| hsa-miR-485-5p | 4934 | 5955 | | ovarian epithelial tumor | |
| hsa-miR-486-3p | 4935 | 5956 | erythroid cells | various cancers | |
| hsa-miR-486-5p | 4936 | 5957 | stem cells (adipose) | various cancers | |
| hsa-miR-487a | 4937 | 5958 | | laryngeal carcinoma | |
| hsa-miR-487b | 4938 | 5959 | | neuroblastoma, pulmonary carcinogenesis | |
| hsa-miR-488-3p | 4939 | 5960 | | prostate cancer, others | |
| hsa-miR-488-5p | 4940 | 5961 | | prostate cancer, others | |
| hsa-miR-489 | 4941 | 5962 | mesenchymal stem cells | osteogenesis | |
| hsa-miR-490-3p | 4942 | 5963 | | neuroblastoma, terine leiomyoma (ULM)/muscle | |
| hsa-miR-490-5p | 4943 | 5964 | | neuroblastoma, terine leiomyoma (ULM)/muscle | |
| hsa-miR-491-3p | 4944 | 5965 | | various cancers, brain disease | pro-apoptosis |
| hsa-miR-491-5p | 4945 | 5966 | | various cancers, brain disease | pro-apoptosis |
| hsa-miR-492 | 4946 | 5967 | | | |
| hsa-miR-493-3p | 4947 | 5968 | myeloid cells, pancreas (islet) | | |
| hsa-miR-493-5p | 4948 | 5969 | myeloid cells, pancreas (islet) | | |
| hsa-miR-494 | 4949 | 5970 | epithelial cells | various cancers | cell cycle |
| hsa-miR-495-3p | 4950 | 5971 | platelet | various cancers (gastric, MLL leukemia, pancreatic etc) and inflammation | |
| hsa-miR-495-5p | 4951 | 5972 | platelet | various cancers (gastric, MLL leukemia, pancreatic etc) and inflammation | |

TABLE 10-continued mirs, tissues/cell expression and diseases

| microRNA | mir SEQ ID | BS SEQ ID | Tissues/cells | Associated Disease | Biological Function |
|---|---|---|---|---|---|
| hsa-miR-496 | 4952 | 5973 | Blood | | |
| hsa-miR-497-3p | 4953 | 5974 | | various cancers (breast, colorectal, etc) | tumor supressor/pro-apoptosis |
| hsa-miR-497-5p | 4954 | 5975 | | various cancers (breast, colorectal, etc) | tumor supressor/pro-apoptosis |
| hsa-miR-498 | 4955 | 5976 | | autoimmuno (e.g. rheumatoid arthritis) | |
| hsa-miR-4999-3p | 4956 | 5977 | | | |
| hsa-miR-4999-5p | 4957 | 5978 | | | |
| hsa-miR-499a-3p | 4958 | 5979 | heart, cardiac stem cells | cardiovascular disease | cardiomyocyte differentiation |
| hsa-miR-499a-5p | 4959 | 5980 | heart, cardiac stem cells | cardiovascular disease | cardiomyocyte differentiation |
| hsa-miR-499b-3p | 4960 | 5981 | heart, cardiac stem cells | cardiovascular disease | cardiomyocyte differentiation |
| hsa-miR-499b-5p | 4961 | 5982 | heart, cardiac stem cells | cardiovascular disease | cardiomyocyte differentiation |
| hsa-miR-5000-3p | 4962 | 5983 | discovered in lymphoblastic leukaemia | | |
| hsa-miR-5000-5p | 4963 | 5984 | discovered in lymphoblastic leukaemia | | |
| hsa-miR-5001-3p | 4964 | 5985 | | | |
| hsa-miR-5001-5p | 4965 | 5986 | | | |
| hsa-miR-5002-3p | 4966 | 5987 | | | |
| hsa-miR-5002-5p | 4967 | 5988 | | | |
| hsa-miR-5003-3p | 4968 | 5989 | | | |
| hsa-miR-5003-5p | 4969 | 5990 | | | |
| hsa-miR-5004-3p | 4970 | 5991 | | | |
| hsa-miR-5004-5p | 4971 | 5992 | | | |
| hsa-miR-5006-3p | 4972 | 5993 | discovered in lymphoblastic leukaemia | | |
| hsa-miR-5006-5p | 4973 | 5994 | discovered in lymphoblastic leukaemia | | |
| hsa-miR-5007-3p | 4974 | 5995 | | | |
| hsa-miR-5007-5p | 4975 | 5996 | | | |
| hsa-miR-5008-3p | 4976 | 5997 | | | |
| hsa-miR-5008-5p | 4977 | 5998 | | | |
| hsa-miR-5009-3p | 4978 | 5999 | | | |
| hsa-miR-5009-5p | 4979 | 6000 | | | |
| hsa-miR-500a-3p | 4980 | 6001 | | | |
| hsa-miR-500a-5p | 4981 | 6002 | | | |
| hsa-miR-500b | 4982 | 6003 | Blood (plasma) | | |
| hsa-miR-5010-3p | 4983 | 6004 | | abnormal skin (psoriasis) | |
| hsa-miR-5010-5p | 4984 | 6005 | | abnormal skin (psoriasis) | |
| hsa-miR-5011-3p | 4985 | 6006 | | | |
| hsa-miR-5011-5p | 4986 | 6007 | | | |
| hsa-miR-501-3p | 4987 | 6008 | | | |
| hsa-miR-501-5p | 4988 | 6009 | | | |
| hsa-miR-502-3p | 4989 | 6010 | | various cancers (hepatocellular, ovarian, breast) | |
| hsa-miR-502-5p | 4990 | 6011 | | various cancers (hepatocellular, ovarian, breast) | |
| hsa-miR-503-3p | 4991 | 6012 | ovary | | |
| hsa-miR-503-5p | 4992 | 6013 | ovary | | |
| hsa-miR-504 | 4993 | 6014 | | glioblastoma | |
| hsa-miR-5047 | 4994 | 6015 | | | |
| hsa-miR-505-3p | 4995 | 6016 | | breast cancer | |
| hsa-miR-505-5p | 4996 | 6017 | | breast cancer | |
| hsa-miR-506-3p | 4997 | 6018 | | various cancers | |
| hsa-miR-506-5p | 4998 | 6019 | | various cancers | |
| hsa-miR-507 | 4999 | 6020 | | | |
| hsa-miR-508-3p | 5000 | 6021 | | renal cell carcinoma | |

TABLE 10-continued mirs, tissues/cell expression and diseases

| microRNA | mir SEQ ID | BS SEQ ID | Tissues/cells | Associated Disease | Biological Function |
|---|---|---|---|---|---|
| hsa-miR-508-5p | 5001 | 6022 | endothelial progenitor cells (EPCs) | | |
| hsa-miR-5087 | 5002 | 6023 | | | |
| hsa-miR-5088 | 5003 | 6024 | | | |
| hsa-miR-5089-3p | 5004 | 6025 | | | |
| hsa-miR-5089-5p | 5005 | 6026 | | | |
| hsa-miR-5090 | 5006 | 6027 | | | |
| hsa-miR-5091 | 5007 | 6028 | | | |
| hsa-miR-5092 | 5008 | 6029 | | | |
| hsa-miR-5093 | 5009 | 6030 | | | |
| hsa-miR-509-3-5p | 5010 | 6031 | testis | | |
| hsa-miR-509-3p | 5011 | 6032 | | renal cell carcinoma, brain disease | |
| hsa-miR-5094 | 5012 | 6033 | | | |
| hsa-miR-5095 | 5013 | 6034 | | cervical cancer | |
| hsa-miR-509-5p | 5014 | 6035 | | metabolic syndrome, brain disease | |
| hsa-miR-5096 | 5015 | 6036 | | cervical cance | |
| hsa-miR-510 | 5016 | 6037 | brain | | |
| hsa-miR-5100 | 5017 | 6038 | discoverd in Salivary gland | | |
| hsa-miR-511 | 5018 | 6039 | dendritic cells and macrophages | | |
| hsa-miR-512-3p | 5019 | 6040 | embryonic stem cells, placenta | | |
| hsa-miR-512-5p | 5020 | 6041 | embryonic stem cells, placenta, | | |
| hsa-miR-513a-3p | 5021 | 6042 | | lung carcinoma | |
| hsa-miR-513a-5p | 5022 | 6043 | endothelial cells | | |
| hsa-miR-513b | 5023 | 6044 | | follicular lymphoma | |
| hsa-miR-513c-3p | 5024 | 6045 | | | |
| hsa-miR-513c-5p | 5025 | 6046 | | | |
| hsa-miR-514a-3p | 5026 | 6047 | | | |
| hsa-miR-514a-5p | 5027 | 6048 | | | |
| hsa-miR-514b-3p | 5028 | 6049 | | various cancer cells | |
| hsa-miR-514b-5p | 5029 | 6050 | | various cancer cells | |
| hsa-miR-515-3p | 5030 | 6051 | | | |
| hsa-miR-515-5p | 5031 | 6052 | placenta | | |
| hsa-miR-516a-3p | 5032 | 6053 | frontal cortex | | |
| hsa-miR-516a-5p | 5033 | 6054 | placenta | | |
| hsa-miR-516b-3p | 5034 | 6055 | | | |
| hsa-miR-516b-5p | 5035 | 6056 | | | |
| hsa-miR-517-5p | 5036 | 6057 | placenta | | |
| hsa-miR-517a-3p | 5037 | 6058 | placenta | | |
| hsa-miR-517b-3p | 5038 | 6059 | placenta | | |
| hsa-miR-517c-3p | 5039 | 6060 | placenta | | |
| hsa-miR-5186 | 5040 | 6061 | discovered in lymphoblastic leukaemia | | |
| hsa-miR-5187-3p | 5041 | 6062 | discovered in lymphoblastic leukaemia, skin (psoriasis) | | |
| hsa-miR-5187-5p | 5042 | 6063 | discovered in lymphoblastic leukaemia, skin (psoriasis) | | |
| hsa-miR-5188 | 5043 | 6064 | discovered in lymphoblastic leukaemia | | |
| hsa-miR-5189 | 5044 | 6065 | discovered in lymphoblastic leukaemia | | |
| hsa-miR-518a-3p | 5045 | 6066 | | HCC | |
| hsa-miR-518a-5p | 5046 | 6067 | | various cancer cells | |
| hsa-miR-518b | 5047 | 6068 | placenta | HCC | cell cycle progression |

TABLE 10-continued mirs, tissues/cell expression and diseases

| microRNA | mir SEQ ID | BS SEQ ID | Tissues/cells | Associated Disease | Biological Function |
|---|---|---|---|---|---|
| hsa-miR-518c-3p | 5048 | 6069 | placenta | | |
| hsa-miR-518c-5p | 5049 | 6070 | placenta | | |
| hsa-miR-518d-3p | 5050 | 6071 | | | |
| hsa-miR-518d-5p | 5051 | 6072 | | | |
| hsa-miR-518e-3p | 5052 | 6073 | | HCC | cell cycle progression |
| hsa-miR-518e-5p | 5053 | 6074 | | HCC | cell cycle progression |
| hsa-miR-518f-3p | 5054 | 6075 | placenta | | |
| hsa-miR-518f-5p | 5055 | 6076 | placenta | | |
| hsa-miR-5190 | 5056 | 6077 | discovered in lymphoblastic leukaemia | | |
| hsa-miR-5191 | 5057 | 6078 | discovered in lymphoblastic leukaemia | | |
| hsa-miR-5192 | 5058 | 6079 | discovered in lymphoblastic leukaemia | | |
| hsa-miR-5193 | 5059 | 6080 | discovered in lymphoblastic leukaemia | | |
| hsa-miR-5194 | 5060 | 6081 | discovered in lymphoblastic leukaemia | | |
| hsa-miR-5195-3p | 5061 | 6082 | discovered in lymphoblastic leukaemia | | |
| hsa-miR-5195-5p | 5062 | 6083 | discovered in lymphoblastic leukaemia | | |
| hsa-miR-5196-3p | 5063 | 6084 | discovered in lymphoblastic leukaemia | | |
| hsa-miR-5196-5p | 5064 | 6085 | discovered in lymphoblastic leukaemia | | |
| hsa-miR-5197-3p | 5065 | 6086 | discovered in lymphoblastic leukaemia | | |
| hsa-miR-5197-5p | 5066 | 6087 | discovered in lymphoblastic leukaemia | | |
| hsa-miR-519a-3p | 5067 | 6088 | placenta | HCC | |
| hsa-miR-519a-5p | 5068 | 6089 | placenta | HCC | |
| hsa-miR-519b-3p | 5069 | 6090 | | breast cancer | |
| hsa-miR-519b-5p | 5070 | 6091 | | breast cancer | |
| hsa-miR-519c-3p | 5071 | 6092 | | | |
| hsa-miR-519c-5p | 5072 | 6093 | | | |
| hsa-miR-519d | 5073 | 6094 | placenta | | |
| hsa-miR-519e-3p | 5074 | 6095 | placenta | | |
| hsa-miR-519e-5p | 5075 | 6096 | placenta | | |
| hsa-miR-520a-3p | 5076 | 6097 | placenta | | |
| hsa-miR-520a-5p | 5077 | 6098 | placenta | | |
| hsa-miR-520b | 5078 | 6099 | | breast cancer | |
| hsa-miR-520c-3p | 5079 | 6100 | | gastric cancer, breast tumor | |
| hsa-miR-520c-5p | 5080 | 6101 | | breast tumor | |
| hsa-miR-520d-3p | 5081 | 6102 | | various cancer cells | |
| hsa-miR-520d-5p | 5082 | 6103 | | various cancer cells | |
| hsa-miR-520e | 5083 | 6104 | | hepatoma | tomor suppressor |
| hsa-miR-520f | 5084 | 6105 | | breast cancer | |
| hsa-miR-520g | 5085 | 6106 | | HCC, bladder cancer, breast cancer | |
| hsa-miR-520h | 5086 | 6107 | placental specific | | |
| hsa-miR-521 | 5087 | 6108 | | prostate cancer | |
| hsa-miR-522-3p | 5088 | 6109 | | HCC | |
| hsa-miR-522-5p | 5089 | 6110 | | HCC | |
| hsa-miR-523-3p | 5090 | 6111 | | | |
| hsa-miR-523-5p | 5091 | 6112 | | | |

TABLE 10-continued mirs, tissues/cell expression and diseases

| microRNA | mir SEQ ID | BS SEQ ID | Tissues/cells | Associated Disease | Biological Function |
|---|---|---|---|---|---|
| hsa-miR-524-3p | 5092 | 6113 | | colon cancer stem cells | |
| hsa-miR-524-5p | 5093 | 6114 | placental specific | gliomas | |
| hsa-miR-525-3p | 5094 | 6115 | placental specific | HCC | |
| hsa-miR-525-5p | 5095 | 6116 | placental specific | | |
| hsa-miR-526a | 5096 | 6117 | placental specific | | |
| hsa-miR-526b-3p | 5097 | 6118 | placental specific | | |
| hsa-miR-526b-5p | 5098 | 6119 | placental specific | | |
| hsa-miR-527 | 5099 | 6120 | | | |
| hsa-miR-532-3p | 5100 | 6121 | | ALL | |
| hsa-miR-532-5p | 5101 | 6122 | | ALL | |
| hsa-miR-539-3p | 5102 | 6123 | | | |
| hsa-miR-539-5p | 5103 | 6124 | | | |
| hsa-miR-541-3p | 5104 | 6125 | | | |
| hsa-miR-541-5p | 5105 | 6126 | | | |
| hsa-miR-542-3p | 5106 | 6127 | monocytes | | |
| hsa-miR-542-5p | 5107 | 6128 | | basal cell carcinoma, neuroblastoma | |
| hsa-miR-543 | 5108 | 6129 | | | |
| hsa-miR-544a | 5109 | 6130 | | osteocarcoma | |
| hsa-miR-544b | 5110 | 6131 | | osteocarcoma | |
| hsa-miR-545-3p | 5111 | 6132 | | | |
| hsa-miR-545-5p | 5112 | 6133 | | rectal cancer | |
| hsa-miR-548 | 5113 | 6134 | | | |
| hsa-miR-548-3p | 5114 | 6135 | | | |
| hsa-miR-548-5p | 5115 | 6136 | | | |
| hsa-miR-548a | 5116 | 6137 | identified in colorectal microRNAome | | |
| hsa-miR-548a-3p | 5117 | 6138 | identified in colorectal microRNAome | | |
| hsa-miR-548a-5p | 5118 | 6139 | identified in colorectal microRNAome | | |
| hsa-miR-548aa | 5119 | 6140 | identified in cervical tumor | | |
| hsa-miR-548ab | 5120 | 6141 | discovered in B-cells | | |
| hsa-miR-548ac | 5121 | 6142 | discovered in B-cells | | |
| hsa-miR-548ad | 5122 | 6143 | discovered in B-cells | | |
| hsa-miR-548ae | 5123 | 6144 | discovered in B-cells | | |
| hsa-miR-548ag | 5124 | 6145 | discovered in B-cells | | |
| hsa-miR-548ah-3p | 5125 | 6146 | discovered in B-cells | | |
| hsa-miR-548ah-5p | 5126 | 6147 | discovered in B-cells | | |
| hsa-miR-548ai | 5127 | 6148 | discovered in B-cells | | |
| hsa-miR-548aj-3p | 5128 | 6149 | discovered in B-cells | | |
| hsa-miR-548aj-5p | 5129 | 6150 | discovered in B-cells | | |
| hsa-miR-548ak | 5130 | 6151 | discovered in B-cells | | |
| hsa-miR-548al | 5131 | 6152 | discovered in B-cells | | |
| hsa-miR-548am-3p | 5132 | 6153 | discovered in B-cells | | |
| hsa-miR-548am-5p | 5133 | 6154 | discovered in B-cells | | |
| hsa-miR-548an | 5134 | 6155 | discovered in B-cells | | |
| hsa-miR-548ao-3p | 5135 | 6156 | | | |
| hsa-miR-548ao-5p | 5136 | 6157 | | | |
| hsa-miR-548ap-3p | 5137 | 6158 | | | |
| hsa-miR-548ap-5p | 5138 | 6159 | | | |
| hsa-miR-548aq-3p | 5139 | 6160 | | | |
| hsa-miR-548aq-5p | 5140 | 6161 | | | |

TABLE 10-continued mirs, tissues/cell expression and diseases

| microRNA | mir SEQ ID | BS SEQ ID | Tissues/cells | Associated Disease | Biological Function |
|---|---|---|---|---|---|
| hsa-miR-548ar-3p | 5141 | 6162 | | | |
| hsa-miR-548ar-5p | 5142 | 6163 | | | |
| hsa-miR-548as-3p | 5143 | 6164 | | | |
| hsa-miR-548as-5p | 5144 | 6165 | | | |
| hsa-miR-548at-3p | 5145 | 6166 | | prostate cancer | |
| hsa-miR-548at-5p | 5146 | 6167 | | prostate cancer | |
| hsa-miR-548au-3p | 5147 | 6168 | | | |
| hsa-miR-548au-5p | 5148 | 6169 | | | |
| hsa-miR-548av-3p | 5149 | 6170 | | | |
| hsa-miR-548av-5p | 5150 | 6171 | | | |
| hsa-miR-548aw | 5151 | 6172 | | prostate cancer | |
| hsa-miR-548ay-3p | 5152 | 6173 | discovered in abnormal skin (psoriasis) | | |
| hsa-miR-548ay-5p | 5153 | 6174 | discovered in abnormal skin (psoriasis) | | |
| hsa-miR-548az-3p | 5154 | 6175 | discovered in abnormal skin (psoriasis) | | |
| hsa-miR-548az-5p | 5155 | 6176 | discovered in abnormal skin (psoriasis) | | |
| hsa-miR-548b-3p | 5156 | 6177 | identified in colorectal microRNAome | | |
| hsa-miR-548b-5p | 5157 | 6178 | immune cells, frontal cortex | | |
| hsa-miR-548c-3p | 5158 | 6179 | identified in colorectal microRNAome | | |
| hsa-miR-548c-5p | 5159 | 6180 | immune cells, frontal cortex | | |
| hsa-miR-548d-3p | 5160 | 6181 | identified in colorectal microRNAome | | |
| hsa-miR-548d-5p | 5161 | 6182 | identified in colorectal microRNAome | | |
| hsa-miR-548e | 5162 | 6183 | embryonic stem cells | | |
| hsa-miR-548f | 5163 | 6184 | embryonic stem cells | | |
| hsa-miR-548g-3p | 5164 | 6185 | embryonic stem cells | | |
| hsa-miR-548g-5p | 5165 | 6186 | embryonic stem cells | | |
| hsa-miR-548h-3p | 5166 | 6187 | embryonic stem cells | | |
| hsa-miR-548h-5p | 5167 | 6188 | embryonic stem cells | | |
| hsa-miR-548i | 5168 | 6189 | embryonic stem cells, immune cells | | |
| hsa-miR-548j | 5169 | 6190 | immune cells | | |
| hsa-miR-548k | 5170 | 6191 | embryonic stem cells | | |
| hsa-miR-548l | 5171 | 6192 | embryonic stem cells | | |
| hsa-miR-548m | 5172 | 6193 | embryonic stem cells | | |
| hsa-miR-548n | 5173 | 6194 | embryonic stem cells, immune cells | | |
| hsa-miR-548o-3p | 5174 | 6195 | embryonic stem cells | | |
| hsa-miR-548o-5p | 5175 | 6196 | embryonic stem cells | | |
| hsa-miR-548p | 5176 | 6197 | embryonic stem cells | | |
| hsa-miR-548q | 5177 | 6198 | | ovarian cancer cells | |
| hsa-miR-548s | 5178 | 6199 | discovered in the melanoma MicroRNAome | | |

TABLE 10-continued mirs, tissues/cell expression and diseases

| microRNA | mir SEQ ID | BS SEQ ID | Tissues/cells | Associated Disease | Biological Function |
|---|---|---|---|---|---|
| hsa-miR-548t-3p | 5179 | 6200 | discovered in the melanoma MicroRNAome | | |
| hsa-miR-548t-5p | 5180 | 6201 | discovered in the melanoma MicroRNAome | | |
| hsa-miR-548u | 5181 | 6202 | discovered in the melanoma MicroRNAome | | |
| hsa-miR-548w | 5182 | 6203 | discovered in the melanoma MicroRNAome | | |
| hsa-miR-548y | 5183 | 6204 | | | |
| hsa-miR-548z | 5184 | 6205 | discovered in cervical tumor | | |
| hsa-miR-549a | 5185 | 6206 | discovered in a colorectal MicroRNAome | | |
| hsa-miR-550a-3-5p | 5186 | 6207 | | Hepatocellular Carcinoma | |
| hsa-miR-550a-3p | 5187 | 6208 | | Hepatocellular Carcinoma | |
| hsa-miR-550a-5p | 5188 | 6209 | | Hepatocellular Carcinoma | |
| hsa-miR-550b-2-5p | 5189 | 6210 | discovered in cervical tumor | | |
| hsa-miR-550b-3p | 5190 | 6211 | discovered in cervical tumor | | |
| hsa-miR-551a | 5191 | 6212 | | gastric cancer | |
| hsa-miR-551b-3p | 5192 | 6213 | hepatocytes | | |
| hsa-miR-551b-5p | 5193 | 6214 | hepatocytes | | |
| hsa-miR-552 | 5194 | 6215 | discovered in a colorectal MicroRNAome | | |
| hsa-miR-553 | 5195 | 6216 | discovered in a colorectal MicroRNAome | | |
| hsa-miR-554 | 5196 | 6217 | discovered in a colorectal MicroRNAome | | |
| hsa-miR-555 | 5197 | 6218 | discovered in a colorectal MicroRNAome | | |
| hsa-miR-556-3p | 5198 | 6219 | discovered in a colorectal MicroRNAome | | |
| hsa-miR-556-5p | 5199 | 6220 | discovered in a colorectal MicroRNAome | | |
| hsa-miR-557 | 5200 | 6221 | liver (hepatocytes) | | |
| hsa-miR-5571-3p | 5201 | 6222 | discoveredd in Salivary gland | | |
| hsa-miR-5571-5p | 5202 | 6223 | discoveredd in Salivary gland | | |
| hsa-miR-5572 | 5203 | 6224 | discoveredd in Salivary gland | | |
| hsa-miR-5579-3p | 5204 | 6225 | | | |
| hsa-miR-5579-5p | 5205 | 6226 | | | |
| hsa-miR-558 | 5206 | 6227 | | neuroblastoma | |
| hsa-miR-5580-3p | 5207 | 6228 | | | |
| hsa-miR-5580-5p | 5208 | 6229 | | | |
| hsa-miR-5581-3p | 5209 | 6230 | | | |
| hsa-miR-5581-5p | 5210 | 6231 | | | |
| hsa-miR-5582-3p | 5211 | 6232 | | | |
| hsa-miR-5582-5p | 5212 | 6233 | | | |
| hsa-miR-5583-3p | 5213 | 6234 | | | |
| hsa-miR-5583-5p | 5214 | 6235 | | | |
| hsa-miR-5584-3p | 5215 | 6236 | | | |
| hsa-miR-5584-5p | 5216 | 6237 | | | |
| hsa-miR-5585-3p | 5217 | 6238 | | | |
| hsa-miR-5585-5p | 5218 | 6239 | | | |
| hsa-miR-5586-3p | 5219 | 6240 | | | |
| hsa-miR-5586-5p | 5220 | 6241 | | | |
| hsa-miR-5587-3p | 5221 | 6242 | | | |

TABLE 10-continued mirs, tissues/cell expression and diseases

| microRNA | mir SEQ ID | BS SEQ ID | Tissues/cells | Associated Disease | Biological Function |
|---|---|---|---|---|---|
| hsa-miR-5587-5p | 5222 | 6243 | | | |
| hsa-miR-5588-3p | 5223 | 6244 | | | |
| hsa-miR-5588-5p | 5224 | 6245 | | | |
| hsa-miR-5589-3p | 5225 | 6246 | | | |
| hsa-miR-5589-5p | 5226 | 6247 | | | |
| hsa-miR-559 | 5227 | 6248 | | | |
| hsa-miR-5590-3p | 5228 | 6249 | | | |
| hsa-miR-5590-5p | 5229 | 6250 | | | |
| hsa-miR-5591-3p | 5230 | 6251 | | | |
| hsa-miR-5591-5p | 5231 | 6252 | | | |
| hsa-miR-561-3p | 5232 | 6253 | | multiple myeloma | |
| hsa-miR-561-5p | 5233 | 6254 | | multiple myeloma | |
| hsa-miR-562 | 5234 | 6255 | | | |
| hsa-miR-563 | 5235 | 6256 | discovered in a colorectal MicroRNAome | | |
| hsa-miR-564 | 5236 | 6257 | | Chronic myeloid leukemia | |
| hsa-miR-566 | 5237 | 6258 | | MALT lymphoma/lymphocyte | |
| hsa-miR-567 | 5238 | 6259 | | colorectal cancer | |
| hsa-miR-568 | 5239 | 6260 | discovered in a colorectal MicroRNAome | | |
| hsa-miR-5680 | 5240 | 6261 | | Associated with metastatic prostate cancer | |
| hsa-miR-5681a | 5241 | 6262 | | Associated with metastatic prostate cancer | |
| hsa-miR-5681b | 5242 | 6263 | | Associated with metastatic prostate cancer | |
| hsa-miR-5682 | 5243 | 6264 | | Associated with metastatic prostate cancer | |
| hsa-miR-5683 | 5244 | 6265 | | Associated with metastatic prostate cancer | |
| hsa-miR-5684 | 5245 | 6266 | | Associated with metastatic prostate cancer | |
| hsa-miR-5685 | 5246 | 6267 | | Associated with metastatic prostate cancer | |
| hsa-miR-5686 | 5247 | 6268 | | Associated with metastatic prostate cancer | |
| hsa-miR-5687 | 5248 | 6269 | | Associated with metastatic prostate cancer | |
| hsa-miR-5688 | 5249 | 6270 | | Associated with metastatic prostate cancer | |
| hsa-miR-5689 | 5250 | 6271 | | Associated with metastatic prostate cancer | |
| hsa-miR-569 | 5251 | 6272 | | | |
| hsa-miR-5690 | 5252 | 6273 | | Associated with metastatic prostate cancer | |
| hsa-miR-5691 | 5253 | 6274 | | Associated with metastatic prostate cancer | |
| hsa-miR-5692a | 5254 | 6275 | | Associated with metastatic prostate cancer | |
| hsa-miR-5692b | 5255 | 6276 | | Associated with metastatic prostate cancer | |
| hsa-miR-5692c | 5256 | 6277 | | Associated with metastatic prostate cancer | |

TABLE 10-continued mirs, tissues/cell expression and diseases

| microRNA | mir SEQ ID | BS SEQ ID | Tissues/cells | Associated Disease | Biological Function |
|---|---|---|---|---|---|
| hsa-miR-5693 | 5257 | 6278 | | Associated with metastatic prostate cancer | |
| hsa-miR-5694 | 5258 | 6279 | | Associated with metastatic prostate cancer | |
| hsa-miR-5695 | 5259 | 6280 | | Associated with metastatic prostate cancer | |
| hsa-miR-5696 | 5260 | 6281 | | Associated with metastatic prostate cancer | |
| hsa-miR-5697 | 5261 | 6282 | | Associated with metastatic prostate cancer | |
| hsa-miR-5698 | 5262 | 6283 | | Associated with metastatic prostate cancer | |
| hsa-miR-5699 | 5263 | 6284 | | Associated with metastatic prostate cancer | |
| hsa-miR-5700 | 5264 | 6285 | | Associated with metastatic prostate cancer | |
| hsa-miR-5701 | 5265 | 6286 | | Associated with metastatic prostate cancer | |
| hsa-miR-5702 | 5266 | 6287 | | Associated with metastatic prostate cancer | |
| hsa-miR-5703 | 5267 | 6288 | | Associated with metastatic prostate cancer | |
| hsa-miR-570-3p | 5268 | 6289 | | follicular lymphoma | |
| hsa-miR-5704 | 5269 | 6290 | | Associated with metastatic prostate cancer | |
| hsa-miR-5705 | 5270 | 6291 | | Associated with metastatic prostate cancer | |
| hsa-miR-570-5p | 5271 | 6292 | | follicular lymphoma | |
| hsa-miR-5706 | 5272 | 6293 | | Associated with metastatic prostate cancer | |
| hsa-miR-5707 | 5273 | 6294 | | Associated with metastatic prostate cancer | |
| hsa-miR-5708 | 5274 | 6295 | | Associated with metastatic prostate cancer | |
| hsa-miR-571 | 5275 | 6296 | frontal cortex | | |
| hsa-miR-572 | 5276 | 6297 | circulating microRNA (in plasma) | basal cell carcinoma | |
| hsa-miR-573 | 5277 | 6298 | discovered in the colorectal MicroRNAome | | |
| hsa-miR-5739 | 5278 | 6299 | endothelial cells | | |
| hsa-miR-574-3p | 5279 | 6300 | blood (myeloid cells) | follicular lymphoma | |
| hsa-miR-574-5p | 5280 | 6301 | semen | | |
| hsa-miR-575 | 5281 | 6302 | | gastric cancer | |
| hsa-miR-576-3p | 5282 | 6303 | discovered in a colorectal MicroRNAome | | |
| hsa-miR-576-5p | 5283 | 6304 | cartilage/ chondrocyte | | |
| hsa-miR-577 | 5284 | 6305 | discovered in a colorectal MicroRNAome | | |

TABLE 10-continued mirs, tissues/cell expression and diseases

| microRNA | mir SEQ ID | BS SEQ ID | Tissues/cells | Associated Disease | Biological Function |
|---|---|---|---|---|---|
| hsa-miR-578 | 5285 | 6306 | discovered in a colorectal MicroRNAome | | |
| hsa-miR-5787 | 5286 | 6307 | fibroblast | | |
| hsa-miR-579 | 5287 | 6308 | | | |
| hsa-miR-580 | 5288 | 6309 | | breast cancer | |
| hsa-miR-581 | 5289 | 6310 | liver (hepatocytes) | | |
| hsa-miR-582-3p | 5290 | 6311 | cartilage/chondrocyte | bladder cancer | |
| hsa-miR-582-5p | 5291 | 6312 | | bladder cancer | |
| hsa-miR-583 | 5292 | 6313 | | rectal cancer cells | |
| hsa-miR-584-3p | 5293 | 6314 | | tumor cells (follicular lymphoma, rectal cancer cells) | |
| hsa-miR-584-5p | 5294 | 6315 | | tumor cells (follicular lymphoma, rectal cancer cells) | |
| hsa-miR-585 | 5295 | 6316 | | oral squamous cell carcinoma | |
| hsa-miR-586 | 5296 | 6317 | discovered in a colorectal MicroRNAome | | |
| hsa-miR-587 | 5297 | 6318 | discovered in a colorectal MicroRNAome | | |
| hsa-miR-588 | 5298 | 6319 | discovered in a colorectal MicroRNAome | | |
| hsa-miR-589-3p | 5299 | 6320 | mesothelial cells | | |
| hsa-miR-589-5p | 5300 | 6321 | mesothelial cells | | |
| hsa-miR-590-3p | 5301 | 6322 | cardiomyocytes | | Cell cycle progression |
| hsa-miR-590-5p | 5302 | 6323 | cardiomyocytes | | Cell cycle progression |
| hsa-miR-591 | 5303 | 6324 | | neuroblastoma | |
| hsa-miR-592 | 5304 | 6325 | | hepatocellular carcinoma | |
| hsa-miR-593-3p | 5305 | 6326 | | esophageal cancer | |
| hsa-miR-593-5p | 5306 | 6327 | | esophageal cancer | |
| hsa-miR-595 | 5307 | 6328 | | heart failure | |
| hsa-miR-596 | 5308 | 6329 | | ependymoma, cancers | |
| hsa-miR-597 | 5309 | 6330 | discovered in a colorectal MicroRNAome | | |
| hsa-miR-598 | 5310 | 6331 | Blood (lymphocytes) | | |
| hsa-miR-599 | 5311 | 6332 | | Multiple sclerosis | |
| hsa-miR-600 | 5312 | 6333 | discovered in a colorectal MicroRNAome | | |
| hsa-miR-601 | 5313 | 6334 | | various cancers (colonrectal, gastric) | |
| hsa-miR-602 | 5314 | 6335 | oocyte | | |
| hsa-miR-603 | 5315 | 6336 | | | |
| hsa-miR-604 | 5316 | 6337 | discovered in a colorectal MicroRNAome | | |
| hsa-miR-605 | 5317 | 6338 | discovered in a colorectal MicroRNAome | | |
| hsa-miR-606 | 5318 | 6339 | discovered in a colorectal MicroRNAome | | |
| hsa-miR-6068 | 5319 | 6340 | discovered in endothelial cells | | |
| hsa-miR-6069 | 5320 | 6341 | discovered in endothelial cells | | |
| hsa-miR-607 | 5321 | 6342 | discovered in a colorectal MicroRNAome | | |

TABLE 10-continued mirs, tissues/cell expression and diseases

| microRNA | mir SEQ ID | BS SEQ ID | Tissues/cells | Associated Disease | Biological Function |
|---|---|---|---|---|---|
| hsa-miR-6070 | 5322 | 6343 | discovered in a colorectal MicroRNAome | | |
| hsa-miR-6071 | 5323 | 6344 | discovered in endothelial cells | | |
| hsa-miR-6072 | 5324 | 6345 | discovered in endothelial cells | | |
| hsa-miR-6073 | 5325 | 6346 | discovered in endothelial cells | | |
| hsa-miR-6074 | 5326 | 6347 | discovered in endothelial cells | | |
| hsa-miR-6075 | 5327 | 6348 | discovered in endothelial cells | | |
| hsa-miR-6076 | 5328 | 6349 | discovered in endothelial cells | | |
| hsa-miR-6077 | 5329 | 6350 | discovered in endothelial cells | | |
| hsa-miR-6078 | 5330 | 6351 | discovered in endothelial cells | | |
| hsa-miR-6079 | 5331 | 6352 | discovered in endothelial cells | | |
| hsa-miR-608 | 5332 | 6353 | | various cancers | |
| hsa-miR-6080 | 5333 | 6354 | discovered in endothelial cells | | |
| hsa-miR-6081 | 5334 | 6355 | discovered in endothelial cells | | |
| hsa-miR-6082 | 5335 | 6356 | discovered in endothelial cells | | |
| hsa-miR-6083 | 5336 | 6357 | discovered in endothelial cells | | |
| hsa-miR-6084 | 5337 | 6358 | discovered in endothelial cells | | |
| hsa-miR-6085 | 5338 | 6359 | discovered in endothelial cells | | |
| hsa-miR-6086 | 5339 | 6360 | embryonic stem cells | | |
| hsa-miR-6087 | 5340 | 6361 | embryonic stem cells | | |
| hsa-miR-6088 | 5341 | 6362 | embryonic stem cells | | |
| hsa-miR-6089 | 5342 | 6363 | embryonic stem cells | | |
| hsa-miR-609 | 5343 | 6364 | discovered in a colorectal MicroRNAome | | |
| hsa-miR-6090 | 5344 | 6365 | embryonic stem cells | | |
| hsa-miR-610 | 5345 | 6366 | | gastric cancer | |
| hsa-miR-611 | 5346 | 6367 | | Renal cell carcinoma | |
| hsa-miR-612 | 5347 | 6368 | | AM leukemia | |
| hsa-miR-6124 | 5348 | 6369 | | | |
| hsa-miR-6125 | 5349 | 6370 | | | |
| hsa-miR-6126 | 5350 | 6371 | | | |
| hsa-miR-6127 | 5351 | 6372 | | | |
| hsa-miR-6128 | 5352 | 6373 | | | |
| hsa-miR-6129 | 5353 | 6374 | | | |
| hsa-miR-613 | 5354 | 6375 | lipid metabollism | | |
| hsa-miR-6130 | 5355 | 6376 | | | |
| hsa-miR-6131 | 5356 | 6377 | | | |
| hsa-miR-6132 | 5357 | 6378 | | | |
| hsa-miR-6133 | 5358 | 6379 | | | |
| hsa-miR-6134 | 5359 | 6380 | | | |
| hsa-miR-614 | 5360 | 6381 | circulating micrRNAs (in Plasma) | | |
| hsa-miR-615-3p | 5361 | 6382 | | | |
| hsa-miR-615-5p | 5362 | 6383 | | | |
| hsa-miR-616-3p | 5363 | 6384 | | prostate cancer | |
| hsa-miR-6165 | 5364 | 6385 | | | Pro-apoptotic factor |
| hsa-miR-616-5p | 5365 | 6386 | | prostate cancer | |
| hsa-miR-617 | 5366 | 6387 | | | |
| hsa-miR-618 | 5367 | 6388 | | | |

TABLE 10-continued mirs, tissues/cell expression and diseases

| microRNA | mir SEQ ID | BS SEQ ID | Tissues/cells | Associated Disease | Biological Function |
|---|---|---|---|---|---|
| hsa-miR-619 | 5368 | 6389 | discovered in a colorectal MicroRNAome | | |
| hsa-miR-620 | 5369 | 6390 | discovered in a colorectal MicroRNAome | | |
| hsa-miR-621 | 5370 | 6391 | | | |
| hsa-miR-622 | 5371 | 6392 | | | |
| hsa-miR-623 | 5372 | 6393 | | | |
| hsa-miR-624-3p | 5373 | 6394 | chondrocyte | | |
| hsa-miR-624-5p | 5374 | 6395 | chondrocyte | | |
| hsa-miR-625-3p | 5375 | 6396 | liver (hepatocytes), circulating (blood) | various cancers | |
| hsa-miR-625-5p | 5376 | 6397 | liver (hepatocytes), circulating (blood) | various cancers | |
| hsa-miR-626 | 5377 | 6398 | discovered in the colorectal MicroRNAome | | |
| hsa-miR-627 | 5378 | 6399 | | colorectal cancer | |
| hsa-miR-628-3p | 5379 | 6400 | | neuroblastoma | |
| hsa-miR-628-5p | 5380 | 6401 | | neuroblastoma | |
| hsa-miR-629-3p | 5381 | 6402 | | B-lineage ALL, T cell lupus, RCC/kidney | |
| hsa-miR-629-5p | 5382 | 6403 | | B-lineage ALL, T cell lupus, RCC/kidney | |
| hsa-miR-630 | 5383 | 6404 | chondrocytes | rectal cancer | |
| hsa-miR-631 | 5384 | 6405 | discovered in the colorectal MicroRNAom | | |
| hsa-miR-632 | 5385 | 6406 | | myelodysplastic syndromes | |
| hsa-miR-633 | 5386 | 6407 | | multiple sclerosis | |
| hsa-miR-634 | 5387 | 6408 | cartilage/ chondrocyte | | |
| hsa-miR-635 | 5388 | 6409 | discovered in the colorectal MicroRNAome | | |
| hsa-miR-636 | 5389 | 6410 | | myelodysplastic syndromes | |
| hsa-miR-637 | 5390 | 6411 | discovered in the colorectal MicroRNAome | | |
| hsa-miR-638 | 5391 | 6412 | | Lupus nephritis, basal cell carcinoma | |
| hsa-miR-639 | 5392 | 6413 | discovered in the colorectal MicroRNAome | | |
| hsa-miR-640 | 5393 | 6414 | | Chronic lymphocytic leukemia | |
| hsa-miR-641 | 5394 | 6415 | cartilage/ chondrocyte | | |
| hsa-miR-642a-3p | 5395 | 6416 | adipocyte | | |
| hsa-miR-642a-5p | 5396 | 6417 | discovered in the colorectal MicroRNAome | | |
| hsa-miR-642b-3p | 5397 | 6418 | discovered in a cervial tumo | | |
| hsa-miR-642b-5p | 5398 | 6419 | discovered in a cervial tumo | | |
| hsa-miR-643 | 5399 | 6420 | discovered in the colorectal MicroRNAome | | |
| hsa-miR-644a | 5400 | 6421 | | | |
| hsa-miR-645 | 5401 | 6422 | | ovarian cancer | |
| hsa-miR-646 | 5402 | 6423 | | | |
| hsa-miR-647 | 5403 | 6424 | | prostate and lung cancer | |
| hsa-miR-648 | 5404 | 6425 | circulating micrRNAs (in Plasma) | | |

TABLE 10-continued mirs, tissues/cell expression and diseases

| microRNA | mir SEQ ID | BS SEQ ID | Tissues/cells | Associated Disease | Biological Function |
|---|---|---|---|---|---|
| hsa-miR-649 | 5405 | 6426 | Serum | | |
| hsa-miR-6499-3p | 5406 | 6427 | discovered in abnormal skin (psoriasis) | | |
| hsa-miR-6499-5p | 5407 | 6428 | discovered in abnormal skin (psoriasis) | | |
| hsa-miR-650 | 5408 | 6429 | | melanoma | |
| hsa-miR-6500-3p | 5409 | 6430 | discovered in abnormal skin (psoriasis) | | |
| hsa-miR-6500-5p | 5410 | 6431 | discovered in abnormal skin (psoriasis) | | |
| hsa-miR-6501-3p | 5411 | 6432 | discovered in abnormal skin (psoriasis) | | |
| hsa-miR-6501-5p | 5412 | 6433 | discovered in abnormal skin (psoriasis) | | |
| hsa-miR-6502-3p | 5413 | 6434 | discovered in abnormal skin (psoriasis) | | |
| hsa-miR-6502-5p | 5414 | 6435 | discovered in abnormal skin (psoriasis) | | |
| hsa-miR-6503-3p | 5415 | 6436 | discovered in abnormal skin (psoriasis) | | |
| hsa-miR-6503-5p | 5416 | 6437 | discovered in abnormal skin (psoriasis) | | |
| hsa-miR-6504-3p | 5417 | 6438 | discovered in abnormal skin (psoriasis) | | |
| hsa-miR-6504-5p | 5418 | 6439 | discovered in abnormal skin (psoriasis) | | |
| hsa-miR-6505-3p | 5419 | 6440 | discovered in abnormal skin (psoriasis) | | |
| hsa-miR-6505-5p | 5420 | 6441 | discovered in abnormal skin (psoriasis) | | |
| hsa-miR-6506-3p | 5421 | 6442 | discovered in abnormal skin (psoriasis) | | |
| hsa-miR-6506-5p | 5422 | 6443 | discovered in abnormal skin (psoriasis) | | |
| hsa-miR-6507-3p | 5423 | 6444 | discovered in abnormal skin (psoriasis) | | |
| hsa-miR-6507-5p | 5424 | 6445 | discovered in abnormal skin (psoriasis) | | |
| hsa-miR-6508-3p | 5425 | 6446 | discovered in abnormal skin (psoriasis) | | |
| hsa-miR-6508-5p | 5426 | 6447 | discovered in abnormal skin (psoriasis) | | |
| hsa-miR-6509-3p | 5427 | 6448 | discovered in abnormal skin (psoriasis) | | |
| hsa-miR-6509-5p | 5428 | 6449 | discovered in abnormal skin (psoriasis) | | |
| hsa-miR-651 | 5429 | 6450 | discovered in the colorectal MicroRNAome | lung cancer | |
| hsa-miR-6510-3p | 5430 | 6451 | discovered in abnormal skin (psoriasis) | | |

TABLE 10-continued mirs, tissues/cell expression and diseases

| microRNA | mir SEQ ID | BS SEQ ID | Tissues/cells | Associated Disease | Biological Function |
|---|---|---|---|---|---|
| hsa-miR-6510-5p | 5431 | 6452 | discovered in abnormal skin (psoriasis) | | |
| hsa-miR-6511a-3p | 5432 | 6453 | discovered in abnormal skin (psoriasis) and epididymis | | |
| hsa-miR-6511a-5p | 5433 | 6454 | discovered in abnormal skin (psoriasis) and epididymis | | |
| hsa-miR-6511b-3p | 5434 | 6455 | discovered in epididymis | | |
| hsa-miR-6511b-5p | 5435 | 6456 | discovered in epididymis | | |
| hsa-miR-6512-3p | 5436 | 6457 | discovered in abnormal skin (psoriasis) | | |
| hsa-miR-6512-5p | 5437 | 6458 | discovered in abnormal skin (psoriasis) | | |
| hsa-miR-6513-3p | 5438 | 6459 | discovered in abnormal skin (psoriasis) | | |
| hsa-miR-6513-5p | 5439 | 6460 | discovered in abnormal skin (psoriasis) | | |
| hsa-miR-6514-3p | 5440 | 6461 | discovered in abnormal skin (psoriasis) | | |
| hsa-miR-6514-5p | 5441 | 6462 | discovered in abnormal skin (psoriasis) | | |
| hsa-miR-6515-3p | 5442 | 6463 | discovered in abnormal skin (psoriasis) and epididymis | | |
| hsa-miR-6515-5p | 5443 | 6464 | discovered in abnormal skin (psoriasis) and epididymis | | |
| hsa-miR-652-3p | 5444 | 6465 | | rectal cancer cells | |
| hsa-miR-652-5p | 5445 | 6466 | | rectal cancer cells | |
| hsa-miR-653 | 5446 | 6467 | Discovered in the colorectal MicroRNAome | | |
| hsa-miR-654-3p | 5447 | 6468 | Discovered in the colorectal MicroRNAome | | |
| hsa-miR-654-5p | 5448 | 6469 | bone marrow | prostate cancer | |
| hsa-miR-655 | 5449 | 6470 | | | |
| hsa-miR-656 | 5450 | 6471 | | various cancers | |
| hsa-miR-657 | 5451 | 6472 | oligodendrocytes | diabetes | |
| hsa-miR-658 | 5452 | 6473 | | gastric cancer | |
| hsa-miR-659-3p | 5453 | 6474 | myoblast | | |
| hsa-miR-659-5p | 5454 | 6475 | myoblast | | |
| hsa-miR-660-3p | 5455 | 6476 | myoblast | | |
| hsa-miR-660-5p | 5456 | 6477 | myoblast | | |
| hsa-miR-661 | 5457 | 6478 | | breast cancer | |
| hsa-miR-662 | 5458 | 6479 | endothelial progenitor cells, oocytes | | |
| hsa-miR-663a | 5459 | 6480 | | follicular lymphoma, Lupus nephritis | |
| hsa-miR-663b | 5460 | 6481 | | follicular lymphoma, Lupus nephritis | |
| hsa-miR-664a-3p | 5461 | 6482 | embryonic stem cells | | component of SnoRNAs |
| hsa-miR-664a-5p | 5462 | 6483 | embryonic stem cells | | component of SnoRNAs |
| hsa-miR-664b-3p | 5463 | 6484 | embryonic stem cells | | component of SnoRNAs |

TABLE 10-continued mirs, tissues/cell expression and diseases

| microRNA | mir SEQ ID | BS SEQ ID | Tissues/cells | Associated Disease | Biological Function |
|---|---|---|---|---|---|
| hsa-miR-664b-5p | 5464 | 6485 | embryonic stem cells | | component of SnoRNAs |
| hsa-miR-665 | 5465 | 6486 | | breast cancer | |
| hsa-miR-668 | 5466 | 6487 | keratinocytes | | senescence |
| hsa-miR-670 | 5467 | 6488 | | | |
| hsa-miR-671-3p | 5468 | 6489 | | | |
| hsa-miR-6715a-3p | 5469 | 6490 | discovered in epididymis | | |
| hsa-miR-6715b-3p | 5470 | 6491 | discovered in epididymis | | |
| hsa-miR-6715b-5p | 5471 | 6492 | discovered in epididymis | | |
| hsa-miR-671-5p | 5472 | 6493 | | rectal cancer, prolactinomas | |
| hsa-miR-6716-3p | 5473 | 6494 | discovered in epididymis | | |
| hsa-miR-6716-5p | 5474 | 6495 | discovered in epididymis | | |
| hsa-miR-6717-5p | 5475 | 6496 | discovered in epididymis | | |
| hsa-miR-6718-5p | 5476 | 6497 | discovered in epididymis | | |
| hsa-miR-6719-3p | 5477 | 6498 | discovered in epididymis | | |
| hsa-miR-6720-3p | 5478 | 6499 | discovered in epididymis | | |
| hsa-miR-6721-5p | 5479 | 6500 | discovered in epididymis | | |
| hsa-miR-6722-3p | 5480 | 6501 | discovered in epididymis | | |
| hsa-miR-6722-5p | 5481 | 6502 | discovered in epididymis | | |
| hsa-miR-6723-5p | 5482 | 6503 | discovered in epididymis | | |
| hsa-miR-6724-5p | 5483 | 6504 | discovered in epididymis | | |
| hsa-miR-675-3p | 5484 | 6505 | | adrenocortical tumor | |
| hsa-miR-675-5p | 5485 | 6506 | | adrenocortical tumor | |
| hsa-miR-676-3p | 5486 | 6507 | discovered in female reproductuve tract | | |
| hsa-miR-676-5p | 5487 | 6508 | discovered in female reproductuve tract | | |
| hsa-miR-708-3p | 5488 | 6509 | | Various cancers (lung, bladder, pancreatic, ALL) | |
| hsa-miR-708-5p | 5489 | 6510 | | Various cancers (lung, bladder, pancreatic, ALL) | |
| hsa-miR-711 | 5490 | 6511 | | cutaneous T-cell lymphomas | |
| hsa-miR-7-1-3p | 5491 | 6512 | Glioblast, brain, prancreas | | |
| hsa-miR-718 | 5492 | 6513 | blood | | |
| hsa-miR-7-2-3p | 5493 | 6514 | brain, pancreas | | |
| hsa-miR-744-3p | 5494 | 6515 | heart | | |
| hsa-miR-744-5p | 5495 | 6516 | embryonic stem cells, heart | | |
| hsa-miR-758-3p | 5496 | 6517 | cholesterol regulation and brain | | |
| hsa-miR-758-5p | 5497 | 6518 | cholesterol regulation and brain | | |
| hsa-miR-759 | 5498 | 6519 | | | |
| hsa-miR-7-5p | 5499 | 6520 | brain | | |
| hsa-miR-760 | 5500 | 6521 | | colonrectal and breast cancer | |
| hsa-miR-761 | 5501 | 6522 | | | |
| hsa-miR-762 | 5502 | 6523 | corneal epithelial cells | | |
| hsa-miR-764 | 5503 | 6524 | osteoblast | | |
| hsa-miR-765 | 5504 | 6525 | | rectal cancer | |

TABLE 10-continued mirs, tissues/cell expression and diseases

| microRNA | mir SEQ ID | BS SEQ ID | Tissues/cells | Associated Disease | Biological Function |
|---|---|---|---|---|---|
| hsa-miR-766-3p | 5505 | 6526 | embryonic stem cells | | |
| hsa-miR-766-5p | 5506 | 6527 | embryonic stem cells | | |
| hsa-miR-767-3p | 5507 | 6528 | / | | |
| hsa-miR-767-5p | 5508 | 6529 | / | | |
| hsa-miR-769-3p | 5509 | 6530 | | | |
| hsa-miR-769-5p | 5510 | 6531 | | | |
| hsa-miR-770-5p | 5511 | 6532 | | | |
| hsa-miR-802 | 5512 | 6533 | brain, epithelial cells, hepatocytes | down symdrome | |
| hsa-miR-873-3p | 5513 | 6534 | | | |
| hsa-miR-873-5p | 5514 | 6535 | | | |
| hsa-miR-874 | 5515 | 6536 | | cervical cancer, lung cancer, carcinoma | |
| hsa-miR-875-3p | 5516 | 6537 | | | |
| hsa-miR-875-5p | 5517 | 6538 | | | |
| hsa-miR-876-3p | 5518 | 6539 | | | |
| hsa-miR-876-5p | 5519 | 6540 | | | |
| hsa-miR-877-3p | 5520 | 6541 | | | |
| hsa-miR-877-5p | 5521 | 6542 | | | |
| hsa-miR-885-3p | 5522 | 6543 | embryonic stem cells | | |
| hsa-miR-885-5p | 5523 | 6544 | embryonic stem cells | | |
| hsa-miR-887 | 5524 | 6545 | | | |
| hsa-miR-888-3p | 5525 | 6546 | | | |
| hsa-miR-888-5p | 5526 | 6547 | | | |
| hsa-miR-889 | 5527 | 6548 | | | |
| hsa-miR-890 | 5528 | 6549 | epididymis | | |
| hsa-miR-891a | 5529 | 6550 | epididymis | osteosarcoma | |
| hsa-miR-891b | 5530 | 6551 | epididymis | | |
| hsa-miR-892a | 5531 | 6552 | epididymis | | |
| hsa-miR-892b | 5532 | 6553 | epididymis | | |
| hsa-miR-892c-3p | 5533 | 6554 | discovered in epididymis | | |
| hsa-miR-892c-5p | 5534 | 6555 | discovered in epididymis | | |
| hsa-miR-920 | 5535 | 6556 | human testis | | |
| hsa-miR-921 | 5536 | 6557 | human testis | muscle invasive bladder cancer | |
| hsa-miR-922 | 5537 | 6558 | human testis, neuronal tissues | multiple sclerosis, Alcoholic liver disease | |
| hsa-miR-924 | 5538 | 6559 | human testis | | |
| hsa-miR-92a-1-5p | 5539 | 6560 | endothelial cells | | |
| hsa-miR-92a-2-5p | 5540 | 6561 | endothelial cells | | |
| hsa-miR-92a-3p | 5541 | 6562 | endothelial cells, CNS | | |
| hsa-miR-92b-3p | 5542 | 6563 | endothelial cells, heart | | |
| hsa-miR-92b-5p | 5543 | 6564 | endothelial cells, heart | | |
| hsa-miR-933 | 5544 | 6565 | discovered in cervical cancer | | |
| hsa-miR-93-3p | 5545 | 6566 | embryonic stem cells | basal cell carcinoma | |
| hsa-miR-934 | 5546 | 6567 | discovered in cervical cancer | | |
| hsa-miR-935 | 5547 | 6568 | blood monoclear cells | energy metabolism/ obesity, medullablastoma/ neural stem cells | |
| hsa-miR-93-5p | 5548 | 6569 | embryonic stem cells | | |
| hsa-miR-936 | 5549 | 6570 | skin | | |
| hsa-miR-937-3p | 5550 | 6571 | | cervical cancer | |
| hsa-miR-937-5p | 5551 | 6572 | | cervical cancer | |
| hsa-miR-938 | 5552 | 6573 | | Various cancer cells | |
| hsa-miR-939-3p | 5553 | 6574 | hepatocytes | | |
| hsa-miR-939-5p | 5554 | 6575 | hepatocytes | | |

TABLE 10-continued mirs, tissues/cell expression and diseases

| microRNA | mir SEQ ID | BS SEQ ID | Tissues/cells | Associated Disease | Biological Function |
|---|---|---|---|---|---|
| hsa-miR-9-3p | 5555 | 6576 | brain | Cancers and brain diseases | |
| hsa-miR-940 | 5556 | 6577 | identified in Cervical cancer | | |
| hsa-miR-941 | 5557 | 6578 | Embryonic stem cells | | |
| hsa-miR-942 | 5558 | 6579 | | lung cancer | |
| hsa-miR-943 | 5559 | 6580 | identified in Cervical cancer | | |
| hsa-miR-944 | 5560 | 6581 | | various cancers (cervical, pancreatic, colonrectal) | |
| hsa-miR-95 | 5561 | 6582 | | various cancers (pancreatic, glioblastoma, colorectal etc) | |
| hsa-miR-9-5p | 5562 | 6583 | brain | Cancers and brain disease | |
| hsa-miR-96-3p | 5563 | 6584 | stem cells | various cancers (prostate, lymphoma, HCC, etc) and inflammation | |
| hsa-miR-96-5p | 5564 | 6585 | stem cells | various cancers (prostate, lymphoma, HCC, etc) and inflammation | |
| hsa-miR-98-3p | 5565 | 6586 | | various cancer cells | apoptosis |
| hsa-miR-98-5p | 5566 | 6587 | | various cancer cells | apoptosis |
| hsa-miR-99a-3p | 5567 | 6588 | hemapoietic cells | | |
| hsa-miR-99a-5p | 5568 | 6589 | hemapoietic cells | | |
| hsa-miR-99b-3p | 5569 | 6590 | hemapoietic cells, embryonic stem cells | | |
| hsa-miR-99b-5p | 5570 | 6591 | hemapoietic cells, embryonic stem cells | | |

MicroRNAs that are enriched in specific types of immune cells are listed in Table 11. Furthermore, novel miroRNAs are discovered in the immune cells in the art through micro-array hybridization and microtome analysis (Jima D D et al, Blood, 2010, 116:e118-e127; Vaz C et al., BMC Genomics, 2010, 11,288, the content of each of which is incorporated herein by reference in its entirety). In Table 11, "HCC" represents hepatocellular carcinoma, "ALL" stands for acute lymphoblastic leukemia and "CLL" stands for chromic lymphocytic leukemia.

TABLE 11 microRNAs in immune cells

| microRNA | mir SEQ ID | BS SEQ ID | tissues/cells with MicroRNAs | associated diseases | biological functions/targets |
|---|---|---|---|---|---|
| hsa-let-7a-2-3p | 2508 | 3529 | embryonic stem cells, lung, myeloid cells | inflammatory, various cancers (lung, cervical, breast, pancreatic, etc) | tumor suppressor, target to c-myc |
| hsa-let-7a-3p | 2509 | 3530 | embryonic stem cell, lung, myeloid cells | inflammatory, various cancers (lung, cervical, breast, pancreatic, etc) | tumor suppressor, target to c-myc |
| hsa-let-7a-5p | 2510 | 3531 | embryonic stem cells, lung, myeloid cells | inflammatory, various cancers (lung, cervical, breast, pancreatic, etc) | tumor suppressor, target to c-myc |

TABLE 11-continued microRNAs in immune cells

| microRNA | mir SEQ ID | BS SEQ ID | tissues/cells with MicroRNAs | associated diseases | biological functions/targets |
|---|---|---|---|---|---|
| hsa-let-7c | 2513 | 3534 | dendritic cells | various cacners (cervical, pancreatic, lung, esopphageal, etc) | tumor suppressor apoptosis (target to BCL-x1) |
| hsa-let-7e-3p | 2516 | 3537 | immune cells | various cancer cells, autoimmunity TLR signal pathway in endotoxin tolerance | tumor suppressor |
| hsa-let-7e-5p | 2517 | 3538 | immune cells | associated with various cancer cells | tumor suppressor |
| hsa-let-7f-1-3p | 2518 | 3539 | immune cells (T cells) | associated with various cancer cells | tumor suppressor |
| hsa-let-7f-2-3p | 2519 | 3540 | immune cells (T cells) | associated with various cancer cells | tumor suppressor |
| hsa-let-7f-5p | 2520 | 3541 | immune cells (T cells) | associated with various cancer cells | tumor suppressor |
| hsa-let-7g-3p | 2521 | 3542 | hematopoietic cells, adipose, smooth muscle cells | various cancer cells (lung, breast, etc) | tumor suppressor (target to NFkB, LOX1) |
| hsa-let-7g-5p | 2522 | 3543 | hematopoietic cells, adipose, smooth muscle cells | various cancer cells (lung, breast, etc) | tumor suppressor (target to NFkB, LOX1) |
| hsa-let-7i-3p | 2523 | 3544 | immune cells | chronic lymphocyte leukimia | tumor suppressor |
| hsa-let-7i-5p | 2524 | 3545 | immune cells | chronic lymphocyte leukimia | tumor suppressor |
| hsa-miR-10a-3p | 2530 | 3551 | hematopoeitic cells | acute myeoid leukemia | oncogene, cell growth |
| hsa-miR-10a-5p | 2541 | 3562 | hematopoietic cells | acute myeloid leukemia | oncogene, cell growth |
| hsa-miR-1184 | 2551 | 3572 | Hematopoietic cells | downregulated in oral leukoplakia (OLK) | predited in the intron 22 of F8 gene |
| hsa-miR-125b-1-3p | 2616 | 3637 | hematopoietic cells (monocytes), brain (neuron) | various cancer (ALL, prostate, HCC, etc); TLR signal pathway in endotoxin tolerance | oncogene, cell differentiation |
| hsa-miR-125b-2-3p | 2617 | 3638 | hematopoietic cells (monocytes), brain (neuron) | various cancer (ALL, prostate, HCC etc); TLR signal pathway in endotoxin tolerance | oncogene cell differentiation |
| hsa-miR-125b-5p | 2618 | 3639 | hematopoietic cells, brain (neuron) | various cancer (Cutaneous T cell lymphomas, prostate, HCC, etc); TLR signal pathway in endotoxin tolerance | oncogene cell differentiation |
| hsa-miR-1279 | 2652 | 3673 | monocytes | | |
| hsa-miR-130a-3p | 2690 | 3711 | lung, monocytes, vascular endothelial cells | various cancers (basal cell carcinoma, HCC, ovarian, etc), drug resistance | pro-angiogenic |
| hsa-miR-130a-5p | 2691 | 3712 | lung, monocytes, vasscular endothelial cells | various cancers (basal cell carcinoma, HCC, ovarian, etc), drug resistance | pro-angiogenic |
| hsa-miR-132-3p | 2697 | 3718 | brain (neuron), immune cells | | |
| hsa-miR-132-5p | 2699 | 3720 | brain (neuron), immune cells | | |
| hsa-miR-142-3p | 2720 | 3741 | meyloid cells, hematopoiesis, APC cells | | tumor suppressor, immune response |

TABLE 11-continued microRNAs in immune cells

| microRNA | mir SEQ ID | BS SEQ ID | tissues/cells with MicroRNAs | associated diseases | biological functions/targets |
|---|---|---|---|---|---|
| hsa-miR-142-5p | 2721 | 3742 | meyloid cells, hematopoiesis, APC cells | | immune response |
| hsa-miR-143-5p | 2723 | 3744 | vascular smooth muscle, T-cells | increased in serum after virus infection | |
| hsa-miR-146a-3p | 2730 | 3751 | immune cells, hematopoiesis, cartilage, | associated with CLL, TLR signal pathway in endotoxin tolerance | |
| hsa-miR-146a-5p | 2731 | 3752 | immune cells, hematopoiesis, cartilage, | associated with CLL, TLR signal pathway in endotoxin tolerance | |
| hsa-miR-146b-3p | 2732 | 3753 | immune cells | cancers (thyroid carcimona) | immune response |
| hsa-miR-146b-5p | 2733 | 3754 | embryoid body cells | thyroid cancer, associated with CLL | tumor invation, migration |
| hsa-miR-147a | 2736 | 3757 | Macrophage | inflammatory response | |
| hsa-miR-147b | 2737 | 3758 | Macrophage | inflammatory response | |
| hsa-miR-148a-3p | 2738 | 3759 | hematopoietic cells | associated with CLL, T-lineage ALL | |
| hsa-miR-148a-5p | 2739 | 3760 | hematopoietic cells | associated with CLL, T-lineage ALL | |
| hsa-miR-150-3p | 2744 | 3765 | hematopoitic cells (lymphoid) | circulating plasma (acute myeloid leukemia) | |
| hsa-miR-150-5p | 2745 | 3766 | hematopoitic cells (lymphoid) | circulating plasma (acute myeloid leukemia) | |
| hsa-miR-151b | 2748 | 3769 | immune cells (B-cells) | | |
| hsa-miR-155-3p | 2756 | 3777 | T/B cells, monocytes, breast | associated with CLL, TLR signal pathway in endotoxin tolerance; upregulated in B cell lymphoma (CLL) and other cancers (breast, lung, ovarian, cervical, colorectal, prostate) | |
| hsa-miR-155-5p | 2757 | 3778 | T/B cells, monocytes, breast | associated with CLL, TLR signal pathway in endotoxin tolerance, upregulated in B cell lymphoma (CLL) and other cancers (breast, lung, ovarian, cervical, colorectal, prostate) | |
| hsa-miR-15a-3p | 2759 | 3780 | blood, lymphocyte, hematopoietic tissues (spleen) | chronic lymphocytic leukemia | |
| hsa-miR-15a-5p | 2760 | 3781 | blood, lymphocyte, hematopoietic tissues (spleen) | chronic lymphocytic leukemia | |
| hsa-miR-15b-3p | 2761 | 3782 | blood, lymphocyte, hematopoietic tissues (spleen) | | cell cycle, proliferation |
| hsa-miR-15b-5p | 2762 | 3783 | blood, lymphocyte, hematopoietic tissues (spleen) | | cell cycle, proliferation |

TABLE 11-continued microRNAs in immune cells

| microRNA | mir SEQ ID | BS SEQ ID | tissues/cells with MicroRNAs | associated diseases | biological functions/targets |
|---|---|---|---|---|---|
| hsa-miR-16-1-3p | 2763 | 3784 | embryonic stem cells, blood, hematopoietic tissues (spleen) | chronic lymphocytic leukemia | |
| hsa-miR-16-2-3p | 2764 | 3785 | blood, lymphocyte, hematopoietic tissues (spleen) | | |
| hsa-miR-16-5p | 2765 | 3786 | blood, lymphocyte, hematopoietic tissues | | |
| hsa-miR-181a-3p | 2769 | 3790 | glioblast, myeloid cells, Embryonic stem cells | | |
| hsa-miR-181a-5p | 2770 | 3791 | glioblast, myeloid cells, Embryonic stem cells | | |
| hsa-miR-182-3p | 2776 | 3797 | immune cells | colonrectal cancer, autoimmne | immune response |
| hsa-miR-182-5p | 2778 | 3799 | lung, immune cells | autoimmune | immune response |
| hsa-miR-197-3p | 2827 | 3848 | blood (myeloid), other tissues | various cancers (thyroid tumor, leukemia, etc) | |
| hsa-miR-197-5p | 2828 | 3849 | blood (myeloid), other tissues | various cancers (thyroid tumor, leukemia, etc) | |
| hsa-miR-21-3p | 2879 | 3099 | glioblast, Blood (meyloid cells), liver, vascular endothelial cells | autoimmune, heart diseases, cancers | |
| hsa-miR-214-3p | 2880 | 3901 | immune cells, pancreas | varioua cancers (melanoma, pancreatic, ovarian) | immune response |
| hsa-miR-214-5p | 2881 | 3902 | immune cells, pancreas | varioua cancers (melanoma, pancreatic, ovarian) | immune response |
| hsa-miR-21-5p | 2883 | 3904 | blood (myeloid cells), liver, endothelial cells | autoimmune, heart diseases, cancers | |
| hsa-miR-221-3p | 2894 | 3915 | endothelial cells, immune cells | breast cancer, upregulated in thyroid cell transformation induced by HMGA1, TLR signal pathway in endotoxin tolerance, upregulated in T cell ALL | angiogenesis/vasculogenesis |
| hsa-miR-221-5p | 2895 | 3916 | endothelial cells, immune cells | breast cancer, upregulated in thyroid cell transformation induced by HMGA1, TLR signal pathway in endotoxin tolerance, upregulated in T cell ALL | angiogenesis/vasculogenesis |
| hsa-miR-223-3p | 2898 | 3919 | meyloid cells | associated with CLL | |
| hsa-miR-223-5p | 2899 | 3920 | meyloid cells | associated with CLL | |
| hsa-miR-23b-3p | 2913 | 3934 | blood, myeloid cells | cancers (renal cancer, glioblastoma, prostate, etc) and autoimmune | |

TABLE 11-continued microRNAs in immune cells

| microRNA | mir SEQ ID | BS SEQ ID | tissues/cells with MicroRNAs | associated diseases | biological functions/targets |
|---|---|---|---|---|---|
| hsa-miR-23b-5p | 2914 | 3935 | blood, myeloid cells | cancers (glioblastoma, prostate, etc) and autoimmune | |
| hsa-miR-24-1-5p | 2916 | 3937 | lung, myeloid cells | | |
| hsa-miR-24-2-5p | 2917 | 3938 | lung, myeloid cells | | |
| hsa-miR-24-3p | 2918 | 3939 | lung, myeloid cells | | |
| hsa-miR-26a-1-3p | 2927 | 3948 | embryonic stem cells, blood (T cells) | chronic lymphocyte leukemia and other cancers | cell cycle and differentiation |
| hsa-miR-26a-2-3p | 2928 | 3949 | blood (Tcells), other tissues | chronic lymphocyte leukemia and other cancers | cell cycle and differentiation |
| hsa-miR-26a-5p | 2929 | 3950 | blood (Tcells), other tissues | chronic lymphocyte leukemia and other cancers | cell cycle and differentiation |
| hsa-miR-26b-3p | 2930 | 3951 | hematopoietic cells | | |
| hsa-miR-26b-5p | 2931 | 3952 | hematopoietic cells | | |
| hsa-miR-27a-3p | 2932 | 3953 | myeloid cells | various cancer cells | |
| hsa-miR-27a-5p | 2933 | 3954 | myeloid cells | various cancer cells | |
| hsa-miR-27b-3p | 2934 | 3955 | myeloid cells, vascular endothelial cells | various cancer cells | pro-angiogenic |
| hsa-miR-28-3p | 2936 | 3957 | blood(immune cells) | B/T cell lymphoma | |
| hsa-miR-28-5p | 2937 | 3958 | blood(immune cells) | B/T cell lymphoma | |
| hsa-miR-2909 | 2939 | 3960 | T-Lymphocytes | | |
| hsa-miR-29a-3p | 2948 | 3969 | immuno system, colonrectun | various cancers, neurodegenerative disease | tumor suppression, immune modulation (mir-29 family) |
| hsa-miR-29a-5p | 2949 | 3970 | immuno system, colonrectun | various cancers, neurodegenerative disease | adaptive immunity |
| hsa-miR-29b-1-5p | 2950 | 3971 | immuno system | associated with CLL, other cancers, neurodegenerative disease | adaptive immunity |
| hsa-miR-29b-2-5p | 2951 | 3972 | immuno system | associated with CLL, other cancers, | adaptive immunity |
| hsa-miR-29b-3p | 2952 | 3973 | immuno system | associated with CLL, other cancers | adaptive immunity |
| hsa-miR-29c-3p | 2953 | 3974 | immuno system | associated with CLL, other cancers | adaptive immunity |
| hsa-miR-29c-5p | 2954 | 3975 | immuno system | associated with CLL, other cancers | adaptive immunity |
| hsa-miR-30e-3p | 2984 | 4005 | myeloid cells, glia cells | | |
| hsa-miR-30e-5p | 2985 | 4006 | myeloid cells, glia cells | | |
| hsa-miR-331-5p | 3130 | 4151 | lymphocytes | | |
| hsa-miR-339-3p | 3137 | 4158 | immune cells | | |
| hsa-miR-339-5p | 3138 | 4159 | immune cells | | |
| hsa-miR-345-3p | 3147 | 4168 | hematopoietic cells | increased in follicular lymphoma (53), other cancers | |
| hsa-miR-345-5p | 3148 | 4169 | hematopoietic cells | increased in follicular lymphoma (53) | |
| hsa-miR-346 | 3149 | 4170 | immume cells | cancers and autoimmune | |
| hsa-miR-34a-3p | 3150 | 4171 | breast, myeloid cells, ciliated epithelial cells | gastric cancer, CLL, other | tumor suppressor, p53 inducible |
| hsa-miR-34a-5p | 3151 | 4172 | breast, myeloid cells, ciliated epithelial cells | gastric cancer, CLL, other | tumor suppressor, p53 inducible |

TABLE 11-continued microRNAs in immune cells

| microRNA | mir SEQ ID | BS SEQ ID | tissues/cells with MicroRNAs | associated diseases | biological functions/targets |
|---|---|---|---|---|---|
| hsa-miR-363-3p | 3193 | 4214 | kidney stem cell, blood cells | | |
| hsa-miR-363-5p | 3194 | 4215 | kidney stem cell, blood cells | | |
| hsa-miR-372 | 3277 | 4298 | hematopoietic cells, lung, placental (blood) | | |
| hsa-miR-377-3p | 3294 | 4315 | hematopoietic cells | | |
| hsa-miR-377-5p | 3295 | 4316 | hematopoietic cells | | |
| hsa-miR-493-3p | 4947 | 5968 | myeloid cells, pancreas (islet) | | |
| hsa-miR-493-5p | 4948 | 5969 | myeloid cells, pancreas (islet) | | |
| hsa-miR-542-3p | 5106 | 6127 | monocytes | | targets to survivin, introduce growth arrest |
| hsa-miR-548b-5p | 5157 | 6178 | immune cells frontal cortex | | |
| hsa-miR-548c-5p | 5159 | 6180 | immune cells frontal cortex | | |
| hsa-miR-548i | 5168 | 6189 | embryonic stem cells (41), immune cells | | |
| hsa-miR-548j | 5169 | 6190 | immune cells | | |
| hsa-miR-548n | 5173 | 6194 | embryonic stem cells, immune cells | | |
| hsa-miR-574-3p | 5279 | 6300 | blood (myeloid cells) | increased in follicular lymphoma (53) | |
| hsa-miR-598 | 5310 | 6331 | in blood lymphocytes (PBL) | | |
| hsa-miR-935 | 5547 | 6568 | identified in human cervical cancer blood mononuclear cells | associated with energy metabolism/obesity, medullablastoma/neural stem cells | |
| hsa-miR-99a-3p | 5567 | 6588 | hemapoietic cells | | |
| hsa-miR-99a-5p | 5568 | 6589 | hemapoietic cells, plasma (exosome) | | |
| hsa-miR-99b-3p | 5569 | 6590 | hemapoietic cells, Embryonic stem cells, | | |
| hsa-miR-99b-5p | 5570 | 6591 | hemapoietic cells, Embryonic stem cells, plasma (exosome) | | |

III. Modifications

Herein, in a signal-sensor polynucleotide (such as a primary construct or a mRNA molecule), the terms "modification" or, as appropriate, "modified" refer to modification with respect to A, G, U or C ribonucleotides. Generally, herein, these terms are not intended to refer to the ribonucleotide modifications in naturally occurring 5'-terminal mRNA cap moieties. In a polypeptide, the term "modification" refers to a modification as compared to the canonical set of 20 amino acids.

The modifications may be various distinct modifications. In some embodiments, the coding region, the flanking regions and/or the terminal regions may contain one, two, or more (optionally different) nucleoside or nucleotide modifications. In some embodiments, a modified signal-sensor polynucleotide, primary construct, or mmRNA introduced to a cell may exhibit reduced degradation in the cell, as compared to an unmodified signal-sensor polynucleotide, primary construct, or mmRNA.

The signal-sensor polynucleotides, primary constructs, and mmRNA can include any useful modification, such as to the sugar, the nucleobase, or the internucleoside linkage (e.g. to a linking phosphate/to a phosphodiester linkage/to the phosphodiester backbone). One or more atoms of a pyrimidine nucleobase may be replaced or substituted with optionally substituted amino, optionally substituted thiol, optionally substituted alkyl (e.g., methyl or ethyl), or halo (e.g., chloro or fluoro). In certain embodiments, modifications (e.g., one or more modifications) are present in each of the sugar and the internucleoside linkage. Modifications according to the present invention may be modifications of ribonucleic acids (RNAs) to deoxyribonucleic acids (DNAs), threose nucleic acids (TNAs), glycol nucleic acids (GNAs), peptide nucleic acids (PNAs), locked nucleic acids (LNAs) or hybrids thereof). Additional modifications are described herein.

As described herein, in some embodiments, the signal-sensor polynucleotides, primary constructs, and mmRNA of the invention do not substantially induce an innate immune response of a cell into which the mRNA is introduced. Features of an induced innate immune response include 1) increased expression of pro-inflammatory cytokines, 2) activation of intracellular PRRs (RIG-I, MDA5, etc, and/or 3) termination or reduction in protein translation. In other embodiments, an immune response is induced.

In certain embodiments, it may desirable to intracellularly degrade a modified nucleic acid molecule introduced into the cell. For example, degradation of a modified nucleic acid molecule may be preferable if precise timing of protein production is desired. Thus, in some embodiments, the invention provides a modified nucleic acid molecule containing a degradation domain, which is capable of being acted on in a directed manner within a cell.

In another aspect, the present disclosure provides signal-sensor polynucleotides comprising a nucleoside or nucleotide that can disrupt the binding of a major groove interacting, e.g. binding, partner with the polynucleotide (e.g., where the modified nucleotide has decreased binding affinity to major groove interacting partner, as compared to an unmodified nucleotide).

The signal-sensor polynucleotides, primary constructs, and mmRNA can optionally include other agents (e.g., RNAi-inducing agents, RNAi agents, siRNAs, shRNAs, miRNAs, antisense RNAs, ribozymes, catalytic DNA, tRNA, RNAs that induce triple helix formation, aptamers, vectors, etc.). In some embodiments, the signal-sensor polynucleotides, primary constructs, or mmRNA may include one or more messenger RNAs (mRNAs) and one or more modified nucleoside or nucleotides (e.g., mmRNA molecules). Details for these signal-sensor polynucleotides, primary constructs, and mmRNA follow.

Signal-Sensor Polynucleotides and Primary Constructs

The signal-sensor polynucleotides, primary constructs, and mmRNA of the invention includes a first region of linked nucleosides encoding an oncology-related polypeptide of interest, a first flanking region located at the 5' terminus of the first region, and a second flanking region located at the 3' terminus of the first region.

In some embodiments, the signal-sensor polynucleotide, primary construct, or mmRNA are constructed according to the methods and modifications of International Application PCT/US12/058519 filed Oct. 3, 2012 (M9), the contents of which are incorporated herein by reference in their entirety.

The signal-sensor polynucleotides, primary constructs, and mmRNA can optionally include 5' and/or 3' flanking regions, which are described herein.

Signal-Sensor Modified RNA (mmRNA) Molecules

The present invention also includes the building blocks, e.g., modified ribonucleosides, modified ribonucleotides, of modified signal-sensor mRNA (mmRNA) molecules. For example, these building blocks can be useful for preparing the signal-sensor polynucleotides, primary constructs, or mmRNA of the invention. Such building blocks are taught in co-pending International Application PCT/US12/058519 filed Oct. 3, 2012 (M9), the contents of which are incorporated herein by reference in their entirety.

Modifications on the Nucleobase

The present disclosure provides for modified nucleosides and nucleotides. As described herein "nucleoside" is defined as a compound containing a sugar molecule (e.g., a pentose or ribose) or a derivative thereof in combination with an organic base (e.g., a purine or pyrimidine) or a derivative thereof (also referred to herein as "nucleobase"). As described herein, "nucleotide" is defined as a nucleoside including a phosphate group. In some embodiments, the nucleosides and nucleotides described herein are generally chemically modified on the major groove face. Exemplary non-limiting modifications include an amino group, a thiol group, an alkyl group, a halo group, or any described herein. The modified nucleotides may by synthesized by any useful method, as described herein (e.g., chemically, enzymatically, or recombinantly to include one or more modified or non-natural nucleosides).

The modified nucleosides and nucleotides can include a modified nucleobase. Examples of nucleobases found in RNA include, but are not limited to, adenine, guanine, cytosine, and uracil. Examples of nucleobase found in DNA include, but are not limited to, adenine, guanine, cytosine, and thymine. These nucleobases can be modified or wholly replaced to provide signal-sensor polynucleotides, primary constructs, or mmRNA molecules having enhanced properties. For example, the nucleosides and nucleotides described herein can be chemically modified. In some embodiments, chemical modifications can include an amino group, a thiol group, an alkyl group, or a halo group.

Modifications on the Internucleoside Linkage

The modified nucleotides, which may be incorporated into a signal-sensor polynucleotide, primary construct, or mmRNA molecule, can be modified on the internucleoside linkage (e.g., phosphate backbone). Herein, in the context of the polynucleotide backbone, the phrases "phosphate" and "phosphodiester" are used interchangeably. Backbone phosphate groups can be modified by replacing one or more of the oxygen atoms with a different substituent. Further, the modified nucleosides and nucleotides can include the wholesale replacement of an unmodified phosphate moiety with another internucleoside linkage as described herein. Examples of modified phosphate groups include, but are not limited to, phosphorothioate, phosphoroselenates, borano-phosphates, boranophosphate esters, hydrogen phosphonates, phosphoramidates, phosphorodiamidates, alkyl or aryl phosphonates, and phosphotriesters. Phosphorodithioates have both non-linking oxygens replaced by sulfur. The phosphate linker can also be modified by the replacement of a linking oxygen with nitrogen (bridged phosphoramidates), sulfur (bridged phosphorothioates), and carbon (bridged methylene-phosphonates).

The α-thio substituted phosphate moiety is provided to confer stability to RNA and DNA polymers through the unnatural phosphorothioate backbone linkages. Phosphorothioate DNA and RNA have increased nuclease resistance and subsequently a longer half-life in a cellular environment. Phosphorothioate linked signal-sensor polynucleotides, primary constructs, or mmRNA molecules are expected to also reduce the innate immune response through weaker binding/activation of cellular innate immune molecules.

In specific embodiments, a modified nucleoside includes an alpha-thio-nucleoside (e.g., 5'-O-(1-thiophosphate)-adenosine, 5'-O-(1-thiophosphate)-cytidine (α-thio-cytidine), 5'-O-(1-thiophosphate)-guanosine, 5'-O-(1-thiophosphate)-uridine, or 5'-O-(1-thiophosphate)-pseudouridine).

Other internucleoside linkages that may be employed according to the present invention, including internucleoside linkages which do not contain a phosphorous atom, are described herein below.

Combinations of Modified Sugars, Nucleobases, and Internucleoside Linkages

The signal-sensor polynucleotides, primary constructs, and mmRNA of the invention can include a combination of modifications to the sugar, the nucleobase, and/or the internucleoside linkage. These combinations can include any one or more modifications described herein or in International Application PCT/US12/058519 filed Oct. 3, 2012 (M9), the contents of which are incorporated herein by reference in their entirety.

Synthesis of Signal-Sensor Primary Constructs, and mmRNA Molecules

The signal-sensor polypeptides, primary constructs, and mmRNA molecules for use in accordance with the invention may be prepared according to any useful technique, as described herein. The modified nucleosides and nucleotides used in the synthesis of signal-sensor polynucleotides, primary constructs, and mmRNA molecules disclosed herein can be prepared from readily available starting materials using the following general methods and procedures. Where typical or preferred process conditions (e.g., reaction temperatures, times, mole ratios of reactants, solvents, pressures, etc.) are provided, a skilled artisan would be able to optimize and develop additional process conditions. Optimum reaction conditions may vary with the particular reactants or solvent used, but such conditions can be determined by one skilled in the art by routine optimization procedures.

The processes described herein can be monitored according to any suitable method known in the art. For example, product formation can be monitored by spectroscopic means, such as nuclear magnetic resonance spectroscopy (e.g., $^1$H or $^{13}$C) infrared spectroscopy, spectrophotometry (e.g., UV-visible), or mass spectrometry, or by chromatography such as high performance liquid chromatography (HPLC) or thin layer chromatography.

Preparation of signal-sensor polynucleotides, primary constructs, and mRNA molecules of the present invention can involve the protection and deprotection of various chemical groups. The need for protection and deprotection, and the selection of appropriate protecting groups can be readily determined by one skilled in the art. The chemistry of protecting groups can be found, for example, in Greene, et al., *Protective Groups in Organic Synthesis*, 2d. Ed., Wiley & Sons, 1991, which is incorporated herein by reference in its entirety.

The reactions of the processes described herein can be carried out in suitable solvents, which can be readily selected by one of skill in the art of organic synthesis. Suitable solvents can be substantially nonreactive with the starting materials (reactants), the intermediates, or products at the temperatures at which the reactions are carried out, i.e., temperatures which can range from the solvent's freezing temperature to the solvent's boiling temperature. A given reaction can be carried out in one solvent or a mixture of more than one solvent. Depending on the particular reaction step, suitable solvents for a particular reaction step can be selected.

Resolution of racemic mixtures of modified nucleosides and nucleotides (e.g., mmRNA molecules) can be carried out by any of numerous methods known in the art. An example method includes fractional recrystallization using a "chiral resolving acid" which is an optically active, salt-forming organic acid. Suitable resolving agents for fractional recrystallization methods are, for example, optically active acids, such as the D and L forms of tartaric acid, diacetyltartaric acid, dibenzoyltartaric acid, mandelic acid, malic acid, lactic acid or the various optically active camphorsulfonic acids. Resolution of racemic mixtures can also be carried out by elution on a column packed with an optically active resolving agent (e.g., dinitrobenzoylphenylglycine). Suitable elution solvent composition can be determined by one skilled in the art.

Modified nucleosides and nucleotides (e.g., building block molecules) can be prepared according to the synthetic methods described in Ogata et al., J. Org. Chem. 74:2585-2588 (2009); Purmal et al., Nucl. Acids Res. 22(1): 72-78, (1994); Fukuhara et al., Biochemistry, 1(4): 563-568 (1962); and Xu et al., Tetrahedron, 48(9): 1729-1740 (1992), each of which are incorporated by reference in their entirety.

The signal-sensor polynucleotides, primary constructs, and mmRNA of the invention may or may not be uniformly modified along the entire length of the molecule. For example, one or more or all types of nucleotide (e.g., purine or pyrimidine, or any one or more or all of A, G, U, C) may or may not be uniformly modified in a polynucleotide of the invention, or in a given predetermined sequence region thereof (e.g. one or more of the sequence regions represented in FIG. 1). In some embodiments, all nucleotides X in a signal-sensor polynucleotide of the invention (or in a given sequence region thereof) are modified, wherein X may any one of nucleotides A, G, U, C, or any one of the combinations A+G, A+U, A+C, G+U, G+C, U+C, A+G+U, A+G+C, G+U+C or A+G+C.

Different sugar modifications, nucleotide modifications, and/or internucleoside linkages (e.g., backbone structures) may exist at various positions in the signal-sensor polynucleotide, primary construct, or mmRNA. One of ordinary skill in the art will appreciate that the nucleotide analogs or other modification(s) may be located at any position(s) of a signal-sensor polynucleotide, primary construct, or mmRNA such that the function of the signal-sensor polynucleotide, primary construct, or mmRNA is not substantially decreased. A modification may also be a 5' or 3' terminal modification. The signal-sensor polynucleotide, primary construct, or mmRNA may contain from about 1% to about 100% modified nucleotides (either in relation to overall nucleotide content, or in relation to one or more types of nucleotide, i.e. any one or more of A, G, U or C) or any intervening percentage (e.g., from 1% to 20%, from 1% to 25%, from 1% to 50%, from 1% to 60%, from 1% to 70%, from 1% to 80%, from 1% to 90%, from 1% to 95%, from 10% to 20%, from 10% to 25%, from 10% to 50%, from 10% to 60%, from 10% to 70%, from 10% to 80%, from 10% to 90%, from 10% to 95%, from 10% to 100%, from 20% to 25%, from 20% to 50%, from 20% to 60%, from 20% to 70%, from 20% to 80%, from 20% to 90%, from 20% to 95%, from 20% to 100%, from 50% to 60%, from 50% to 70%, from 50% to 80%, from 50% to 90%, from 50% to 95%, from 50% to 100%, from 70% to 80%, from 70% to 90%, from 70% to 95%, from 70% to 100%, from 80% to 90%, from 80% to 95%, from 80% to 100%, from 90% to 95%, from 90% to 100%, and from 95% to 100%).

In some embodiments, the signal-sensor polynucleotide, primary construct, or mmRNA includes a modified pyrimidine (e.g., a modified uracil/uridine/U or modified cytosine/cytidine/C). In some embodiments, the uracil or uridine (generally: U) in the signal-sensor polynucleotide, primary construct, or mmRNA molecule may be replaced with from about 1% to about 100% of a modified uracil or modified uridine (e.g., from 1% to 20%, from 1% to 25%, from 1% to 50%, from 1% to 60%, from 1% to 70%, from 1% to 80%, from 1% to 90%, from 1% to 95%, from 10% to 20%, from 10% to 25%, from 10% to 50%, from 10% to 60%, from 10% to 70%, from 10% to 80%, from 10% to 90%, from 10% to 95%, from 10% to 100%, from 20% to 25%, from 20% to 50%, from 20% to 60%, from 20% to 70%, from 20% to 80%, from 20% to 90%, from 20% to 95%, from 20% to 100%, from 50% to 60%, from 50% to 70%, from 50% to 80%, from 50% to 90%, from 50% to 95%, from 50% to 100%, from 70% to 80%, from 70% to 90%, from 70% to 95%, from 70% to 100%, from 80% to 90%, from 80% to 95%, from 80% to 100%, from 90% to 95%, from 90% to 100%, and from 95% to 100% of a modified uracil or modified uridine). The modified uracil or uridine can be replaced by a compound having a single unique structure or by a plurality of compounds having different structures (e.g., 2, 3, 4 or more unique structures, as described herein). In some embodiments, the cytosine or cytidine (generally: C) in the signal-sensor polynucleotide, primary construct, or mmRNA molecule may be replaced with from about 1% to about 100% of a modified cytosine or modified cytidine (e.g., from 1% to 20%, from 1% to 25%, from 1% to 50%, from 1% to 60%, from 1% to 70%, from 1% to 80%, from 1% to 90%, from 1% to 95%, from 10% to 20%, from 10% to 25%, from 10% to 50%, from 10% to 60%, from 10% to 70%, from 10% to 80%, from 10% to 90%, from 10% to 95%, from 10% to 100%, from 20% to 25%, from 20% to 50%, from 20% to 60%, from 20% to 70%, from 20% to 80%, from 20% to 90%, from 20% to 95%, from 20% to 100%, from 50% to 60%, from 50% to 70%, from 50% to 80%, from 50% to 90%, from 50% to 95%, from 50% to 100%, from 70% to 80%, from 70% to 90%, from 70% to 95%, from 70% to 100%, from 80% to 90%, from 80% to 95%, from 80% to 100%, from 90% to 95%, from 90% to 100%, and from 95% to 100% of a modified cytosine or modified cytidine). The modified cytosine or cytidine can be replaced by a compound having a single unique structure or by a plurality of compounds having different structures (e.g., 2, 3, 4 or more unique structures, as described herein).

Combinations of Nucleotides

Further examples of modified nucleotides and modified nucleotide combinations are provided in International Application PCT/US12/058519 filed Oct. 3, 2012 (M9) the contents of which are incorporated herein by reference in their entirety.

In some embodiments, at least 25% of the cytidines are replaced (e.g., at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, or about 100%).

In some embodiments, at least 25% of the uracils are replaced (e.g., at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, or about 100%).

In some embodiments, at least 25% of the cytidines are replaced, and at least 25% of the uracils are replaced (e.g., at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, or about 100%).

IV. Pharmaceutical Compositions

Formulation, Administration, Delivery and Dosing

The present invention provides signal-sensor polynucleotides, primary constructs and mmRNA compositions and complexes in combination with one or more pharmaceutically acceptable excipients. Pharmaceutical compositions may optionally comprise one or more additional active substances, e.g. therapeutically and/or prophylactically active substances. General considerations in the formulation and/or manufacture of pharmaceutical agents may be found, for example, in Remington: The Science and Practice of Pharmacy 21$^{st}$ ed., Lippincott Williams & Wilkins, 2005 (incorporated herein by reference).

In some embodiments, compositions are administered to humans, human patients or subjects. For the purposes of the present disclosure, the phrase "active ingredient" generally refers to signal-sensor polynucleotides, primary constructs and mmRNA to be delivered as described herein.

Although the descriptions of pharmaceutical compositions provided herein are principally directed to pharmaceutical compositions which are suitable for administration to humans, it will be understood by the skilled artisan that such compositions are generally suitable for administration to any other animal, e.g., to non-human animals, e.g. non-human mammals. Modification of pharmaceutical compositions suitable for administration to humans in order to render the compositions suitable for administration to various animals is well understood, and the ordinarily skilled veterinary pharmacologist can design and/or perform such modification with merely ordinary, if any, experimentation. Subjects to which administration of the pharmaceutical compositions is contemplated include, but are not limited to, humans and/or other primates; mammals, including commercially relevant mammals such as cattle, pigs, horses, sheep, cats, dogs, mice, and/or rats; and/or birds, including commercially relevant birds such as poultry, chickens, ducks, geese, and/or turkeys.

Formulations of the pharmaceutical compositions described herein may be prepared by any method known or hereafter developed in the art of pharmacology. In general, such preparatory methods include the step of bringing the active ingredient into association with an excipient and/or one or more other accessory ingredients, and then, if necessary and/or desirable, dividing, shaping and/or packaging the product into a desired single- or multi-dose unit.

A pharmaceutical composition in accordance with the invention may be prepared, packaged, and/or sold in bulk, as a single unit dose, and/or as a plurality of single unit doses. As used herein, a "unit dose" is discrete amount of the pharmaceutical composition comprising a predetermined amount of the active ingredient. The amount of the active ingredient is generally equal to the dosage of the active ingredient which would be administered to a subject and/or a convenient fraction of such a dosage such as, for example, one-half or one-third of such a dosage.

Relative amounts of the active ingredient, the pharmaceutically acceptable excipient, and/or any additional ingredients in a pharmaceutical composition in accordance with the invention will vary, depending upon the identity, size, and/or condition of the subject treated and further depending upon the route by which the composition is to be administered. By way of example, the composition may comprise between 0.1% and 100%, e.g., between 0.5 and 50%, between 1-30%, between 5-80%, at least 80% (w/w) active ingredient.

Formulations

The signal-sensor polynucleotide, primary construct, and mmRNA of the invention can be formulated using one or more excipients to: (1) increase stability; (2) increase cell transfection; (3) permit the sustained or delayed release (e.g., from a depot formulation of the signal-sensor polynucleotide, primary construct, or mmRNA); (4) alter the biodistribution (e.g., target the polynucleotide, primary construct, or mmRNA to specific tissues or cell types); (5) increase the translation of encoded protein in vivo; and/or (6) alter the release profile of encoded protein in vivo. In addition to traditional excipients such as any and all solvents, dispersion media, diluents, or other liquid vehicles, dispersion or suspension aids, surface active agents, isotonic agents, thickening or emulsifying agents, preservatives, excipients of the present invention can include, without limitation, lipidoids, liposomes, lipid nanoparticles, polymers, lipoplexes, core-shell nanoparticles, peptides, proteins, cells transfected with signal-sensor polynucleotide, primary construct, or mmRNA (e.g., for transplantation into a subject), hyaluronidase, nanoparticle mimics and combinations thereof. Further, the signal-sensor polynucleotide, primary construct, or mmRNA of the present invention may be formulated using self-assembled nucleic acid nanoparticles.

Accordingly, the formulations of the invention can include one or more excipients, each in an amount that together increases the stability of the signal-sensor polynucleotide, primary construct, or mmRNA, increases cell transfection by the signal-sensor polynucleotide, primary construct, or mmRNA, increases the expression of polynucleotide, primary construct, or mmRNA encoded protein, and/or alters the release profile of signal-sensor polynucleotide, primary construct, or mmRNA encoded proteins. Further, the primary construct and mmRNA of the present invention may be formulated using self-assembled nucleic acid nanoparticles.

Formulations of the pharmaceutical compositions described herein may be prepared by any method known or hereafter developed in the art of pharmacology. In general, such preparatory methods include the step of associating the active ingredient with an excipient and/or one or more other accessory ingredients.

A pharmaceutical composition in accordance with the present disclosure may be prepared, packaged, and/or sold in bulk, as a single unit dose, and/or as a plurality of single unit doses. As used herein, a "unit dose" refers to a discrete amount of the pharmaceutical composition comprising a predetermined amount of the active ingredient. The amount of the active ingredient may generally be equal to the dosage of the active ingredient which would be administered to a subject and/or a convenient fraction of such a dosage including, but not limited to, one-half or one-third of such a dosage.

Relative amounts of the active ingredient, the pharmaceutically acceptable excipient, and/or any additional ingredients in a pharmaceutical composition in accordance with the present disclosure may vary, depending upon the identity, size, and/or condition of the subject being treated and further depending upon the route by which the composition is to be administered. For example, the composition may comprise between 0.1% and 99% (w/w) of the active ingredient.

In some embodiments, the formulations described herein may contain at least one signal-sensor mmRNA. As a non-limiting example, the formulations may contain 1, 2, 3, 4 or 5 signal-sensor mmRNA. In one embodiment the formulation may contain modified mRNA encoding proteins selected from categories such as, proteins. In one embodiment, the formulation contains at least three signal-sensor modified mRNA encoding oncology-related proteins. In one embodiment, the formulation contains at least five signal-sensor modified mRNA encoding oncology-related proteins.

Pharmaceutical formulations may additionally comprise a pharmaceutically acceptable excipient, which, as used herein, includes, but is not limited to, any and all solvents, dispersion media, diluents, or other liquid vehicles, dispersion or suspension aids, surface active agents, isotonic agents, thickening or emulsifying agents, preservatives, and the like, as suited to the particular dosage form desired. Various excipients for formulating pharmaceutical compositions and techniques for preparing the composition are known in the art (see Remington: The Science and Practice of Pharmacy, 21$^{st}$ Edition, A. R. Gennaro, Lippincott, Williams & Wilkins, Baltimore, Md., 2006; incorporated herein by reference). The use of a conventional excipient medium may be contemplated within the scope of the present disclosure, except insofar as any conventional excipient medium may be incompatible with a substance or its derivatives, such as by producing any undesirable biological effect or otherwise interacting in a deleterious manner with any other component(s) of the pharmaceutical composition.

In some embodiments, the particle size of the lipid nanoparticle may be increased and/or decreased. The change in particle size may be able to help counter biological reaction such as, but not limited to, inflammation or may increase the biological effect of the signal-sensor modified mRNA delivered to mammals.

Pharmaceutically acceptable excipients used in the manufacture of pharmaceutical compositions include, but are not limited to, inert diluents, surface active agents and/or emulsifiers, preservatives, buffering agents, lubricating agents, and/or oils. Such excipients may optionally be included in the pharmaceutical formulations of the invention.

Pharmaceutical compositions of the present invention may comprise at least one adjuvant which may be a chemo-adjuvant. Non-limiting examples of chemo-adjuvants and delivery systems which comprises a chemo-adjuvant are described in International Patent Publication No. WO2013134349, the contents of which is herein incorporated by reference in its entirety. The chemo-adjuvant may be bonded to, non-covalently bonded to or encapsulated within a delivery vehicle described herein.

Lipidoids

The synthesis of lipidoids has been extensively described and formulations containing these compounds are particularly suited for delivery of signal-sensor polynucleotides, primary constructs or mmRNA (see Mahon et al., Bioconjug Chem. 2010 21:1448-1454; Schroeder et al., J Intern Med. 2010 267:9-21; Akinc et al., Nat Biotechnol. 2008 26:561-569; Love et al., Proc Natl Acad Sci USA. 2010 107:1864-1869; Siegwart et al., Proc Natl Acad Sci USA. 2011 108:12996-3001; all of which are incorporated herein in their entireties).

While these lipidoids have been used to effectively deliver double stranded small interfering RNA molecules in rodents and non-human primates (see Akinc et al., Nat Biotechnol. 2008 26:561-569; Frank-Kamenetsky et al., Proc Natl Acad Sci USA. 2008 105:11915-11920; Akinc et al., Mol Ther. 2009 17:872-879; Love et al., Proc Natl Acad Sci USA.

2010 107:1864-1869; Leuschner et al., Nat Biotechnol. 2011 29:1005-1010; all of which is incorporated herein in their entirety), the present disclosure describes their formulation and use in delivering single stranded signal-sensor polynucleotides, primary constructs, or mmRNA. Complexes, micelles, liposomes or particles can be prepared containing these lipidoids and therefore, can result in an effective delivery of the signal-sensor polynucleotide, primary construct, or mmRNA, as judged by the production of an encoded protein, following the injection of a lipidoid formulation via localized and/or systemic routes of administration. Lipidoid complexes of signal-sensor polynucleotides, primary constructs, or mmRNA can be administered by various means including, but not limited to, intravenous, intramuscular, or subcutaneous routes.

In vivo delivery of nucleic acids may be affected by many parameters, including, but not limited to, the formulation composition, nature of particle PEGylation, degree of loading, oligonucleotide to lipid ratio, and biophysical parameters such as particle size (Akinc et al., Mol Ther. 2009 17:872-879; herein incorporated by reference in its entirety). As an example, small changes in the anchor chain length of poly(ethylene glycol) (PEG) lipids may result in significant effects on in vivo efficacy. Formulations with the different lipidoids, including, but not limited to penta[3-(1-laurylaminopropionyl)]-triethylenetetramine hydrochloride (TETA-5LAP; aka 98N12-5, see Murugaiah et al., Analytical Biochemistry, 401:61 (2010)), C12-200 (including derivatives and variants), and MD1, can be tested for in vivo activity.

The lipidoid referred to herein as "98N12-5" is disclosed by Akinc et al., Mol Ther. 2009 17:872-879 and is incorporated by reference in its entirety.

The lipidoid referred to herein as "C12-200" is disclosed by Love et al., Proc Natl Acad Sci USA. 2010 107:1864-1869 and Liu and Huang, Molecular Therapy. 2010 669-670; both of which are herein incorporated by reference in their entirety. The lipidoid formulations can include particles comprising either 3 or 4 or more components in addition to signal-sensor polynucleotide, primary construct, or mmRNA. As an example, formulations with certain lipidoids, include, but are not limited to, 98N12-5 and may contain 42% lipidoid, 48% cholesterol and 10% PEG (C14 alkyl chain length). As another example, formulations with certain lipidoids, include, but are not limited to, C12-200 and may contain 50% lipidoid, 10% disteroylphosphatidyl choline, 38.5% cholesterol, and 1.5% PEG-DMG.

Combinations of different lipidoids may be used to improve the efficacy of signal-sensor polynucleotide, primary construct, or mmRNA directed protein production as the lipidoids may be able to increase cell transfection by the signal-sensor polynucleotide, primary construct, or mmRNA; and/or increase the translation of encoded oncology-related protein (see Whitehead et al., Mol. Ther. 2011, 19:1688-1694, herein incorporated by reference in its entirety).

In some embodiments, the particle size of the lipid nanoparticle may be increased and/or decreased. The change in particle size may be able to help counter biological reaction such as, but not limited to, inflammation or may increase the biological effect of, the signal-sensor polynucleotide, primary construct, or mmRNA delivered to subjects.

Liposomes, Lipoplexes, and Lipid Nanoparticles

The signal-sensor polynucleotide, primary construct, and mmRNA of the invention can be formulated using one or more liposomes, lipoplexes, or lipid nanoparticles. In one embodiment, pharmaceutical compositions of signal-sensor polynucleotide, primary construct, or mmRNA include liposomes. Liposomes are artificially-prepared vesicles which may primarily be composed of a lipid bilayer and may be used as a delivery vehicle for the administration of nutrients and pharmaceutical formulations. Liposomes can be of different sizes such as, but not limited to, a multilamellar vesicle (MLV) which may be hundreds of nanometers in diameter and may contain a series of concentric bilayers separated by narrow aqueous compartments, a small unicellular vesicle (SUV) which may be smaller than 50 nm in diameter, and a large unilamellar vesicle (LUV) which may be between 50 and 500 nm in diameter. Liposome design may include, but is not limited to, opsonins or ligands in order to improve the attachment of liposomes to unhealthy tissue or to activate events such as, but not limited to, endocytosis. Liposomes may contain a low or a high pH in order to improve the delivery of the pharmaceutical formulations.

The formation of liposomes may depend on the physicochemical characteristics such as, but not limited to, the pharmaceutical formulation entrapped and the liposomal ingredients, the nature of the medium in which the lipid vesicles are dispersed, the effective concentration of the entrapped substance and its potential toxicity, any additional processes involved during the application and/or delivery of the vesicles, the optimization size, polydispersity and the shelf-life of the vesicles for the intended application, and the batch-to-batch reproducibility and possibility of large-scale production of safe and efficient liposomal products.

In one embodiment, pharmaceutical compositions described herein may include, without limitation, liposomes such as those formed from 1,2-dioleyloxy-N,N-dimethylaminopropane (DODMA) liposomes, DiLa2 liposomes from Marina Biotech (Bothell, Wash.), 1,2-dilinoleyloxy-3-dimethylaminopropane (DLin-DMA), 2,2-dilinoleyl-4-(2-dimethylaminoethyl)-[1,3]-dioxolane (DLin-KC2-DMA), and MC3 (US20100324120; herein incorporated by reference in its entirety) and liposomes which may deliver small molecule drugs such as, but not limited to, DOXIL® from Janssen Biotech, Inc. (Horsham, Pa.).

In one embodiment, pharmaceutical compositions described herein may include, without limitation, liposomes such as those formed from the synthesis of stabilized plasmid-lipid particles (SPLP) or stabilized nucleic acid lipid particle (SNALP) that have been previously described and shown to be suitable for oligonucleotide delivery in vitro and in vivo (see Wheeler et al. Gene Therapy. 1999 6:271-281; Zhang et al. Gene Therapy. 1999 6:1438-1447; Jeffs et al. Pharm Res. 2005 22:362-372; Morrissey et al., Nat Biotechnol. 2005 2:1002-1007; Zimmermann et al., Nature. 2006 441:111-114; Heyes et al. J Contr Rel. 2005 107:276-287; Semple et al. Nature Biotech. 2010 28:172-176; Judge et al. J Clin Invest. 2009 119:661-673; deFougerolles Hum Gene Ther. 2008 19:125-132; all of which are incorporated herein in their entireties.) The original manufacture method by Wheeler et al. was a detergent dialysis method, which was later improved by Jeffs et al. and is referred to as the spontaneous vesicle formation method. The liposome formulations are composed of 3 to 4 lipid components in addition to the signal-sensor polynucleotide, primary construct, or mmRNA. As an example a liposome can contain, but is not limited to, 55% cholesterol, 20% disteroylphosphatidyl choline (DSPC), 10% PEG-S-DSG, and 15% 1,2-dioleyloxy-N,N-dimethylaminopropane (DODMA), as described by Jeffs et al. As another example, certain liposome formulations may contain, but are not limited to, 48% cholesterol, 20% DSPC, 2% PEG-c-DMA, and 30% cationic lipid, where the cationic lipid can be 1,2-distearloxy-N,N- dimethylaminopropane (DSDMA), DODMA, DLin-DMA, or 1,2-dilinolenyloxy-3-dimethylaminopropane (DLenDMA), as described by Heyes et al.

In one embodiment, pharmaceutical compositions may include liposomes which may be formed to deliver signal-sensor mmRNA which may encode at least one immunogen. The mmRNA may be encapsulated by the liposome and/or it may be contained in an aqueous core which may then be encapsulated by the liposome (see International Pub. Nos. WO2012031046, WO2012031043, WO201203091 and WO2012006378 herein incorporated by reference in their entireties). In another embodiment, the signal-sensor mmRNA which may encode an immunogen may be formulated in a cationic oil-in-water emulsion where the emulsion particle comprises an oil core and a cationic lipid which can interact with the signal-sensor mmRNA anchoring the molecule to the emulsion particle (see International Pub. No. WO2012006380). In yet another embodiment, the lipid formulation may include at least cationic lipid, a lipid which may enhance transfection and a least one lipid which contains a hydrophilic head group linked to a lipid moiety (International Pub. No. WO2011076807 and U.S. Pub. No. 20110200582; herein incorporated by reference in their entireties). In another embodiment, the signal-sensor polynucleotides, primary constructs and/or mmRNA encoding an immunogen may be formulated in a lipid vesicle which may have crosslinks between functionalized lipid bilayers (see U.S. Pub. No. 20120177724, herein incorporated by reference in its entirety).

In one embodiment, the signal-sensor polynucleotides, primary constructs and/or mmRNA may be formulated in a lipid vesicle which may have crosslinks between functionalized lipid bilayers.

In one embodiment, the signal-sensor polynucleotides, primary constructs and/or mmRNA may be formulated in a lipid-polycation complex. The formation of the lipid-polycation complex may be accomplished by methods known in the art and/or as described in U.S. Pub. No. 20120178702, herein incorporated by reference in its entirety. As a non-limiting example, the polycation may include a cationic peptide or a polypeptide such as, but not limited to, polylysine, polyornithine and/or polyarginine. In another embodiment, the signal-sensor polynucleotides, primary constructs and/or mmRNA may be formulated in a lipid-polycation complex which may further include a neutral lipid such as, but not limited to, cholesterol or dioleoyl phosphatidylethanolamine (DOPE).

The liposome formulation may be influenced by, but not limited to, the selection of the cationic lipid component, the degree of cationic lipid saturation, the nature of the PEGylation, ratio of all components and biophysical parameters such as size. In one example by Semple et al. (Semple et al. Nature Biotech. 2010 28:172-176), the liposome formulation was composed of 57.1% cationic lipid, 7.1% dipalmitoylphosphatidylcholine, 34.3% cholesterol, and 1.4% PEG-c-DMA. As another example, changing the composition of the cationic lipid could more effectively deliver siRNA to various antigen presenting cells (Basha et al. Mol Ther. 2011 19:2186-2200; herein incorporated by reference in its entirety).

In some embodiments, the ratio of PEG in the LNP formulations may be increased or decreased and/or the carbon chain length of the PEG lipid may be modified from C14 to C18 to alter the pharmacokinetics and/or biodistribution of the LNP formulations. As a non-limiting example, LNP formulations may contain 1-5% of the lipid molar ratio of PEG-c-DOMG as compared to the cationic lipid, DSPC and cholesterol. In another embodiment the PEG-c-DOMG may be replaced with a PEG lipid such as, but not limited to, PEG-DSG (1,2-Distearoyl-sn-glycerol, methoxypolyethylene glycol) or PEG-DPG (1,2-Dipalmitoyl-sn-glycerol, methoxypolyethylene glycol). The cationic lipid may be selected from any lipid known in the art such as, but not limited to, DLin-MC3-DMA, DLin-DMA, C12-200 and DLin-KC2-DMA.

In one embodiment, the LNP formulations of the signal-sensor polynucleotides, primary constructs and/or mmRNA may contain PEG-c-DOMG 3% lipid molar ratio. In another embodiment, the LNP formulations of the signal-sensor polynucleotides, primary constructs and/or mmRNA may contain PEG-c-DOMG 1.5% lipid molar ratio.

In one embodiment, the pharmaceutical compositions of the signal-sensor polynucleotides, primary constructs and/or mmRNA may include at least one of the PEGylated lipids described in International Publication No. 2012099755, herein incorporated by reference.

In one embodiment, the pharmaceutical compositions may be formulated in liposomes such as, but not limited to, DiLa2 liposomes (Marina Biotech, Bothell, Wash.), SMARTICLES® (Marina Biotech, Bothell, Wash.), neutral DOPC (1,2-dioleoyl-sn-glycero-3-phosphocholine) based liposomes (e.g., siRNA delivery for ovarian cancer (Landen et al. Cancer Biology & Therapy 2006 5(12)1708-1713)) and hyaluronan-coated liposomes (Quiet Therapeutics, Israel).

In some embodiments the liposome may be a liposomal nanostructure which has been formulated for treatment of cancers and other diseases or to control the cholesterol metabolism in cells. The liposome nanostructure may also comprise a scavenger receptor type B-1 (SR-B1) in order to kill cancer cells. Non-limiting examples of liposomal nanostructures, which may be used with the signal-sensor polynucleotides described herein, are described in International Publication No. WO2013126776, the contents of which are herein incorporated by reference in its entirety.

In one embodiment, the liposomes described herein may comprise at least one immunomodulator such as, but not limited to, cytokines. Formulations and methods of using the liposomes comprising at least one immunomodulator are described in International Publication No WO2013129935 and WO2013129936, the contents of each of which are herein incorporated by reference in their entirety. As a non-limiting example, the liposomes comprising at least one immunomodulator may be used in the treatment of cancer. The liposomes comprising an immunomodulator may comprise a signal-sensor polynucleotide described herein. As a non-limiting example, the liposome comprising an immunomodulator may be used in a combination with at least one antibody such as the particulate or vesicular immunomodulators described in International Publication No WO2013129936, the contents of which are herein incorporated by reference in its entirety.

Lipid nanoparticle formulations may be improved by replacing the cationic lipid with a biodegradable cationic lipid which is known as a rapidly eliminated lipid nanoparticle (reLNP). Ionizable cationic lipids, such as, but not limited to, DLinDMA, DLin-KC2-DMA, and DLin-MC3-DMA, have been shown to accumulate in plasma and tissues over time and may be a potential source of toxicity. The rapid metabolism of the rapidly eliminated lipids can improve the tolerability and therapeutic index of the lipid nanoparticles by an order of magnitude from a 1 mg/kg dose to a 10 mg/kg dose in rat. Inclusion of an enzymatically degraded ester linkage can improve the degradation and metabolism profile of the cationic component, while still maintaining the activity of the reLNP formulation. The ester linkage can be internally located within the lipid chain or it may be terminally located at the terminal end of the lipid chain. The internal ester linkage may replace any carbon in the lipid chain.

In one embodiment, the internal ester linkage may be located on either side of the saturated carbon.

In one embodiment, an immune response may be elicited by delivering a lipid nanoparticle which may include a nanospecies, a polymer and an immunogen. (U.S. Publication No. 20120189700 and International Publication No. WO2012099805; herein incorporated by reference in their entireties). The polymer may encapsulate the nanospecies or partially encapsulate the nanospecies. The immunogen may be a recombinant oncology-related protein, a signal-sensor modified RNA and/or a primary construct described herein. In one embodiment, the lipid nanoparticle may be formulated for use in a vaccine such as, but not limited to, against a pathogen.

Lipid nanoparticles may be engineered to alter the surface properties of particles so the lipid nanoparticles may penetrate the mucosal barrier. Mucus is located on mucosal tissue such as, but not limited to, oral (e.g., the buccal and esophageal membranes and tonsil tissue), ophthalmic, gastrointestinal (e.g., stomach, small intestine, large intestine, colon, rectum), nasal, respiratory (e.g., nasal, pharyngeal, tracheal and bronchial membranes), genital (e.g., vaginal, cervical and urethral membranes). Nanoparticles larger than 10-200 nm which are preferred for higher drug encapsulation efficiency and the ability to provide the sustained delivery of a wide array of drugs have been thought to be too large to rapidly diffuse through mucosal barriers. Mucus is continuously secreted, shed, discarded or digested and recycled so most of the trapped particles may be removed from the mucosal tissue within seconds or within a few hours. Large polymeric nanoparticles (200 nm-500 nm in diameter) which have been coated densely with a low molecular weight polyethylene glycol (PEG) diffused through mucus only 4 to 6-fold lower than the same particles diffusing in water (Lai et al. PNAS 2007 104(5):1482-487; Lai et al. Adv Drug Deliv Rev. 2009 61(2): 158-171; herein incorporated by reference in their entirety). The transport of nanoparticles may be determined using rates of permeation and/or fluorescent microscopy techniques including, but not limited to, fluorescence recovery after photobleaching (FRAP) and high resolution multiple particle tracking (MPT).

The lipid nanoparticle engineered to penetrate mucus may comprise a polymeric material (i.e. a polymeric core) and/or a polymer-vitamin conjugate and/or a tri-block co-polymer. The polymeric material may include, but is not limited to, polyamines, polyethers, polyamides, polyesters, polycarbamates, polyureas, polycarbonates, poly(styrenes), polyimides, polysulfones, polyurethanes, polyacetylenes, polyethylenes, polyetheneimines, polyisocyanates, polyacrylates, polymethacrylates, polyacrylonitriles, and polyarylates. The polymeric material may be biodegradable and/or biocompatible. Non-limiting examples of specific polymers include poly(caprolactone) (PCL), ethylene vinyl acetate polymer (EVA), poly(lactic acid) (PLA), poly(L-lactic acid) (PLLA), poly(glycolic acid) (PGA), poly(lactic acid-co-glycolic acid) (PLGA), poly(L-lactic acid-co-glycolic acid) (PLLGA), poly(D,L-lactide) (PDLA), poly(L-lactide) (PLLA), poly(D,L-lactide-co-caprolactone), poly(D,L-lactide-co-caprolactone-co-glycolide), poly(D,L-lactide-co-PEO-co-D,L-lactide), poly(D,L-lactide-co-PPO-co-D,L-lactide), polyalkyl cyanoacrylate, polyurethane, poly-L-lysine (PLL), hydroxypropyl methacrylate (HPMA), polyethyleneglycol, poly-L-glutamic acid, poly(hydroxy acids), polyanhydrides, polyorthoesters, poly(ester amides), polyamides, poly(ester ethers), polycarbonates, polyalkylenes such as polyethylene and polypropylene, polyalkylene glycols such as poly(ethylene glycol) (PEG), polyalkylene oxides (PEO), polyalkylene terephthalates such as poly(ethylene terephthalate), polyvinyl alcohols (PVA), polyvinyl ethers, polyvinyl esters such as poly(vinyl acetate), polyvinyl halides such as poly(vinyl chloride) (PVC), polyvinylpyrrolidone, polysiloxanes, polystyrene (PS), polyurethanes, derivatized celluloses such as alkyl celluloses, hydroxyalkyl celluloses, cellulose ethers, cellulose esters, nitro celluloses, hydroxypropylcellulose, carboxymethylcellulose, polymers of acrylic acids, such as poly(methyl(meth)acrylate) (PMMA), poly(ethyl(meth)acrylate), poly(butyl(meth)acrylate), poly(isobutyl(meth)acrylate), poly(hexyl(meth)acrylate), poly(isodecyl(meth)acrylate), poly(lauryl(meth)acrylate), poly(phenyl(meth)acrylate), poly(methyl acrylate), poly(isopropyl acrylate), poly(isobutyl acrylate), poly(octadecyl acrylate) and copolymers and mixtures thereof, polydioxanone and its copolymers, polyhydroxyalkanoates, polypropylene fumarate, polyoxymethylene, poloxamers, poly(ortho)esters, poly(butyric acid), poly(valeric acid), poly(lactide-co-caprolactone), and trimethylene carbonate, polyvinylpyrrolidone. The lipid nanoparticle may be coated or associated with a co-polymer such as, but not limited to, a block co-polymer, and (poly(ethylene glycol))-(poly(propylene oxide))-(poly(ethylene glycol)) triblock copolymer (see US Publication 20120121718 and US Publication 20100003337; herein incorporated by reference in their entireties). The co-polymer may be a polymer that is generally regarded as safe (GRAS) and the formation of the lipid nanoparticle may be in such a way that no new chemical entities are created. For example, the lipid nanoparticle may comprise poloxamers coating PLGA nanoparticles without forming new chemical entities which are still able to rapidly penetrate human mucus (Yang et al. Angew. Chem. Int. Ed. 2011 50:2597-2600; herein incorporated by reference in its entirety).

The vitamin of the polymer-vitamin conjugate may be vitamin E. The vitamin portion of the conjugate may be substituted with other suitable components such as, but not limited to, vitamin A, vitamin E, other vitamins, cholesterol, a hydrophobic moiety, or a hydrophobic component of other surfactants (e.g., sterol chains, fatty acids, hydrocarbon chains and alkylene oxide chains).

The lipid nanoparticle engineered to penetrate mucus may include surface altering agents such as, but not limited to, signal-sensor mmRNA, anionic protein (e.g., bovine serum albumin), surfactants (e.g., cationic surfactants such as for example dimethyldioctadecyl-ammonium bromide), sugars or sugar derivatives (e.g., cyclodextrin), nucleic acids, polymers (e.g., heparin, polyethylene glycol and poloxamer), mucolytic agents (e.g., N-acetylcysteine, mugwort, bromelain, papain, clerodendrum, acetylcysteine, bromhexine, carbocisteine, eprazinone, mesna, ambroxol, sobrerol, domiodol, letosteine, stepronin, tiopronin, gelsolin, thymosin J34 dornase alfa, neltenexine, erdosteine) and various DNases including rhDNase. The surface altering agent may be embedded or enmeshed in the particle's surface or disposed (e.g., by coating, adsorption, covalent linkage, or other process) on the surface of the lipid nanoparticle. (see US Publication 20100215580 and US Publication 20080166414; herein incorporated by reference in their entireties).

The mucus penetrating lipid nanoparticles may comprise at least one signal-sensor mmRNA described herein. The signal-sensor mmRNA may be encapsulated in the lipid nanoparticle and/or disposed on the surface of the particle. The signal-sensor mmRNA may be covalently coupled to the lipid nanoparticle. Formulations of mucus penetrating lipid nanoparticles may comprise a plurality of nanoparticles. Further, the formulations may contain particles which may interact with the mucus and alter the structural and/or adhesive properties of the surrounding mucus to decrease mucoadhesion which may increase the delivery of the mucus penetrating lipid nanoparticles to the mucosal tissue.

Lipid nanoparticles may be engineered to alter the surface properties of particles so the lipid nanoparticles may penetrate the mucosal barrier. Mucus is located on mucosal tissue such as, but not limited to, oral (e.g., the buccal and esophageal membranes and tonsil tissue), ophthalmic, gastrointestinal (e.g., stomach, small intestine, large intestine, colon, rectum), nasal, respiratory (e.g., nasal, pharyngeal, tracheal and bronchial membranes), genital (e.g., vaginal, cervical and urethral membranes). Nanoparticles larger than 10-200 nm which are preferred for higher drug encapsulation efficiency and the ability to provide the sustained delivery of a wide array of drugs have been thought to be too large to rapidly diffuse through mucosal barriers. Mucus is continuously secreted, shed, discarded or digested and recycled so most of the trapped particles may be removed from the mucosal tissue within seconds or within a few hours. Large polymeric nanoparticles (200 nm-500 nm in diameter) which have been coated densely with a low molecular weight polyethylene glycol (PEG) diffused through mucus only 4 to 6-fold lower than the same particles diffusing in water (Lai et al. PNAS 2007 104(5):1482-487; Lai et al. Adv Drug Deliv Rev. 2009 61(2): 158-171; herein incorporated by reference in their entirety). The transport of nanoparticles may be determined using rates of permeation and/or fluorescent microscopy techniques including, but not limited to, fluorescence recovery after photobleaching (FRAP) and high resolution multiple particle tracking (MPT).

The lipid nanoparticle engineered to penetrate mucus may comprise a polymeric material (i.e. a polymeric core) and/or a polymer-vitamin conjugate and/or a tri-block co-polymer. The polymeric material may including, but is not limited to, polyamines, polyethers, polyamides, polyesters, polycarbamates, polyureas, polycarbonates, poly(styrenes), polyimides, polysulfones, polyurethanes, polyacetylenes, polyethylenes, polyethyeneimines, polyisocyanates, polyacrylates, polymethacrylates, polyacrylonitriles, and polyarylates. The polymeric material may be biodegradable and/or biocompatible. Non-limiting examples of specific polymers include poly(caprolactone) (PCL), ethylene vinyl acetate polymer (EVA), poly(lactic acid) (PLA), poly(L-lactic acid) (PLLA), poly(glycolic acid) (PGA), poly(lactic acid-co-glycolic acid) (PLGA), poly(L-lactic acid-co-glycolic acid) (PLLGA), poly(D,L-lactide) (PDLA), poly(L-lactide) (PLLA), poly(D,L-lactide-co-caprolactone), poly(D,L-lactide-co-caprolactone-co-glycolide), poly(D,L-lactide-co-PEO-co-D,L-lactide), poly(D,L-lactide-co-PPO-co-D,L-lactide), polyalkyl cyanoacrylate, polyurethane, poly-L-lysine (PLL), hydroxypropyl methacrylate (HPMA), polyethyleneglycol, poly-L-glutamic acid, poly(hydroxy acids), polyanhydrides, polyorthoesters, poly(ester amides), polyamides, poly(ester ethers), polycarbonates, polyalkylenes such as polyethylene and polypropylene, polyalkylene glycols such as poly(ethylene glycol) (PEG), polyalkylene oxides (PEO), polyalkylene terephthalates such as poly(ethylene terephthalate), polyvinyl alcohols (PVA), polyvinyl ethers, polyvinyl esters such as poly(vinyl acetate), polyvinyl halides such as poly(vinyl chloride) (PVC), polyvinylpyrrolidone, polysiloxanes, polystyrene (PS), polyurethanes, derivatized celluloses such as alkyl celluloses, hydroxyalkyl celluloses, cellulose ethers, cellulose esters, nitro celluloses, hydroxypropylcellulose, carboxymethylcellulose, polymers of acrylic acids, such as poly(methyl(meth)acrylate) (PMMA), poly(ethyl(meth) acrylate), poly(butyl(meth)acrylate), poly(isobutyl(meth) acrylate), poly(hexyl(meth)acrylate), poly(isodecyl(meth) acrylate), poly(lauryl(meth)acrylate), poly(phenyl(meth) acrylate), poly(methyl acrylate), poly(isopropyl acrylate), poly(isobutyl acrylate), poly(octadecyl acrylate) and copolymers and mixtures thereof, polydioxanone and its copolymers, polyhydroxyalkanoates, polypropylene fumarate, polyoxymethylene, poloxamers, poly(ortho)esters, poly(butyric acid), poly(valeric acid), poly(lactide-co-caprolactone), and trimethylene carbonate, polyvinylpyrrolidone. The lipid nanoparticle may be coated or associated with a co-polymer such as, but not limited to, a block co-polymer, and (poly(ethylene glycol))-(poly(propylene oxide))-(poly (ethylene glycol)) triblock copolymer (see US Publication 20120121718 and US Publication 20100003337; herein incorporated by reference in their entireties).

The vitamin of the polymer-vitamin conjugate may be vitamin E. The vitamin portion of the conjugate may be substituted with other suitable components such as, but not limited to, vitamin A, vitamin E, other vitamins, cholesterol, a hydrophobic moiety, or a hydrophobic component of other surfactants (e.g., sterol chains, fatty acids, hydrocarbon chains and alkylene oxide chains).

The lipid nanoparticle engineered to penetrate mucus may include surface altering agents such as, but not limited to, mmRNA, anionic protein (e.g., bovine serum albumin), surfactants (e.g., cationic surfactants such as for example dimethyldioctadecyl-ammonium bromide), sugars or sugar derivatives (e.g., cyclodextrin), nucleic acids, polymers (e.g., heparin, polyethylene glycol and poloxamer), mucolytic agents (e.g., N-acetylcysteine, mugwort, bromelain, papain, clerodendrum, acetylcysteine, bromhexine, carbocisteine, eprazinone, mesna, ambroxol, sobrerol, domiodol, letosteine, stepronin, tiopronin, gelsolin, thymosin β4 dornase alfa, neltenexine, erdosteine) and various DNases including rhDNase. The surface altering agent may be embedded or enmeshed in the particle's surface or disposed (e.g., by coating, adsorption, covalent linkage, or other process) on the surface of the lipid nanoparticle. (see US Publication 20100215580 and US Publication 20080166414; herein incorporated by reference in their entireties).

The mucus penetrating lipid nanoparticles may comprise at least one signal-sensor polynucleotide, primary construct, or mmRNA described herein. The signal-sensor polynucleotide, primary construct, or mmRNA may be encapsulated in the lipid nanoparticle and/or disposed on the surface of the particle. The signal-sensor polynucleotide, primary construct, or mmRNA may be covalently coupled to the lipid nanoparticle. Formulations of mucus penetrating lipid nanoparticles may comprise a plurality of nanoparticles. Further, the formulations may contain particles which may interact with the mucus and alter the structural and/or adhesive properties of the surrounding mucus to decrease mucoadhesion which may increase the delivery of the mucus penetrating lipid nanoparticles to the mucosal tissue.

In one embodiment, the nanoparticle may be for a dual modality therapy such as described by Mieszawska et al.

(Bioconjugate Chemistry, 2013, 24 (9), pp 1429-1434; the contents of which is herein incorporated by reference in its entirety) comprising at least one therapeutic agent (e.g., a signal-sequence polynucleotide described herein). The therapeutic agent or agents formulated in the lipid nanoparticle may be an anti-angiogenic and a cytotoxic agent (see e.g., the polymer-lipid nanoparticles taught by Mieszawska et al. Bioconjugate Chemistry, 2013, 24 (9), pp 1429-1434; the contents of which is herein incorporated by reference in its entirety).

In another embodiment, the nanoparticle may comprise a LyP-1 peptide such as the nanocarrier composition described in International Patent Publication No. WO2013100869, the contents of which are herein incorporated by reference in its entirety. The LyP-1 peptide may be contained in the nanoparticles disclosed herein, or may be a conjugate, derivative, analogue or pegylated form of the peptide. In one embodiment, a nanoparticle comprising the LyP-1 peptide may comprise a signal-sensor polynucleotide and may be used for cancer treatment and/or imaging.

In one embodiment, the signal-sensor polynucleotide, primary construct, or mmRNA is formulated as a lipoplex, such as, without limitation, the ATUPLEX™ system, the DACC system, the DBTC system and other siRNA-lipoplex technology from Silence Therapeutics (London, United Kingdom), STEMFECT™ from STEMGENT® (Cambridge, Mass.), and polyethylenimine (PEI) or protamine-based targeted and non-targeted delivery of nucleic acids (Aleku et al. Cancer Res. 2008 68:9788-9798; Strumberg et al. Int J Clin Pharmacol Ther 2012 50:76-78; Santel et al., Gene Ther 2006 13:1222-1234; Santel et al., Gene Ther 2006 13:1360-1370; Gutbier et al., Pulm Pharmacol. Ther. 2010 23:334-344; Kaufmann et al. Microvasc Res 2010 80:286-293 Weide et al. J Immunother. 2009 32:498-507; Weide et al. J Immunother. 2008 31:180-188; Pascolo Expert Opin. Biol. Ther. 4:1285-1294; Fotin-Mleczek et al., 2011 J. Immunother. 34:1-15; Song et al., Nature Biotechnol. 2005, 23:709-717; Peer et al., Proc Natl Acad Sci USA. 2007 6; 104:4095-4100; deFougerolles Hum Gene Ther. 2008 19:125-132; all of which are incorporated herein by reference in its entirety).

In one embodiment such formulations may also be constructed or compositions altered such that they passively or actively are directed to different cell types in vivo, including but not limited to hepatocytes, immune cells, tumor cells, endothelial cells, antigen presenting cells, and leukocytes (Akinc et al. Mol Ther. 2010 18:1357-1364; Song et al., Nat Biotechnol. 2005 23:709-717; Judge et al., J Clin Invest. 2009 119:661-673; Kaufmann et al., Microvasc Res 2010 80:286-293; Santel et al., Gene Ther 2006 13:1222-1234; Santel et al., Gene Ther 2006 13:1360-1370; Gutbier et al., Pulm Pharmacol. Ther. 2010 23:334-344; Basha et al., Mol. Ther. 2011 19:2186-2200; Fenske and Cullis, Expert Opin Drug Deliv. 2008 5:25-44; Peer et al., Science. 2008 319: 627-630; Peer and Lieberman, Gene Ther. 2011 18:1127-1133; all of which are incorporated herein by reference in its entirety). One example of passive targeting of formulations to liver cells includes the DLin-DMA, DLin-KC2-DMA and MC3-based lipid nanoparticle formulations which have been shown to bind to apolipoprotein E and promote binding and uptake of these formulations into hepatocytes in vivo (Akinc et al. Mol Ther. 2010 18:1357-1364; herein incorporated by reference in its entirety). Formulations can also be selectively targeted through expression of different ligands on their surface as exemplified by, but not limited by, folate, transferrin, N-acetylgalactosamine (GalNAc), and antibody targeted approaches (Kolhatkar et al., Curr Drug Discov Technol. 2011 8:197-206; Musacchio and Torchilin, Front Biosci. 2011 16:1388-1412; Yu et al., Mol Membr Biol. 2010 27:286-298; Patil et al., Crit Rev Ther Drug Carrier Syst. 2008 25:1-61; Benoit et al., Biomacromolecules. 2011 12:2708-2714 Zhao et al., Expert Opin Drug Deliv. 2008 5:309-319; Akinc et al., Mol Ther. 2010 18:1357-1364; Srinivasan et al., Methods Mol Biol. 2012 820:105-116; Ben-Arie et al., Methods Mol Biol. 2012 757:497-507; Peer 2010 J Control Release. 20:63-68; Peer et al., Proc Natl Acad Sci USA. 2007 104:4095-4100; Kim et al., Methods Mol Biol. 2011 721:339-353; Subramanya et al., Mol Ther. 2010 18:2028-2037; Song et al., Nat Biotechnol. 2005 23:709-717; Peer et al., Science. 2008 319:627-630; Peer and Lieberman, Gene Ther. 2011 18:1127-1133; all of which are incorporated herein by reference in its entirety).

In one embodiment, the signal-sensor polynucleotide, primary construct, or mmRNA is formulated as a solid lipid nanoparticle. A solid lipid nanoparticle (SLN) may be spherical with an average diameter between 10 to 1000 nm. SLN possess a solid lipid core matrix that can solubilize lipophilic molecules and may be stabilized with surfactants and/or emulsifiers. In a further embodiment, the lipid nanoparticle may be a self-assembly lipid-polymer nanoparticle (see Zhang et al., ACS Nano, 2008, 2 (8), pp 1696-1702; herein incorporated by reference in its entirety).

Liposomes, lipoplexes, or lipid nanoparticles may be used to improve the efficacy of signal-sensor polynucleotide, primary construct, or mmRNA directed protein production as these formulations may be able to increase cell transfection by the signal-sensor polynucleotide, primary construct, or mmRNA; and/or increase the translation of encoded protein. One such example involves the use of lipid encapsulation to enable the effective systemic delivery of polyplex plasmid DNA (Heyes et al., Mol Ther. 2007 15:713-720; herein incorporated by reference in its entirety). The liposomes, lipoplexes, or lipid nanoparticles may also be used to increase the stability of the signal-sensor polynucleotide, primary construct, or mmRNA.

Polymers, Biodegradable Nanoparticles, and Core-Shell Nanoparticles

The signal-sensor polynucleotide, primary construct, and mmRNA of the invention can be formulated using natural and/or synthetic polymers. Non-limiting examples of polymers which may be used for delivery include, but are not limited to, Dynamic POLYCONJUGATE™ formulations from MIRUS® Bio (Madison, Wis.) and Roche Madison (Madison, Wis.), PHASERX™ polymer formulations such as, without limitation, SMARTT POLYMER TECHNOLOGY™ (Seattle, Wash.), DMRI/DOPE, poloxamer, VAXFECTIN® adjuvant from Vical (San Diego, Calif.), chitosan, cyclodextrin from Calando Pharmaceuticals (Pasadena, Calif.), dendrimers and poly(lactic-co-glycolic acid) (PLGA) polymers. RONDEL™ (RNAi/Oligonucleotide Nanoparticle Delivery) polymers (Arrowhead Research Corporation, Pasadena, Calif.) and pH responsive co-block polymers such as, but not limited to, PHASERX™ (Seattle, Wash.).

A non-limiting example of PLGA formulations include, but are not limited to, PLGA injectable depots (e.g., ELIGARD® which is formed by dissolving PLGA in 66% N-methyl-2-pyrrolidone (NMP) and the remainder being aqueous solvent and leuprolide. Once injected, the PLGA and leuprolide peptide precipitates into the subcutaneous space).

Many of these polymer approaches have demonstrated efficacy in delivering oligonucleotides in vivo into the cell cytoplasm (reviewed in deFougerolles Hum Gene Ther.

2008 19:125-132; herein incorporated by reference in its entirety). Two polymer approaches that have yielded robust in vivo delivery of nucleic acids, in this case with small interfering RNA (siRNA), are dynamic polyconjugates and cyclodextrin-based nanoparticles. The first of these delivery approaches uses dynamic polyconjugates and has been shown in vivo in mice to effectively deliver siRNA and silence endogenous target mRNA in hepatocytes (Rozema et al., Proc Natl Acad Sci USA. 2007 104:12982-12887). This particular approach is a multicomponent polymer system whose key features include a membrane-active polymer to which nucleic acid, in this case siRNA, is covalently coupled via a disulfide bond and where both PEG (for charge masking) and N-acetylgalactosamine (for hepatocyte targeting) groups are linked via pH-sensitive bonds (Rozema et al., Proc Natl Acad Sci USA. 2007 104:12982-12887). On binding to the hepatocyte and entry into the endosome, the polymer complex disassembles in the low-pH environment, with the polymer exposing its positive charge, leading to endosomal escape and cytoplasmic release of the siRNA from the polymer. Through replacement of the N-acetylgalactosamine group with a mannose group, it was shown one could alter targeting from asialoglycoprotein receptor-expressing hepatocytes to sinusoidal endothelium and Kupffer cells. Another polymer approach involves using transferrin-targeted cyclodextrin-containing polycation nanoparticles. These nanoparticles have demonstrated targeted silencing of the EWS-FLI1 gene product in transferrin receptor-expressing Ewing's sarcoma tumor cells (Hu-Lieskovan et al., Cancer Res. 2005 65: 8984-8982) and siRNA formulated in these nanoparticles was well tolerated in non-human primates (Heidel et al., Proc Natl Acad Sci USA 2007 104: 5715-21). Both of these delivery strategies incorporate rational approaches using both targeted delivery and endosomal escape mechanisms.

The polymer formulation can permit the sustained or delayed release of signal-sensor polynucleotide, primary construct, or mmRNA (e.g., following intramuscular or subcutaneous injection). The altered release profile for the signal-sensor polynucleotide, primary construct, or mmRNA can result in, for example, translation of an encoded protein over an extended period of time. The polymer formulation may also be used to increase the stability of the signal-sensor polynucleotide, primary construct, or mmRNA. Biodegradable polymers have been previously used to protect nucleic acids other than mmRNA from degradation and been shown to result in sustained release of payloads in vivo (Rozema et al., Proc Natl Acad Sci USA. 2007 104:12982-12887; Sullivan et al., Expert Opin Drug Deliv. 2010 7:1433-1446; Convertine et al., Biomacromolecules. 2010 Oct. 1; Chu et al., Acc Chem Res. 2012 Jan. 13; Manganiello et al., Biomaterials. 2012 33:2301-2309; Benoit et al., Biomacromolecules. 2011 12:2708-2714; Singha et al., Nucleic Acid Ther. 2011 2:133-147; deFougerolles Hum Gene Ther. 2008 19:125-132; Schaffert and Wagner, Gene Ther. 2008 16:1131-1138; Chaturvedi et al., Expert Opin Drug Deliv. 2011 8:1455-1468; Davis, Mol Pharm. 2009 6:659-668; Davis, Nature 2010 464:1067-1070; herein incorporated by reference in its entirety).

In one embodiment, the pharmaceutical compositions may be sustained release formulations. In a further embodiment, the sustained release formulations may be for subcutaneous delivery. Sustained release formulations may include, but are not limited to, PLGA microspheres, ethylene vinyl acetate (EVAc), poloxamer, GELSITE® (Nanotherapeutics, Inc. Alachua, Fla.), HYLENEX® (Halozyme Therapeutics, San Diego Calif.), surgical sealants such as fibrinogen polymers (Ethicon Inc. Cornelia, Ga.). TISSELL® (Baxter International, Inc Deerfield, Ill.), PEG-based sealants, and COSEAL® (Baxter International, Inc Deerfield, Ill.).

As a non-limiting example modified mRNA may be formulated in PLGA microspheres by preparing the PLGA microspheres with tunable release rates (e.g., days and weeks) and encapsulating the signal-sensor modified mRNA in the PLGA microspheres while maintaining the integrity of the signal-sensor modified mRNA during the encapsulation process. EVAc are non-biodegradable, biocompatible polymers which are used extensively in pre-clinical sustained release implant applications (e.g., extended release products Ocusert a pilocarpine ophthalmic insert for glaucoma or progestasert a sustained release progesterone intrauterine device; transdermal delivery systems Testoderm, Duragesic and Selegiline; catheters). Poloxamer F-407 NF is a hydrophilic, non-ionic surfactant triblock copolymer of polyoxyethylene-polyoxypropylene-polyoxyethylene having a low viscosity at temperatures less than 5° C. and forms a solid gel at temperatures greater than 15° C. PEG-based surgical sealants comprise two synthetic PEG components mixed in a delivery device which can be prepared in one minute, seals in 3 minutes and is reabsorbed within 30 days. GELSITE® and natural polymers are capable of in-situ gelation at the site of administration. They have been shown to interact with protein and peptide therapeutic candidates through ionic interaction to provide a stabilizing effect.

Polymer formulations can also be selectively targeted through expression of different ligands as exemplified by, but not limited by, folate, transferrin, and N-acetylgalactosamine (GalNAc) (Benoit et al., Biomacromolecules. 2011 12:2708-2714; Rozema et al., Proc Natl Acad Sci USA. 2007 104:12982-12887; Davis, Mol Pharm. 2009 6:659-668; Davis, Nature 2010 464:1067-1070; herein incorporated by reference in its entirety).

The signal-sensor mmRNA of the invention may be formulated with or in a polymeric compound. The polymer may include at least one polymer such as, but not limited to, polyethylene glycol (PEG), poly(l-lysine)(PLL), PEG grafted to PLL, cationic lipopolymer, biodegradable cationic lipopolymer, polyethyleneimine (PEI), cross-linked branched poly(alkylene imines), a polyamine derivative, a modified poloxamer, a biodegradable polymer, biodegradable block copolymer, biodegradable random copolymer, biodegradable polyester copolymer, biodegradable polyester block copolymer, biodegradable polyester block random copolymer, linear biodegradable copolymer, poly[α-(4-aminobutyl)-L-glycolic acid) (PAGA), biodegradable cross-linked cationic multi-block copolymers or combinations thereof.

As a non-limiting example, the signal-sensor mmRNA of the invention may be formulated with the polymeric compound of PEG grafted with PLL as described in U.S. Pat. No. 6,177,274 herein incorporated by reference in its entirety. The formulation may be used for transfecting cells in vitro or for in vivo delivery of the signal-sensor mmRNA. In another example, the signal-sensor mmRNA may be suspended in a solution or medium with a cationic polymer, in a dry pharmaceutical composition or in a solution that is capable of being dried as described in U.S. Pub. Nos. 20090042829 and 20090042825 each of which are herein incorporated by reference in their entireties.

A polyamine derivative may be used to deliver nucleic acids or to treat and/or prevent a disease or to be included in an implantable or injectable device (U.S. Pub. No.

20100260817 herein incorporated by reference in its entirety). As a non-limiting example, a pharmaceutical composition may include the signal-sensor mmRNA and the polyamine derivative described in U.S. Pub. No. 20100260817 (the contents of which are incorporated herein by reference in its entirety.

For example, the signal-sensor mmRNA of the invention may be formulated in a pharmaceutical compound including a poly(alkylene imine), a biodegradable cationic lipopolymer, a biodegradable block copolymer, a biodegradable polymer, or a biodegradable random copolymer, a biodegradable polyester block copolymer, a biodegradable polyester polymer, a biodegradable polyester random copolymer, a linear biodegradable copolymer, PAGA, a biodegradable cross-linked cationic multi-block copolymer or combinations thereof. The biodegradable cationic lipopolymer may be made my methods known in the art and/or described in U.S. Pat. No. 6,696,038, U.S. App. Nos. 20030073619 and 20040142474 which is herein incorporated by reference in their entireties. The poly(alkylene imine) may be made using methods known in the art and/or as described in U.S. Pub. No. 20100004315, herein incorporated by reference in its entirety. The biodegradable polymer, biodegradable block copolymer, the biodegradable random copolymer, biodegradable polyester block copolymer, biodegradable polyester polymer, or biodegradable polyester random copolymer may be made using methods known in the art and/or as described in U.S. Pat. Nos. 6,517,869 and 6,267,987, the contents of which are each incorporated herein by reference in its entirety. The linear biodegradable copolymer may be made using methods known in the art and/or as described in U.S. Pat. No. 6,652,886. The PAGA polymer may be made using methods known in the art and/or as described in U.S. Pat. No. 6,217,912 herein incorporated by reference in its entirety. The PAGA polymer may be copolymerized to form a copolymer or block copolymer with polymers such as but not limited to, poly-L-lysine, polyarginine, polyornithine, histones, avidin, protamines, polylactides and poly(lactide-co-glycolides). The biodegradable cross-linked cationic multi-block copolymers may be made my methods known in the art and/or as described in U.S. Pat. No. 8,057,821 or U.S. Pub. No. 2012009145 herein incorporated by reference in their entireties. For example, the multi-block copolymers may be synthesized using linear polyethyleneimine (LPEI) blocks which have distinct patterns as compared to branched polyethyleneimines. Further, the composition or pharmaceutical composition may be made by the methods known in the art, described herein, or as described in U.S. Pub. No. 20100004315 or U.S. Pat. Nos. 6,267,987 and 6,217,912 herein incorporated by reference in their entireties.

As described in U.S. Pub. No. 20100004313, herein incorporated by reference in its entirety, a gene delivery composition may include a nucleotide sequence and a poloxamer. For example, the signal-sensor mmRNA of the present invention may be used in a gene delivery composition with the poloxamer described in U.S. Pub. No. 20100004313.

In one embodiment, the polymer formulation of the present invention may be stabilized by contacting the polymer formulation, which may include a cationic carrier, with a cationic lipopolymer which may be covalently linked to cholesterol and polyethylene glycol groups. The polymer formulation may be contacted with a cationic lipopolymer using the methods described in U.S. Pub. No. 20090042829 herein incorporated by reference in its entirety. The cationic carrier may include, but is not limited to, polyethylenimine, poly(trimethylenimine), poly(tetramethylenimine), polypropylenimine, aminoglycoside-polyamine, dideoxy-diamino-b-cyclodextrin, spermine, spermidine, poly(2-dimethylamino)ethyl methacrylate, poly(lysine), poly(histidine), poly(arginine), cationized gelatin, dendrimers, chitosan, 1,2-Dioleoyl-3-Trimethylammonium-Propane (DOTAP), N-[1-(2,3-dioleoyloxy)propyl]-N,N,N-trimethylammonium chloride (DOTMA), 1-[2-(oleoyloxy)ethyl]-2-oleyl-3-(2-hydroxyethyl)imidazolinium chloride (DOTIM), 2,3-dioleyloxy-N-[2(sperminecarboxamido)ethyl]-N,N-dimethyl-1-propanaminium trifluoroacetate (DOSPA), 3B-[N—(N',N'-Dimethylaminoethane)-carbamoyl]Cholesterol Hydrochloride (DC-Cholesterol HCl) diheptadecylamidoglycyl spermidine (DOGS), N,N-distearyl-N,N-dimethylammonium bromide (DDAB), N-(1,2-dimyristyloxyprop-3-yl)-N,N-dimethyl-N-hydroxyethyl ammonium bromide (DMRIE), N,N-dioleyl-N,N-dimethylammonium chloride DODAC) and combinations thereof.

The signal-sensor polynucleotide, primary construct, and mmRNA of the invention can also be formulated as a nanoparticle using a combination of polymers, lipids, and/or other biodegradable agents, such as, but not limited to, calcium phosphate. Components may be combined in a core-shell, hybrid, and/or layer-by-layer architecture, to allow for fine-tuning of the nanoparticle so to delivery of the signal-sensor polynucleotide, primary construct and mmRNA may be enhanced (Wang et al., Nat Mater. 2006 5:791-796; Fuller et al., Biomaterials. 2008 29:1526-1532; DeKoker et al., Adv Drug Deliv Rev. 2011 63:748-761; Endres et al., Biomaterials. 2011 32:7721-7731; Su et al., Mol Pharm. 2011 Jun. 6; 8(3):774-87; herein incorporated by reference in its entirety).

Biodegradable calcium phosphate nanoparticles in combination with lipids and/or polymers have been shown to deliver signal-sensor polynucleotides, primary constructs and mmRNA in vivo. In one embodiment, a lipid coated calcium phosphate nanoparticle, which may also contain a targeting ligand such as anisamide, may be used to deliver the signal-sensor polynucleotide, primary construct and mmRNA of the present invention. For example, to effectively deliver siRNA in a mouse metastatic lung model a lipid coated calcium phosphate nanoparticle was used (Li et al., J Contr Rel. 2010 142: 416-421; Li et al., J Contr Rel. 2012 158:108-114; Yang et al., Mol Ther. 2012 20:609-615). This delivery system combines both a targeted nanoparticle and a component to enhance the endosomal escape, calcium phosphate, in order to improve delivery of the siRNA.

In one embodiment, calcium phosphate with a PEG-polyanion block copolymer may be used to deliver signal-sensor polynucleotides, primary constructs and mmRNA (Kazikawa et al., J Contr Rel. 2004 97:345-356; Kazikawa et al., J Contr Rel. 2006 111:368-370).

In one embodiment, a PEG-charge-conversional polymer (Pitella et al., Biomaterials. 2011 32:3106-3114) may be used to form a nanoparticle to deliver the signal-sensor polynucleotides, primary constructs and mmRNA of the present invention. The PEG-charge-conversional polymer may improve upon the PEG-polyanion block copolymers by being cleaved into a polycation at acidic pH, thus enhancing endosomal escape.

The use of core-shell nanoparticles has additionally focused on a high-throughput approach to synthesize cationic cross-linked nanogel cores and various shells (Siegwart et al., Proc Natl Acad Sci USA. 2011 108:12996-13001). The complexation, delivery, and internalization of the polymeric nanoparticles can be precisely controlled by altering the chemical composition in both the core and shell components of the nanoparticle. For example, the core-shell nanoparticles may efficiently deliver siRNA to mouse hepatocytes after they covalently attach cholesterol to the nanoparticle.

In one embodiment, a hollow lipid core comprising a middle PLGA layer and an outer neutral lipid layer containing PEG may be used to delivery of the signal-sensor polynucleotide, primary construct and mmRNA of the present invention. As a non-limiting example, in mice bearing a luciferase-expressing tumor, it was determined that the lipid-polymer-lipid hybrid nanoparticle significantly suppressed luciferase expression, as compared to a conventional lipoplex (Shi et al, Angew Chem Int Ed. 2011 50:7027-7031).

Peptides and Proteins

The signal-sensor polynucleotide, primary construct, and mmRNA of the invention can be formulated with peptides and/or proteins in order to increase transfection of cells by the polynucleotide, primary construct, or mmRNA. In one embodiment, peptides such as, but not limited to, cell penetrating peptides and proteins and peptides that enable intracellular delivery may be used to deliver pharmaceutical formulations. A non-limiting example of a cell penetrating peptide which may be used with the pharmaceutical formulations of the present invention includes a cell-penetrating peptide sequence attached to polycations that facilitates delivery to the intracellular space, e.g., HIV-derived TAT peptide, penetratins, transportans, or hCT derived cell-penetrating peptides (see, e.g., Caron et al., Mol. Ther. 3(3): 310-8 (2001); Langel, Cell-Penetrating Peptides: Processes and Applications (CRC Press, Boca Raton Fla., 2002); El-Andaloussi et al., Curr. Pharm. Des. 11(28):3597-611 (2003); and Deshayes et al., Cell. Mol. Life Sci. 62(16): 1839-49 (2005), all of which are incorporated herein by reference). The compositions can also be formulated to include a cell penetrating agent, e.g., liposomes, which enhance delivery of the compositions to the intracellular space. signal-sensor polynucleotides, primary constructs, and mmRNA of the invention may be complexed to peptides and/or proteins such as, but not limited to, peptides and/or proteins from Aileron Therapeutics (Cambridge, Mass.) and Permeon Biologics (Cambridge, Mass.) in order to enable intracellular delivery (Cronican et al., ACS Chem. Biol. 2010 5:747-752; McNaughton et al., Proc. Natl. Acad. Sci. USA 2009 106:6111-6116; Sawyer, Chem Biol Drug Des. 2009 73:3-6; Verdine and Hilinski, Methods Enzymol. 2012; 503:3-33; all of which are herein incorporated by reference in its entirety).

In one embodiment, the cell-penetrating polypeptide may comprise a first domain and a second domain. The first domain may comprise a supercharged polypeptide. The second domain may comprise a protein-binding partner. As used herein, "protein-binding partner" includes, but are not limited to, antibodies and functional fragments thereof, scaffold proteins, or peptides. The cell-penetrating polypeptide may further comprise an intracellular binding partner for the protein-binding partner. The cell-penetrating polypeptide may be capable of being secreted from a cell where the signal-sensor polynucleotide, primary construct, or mmRNA may be introduced.

Formulations of the including peptides or proteins may be used to increase cell transfection by the signal-sensor polynucleotide, primary construct, or mmRNA, alter the biodistribution of the signal-sensor polynucleotide, primary construct, or mmRNA (e.g., by targeting specific tissues or cell types), and/or increase the translation of encoded protein.

Cells

The signal-sensor polynucleotide, primary construct, and mmRNA of the invention can be transfected ex vivo into cells, which are subsequently transplanted into a subject. As non-limiting examples, the pharmaceutical compositions may include red blood cells to deliver modified RNA to liver and myeloid cells, virosomes to deliver modified RNA in virus-like particles (VLPs), and electroporated cells such as, but not limited to, from MAXCYTE® (Gaithersburg, Md.) and from ERYTECH® (Lyon, France) to deliver modified RNA. Examples of use of red blood cells, viral particles and electroporated cells to deliver payloads other than mmRNA have been documented (Godfrin et al., Expert Opin Biol Ther. 2012 12:127-133; Fang et al., Expert Opin Biol Ther. 2012 12:385-389; Hu et al., Proc Natl Acad Sci USA. 2011 108:10980-10985; Lund et al., Pharm Res. 2010 27:400-420; Huckriede et al., J Liposome Res. 2007; 17:39-47; Cusi, Hum Vaccin. 2006 2:1-7; de Jonge et al., Gene Ther. 2006 13:400-411; all of which are herein incorporated by reference in its entirety).

Cell-based formulations of the signal-sensor polynucleotide, primary construct, and mmRNA of the invention may be used to ensure cell transfection (e.g., in the cellular carrier), alter the biodistribution of the signal-sensor polynucleotide, primary construct, or mmRNA (e.g., by targeting the cell carrier to specific tissues or cell types), and/or increase the translation of encoded oncology-related protein.

A variety of methods are known in the art and suitable for introduction of nucleic acid into a cell, including viral and non-viral mediated techniques. Examples of typical non-viral mediated techniques include, but are not limited to, electroporation, calcium phosphate mediated transfer, nucleofection, sonoporation, heat shock, magnetofection, liposome mediated transfer, microinjection, microprojectile mediated transfer (nanoparticles), cationic polymer mediated transfer (DEAE-dextran, polyethylenimine, polyethylene glycol (PEG) and the like) or cell fusion.

The technique of sonoporation, or cellular sonication, is the use of sound (e.g., ultrasonic frequencies) for modifying the permeability of the cell plasma membrane. Sonoporation methods are known to those in the art and are used to deliver nucleic acids in vivo (Yoon and Park, Expert Opin Drug Deliv. 2010 7:321-330; Postema and Gilja, Curr Pharm Biotechnol. 2007 8:355-361; Newman and Bettinger, Gene Ther. 2007 14:465-475; all herein incorporated by reference in their entirety). Sonoporation methods are known in the art and are also taught for example as it relates to bacteria in US Patent Publication 20100196983 and as it relates to other cell types in, for example, US Patent Publication 20100009424, each of which are incorporated herein by reference in their entirety.

Electroporation techniques are also well known in the art and are used to deliver nucleic acids in vivo and clinically (Andre et at, Curr Gene Ther. 2010 10:267-280; Chiarella et al., Curr Gene Ther. 2010 10:281-286; Hojman, Curr Gene Ther. 2010 10:128-138; all herein incorporated by reference in their entirety). In one embodiment, signal-sensor polynucleotides, primary constructs or mmRNA may be delivered by electroporation as described in Example 12.

Hyaluronidase

The intramuscular or subcutaneous localized injection of signal-sensor polynucleotide, primary construct, or mmRNA of the invention can include hyaluronidase, which catalyzes the hydrolysis of hyaluronan. By catalyzing the hydrolysis of hyaluronan, a constituent of the interstitial barrier, hyaluronidase lowers the viscosity of hyaluronan, thereby increasing tissue permeability (Frost, Expert Opin. Drug Deliv. (2007) 4:427-440; herein incorporated by reference in its entirety). It is useful to speed their dispersion and systemic distribution of encoded proteins produced by transfected cells. Alternatively, the hyaluronidase can be used to increase the number of cells exposed to a signal-sensor polynucleotide, primary construct, or mmRNA of the invention administered intramuscularly or subcutaneously.

Nanoparticle Mimics

The signal-sensor polynucleotide, primary construct or mmRNA of the invention may be encapsulated within and/or absorbed to a nanoparticle mimic. A nanoparticle mimic can mimic the delivery function organisms or particles such as, but not limited to, pathogens, viruses, bacteria, fungus, parasites, prions and cells. As a non-limiting example the signal-sensor polynucleotide, primary construct or mmRNA of the invention may be encapsulated in a non-viron particle which can mimic the delivery function of a virus (see International Pub. No. WO2012006376 herein incorporated by reference in its entirety).

Nanotubes

The signal-sensor polynucleotides, primary constructs or mmRNA of the invention can be attached or otherwise bound to at least one nanotube such as, but not limited to, rosette nanotubes, rosette nanotubes having twin bases with a linker, carbon nanotubes and/or single-walled carbon nanotubes, The signal-sensor polynucleotides, primary constructs or mmRNA may be bound to the nanotubes through forces such as, but not limited to, steric, ionic, covalent and/or other forces.

In one embodiment, the nanotube can release one or more signal-sensor polynucleotides, primary constructs or mmRNA into cells. The size and/or the surface structure of at least one nanotube may be altered so as to govern the interaction of the nanotubes within the body and/or to attach or bind to the signal-sensor polynucleotides, primary constructs or mmRNA disclosed herein. In one embodiment, the building block and/or the functional groups attached to the building block of the at least one nanotube may be altered to adjust the dimensions and/or properties of the nanotube. As a non-limiting example, the length of the nanotubes may be altered to hinder the nanotubes from passing through the holes in the walls of normal blood vessels but still small enough to pass through the larger holes in the blood vessels of tumor tissue.

In one embodiment, at least one nanotube may also be coated with delivery enhancing compounds including polymers, such as, but not limited to, polyethylene glycol. In another embodiment, at least one nanotube and/or the signal-sensor polynucleotides, primary constructs or mmRNA may be mixed with pharmaceutically acceptable excipients and/or delivery vehicles.

In one embodiment, the signal-sensor polynucleotides, primary constructs or mmRNA are attached and/or otherwise bound to at least one rosette nanotube. The rosette nanotubes may be formed by a process known in the art and/or by the process described in International Publication No. WO2012094304, herein incorporated by reference in its entirety. At least one signal-sensor polynucleotide, primary construct and/or mmRNA may be attached and/or otherwise bound to at least one rosette nanotube by a process as described in International Publication No. WO2012094304, herein incorporated by reference in its entirety, where rosette nanotubes or modules forming rosette nanotubes are mixed in aqueous media with at least one signal-sensor polynucleotide, primary construct and/or mmRNA under conditions which may cause at least one signal-sensor polynucleotide, primary construct or mmRNA to attach or otherwise bind to the rosette nanotubes.

Conjugates

The signal-sensor polynucleotides, primary constructs, and mmRNA of the invention include conjugates, such as a polynucleotide, primary construct, or mmRNA covalently linked to a carrier or targeting group, or including two encoding regions that together produce a fusion protein (e.g., bearing a targeting group and therapeutic protein or peptide).

The conjugates of the invention include a naturally occurring substance, such as a protein (e.g., human serum albumin (HSA), low-density lipoprotein (LDL), high-density lipoprotein (HDL), or globulin); an carbohydrate (e.g., a dextran, pullulan, chitin, chitosan, inulin, cyclodextrin or hyaluronic acid); or a lipid. The ligand may also be a recombinant or synthetic molecule, such as a synthetic polymer, e.g., a synthetic polyamino acid, an oligonucleotide (e.g. an aptamer). Examples of polyamino acids include polyamino acid is a polylysine (PLL), poly L-aspartic acid, poly L-glutamic acid, styrene-maleic acid anhydride copolymer, poly(L-lactide-co-glycolide) copolymer, divinyl ether-maleic anhydride copolymer, N-(2-hydroxypropyl)methacrylamide copolymer (HMPA), polyethylene glycol (PEG), polyvinyl alcohol (PVA), polyurethane, poly (2-ethylacrylic acid), N-isopropylacrylamide polymers, or polyphosphazene. Example of polyamines include: polyethylenimine, polylysine (PLL), spermine, spermidine, polyamine, pseudopeptide-polyamine, peptidomimetic polyamine, dendrimer polyamine, arginine, amidine, protamine, cationic lipid, cationic porphyrin, quaternary salt of a polyamine, or an alpha helical peptide.

Representative U.S. patents that teach the preparation of polynucleotide conjugates, particularly to RNA, include, but are not limited to, U.S. Pat. Nos. 4,828,979; 4,948,882; 5,218,105; 5,525,465; 5,541,313; 5,545,730; 5,552,538; 5,578,717; 5,580,731; 5,591,584; 5,109,124; 5,118,802; 5,138,045; 5,414,077; 5,486,603; 5,512,439; 5,578,718; 5,608,046; 4,587,044; 4,605,735; 4,667,025; 4,762,779; 4,789,737; 4,824,941; 4,835,263; 4,876,335; 4,904,582; 4,958,013; 5,082,830; 5,112,963; 5,214,136; 5,082,830; 5,112,963; 5,214,136; 5,245,022; 5,254,469; 5,258,506; 5,262,536; 5,272,250; 5,292,873; 5,317,098; 5,371,241, 5,391,723; 5,416,203, 5,451,463; 5,510,475; 5,512,667; 5,514,785; 5,565,552; 5,567,810; 5,574,142; 5,585,481; 5,587,371; 5,595,726; 5,597,696; 5,599,923; 5,599,928 and 5,688,941; 6,294,664; 6,320,017; 6,576,752; 6,783,931; 6,900,297; 7,037,646; each of which is herein incorporated by reference in their entirety.

In one embodiment, the conjugate of the present invention may function as a carrier for the signal-sensor mmRNA of the present invention. The conjugate may comprise a cationic polymer such as, but not limited to, polyamine, polylysine, polyalkyleneamine, and polyethylenimine which may be grafted to with poly(ethylene glycol). As a non-limiting example, the conjugate may be similar to the polymeric conjugate and the method of synthesizing the polymeric conjugate described in U.S. Pat. No. 6,586,524 herein incorporated by reference in its entirety.

The conjugates can also include targeting groups, e.g., a cell or tissue targeting agent, e.g., a lectin, glycoprotein, lipid or protein, e.g., an antibody, that binds to a specified cell type such as a kidney cell. A targeting group can be a thyrotropin, melanotropin, lectin, glycoprotein, surfactant protein A, Mucin carbohydrate, multivalent lactose, multivalent galactose, N-acetyl-galactosamine, N-acetyl-glucosamine multivalent mannose, multivalent fucose, glycosylated polyaminoacids, multivalent galactose, transferrin, bisphosphonate, polyglutamate, polyaspartate, a lipid, cholesterol, a steroid, bile acid, folate, vitamin B12, biotin, an RGD peptide, an RGD peptide mimetic or an aptamer.

Targeting groups can be proteins, e.g., glycoproteins, or peptides, e.g., molecules having a specific affinity for a co-ligand, or antibodies e.g., an antibody, that binds to a specified cell type such as a cancer cell, endothelial cell, or bone cell. Targeting groups may also include hormones and hormone receptors. They can also include non-peptidic species, such as lipids, lectins, carbohydrates, vitamins, cofactors, multivalent lactose, multivalent galactose, N-acetyl-galactosamine, N-acetyl-glucosamine multivalent mannose, multivalent fucose, or aptamers. The ligand can be, for example, a lipopolysaccharide, or an activator of p38 MAP kinase.

The targeting group can be any ligand that is capable of targeting a specific receptor. Examples include, without limitation, folate, GalNAc, galactose, mannose, mannose-6P, aptamers, integrin receptor ligands, chemokine receptor ligands, transferrin, biotin, serotonin receptor ligands, PSMA, endothelin, GCPII, somatostatin, LDL, and HDL ligands. In particular embodiments, the targeting group is an aptamer. The aptamer can be unmodified or have any combination of modifications disclosed herein.

In one embodiment, pharmaceutical compositions of the present invention may include chemical modifications such as, but not limited to, modifications similar to locked nucleic acids.

Representative U.S. patents that teach the preparation of locked nucleic acid (LNA) such as those from Santaris, include, but are not limited to, the following: U.S. Pat. Nos. 6,268,490; 6,670,461; 6,794,499; 6,998,484; 7,053,207; 7,084,125; and 7,399,845, each of which is herein incorporated by reference in its entirety.

Representative U.S. patents that teach the preparation of PNA compounds include, but are not limited to, U.S. Pat. Nos. 5,539,082; 5,714,331; and 5,719,262, each of which is herein incorporated by reference. Further teaching of PNA compounds can be found, for example, in Nielsen et al., Science, 1991, 254, 1497-1500.

Some embodiments featured in the invention include signal-sensor polynucleotides, primary constructs or mmRNA with phosphorothioate backbones and oligo-nucleosides with other modified backbones, and in particular —$CH_2$—NH—$CH_2$—, —$CH_2$—N($CH_3$)—O—$CH_2$— [known as a methylene (methylimino) or MMI backbone], —$CH_2$—O—N($CH_3$)—$CH_2$—, —$CH_2$—N($CH_3$)—N($CH_3$)—$CH_2$— and —N($CH_3$)—$CH_2$—$CH_2$— [wherein the native phosphodiester backbone is represented as —O—P(O)$_2$—O—$CH_2$—] of the above-referenced U.S. Pat. No. 5,489,677, and the amide backbones of the above-referenced U.S. Pat. No. 5,602,240. In some embodiments, the polynucleotides featured herein have morpholino backbone structures of the above-referenced U.S. Pat. No. 5,034,506.

Modifications at the 2' position may also aid in delivery. Preferably, modifications at the 2' position are not located in a polypeptide-coding sequence, i.e., not in a translatable region. Modifications at the 2' position may be located in a 5'UTR, a 3'UTR and/or a tailing region. Modifications at the 2' position can include one of the following at the 2' position: H (i.e., 2'-deoxy); F; O-, S-, or N-alkyl; O-, S-, or N-alkenyl; O-, S- or N-alkynyl; or O-alkyl-O-alkyl, wherein the alkyl, alkenyl and alkynyl may be substituted or unsubstituted $C_1$ to $C_{10}$ alkyl or $C_2$ to $C_{10}$ alkenyl and alkynyl. Exemplary suitable modifications include O[($CH_2$)$_n$O]$_m$$CH_3$, O($CH_2$)$_n$OCH$_3$, O($CH_2$)$_n$NH$_2$, O($CH_2$)$_n$CH$_3$, O($CH_2$)$_n$ONH$_2$, and O($CH_2$)$_n$ON[($CH_2$)$_n$CH$_3$)]$_2$, where n and m are from 1 to about 10. In other embodiments, the signal-sensor polynucleotides, primary constructs or mmRNA include one of the following at the 2' position: $C_1$ to $C_{10}$ lower alkyl, substituted lower alkyl, alkaryl, aralkyl, O-alkaryl or O-aralkyl, SH, SCH$_3$, OCN, Cl, Br, CN, CF$_3$, OCF$_3$, SOCH$_3$, SO$_2$CH$_3$, ONO$_2$, NO$_2$, N$_3$, NH$_2$, heterocycloalkyl, heterocycloalkaryl, aminoalkylamino, polyalkylamino, substituted silyl, an RNA cleaving group, a reporter group, an intercalator, a group for improving the pharmacokinetic properties, or a group for improving the pharmacodynamic properties, and other substituents having similar properties. In some embodiments, the modification includes a 2'-methoxyethoxy (2'-O—CH$_2$CH$_2$OCH$_3$, also known as 2'-O-(2-methoxyethyl) or T-MOE) (Martin et al., *Helv. Chim. Acta*, 1995, 78:486-504) i.e., an alkoxy-alkoxy group. Another exemplary modification is 2'-dimethylaminooxyethoxy, i.e., a O(CH$_2$)$_2$ON(CH$_3$)$_2$ group, also known as 2'-DMAOE, as described in examples herein below, and 2'-dimethylaminoethoxyethoxy (also known in the art as 2'-O-dimethylaminoethoxyethyl or 2'-DMAEOE), i.e., 2'-O—CH$_2$—O—CH$_2$—N(CH$_3$)$_2$, also described in examples herein below. Other modifications include 2'-methoxy (2'-OCH$_3$), 2'-aminopropoxy (2'-OCH$_2$CH$_2$CH$_2$NH$_2$) and 2'-fluoro (2'-F). Similar modifications may also be made at other positions, particularly the 3' position of the sugar on the 3' terminal nucleotide or in 2'-5' linked dsRNAs and the 5' position of 5' terminal nucleotide. signal-sensor polynucleotides of the invention may also have sugar mimetics such as cyclobutyl moieties in place of the pentofuranosyl sugar. Representative U.S. patents that teach the preparation of such modified sugar structures include, but are not limited to, U.S. Pat. Nos. 4,981,957; 5,118,800; 5,319,080; 5,359,044; 5,393,878; 5,446,137; 5,466,786; 5,514,785; 5,519,134; 5,567,811; 5,576,427; 5,591,722; 5,597,909; 5,610,300; 5,627,053; 5,639,873; 5,646,265; 5,658,873; 5,670,633; and 5,700,920 and each of which is herein incorporated by reference.

In still other embodiments, the signal-sensor polynucleotide, primary construct, or mmRNA is covalently conjugated to a cell penetrating polypeptide. The cell-penetrating peptide may also include a signal peptide sequence. The conjugates of the invention can be designed to have increased stability; increased cell transfection; and/or altered the biodistribution (e.g., targeted to specific tissues or cell types).

Self-Assembled Nucleic Acid Nanoparticles

Self-assembled nanoparticles have a well-defined size which may be precisely controlled as the nucleic acid strands may be easily reprogrammable. For example, the optimal particle size for a cancer-targeting nanodelivery carrier is 20-100 nm as a diameter greater than 20 nm avoids renal clearance and enhances delivery to certain tumors through enhanced permeability and retention effect. Using self-assembled nucleic acid nanoparticles a single uniform population in size and shape having a precisely controlled spatial orientation and density of cancer-targeting ligands for enhanced delivery. As a non-limiting example, oligonucleotide nanoparticles were prepared using programmable self-assembly of short DNA fragments and therapeutic siRNAs. These nanoparticles are molecularly identical with controllable particle size and target ligand location and density. The DNA fragments and siRNAs self-assembled into a one-step reaction to generate DNA/siRNA tetrahedral nanoparticles for targeted in vivo delivery. (Lee et al., Nature Nanotechnology 2012 7:389-393).

Excipients

Pharmaceutical formulations may additionally comprise a pharmaceutically acceptable excipient, which, as used herein, includes any and all solvents, dispersion media, diluents, or other liquid vehicles, dispersion or suspension aids, surface active agents, isotonic agents, thickening or emulsifying agents, preservatives, solid binders, lubricants and the like, as suited to the particular dosage form desired. Remington's *The Science and Practice of Pharmacy*, 21$^{st}$ Edition, A. R. Gennaro (Lippincott, Williams & Wilkins, Baltimore, Md., 2006; incorporated herein by reference) discloses various excipients used in formulating pharmaceutical compositions and known techniques for the preparation thereof. Except insofar as any conventional excipient medium is incompatible with a substance or its derivatives, such as by producing any undesirable biological effect or otherwise interacting in a deleterious manner with any other component(s) of the pharmaceutical composition, its use is contemplated to be within the scope of this invention.

In some embodiments, a pharmaceutically acceptable excipient is at least 95%, at least 96%, at least 97%, at least 98%, at least 99%, or 100% pure. In some embodiments, an excipient is approved for use in humans and for veterinary use. In some embodiments, an excipient is approved by United States Food and Drug Administration. In some embodiments, an excipient is pharmaceutical grade. In some embodiments, an excipient meets the standards of the United States Pharmacopoeia (USP), the European Pharmacopoeia (EP), the British Pharmacopoeia, and/or the International Pharmacopoeia.

Pharmaceutically acceptable excipients used in the manufacture of pharmaceutical compositions include, but are not limited to, inert diluents, dispersing and/or granulating agents, surface active agents and/or emulsifiers, disintegrating agents, binding agents, preservatives, buffering agents, lubricating agents, and/or oils. Such excipients may optionally be included in pharmaceutical compositions.

Exemplary diluents include, but are not limited to, calcium carbonate, sodium carbonate, calcium phosphate, dicalcium phosphate, calcium sulfate, calcium hydrogen phosphate, sodium phosphate lactose, sucrose, cellulose, microcrystalline cellulose, kaolin, mannitol, sorbitol, inositol, sodium chloride, dry starch, cornstarch, powdered sugar, etc., and/or combinations thereof.

Exemplary granulating and/or dispersing agents include, but are not limited to, potato starch, corn starch, tapioca starch, sodium starch glycolate, clays, alginic acid, guar gum, citrus pulp, agar, bentonite, cellulose and wood products, natural sponge, cation-exchange resins, calcium carbonate, silicates, sodium carbonate, cross-linked poly(vinyl-pyrrolidone) (crospovidone), sodium carboxymethyl starch (sodium starch glycolate), carboxymethyl cellulose, cross-linked sodium carboxymethyl cellulose (croscarmellose), methylcellulose, pregelatinized starch (starch 1500), microcrystalline starch, water insoluble starch, calcium carboxymethyl cellulose, magnesium aluminum silicate (VEEGUM®), sodium lauryl sulfate, quaternary ammonium compounds, etc., and/or combinations thereof.

Exemplary surface active agents and/or emulsifiers include, but are not limited to, natural emulsifiers (e.g. acacia, agar, alginic acid, sodium alginate, tragacanth, chondrux, cholesterol, xanthan, pectin, gelatin, egg yolk, casein, wool fat, cholesterol, wax, and lecithin), colloidal clays (e.g. bentonite [aluminum silicate] and VEEGUM® [magnesium aluminum silicate]), long chain amino acid derivatives, high molecular weight alcohols (e.g. stearyl alcohol, cetyl alcohol, oleyl alcohol, triacetin monostearate, ethylene glycol distearate, glyceryl monostearate, and propylene glycol monostearate, polyvinyl alcohol), carbomers (e.g. carboxy polymethylene, polyacrylic acid, acrylic acid polymer, and carboxyvinyl polymer), carrageenan, cellulosic derivatives (e.g. carboxymethylcellulose sodium, powdered cellulose, hydroxymethyl cellulose, hydroxypropyl cellulose, hydroxypropyl methylcellulose, methylcellulose), sorbitan fatty acid esters (e.g. polyoxyethylene sorbitan monolaurate [TWEEN®20], polyoxyethylene sorbitan [TWEEN®60], polyoxyethylene sorbitan monooleate [TWEEN®80], sorbitan monopalmitate [SPAN®40], sorbitan monostearate [Span®60], sorbitan tristearate [Span®65], glyceryl monooleate, sorbitan monooleate [SPAN®80]), polyoxyethylene esters (e.g. polyoxyethylene monostearate [MYRJ®45], polyoxyethylene hydrogenated castor oil, polyethoxylated castor oil, polyoxymethylene stearate, and SOLUTOL®), sucrose fatty acid esters, polyethylene glycol fatty acid esters (e.g. CREMOPHOR®), polyoxyethylene ethers, (e.g. polyoxyethylene lauryl ether [BRIJ®30]), poly (vinyl-pyrrolidone), diethylene glycol monolaurate, triethanolamine oleate, sodium oleate, potassium oleate, ethyl oleate, oleic acid, ethyl laurate, sodium lauryl sulfate, PLUORINC®F 68, POLOXAMER®188, cetrimonium bromide, cetylpyridinium chloride, benzalkonium chloride, docusate sodium, etc. and/or combinations thereof.

Exemplary binding agents include, but are not limited to, starch (e.g. cornstarch and starch paste); gelatin; sugars (e.g. sucrose, glucose, dextrose, dextrin, molasses, lactose, lactitol, mannitol,); natural and synthetic gums (e.g. acacia, sodium alginate, extract of Irish moss, panwar gum, ghatti gum, mucilage of isapol husks, carboxymethylcellulose, methylcellulose, ethylcellulose, hydroxyethylcellulose, hydroxypropyl cellulose, hydroxypropyl methylcellulose, microcrystalline cellulose, cellulose acetate, poly(vinyl-pyrrolidone), magnesium aluminum silicate (VEEGUM®), and larch arabogalactan); alginates; polyethylene oxide; polyethylene glycol; inorganic calcium salts; silicic acid; polymethacrylates; waxes; water; alcohol; etc.; and combinations thereof.

Exemplary preservatives may include, but are not limited to, antioxidants, chelating agents, antimicrobial preservatives, antifungal preservatives, alcohol preservatives, acidic preservatives, and/or other preservatives. Exemplary antioxidants include, but are not limited to, alpha tocopherol, ascorbic acid, acorbyl palmitate, butylated hydroxyanisole, butylated hydroxytoluene, monothioglycerol, potassium metabisulfite, propionic acid, propyl gallate, sodium ascorbate, sodium bisulfite, sodium metabisulfite, and/or sodium sulfite. Exemplary chelating agents include ethylenediaminetetraacetic acid (EDTA), citric acid monohydrate, disodium edetate, dipotassium edetate, edetic acid, fumaric acid, malic acid, phosphoric acid, sodium edetate, tartaric acid, and/or trisodium edetate. Exemplary antimicrobial preservatives include, but are not limited to, benzalkonium chloride, benzethonium chloride, benzyl alcohol, bronopol, cetrimide, cetylpyridinium chloride, chlorhexidine, chlorobutanol, chlorocresol, chloroxylenol, cresol, ethyl alcohol, glycerin, hexetidine, imidurea, phenol, phenoxyethanol, phenylethyl alcohol, phenylmercuric nitrate, propylene glycol, and/or thimerosal. Exemplary antifungal preservatives include, but are not limited to, butyl paraben, methyl paraben, ethyl paraben, propyl paraben, benzoic acid, hydroxybenzoic acid, potassium benzoate, potassium sorbate, sodium benzoate, sodium propionate, and/or sorbic acid. Exemplary alcohol preservatives include, but are not limited to, ethanol, polyethylene glycol, phenol, phenolic compounds, bisphenol, chlorobutanol, hydroxybenzoate, and/or phenylethyl alcohol. Exemplary acidic preservatives include, but are not limited to, vitamin A, vitamin C, vitamin E, beta-carotene, citric acid, acetic acid, dehydroacetic acid, ascorbic acid, sorbic acid, and/or phytic acid. Other preservatives include, but are not limited to, tocopherol, tocopherol acetate, deteroxime mesylate, cetrimide, butylated hydroxyanisol (BHA), butylated hydroxytoluened (BHT), ethylenediamine, sodium lauryl sulfate (SLS), sodium lauryl ether sulfate (SLES), sodium bisulfite, sodium metabisulfite, potassium sulfite, potassium metabisulfite, GLYDANT PLUS®, PHENONIP®, methylparaben, GERMALL®115, GERMABEN®II, NEOLONE®, KATHON®, and/or EUXYL®.

Exemplary buffering agents include, but are not limited to, citrate buffer solutions, acetate buffer solutions, phosphate buffer solutions, ammonium chloride, calcium carbonate, calcium chloride, calcium citrate, calcium glubionate, calcium gluceptate, calcium gluconate, D-gluconic acid, calcium glycerophosphate, calcium lactate, propanoic acid, calcium levulinate, pentanoic acid, dibasic calcium phosphate, phosphoric acid, tribasic calcium phosphate, calcium hydroxide phosphate, potassium acetate, potassium chloride, potassium gluconate, potassium mixtures, dibasic potassium phosphate, monobasic potassium phosphate, potassium phosphate mixtures, sodium acetate, sodium bicarbonate, sodium chloride, sodium citrate, sodium lactate, dibasic sodium phosphate, monobasic sodium phosphate, sodium phosphate mixtures, tromethamine, magnesium hydroxide, aluminum hydroxide, alginic acid, pyrogen-free water, isotonic saline, Ringer's solution, ethyl alcohol, etc., and/or combinations thereof.

Exemplary lubricating agents include, but are not limited to, magnesium stearate, calcium stearate, stearic acid, silica, talc, malt, glyceryl behanate, hydrogenated vegetable oils, polyethylene glycol, sodium benzoate, sodium acetate, sodium chloride, leucine, magnesium lauryl sulfate, sodium lauryl sulfate, etc., and combinations thereof.

Exemplary oils include, but are not limited to, almond, apricot kernel, avocado, babassu, bergamot, black current seed, borage, cade, camomile, canola, caraway, carnauba, castor, cinnamon, cocoa butter, coconut, cod liver, coffee, corn, cotton seed, emu, *Eucalyptus*, evening primrose, fish, flaxseed, geraniol, gourd, grape seed, hazel nut, hyssop, isopropyl myristate, jojoba, kukui nut, lavandin, lavender, lemon, *Litsea cubeba*, macadamia nut, mallow, mango seed, meadowfoam seed, mink, nutmeg, olive, orange, orange roughy, palm, palm kernel, peach kernel, peanut, poppy seed, pumpkin seed, rapeseed, rice bran, rosemary, safflower, sandalwood, sasquana, savoury, sea buckthorn, sesame, shea butter, silicone, soybean, sunflower, tea tree, thistle, tsubaki, vetiver, walnut, and wheat germ oils. Exemplary oils include, but are not limited to, butyl stearate, caprylic triglyceride, capric triglyceride, cyclomethicone, diethyl sebacate, dimethicone 360, isopropyl myristate, mineral oil, octyldodecanol, oleyl alcohol, silicone oil, and/or combinations thereof.

Excipients such as cocoa butter and suppository waxes, coloring agents, coating agents, sweetening, flavoring, and/or perfuming agents can be present in the composition, according to the judgment of the formulator.

Delivery

The present disclosure encompasses the delivery of signal-sensor polynucleotides, primary constructs or mmRNA for any of therapeutic, pharmaceutical, diagnostic or imaging by any appropriate route taking into consideration likely advances in the sciences of drug delivery. Delivery may be naked or formulated.

Naked Delivery

The signal-sensor polynucleotides, primary constructs or mmRNA of the present invention may be delivered to a cell naked. As used herein in, "naked" refers to delivering signal-sensor polynucleotides, primary constructs or mmRNA free from agents which promote transfection. For example, the polynucleotides, primary constructs or mmRNA delivered to the cell may contain no modifications. The naked signal-sensor polynucleotides, primary constructs or mmRNA may be delivered to the cell using routes of administration known in the art and described herein.

Formulated Delivery

The signal-sensor polynucleotides, primary constructs or mmRNA of the present invention may be formulated, using the methods described herein. The formulations may contain signal-sensor polynucleotides, primary constructs or mmRNA which may be modified and/or unmodified. The formulations may further include, but are not limited to, cell penetration agents, a pharmaceutically acceptable carrier, a delivery agent, a bioerodible or biocompatible polymer, a solvent, and a sustained-release delivery depot. The formulated signal-sensor polynucleotides, primary constructs or mmRNA may be delivered to the cell using routes of administration known in the art and described herein.

The compositions may also be formulated for direct delivery to an organ or tissue in any of several ways in the art including, but not limited to, direct soaking or bathing, via a catheter, by gels, powder, ointments, creams, gels, lotions, and/or drops, by using substrates such as fabric or biodegradable materials coated or impregnated with the compositions, and the like.

Administration

The signal-sensor polynucleotides, primary constructs or mmRNA of the present invention may be administered by any route which results in a therapeutically effective outcome. These include, but are not limited to enteral, gastroenteral, epidural, oral, transdermal, epidural (peridural), intracerebral (into the cerebrum), intracerebroventricular (into the cerebral ventricles), epicutaneous (application onto the skin), intradermal, (into the skin itself), subcutaneous (under the skin), nasal administration (through the nose), intravenous (into a vein), intraarterial (into an artery), intramuscular (into a muscle), intracardiac (into the heart), intraosseous infusion (into the bone marrow), intrathecal (into the spinal canal), intraperitoneal, (infusion or injection into the peritoneum), intravesical infusion, intravitreal, (through the eye), intracavernous injection, (into the base of the penis), intravaginal administration, intrauterine, extra-amniotic administration, transdermal (diffusion through the intact skin for systemic distribution), transmucosal (diffusion through a mucous membrane), insufflation (snorting), sublingual, sublabial, enema, eye drops (onto the conjunctiva), or in ear drops. In specific embodiments, compositions may be administered in a way which allows them cross the blood-brain barrier, vascular barrier, or other epithelial barrier. Non-limiting routes of administration for the signal-sensor polynucleotides, primary constructs or mmRNA of the present invention are described below.

Parenteral and Injectable Administration

Liquid dosage forms for oral and parenteral administration include, but are not limited to, pharmaceutically acceptable emulsions, microemulsions, solutions, suspensions, syrups, and/or elixirs. In addition to active ingredients, liquid dosage forms may comprise inert diluents commonly used in the art such as, for example, water or other solvents, solubilizing agents and emulsifiers such as ethyl alcohol, isopropyl alcohol, ethyl carbonate, ethyl acetate, benzyl alcohol, benzyl benzoate, propylene glycol, 1,3-butylene glycol, dimethylformamide, oils (in particular, cottonseed, groundnut, corn, germ, olive, castor, and sesame oils), glycerol, tetrahydrofurfuryl alcohol, polyethylene glycols and fatty acid esters of sorbitan, and mixtures thereof. Besides inert diluents, oral compositions can include adjuvants such as wetting agents, emulsifying and suspending agents, sweetening, flavoring, and/or perfuming agents. In certain embodiments for parenteral administration, compositions are mixed with solubilizing agents such as CREMOPHOR®, alcohols, oils, modified oils, glycols, polysorbates, cyclodextrins, polymers, and/or combinations thereof.

Injectable preparations, for example, sterile injectable aqueous or oleaginous suspensions may be formulated according to the known art using suitable dispersing agents, wetting agents, and/or suspending agents. Sterile injectable preparations may be sterile injectable solutions, suspensions, and/or emulsions in nontoxic parenterally acceptable diluents and/or solvents, for example, as a solution in 1,3-butanediol. Among the acceptable vehicles and solvents that may be employed are water, Ringer's solution, U.S.P., and isotonic sodium chloride solution. Sterile, fixed oils are conventionally employed as a solvent or suspending medium. For this purpose any bland fixed oil can be employed including synthetic mono- or diglycerides. Fatty acids such as oleic acid can be used in the preparation of injectables.

Injectable formulations can be sterilized, for example, by filtration through a bacterial-retaining filter, and/or by incorporating sterilizing agents in the form of sterile solid compositions which can be dissolved or dispersed in sterile water or other sterile injectable medium prior to use.

In order to prolong the effect of an active ingredient, it is often desirable to slow the absorption of the active ingredient from subcutaneous or intramuscular injection. This may be accomplished by the use of a liquid suspension of crystalline or amorphous material with poor water solubility. The rate of absorption of the drug then depends upon its rate of dissolution which, in turn, may depend upon crystal size and crystalline form. Alternatively, delayed absorption of a parenterally administered drug form is accomplished by dissolving or suspending the drug in an oil vehicle. Injectable depot forms are made by forming microencapsule matrices of the drug in biodegradable polymers such as polylactide-polyglycolide. Depending upon the ratio of drug to polymer and the nature of the particular polymer employed, the rate of drug release can be controlled. Examples of other biodegradable polymers include poly(orthoesters) and poly(anhydrides). Depot injectable formulations are prepared by entrapping the drug in liposomes or microemulsions which are compatible with body tissues.

Rectal and Vaginal Administration

Compositions for rectal or vaginal administration are typically suppositories which can be prepared by mixing compositions with suitable non-irritating excipients such as cocoa butter, polyethylene glycol or a suppository wax which are solid at ambient temperature but liquid at body temperature and therefore melt in the rectum or vaginal cavity and release the active ingredient.

Oral Administration

Solid dosage forms for oral administration include capsules, tablets, pills, powders, and granules. In such solid dosage forms, an active ingredient is mixed with at least one inert, pharmaceutically acceptable excipient such as sodium citrate or dicalcium phosphate and/or fillers or extenders (e.g. starches, lactose, sucrose, glucose, mannitol, and silicic acid), binders (e.g. carboxymethylcellulose, alginates, gelatin, polyvinylpyrrolidinone, sucrose, and acacia), humectants (e.g. glycerol), disintegrating agents (e.g. agar, calcium carbonate, potato or tapioca starch, alginic acid, certain silicates, and sodium carbonate), solution retarding agents (e.g. paraffin), absorption accelerators (e.g. quaternary ammonium compounds), wetting agents (e.g. cetyl alcohol and glycerol monostearate), absorbents (e.g. kaolin and bentonite clay), and lubricants (e.g. talc, calcium stearate, magnesium stearate, solid polyethylene glycols, sodium lauryl sulfate), and mixtures thereof. In the case of capsules, tablets and pills, the dosage form may comprise buffering agents.

Topical or Transdermal Administration

As described herein, compositions containing the signal-sensor polynucleotides, primary constructs or mmRNA of the invention may be formulated for administration topically. The skin may be an ideal target site for delivery as it is readily accessible. Gene expression may be restricted not only to the skin, potentially avoiding nonspecific toxicity, but also to specific layers and cell types within the skin.

The site of cutaneous expression of the delivered compositions will depend on the route of nucleic acid delivery. Three routes are commonly considered to deliver signal-sensor polynucleotides, primary constructs or mmRNA to the skin: (i) topical application (e.g. for local/regional treatment and/or oncology-related applications); (ii) intradermal injection (e.g. for local/regional treatment and/or oncology-related applications); and (iii) systemic delivery (e.g. for treatment of dermatologic diseases that affect both cutaneous and extracutaneous regions). Signal-sensor polynucleotides, primary constructs or mmRNA can be delivered to the skin by several different approaches known in the art. Most topical delivery approaches have been shown to work for delivery of DNA, such as but not limited to, topical application of non-cationic liposome-DNA complex, cationic liposome-DNA complex, particle-mediated (gene gun), puncture-mediated gene transfections, and viral delivery approaches. After delivery of the nucleic acid, gene products have been detected in a number of different skin cell types, including, but not limited to, basal keratinocytes, sebaceous gland cells, dermal fibroblasts and dermal macrophages.

In one embodiment, the invention provides for a variety of dressings (e.g., wound dressings) or bandages (e.g., adhesive bandages) for conveniently and/or effectively carrying out methods of the present invention. Typically dressing or bandages may comprise sufficient amounts of pharmaceutical compositions and/or signal-sensor polynucleotides, primary constructs or mmRNA described herein to allow a user to perform multiple treatments of a subject(s).

In one embodiment, the invention provides for the signal-sensor polynucleotides, primary constructs or mmRNA compositions to be delivered in more than one injection.

In one embodiment, before topical and/or transdermal administration at least one area of tissue, such as skin, may be subjected to a device and/or solution which may increase permeability. In one embodiment, the tissue may be subjected to an abrasion device to increase the permeability of the skin (see U.S. Patent Publication No. 20080275468, herein incorporated by reference in its entirety). In another embodiment, the tissue may be subjected to an ultrasound enhancement device. An ultrasound enhancement device may include, but is not limited to, the devices described in U.S. Publication No. 20040236268 and U.S. Pat. Nos. 6,491,657 and 6,234,990; herein incorporated by reference in their entireties. Methods of enhancing the permeability of tissue are described in U.S. Publication Nos. 20040171980 and 20040236268 and U.S. Pat. No. 6,190,315; herein incorporated by reference in their entireties.

In one embodiment, a device may be used to increase permeability of tissue before delivering formulations of modified mRNA described herein. The permeability of skin may be measured by methods known in the art and/or described in U.S. Pat. No. 6,190,315, herein incorporated by reference in its entirety. As a non-limiting example, a modified mRNA formulation may be delivered by the drug delivery methods described in U.S. Pat. No. 6,190,315, herein incorporated by reference in its entirety.

In another non-limiting example tissue may be treated with a eutectic mixture of local anesthetics (EMLA) cream before, during and/or after the tissue may be subjected to a device which may increase permeability. Katz et al. (Anesth Analg (2004); 98:371-76; herein incorporated by reference in its entirety) showed that using the EMLA cream in combination with a low energy, an onset of superficial cutaneous analgesia was seen as fast as 5 minutes after a pretreatment with a low energy ultrasound.

In one embodiment, enhancers may be applied to the tissue before, during, and/or after the tissue has been treated to increase permeability. Enhancers include, but are not limited to, transport enhancers, physical enhancers, and cavitation enhancers. Non-limiting examples of enhancers are described in U.S. Pat. No. 6,190,315, herein incorporated by reference in its entirety.

In one embodiment, a device may be used to increase permeability of tissue before delivering formulations of modified mRNA described herein, which may further contain a substance that invokes an immune response. In another non-limiting example, a formulation containing a substance to invoke an immune response may be delivered by the methods described in U.S. Publication Nos. 20040171980 and 20040236268; herein incorporated by reference in their entireties.

Dosage forms for topical and/or transdermal administration of a composition may include ointments, pastes, creams, lotions, gels, foams, powders, solutions, sprays, inhalants and/or patches. Generally, an active ingredient is admixed under sterile conditions with a pharmaceutically acceptable excipient and/or any needed preservatives and/or buffers as may be required. Additionally, the present invention contemplates the use of transdermal patches, which often have the added advantage of providing controlled delivery of a compound to the body. Such dosage forms may be prepared, for example, by dissolving and/or dispensing the compound in the proper medium. Alternatively or additionally, rate may be controlled by either providing a rate controlling membrane and/or by dispersing the compound in a polymer matrix and/or gel.

Formulations suitable for topical administration include, but are not limited to, liquid and/or semi liquid preparations such as liniments, lotions, oil in water and/or water in oil emulsions such as creams, ointments and/or pastes, and/or solutions and/or suspensions.

Topically-administrable formulations may, for example, comprise from about 0.1% to about 10% (w/w) active ingredient, although the concentration of active ingredient may be as high as the solubility limit of the active ingredient in the solvent. Formulations for topical administration may further comprise one or more of the additional ingredients described herein.

Penetration Enhancers

In one embodiment, the signal-sensor polynucleotides, primary construct and mmRNA of present invention may use various penetration enhancers to deliver the signal-sensor polynucleotides, primary construct and mmRNA to at least one area associated with one or more hyperproliferative diseases, disorders or conditions. Most drugs are present in solution in both ionized and nonionized forms. However, usually only lipid soluble or lipophilic drugs readily cross cell membranes. It has been discovered that even non-lipophilic drugs may cross cell membranes if the membrane to be crossed is treated with a penetration enhancer. In addition to aiding the diffusion of non-lipophilic drugs across cell membranes, penetration enhancers also enhance the permeability of lipophilic drugs.

Penetration enhancers may be classified as belonging to one of five broad categories, i.e., surfactants, fatty acids, bile salts, chelating agents, and non-chelating non-surfactants (Lee et al., Critical Reviews in Therapeutic Drug Carrier Systems, 1991, p. 92). Each of the above mentioned classes of penetration enhancers are described below in greater detail. Combinations of penetration enhancer may also be encompassed by the scope of the present invention, for example, fatty acids/salts in combination with bile acids/salts. Other non-limiting examples of combinations of penetration enhancers include the combination of sodium salt of lauric acid, capric acid and UDCA.

Surfactants

In connection with the present invention, surfactants (or "surface-active agents") are chemical entities which, when dissolved in an aqueous solution, reduce the surface tension of the solution or the interfacial tension between the aqueous solution and another liquid, with the result that absorption of the signal-sensor polynucleotides, primary constructs and mmRNA through the mucosa is enhanced. In addition to bile salts and fatty acids, these penetration enhancers include, for example, sodium lauryl sulfate, polyoxyethylene-9-lauryl ether and polyoxyethylene-20-cetyl ether) (Lee et al., Critical Reviews in Therapeutic Drug Carrier Systems, 1991, p. 92); and perfluorochemical emulsions, such as FC-43 (Takahashi et al., J. Pharm. Pharmacol., 1988, 40, 252).

Fatty Acids

Various fatty acids and their derivatives which act as penetration enhancers include, but are not limited to, oleic acid, lauric acid, capric acid (n-decanoic acid), myristic acid, palmitic acid, stearic acid, linoleic acid, linolenic acid, dicaprate, dicaprate, monoolein (1-monooleoyl-rac-glycerol), dilaurin, caprylic acid, arachidonic acid, glycerol 1-monocaprate, 1-dodecylazacycloheptan-2-one, acylcarnitines, acylcholines, $C_1$-$C_{10}$ alkyl esters thereof (e.g., methyl, isopropyl and t-butyl), and mono- and diglycerides thereof (i.e., oleate, laurate, caprate, myristate, palmitate, stearate, linoleate, etc.) (Lee et al., Critical Reviews in Therapeutic Drug Carryier Systems, 1991, p. 92; Muranishi, Critical Reviews in Therapeutic Drug Carrier Systems, 1990, 7, 1-33; El Hariri et al., J. Pharm. Pharmacol., 1992, 44, 651-654).

Bile Salts

The physiological role of bile includes the facilitation of dispersion and absorption of lipids and fat-soluble vitamins (Brunton, Chapter 38 in: Goodman & Gilman's The Pharmacological Basis of Therapeutics, 9th Ed., Hardman et al. Eds., McGraw-Hill, New York, 1996, pp. 934-935). Various natural bile salts, and their synthetic derivatives, act as penetration enhancers. Thus the term "bile salts" includes any of the naturally occurring components of bile as well as any of their synthetic derivatives. The bile salts of the invention include, but are not limited to, cholic acid (or its pharmaceutically acceptable sodium salt, sodium cholate), dehydrocholic acid (sodium dehydrocholate), deoxycholic acid (sodium deoxycholate), glucholic acid (sodium glucholate), glycholic acid (sodium glycocholate), glycodeoxycholic acid (sodium glycodeoxycholate), taurocholic acid (sodium taurocholate), taurodeoxycholic acid (sodium taurodeoxycholate), chenodeoxycholic acid (sodium chenodeoxycholate), ursodeoxycholic acid (UDCA), sodium tauro-24,25-dihydro-fusidate (STDHF), sodium glycodihydrofusidate and polyoxyethylene-9-lauryl ether (POE) (Lee et al., Critical Reviews in Therapeutic Drug Carrier Systems, 1991, page 92; Swinyard, Chapter 39 In: Remington's Pharmaceutical Sciences, 18th Ed., Gennaro, ed., Mack Publishing Co., Easton, Pa., 1990, pages 782-783; Muranishi, Critical Reviews in Therapeutic Drug Carrier Systems, 1990, 7, 1-33; Yamamoto et al., J. Pharm. Exp. Ther., 1992, 263, 25; Yamashita et al., J. Pharm. Sci., 1990, 79, 579-583).

Chelating Agents

Chelating agents, as used in connection with the present invention, can be defined as compounds that remove metallic ions from solution by forming complexes therewith, with the result that absorption of signal-sensor polynucleotides, primary construct and mmRNA through the mucosa is enhanced. With regards to their use as penetration enhancers in the present invention, chelating agents have the added advantage of also serving as DNase inhibitors, as most characterized DNA nucleases require a divalent metal ion for catalysis and are thus inhibited by chelating agents (Jarrett, J. Chromatogr., 1993, 618, 315-339). Chelating agents of the invention include but are not limited to disodium ethylenediaminetetraacetate (EDTA), citric acid, salicylates (e.g., sodium salicylate, 5-methoxysalicylate and homovanilate), N-acyl derivatives of collagen, laureth-9 and N-amino acyl derivatives of beta-diketones (enamines)(Lee et al., Critical Reviews in Therapeutic Drug Carrier Systems, 1991, page 92; Muranishi, Critical Reviews in Therapeutic Drug Carrier Systems, 1990, 7, 1-33; Buur et al., J. Control Rel., 1990, 14, 43-51).

Non-Chelating Non-Surfactants

As used herein, non-chelating non-surfactant penetration enhancing compounds can be defined as compounds that demonstrate insignificant activity as chelating agents or as surfactants but that nonetheless enhance absorption of signal-sensor polynucleotides, primary construct and mmRNA through the alimentary mucosa (Muranishi, Critical Reviews in Therapeutic Drug Carrier Systems, 1990, 7, 1-33). This class of penetration enhancers include, but are not limited to, unsaturated cyclic ureas, 1-alkyl- and 1-alkenylazacycloalkanone derivatives (Lee et al., Critical Reviews in Therapeutic Drug Carrier Systems, 1991, page 92); and non-steroidal anti-inflammatory agents such as diclofenac sodium, indomethacin and phenylbutazone (Yamashita et al., J. Pharm. Pharmacol., 1987, 39, 621-626).

Agents that enhance uptake of signal-sensor polynucleotides, primary construct and mmRNA at the cellular level may also be added to the pharmaceutical and other compositions of the present invention. For example, cationic lipids, such as lipofectin (Junichi et al, U.S. Pat. No. 5,705,188), cationic glycerol derivatives, and polycationic molecules, such as polylysine (Lollo et al., PCT Application WO 97/30731), are also known to enhance the cellular uptake of signal-sensor polynucleotides, primary construct and mmRNA.

Other agents may be utilized to enhance the penetration of the administered signal-sensor polynucleotides, primary construct and mmRNA, including glycols such as ethylene glycol and propylene glycol, pyrrols such as 2-pyrrol, azones, and terpenes such as limonene and menthone.

Depot Administration

As described herein, in some embodiments, the composition is formulated in depots for extended release. Generally, a specific organ or tissue (a "target tissue") is targeted for administration.

In some aspects of the invention, the signal-sensor polynucleotides, primary constructs or mmRNA are spatially retained within or proximal to a target tissue. Provided are method of providing a composition to a target tissue of a mammalian subject by contacting the target tissue (which contains one or more target cells) with the composition under conditions such that the composition, in particular the nucleic acid component(s) of the composition, is substantially retained in the target tissue, meaning that at least 10, 20, 30, 40, 50, 60, 70, 80, 85, 90, 95, 96, 97, 98, 99, 99.9, 99.99 or greater than 99.99% of the composition is retained in the target tissue. Advantageously, retention is determined by measuring the amount of the nucleic acid present in the composition that enters one or more target cells. For example, at least 1, 5, 10, 20, 30, 40, 50, 60, 70, 80, 85, 90, 95, 96, 97, 98, 99, 99.9, 99.99 or greater than 99.99% of the nucleic acids administered to the subject are present intracellularly at a period of time following administration. For example, intramuscular injection to a mammalian subject is performed using an aqueous composition containing a ribonucleic acid and a transfection reagent, and retention of the composition is determined by measuring the amount of the ribonucleic acid present in the muscle cells.

Aspects of the invention are directed to methods of providing a composition to a target tissue of a mammalian subject, by contacting the target tissue (containing one or more target cells) with the composition under conditions such that the composition is substantially retained in the target tissue. The composition contains an effective amount of a signal-sensor polynucleotides, primary constructs or mmRNA such that the polypeptide of interest is produced in at least one target cell. The compositions generally contain a cell penetration agent, although "naked" nucleic acid (such as nucleic acids without a cell penetration agent or other agent) is also contemplated, and a pharmaceutically acceptable carrier.

In some circumstances, the amount of an oncology-related protein produced by cells in a tissue is desirably increased. Preferably, this increase in oncology-related protein production is spatially restricted to cells within the target tissue. Thus, provided are methods of increasing production of an oncology-related protein of interest in a tissue of a mammalian subject. A composition is provided that contains signal-sensor polynucleotides, primary constructs or mmRNA characterized in that a unit quantity of composition has been determined to produce the polypeptide of interest in a substantial percentage of cells contained within a predetermined volume of the target tissue.

In some embodiments, the composition includes a plurality of different signal-sensor polynucleotides, primary constructs or mmRNA, where one or more than one of the signal-sensor polynucleotides, primary constructs or mmRNA encodes an oncology-related polypeptide of interest. Optionally, the composition also contains a cell penetration agent to assist in the intracellular delivery of the composition. A determination is made of the dose of the composition required to produce the oncology-related polypeptide of interest in a substantial percentage of cells contained within the predetermined volume of the target tissue (generally, without inducing significant production of the oncology-related polypeptide of interest in tissue adjacent to the predetermined volume, or distally to the target tissue). Subsequent to this determination, the determined dose is introduced directly into the tissue of the mammalian subject.

In one embodiment, the invention provides for the signal-sensor polynucleotides, primary constructs or mmRNA to be delivered in more than one injection or by split dose injections.

In one embodiment, the invention may be retained near target tissue using a small disposable drug reservoir or patch pump. Non-limiting examples of patch pumps include those manufactured and/or sold by BD® (Franklin Lakes, N.J.), Insulet Corporation (Bedford, Mass.), SteadyMed Therapeutics (San Francisco, Calif.), Medtronic (Minneapolis, Minn.), UniLife (York, Pa.), Valeritas (Bridgewater, N.J.), and SpringLeaf Therapeutics (Boston, Mass.).

Pulmonary Administration

A pharmaceutical composition may be prepared, packaged, and/or sold in a formulation suitable for pulmonary administration via the buccal cavity. Such a formulation may comprise dry particles which comprise the active ingredient and which have a diameter in the range from about 0.5 nm to about 7 nm or from about 1 nm to about 6 nm. Such compositions are suitably in the form of dry powders for administration using a device comprising a dry powder reservoir to which a stream of propellant may be directed to disperse the powder and/or using a self propelling solvent/powder dispensing container such as a device comprising the active ingredient dissolved and/or suspended in a low-boiling propellant in a sealed container. Such powders comprise particles wherein at least 98% of the particles by weight have a diameter greater than 0.5 nm and at least 95% of the particles by number have a diameter less than 7 nm. Alternatively, at least 95% of the particles by weight have a diameter greater than 1 nm and at least 90% of the particles by number have a diameter less than 6 nm. Dry powder compositions may include a solid fine powder diluent such as sugar and are conveniently provided in a unit dose form.

Low boiling propellants generally include liquid propellants having a boiling point of below 65° F. at atmospheric pressure. Generally the propellant may constitute 50% to 99.9% (w/w) of the composition, and active ingredient may constitute 0.1% to 20% (w/w) of the composition. A propellant may further comprise additional ingredients such as a liquid non-ionic and/or solid anionic surfactant and/or a solid diluent (which may have a particle size of the same order as particles comprising the active ingredient).

Pharmaceutical compositions formulated for pulmonary delivery may provide an active ingredient in the form of droplets of a solution and/or suspension. Such formulations may be prepared, packaged, and/or sold as aqueous and/or dilute alcoholic solutions and/or suspensions, optionally sterile, comprising active ingredient, and may conveniently be administered using any nebulization and/or atomization device. Such formulations may further comprise one or more additional ingredients including, but not limited to, a flavoring agent such as saccharin sodium, a volatile oil, a buffering agent, a surface active agent, and/or a preservative such as methylhydroxybenzoate. Droplets provided by this route of administration may have an average diameter in the range from about 0.1 nm to about 200 nm.

Intranasal, Nasal and Buccal Administration

Formulations described herein as being useful for pulmonary delivery are useful for intranasal delivery of a pharmaceutical composition. Another formulation suitable for intranasal administration is a coarse powder comprising the active ingredient and having an average particle from about 0.2 μm to 500 μm. Such a formulation is administered in the manner in which snuff is taken, i.e. by rapid inhalation through the nasal passage from a container of the powder held close to the nose.

Formulations suitable for nasal administration may, for example, comprise from about as little as 0.1% (w/w) and as much as 100% (w/w) of active ingredient, and may comprise one or more of the additional ingredients described herein. A pharmaceutical composition may be prepared, packaged, and/or sold in a formulation suitable for buccal administration. Such formulations may, for example, be in the form of tablets and/or lozenges made using conventional methods, and may, for example, 0.1% to 20% (w/w) active ingredient, the balance comprising an orally dissolvable and/or degradable composition and, optionally, one or more of the additional ingredients described herein. Alternately, formulations suitable for buccal administration may comprise a powder and/or an aerosolized and/or atomized solution and/or suspension comprising active ingredient. Such powdered, aerosolized, and/or aerosolized formulations, when dispersed, may have an average particle and/or droplet size in the range from about 0.1 nm to about 200 nm, and may further comprise one or more of any additional ingredients described herein.

Ophthalmic Administration

A pharmaceutical composition may be prepared, packaged, and/or sold in a formulation suitable for ophthalmic administration. Such formulations may, for example, be in the form of eye drops including, for example, a 0.1/1.0% (w/w) solution and/or suspension of the active ingredient in an aqueous or oily liquid excipient. Such drops may further comprise buffering agents, salts, and/or one or more other of any additional ingredients described herein. Other ophthalmically-administrable formulations which are useful include those which comprise the active ingredient in microcrystalline form and/or in a liposomal preparation. Ear drops and/or eye drops are contemplated as being within the scope of this invention.

Payload Administration: Detectable Agents and Therapeutic Agents

The signal-sensor polynucleotides, primary constructs or mmRNA described herein can be used in a number of different scenarios in which delivery of a substance (the "payload") to a biological target is desired, for example delivery of detectable substances for detection of the target, or delivery of a therapeutic agent. Detection methods can include, but are not limited to, both imaging in vitro and in vivo imaging methods, e.g., immunohistochemistry, bioluminescence imaging (BLI), Magnetic Resonance Imaging (MRI), positron emission tomography (PET), electron microscopy, X-ray computed tomography, Raman imaging, optical coherence tomography, absorption imaging, thermal imaging, fluorescence reflectance imaging, fluorescence microscopy, fluorescence molecular tomographic imaging, nuclear magnetic resonance imaging, X-ray imaging, ultrasound imaging, photoacoustic imaging, lab assays, or in any situation where tagging/staining/imaging is required.

The signal-sensor polynucleotides, primary constructs or mmRNA can be designed to include both a linker and a payload in any useful orientation. For example, a linker having two ends is used to attach one end to the payload and the other end to the nucleobase, such as at the C-7 or C-8 positions of the deaza-adenosine or deaza-guanosine or to the N-3 or C-5 positions of cytosine or uracil. The signal-sensor polynucleotide of the invention can include more than one payload (e.g., a label and a transcription inhibitor), as well as a cleavable linker. In one embodiment, the modified nucleotide is a modified 7-deaza-adenosine triphosphate, where one end of a cleavable linker is attached to the C7 position of 7-deaza-adenine, the other end of the linker is attached to an inhibitor (e.g., to the C5 position of the nucleobase on a cytidine), and a label (e.g., Cy5) is attached to the center of the linker (see, e.g., compound 1 of A*pCp C5 Parg Capless in FIG. 5 and columns 9 and 10 of U.S. Pat. No. 7,994,304, incorporated herein by reference). Upon incorporation of the modified 7-deaza-adenosine triphosphate to an encoding region, the resulting signal-sensor polynucleotide having a cleavable linker attached to a label and an inhibitor (e.g., a polymerase inhibitor). Upon cleavage of the linker (e.g., with reductive conditions to reduce a linker having a cleavable disulfide moiety), the label and inhibitor are released. Additional linkers and payloads (e.g., therapeutic agents, detectable labels, and cell penetrating payloads) are described herein.

For example, the signal-sensor polynucleotides, primary constructs or mmRNA described herein can be used in reprogramming induced pluripotent stem cells (iPS cells), which can directly track cells that are transfected compared to total cells in the cluster. In another example, a drug that may be attached to the signal-sensor polynucleotides, primary constructs or mmRNA via a linker and may be fluorescently labeled can be used to track the drug in vivo, e.g. intracellularly. Other examples include, but are not limited to, the use of signal-sensor polynucleotides, primary constructs or mmRNA in reversible drug delivery into cells.

The signal-sensor polynucleotides, primary constructs or mmRNA described herein can be used in intracellular targeting of a payload, e.g., detectable or therapeutic agent, to specific organelle. Exemplary intracellular targets can include, but are not limited to, the nuclear localization for advanced mRNA processing, or a nuclear localization sequence (NLS) linked to the mRNA containing an inhibitor.

In addition, the signal-sensor polynucleotides, primary constructs or mmRNA described herein can be used to deliver therapeutic agents to cells or tissues, e.g., in living animals. For example, the signal-sensor polynucleotides, primary constructs or mmRNA described herein can be used to deliver highly polar chemotherapeutics agents to kill cancer cells. The signal-sensor polynucleotides, primary constructs or mmRNA attached to the therapeutic agent through a linker can facilitate member permeation allowing the therapeutic agent to travel into a cell to reach an intracellular target.

In another example, the signal-sensor polynucleotides, primary constructs or mmRNA can be attached to the polynucleotides, primary constructs or mmRNA a viral inhibitory peptide (VIP) through a cleavable linker. The cleavable linker can release the VIP and dye into the cell. In another example, the signal-sensor polynucleotides, primary constructs or mmRNA can be attached through the linker to an ADP-ribosylate, which is responsible for the actions of some bacterial toxins, such as cholera toxin, diphtheria toxin, and pertussis toxin. These toxin proteins are ADP-ribosyltransferases that modify target proteins in human cells. For example, cholera toxin ADP-ribosylates G proteins modifies human cells by causing massive fluid secretion from the lining of the small intestine, which results in life-threatening diarrhea.

In some embodiments, the payload may be a therapeutic agent such as a cytotoxin, radioactive ion, chemotherapeutic, or other therapeutic agent. A cytotoxin or cytotoxic agent includes any agent that may be detrimental to cells. Examples include, but are not limited to, taxol, cytochalasin B, gramicidin D, ethidium bromide, emetine, mitomycin, etoposide, teniposide, vincristine, vinblastine, colchicine, doxorubicin, daunorubicin, dihydroxyanthracinedione, mitoxantrone, mithramycin, actinomycin D, 1-dehydrotestosterone, glucocorticoids, procaine, tetracaine, lidocaine, propranolol, puromycin, maytansinoids, e.g., maytansinol (see U.S. Pat. No. 5,208,020 incorporated herein in its entirety), rachelmycin (CC-1065, see U.S. Pat. Nos. 5,475,092, 5,585,499, and 5,846,545, all of which are incorporated herein by reference), and analogs or homologs thereof. Radioactive ions include, but are not limited to iodine (e.g., iodine 125 or iodine 131), strontium 89, phosphorous, palladium, cesium, iridium, phosphate, cobalt, yttrium 90, samarium 153, and praseodymium. Other therapeutic agents include, but are not limited to, antimetabolites (e.g., methotrexate, 6-mercaptopurine, 6-thioguanine, cytarabine, 5-fluorouracil decarbazine), alkylating agents (e.g., mechlorethamine, thiotepa chlorambucil, rachelmycin (CC-1065), melphalan, carmustine (BSNU), lomustine (CCNU), cyclophosphamide, busulfan, dibromomannitol, streptozotocin, mitomycin C, and cis-dichlorodiamine platinum (II) (DDP) cisplatin), anthracyclines (e.g., daunorubicin (formerly daunomycin) and doxorubicin), antibiotics (e.g., dactinomycin (formerly actinomycin), bleomycin, mithramycin, and anthramycin (AMC)), and anti-mitotic agents (e.g., vincristine, vinblastine, taxol and maytansinoids).

In some embodiments, the payload may be a detectable agent, such as various organic small molecules, inorganic compounds, nanoparticles, enzymes or enzyme substrates, fluorescent materials, luminescent materials (e.g., luminol), bioluminescent materials (e.g., luciferase, luciferin, and aequorin), chemiluminescent materials, radioactive materials (e.g., $^{18}F$, $^{67}Ga$, $^{81m}Kr$, $^{82}Rb$, $^{111}In$, $^{123}I$, $^{133}Xe$, $^{201}Tl$, $^{125}I$, $^{35}S$, $^{14}C$, $^{3}H$, or $^{99m}Tc$ (e.g., as pertechnetate (technetate (VII), $TcO_4^-$)), and contrast agents (e.g., gold (e.g., gold nanoparticles), gadolinium (e.g., chelated Gd), iron oxides (e.g., superparamagnetic iron oxide (SPIO), monocrystalline iron oxide nanoparticles (MIONs), and ultrasmall superparamagnetic iron oxide (USPIO)), manganese chelates (e.g., Mn-DPDP), barium sulfate, iodinated contrast media (iohexol), microbubbles, or perfluorocarbons). Such optically-detectable labels include for example, without limitation, 4-acetamido-4'-isothiocyanatostilbene-2,2'disulfonic acid; acridine and derivatives (e.g., acridine and acridine isothiocyanate); 5-(2'-aminoethyl)aminonaphthalene-1-sulfonic acid (EDANS); 4-amino-N-[3-vinylsulfonyl)phenyl]naphthalimide-3,5 disulfonate; N-(4-anilino-1-naphthyl)maleimide; anthranilamide; BODIPY; Brilliant Yellow; coumarin and derivatives (e.g., coumarin, 7-amino-4-methylcoumarin (AMC, Coumarin 120), and 7-amino-4-trifluoromethylcoumarin (Coumarin 151)); cyanine dyes; cyanosine; 4',6-diaminidino-2-phenylindole (DAPI); 5'5"-dibromopyrogallol-sulfonaphthalein (Bromopyrogallol Red); 7-diethylamino-3-(4'-isothiocyanatophenyl)-4-methylcoumarin; diethylenetriamine pentaacetate; 4,4'-diisothiocyanatodihydro-stilbene-2,2'-disulfonic acid; 4,4'-diisothiocyanatostilbene-2,2'-disulfonic acid; 5-[dimethylamino]-naphthalene-1-sulfonyl chloride (DNS, dansylchloride); 4-dimethylaminophenylazophenyl-4'-isothiocyanate (DABITC); eosin and derivatives (e.g., eosin and eosin isothiocyanate); erythrosin and derivatives (e.g., erythrosin B and erythrosin isothiocyanate); ethidium; fluorescein and derivatives (e.g., 5-carboxyfluorescein (FAM), 5-(4,6-dichlorotriazin-2-yl)aminofluorescein (DTAF), 2',7'-dimethoxy-4'5'-dichloro-6-carboxyfluorescein, fluorescein, fluorescein isothiocyanate, X-rhodamine-5-(and 6)-isothiocyanate (QFITC or XRITC), and fluorescamine); 2-[2-[3-[[1,3-dihydro-1,1-dimethyl-3-(3-sulfopropyl)-2H-benz[e]indol-2-ylidene]ethylidene]-2-[4-(ethoxycarbonyl)-

1-piperazinyl]-1-cyclopenten-1-yl]ethenyl]-1,1-dimethyl-3-(3-sulfopropyl)-1H-benz[e]indolium hydroxide, inner salt, compound with n,n-diethylethanamine(1:1) (IR144); 5-chloro-2-[2-[3-[(5-chloro-3-ethyl-2(3H)-benzothiazol-ylidene)ethylidene]-2-(diphenylamino)-1-cyclopenten-1-yl] ethenyl]-3-ethyl benzothiazolium perchlorate (IR140); Malachite Green isothiocyanate; 4-methylumbelliferone orthocresolphthalein; nitrotyrosine; pararosaniline; Phenol Red; B-phycoerythrin; o-phthaldialdehyde; pyrene and derivatives (e.g., pyrene, pyrene butyrate, and succinimidyl 1-pyrene); butyrate quantum dots; Reactive Red 4 (CIBA-CRON™ Brilliant Red 3B-A); rhodamine and derivatives (e.g., 6-carboxy-X-rhodarnine (ROX), 6-carboxyrhodamine (R6G), lissamine rhodamine B sulfonyl chloride rhodarnine (Rhod), rhodamine B, rhodamine 123, rhodamine X isothiocyanate, sulforhodamine B, sulforhodamine 101, sulfonyl chloride derivative of sulforhodamine 101 (Texas Red), N,N,N',N'tetramethyl-6-carboxyrhodamine (TAMRA) tetramethyl rhodamine, and tetramethyl rhodamine isothiocyanate (TRITC)); riboflavin; rosolic acid; terbium chelate derivatives; Cyanine-3 (Cy3); Cyanine-5 (Cy5); cyanine-5.5 (Cy5.5), Cyanine-7 (Cy7); IRD 700; IRD 800; Alexa 647; La Jolta Blue; phthalo cyanine; and naphthalo cyanine.

In some embodiments, the detectable agent may be a non-detectable pre-cursor that becomes detectable upon activation (e.g., fluorogenic tetrazine-fluorophore constructs (e.g., tetrazine-BODIPY FL, tetrazine-Oregon Green 488, or tetrazine-BODIPY TMR-X) or enzyme activatable fluorogenic agents (e.g., PROSENSE® (VisEn Medical))). In vitro assays in which the enzyme labeled compositions can be used include, but are not limited to, enzyme linked immunosorbent assays (ELISAs), immunoprecipitation assays, immunofluorescence, enzyme immunoassays (EIA), radio-immunoassays (RIA), and Western blot analysis. Combinations The signal-sensor polynucleotides, primary constructs or mmRNA may be used in combination with one or more other therapeutic, prophylactic, diagnostic, or imaging agents. By "in combination with," it is not intended to imply that the agents must be administered at the same time and/or formulated for delivery together, although these methods of delivery are within the scope of the present disclosure. Compositions can be administered concurrently with, prior to, or subsequent to, one or more other desired therapeutics or medical procedures. In general, each agent will be administered at a dose and/or on a time schedule determined for that agent. In some embodiments, the present disclosure encompasses the delivery of pharmaceutical, prophylactic, diagnostic, or imaging compositions in combination with agents that may improve their bioavailability, reduce and/or modify their metabolism, inhibit their excretion, and/or modify their distribution within the body. As a non-limiting example, the signal-sensor nucleic acids or mmRNA may be used in combination with a pharmaceutical agent for the treatment of cancer or to control hyperproliferative cells. In U.S. Pat. No. 7,964,571, herein incorporated by reference in its entirety, a combination therapy for the treatment of solid primary or metastasized tumor is described using a pharmaceutical composition including a DNA plasmid encoding for interleukin-12 with a lipopolymer and also administering at least one anticancer agent or chemotherapeutic. Further, the signal-sensor nucleic acids and mmRNA of the present invention that encodes anti-proliferative molecules may be in a pharmaceutical composition with a lipopolymer (see e.g., U.S. Pub. No. 20110218231, herein incorporated by reference in its entirety, claiming a pharmaceutical composition comprising a DNA plasmid encoding an anti-proliferative molecule and a lipopolymer) which may be administered with at least one chemotherapeutic or anticancer agent.

Dosing

The present invention provides methods comprising administering modified mRNAs and their encoded proteins or complexes in accordance with the invention to a subject in need thereof. Nucleic acids, proteins or complexes, or pharmaceutical, imaging, diagnostic, or prophylactic compositions thereof, may be administered to a subject using any amount and any route of administration effective for preventing, treating, diagnosing, or imaging a disease, disorder, and/or condition (e.g., a disease, disorder, and/or condition relating to working memory deficits). The exact amount required will vary from subject to subject, depending on the species, age, and general condition of the subject, the severity of the disease, the particular composition, its mode of administration, its mode of activity, and the like. Compositions in accordance with the invention are typically formulated in dosage unit form for ease of administration and uniformity of dosage. It will be understood, however, that the total daily usage of the compositions of the present invention may be decided by the attending physician within the scope of sound medical judgment. The specific therapeutically effective, prophylactically effective, or appropriate imaging dose level for any particular patient will depend upon a variety of factors including the disorder being treated and the severity of the disorder; the activity of the specific compound employed; the specific composition employed; the age, body weight, general health, sex and diet of the patient; the time of administration, route of administration, and rate of excretion of the specific compound employed; the duration of the treatment; drugs used in combination or coincidental with the specific compound employed; and like factors well known in the medical arts.

In certain embodiments, compositions in accordance with the present invention may be administered at dosage levels sufficient to deliver from about 0.0001 mg/kg to about 100 mg/kg, from about 0.001 mg/kg to about 0.05 mg/kg, from about 0.005 mg/kg to about 0.05 mg/kg, from about 0.001 mg/kg to about 0.005 mg/kg, from about 0.05 mg/kg to about 0.5 mg/kg, from about 0.01 mg/kg to about 50 mg/kg, from about 0.1 mg/kg to about 40 mg/kg, from about 0.5 mg/kg to about 30 mg/kg, from about 0.01 mg/kg to about 10 mg/kg, from about 0.1 mg/kg to about 10 mg/kg, or from about 1 mg/kg to about 25 mg/kg, of subject body weight per day, one or more times a day, to obtain the desired therapeutic, diagnostic, prophylactic, or imaging effect. The desired dosage may be delivered three times a day, two times a day, once a day, every other day, every third day, every week, every two weeks, every three weeks, or every four weeks. In certain embodiments, the desired dosage may be delivered using multiple administrations (e.g., two, three, four, five, six, seven, eight, nine, ten, eleven, twelve, thirteen, fourteen, or more administrations).

According to the present invention, it has been discovered that administration of mmRNA in split-dose regimens produce higher levels of proteins in mammalian subjects. As used herein, a "split dose" is the division of single unit dose or total daily dose into two or more doses, e.g, two or more administrations of the single unit dose. As used herein, a "single unit dose" is a dose of any therapeutic administered in one dose/at one time/single route/single point of contact, i.e., single administration event. As used herein, a "total daily dose" is an amount given or prescribed in 24 hr period. It may be administered as a single unit dose. In one embodiment, the mmRNA of the present invention are administered to a subject in split doses. The mmRNA may be formulated in buffer only or in a formulation described herein.

Dosage Forms

A pharmaceutical composition described herein can be formulated into a dosage form described herein, such as a topical, intranasal, intratracheal, or injectable (e.g., intravenous, intraocular, intravitreal, intramuscular, intracardiac, intraperitoneal, subcutaneous).

Liquid Dosage Forms

Liquid dosage forms for parenteral administration include, but are not limited to, pharmaceutically acceptable emulsions, microemulsions, solutions, suspensions, syrups, and/or elixirs. In addition to active ingredients, liquid dosage forms may comprise inert diluents commonly used in the art including, but not limited to, water or other solvents, solubilizing agents and emulsifiers such as ethyl alcohol, isopropyl alcohol, ethyl carbonate, ethyl acetate, benzyl alcohol, benzyl benzoate, propylene glycol, 1,3-butylene glycol, dimethylformamide, oils (in particular, cottonseed, groundnut, corn, germ, olive, castor, and sesame oils), glycerol, tetrahydrofurfuryl alcohol, polyethylene glycols and fatty acid esters of sorbitan, and mixtures thereof. In certain embodiments for parenteral administration, compositions may be mixed with solubilizing agents such as CREMOPHOR®, alcohols, oils, modified oils, glycols, polysorbates, cyclodextrins, polymers, and/or combinations thereof.

Injectable

Injectable preparations, for example, sterile injectable aqueous or oleaginous suspensions may be formulated according to the known art and may include suitable dispersing agents, wetting agents, and/or suspending agents. Sterile injectable preparations may be sterile injectable solutions, suspensions, and/or emulsions in nontoxic parenterally acceptable diluents and/or solvents, for example, a solution in 1,3-butanediol. Among the acceptable vehicles and solvents that may be employed include, but are not limited to, are water, Ringer's solution, U.S.P., and isotonic sodium chloride solution. Sterile, fixed oils are conventionally employed as a solvent or suspending medium. For this purpose any bland fixed oil can be employed including synthetic mono- or diglycerides. Fatty acids such as oleic acid can be used in the preparation of injectables.

Injectable formulations can be sterilized, for example, by filtration through a bacterial-retaining filter, and/or by incorporating sterilizing agents in the form of sterile solid compositions which can be dissolved or dispersed in sterile water or other sterile injectable medium prior to use.

In order to prolong the effect of an active ingredient, it may be desirable to slow the absorption of the active ingredient from subcutaneous or intramuscular injection. This may be accomplished by the use of a liquid suspension of crystalline or amorphous material with poor water solubility. The rate of absorption of the signal-sensor polynucleotide, primary construct or mmRNA then depends upon its rate of dissolution which, in turn, may depend upon crystal size and crystalline form. Alternatively, delayed absorption of a parenterally administered signal-sensor polynucleotide, primary construct or mmRNA may be accomplished by dissolving or suspending the signal-sensor polynucleotide, primary construct or mmRNA in an oil vehicle. Injectable depot forms are made by forming microencapsule matrices of the signal-sensor polynucleotide, primary construct or mmRNA in biodegradable polymers such as polylactide-polyglycolide. Depending upon the ratio of the signal-sensor polynucleotide, primary construct or mmRNA to polymer and the nature of the particular polymer employed, the rate of signal-sensor polynucleotide, primary construct or mmRNA release can be controlled. Examples of other biodegradable polymers include, but are not limited to, poly(orthoesters) and poly(anhydrides). Depot injectable formulations may be prepared by entrapping the signal-sensor polynucleotide, primary construct or mmRNA in liposomes or microemulsions which are compatible with body tissues.

Pulmonary

Formulations described herein as being useful for pulmonary delivery may also be use for intranasal delivery of a pharmaceutical composition. Another formulation suitable for intranasal administration may be a coarse powder comprising the active ingredient and having an average particle from about 0.2 μm to 500 μm. Such a formulation may be administered in the manner in which snuff is taken, i.e. by rapid inhalation through the nasal passage from a container of the powder held close to the nose.

Formulations suitable for nasal administration may, for example, comprise from about as little as 0.1% (w/w) and as much as 100% (w/w) of active ingredient, and may comprise one or more of the additional ingredients described herein. A pharmaceutical composition may be prepared, packaged, and/or sold in a formulation suitable for buccal administration. Such formulations may, for example, be in the form of tablets and/or lozenges made using conventional methods, and may, for example, contain about 0.1% to 20% (w/w) active ingredient, where the balance may comprise an orally dissolvable and/or degradable composition and, optionally, one or more of the additional ingredients described herein. Alternately, formulations suitable for buccal administration may comprise a powder and/or an aerosolized and/or atomized solution and/or suspension comprising active ingredient. Such powdered, aerosolized, and/or aerosolized formulations, when dispersed, may have an average particle and/or droplet size in the range from about 0.1 nm to about 200 nm, and may further comprise one or more of any additional ingredients described herein.

General considerations in the formulation and/or manufacture of pharmaceutical agents may be found, for example, in Remington: The Science and Practice of Pharmacy $21^{st}$ ed., Lippincott Williams & Wilkins, 2005 (incorporated herein by reference).

Coatings or Shells

Solid dosage forms of tablets, dragees, capsules, pills, and granules can be prepared with coatings and shells such as enteric coatings and other coatings well known in the pharmaceutical formulating art. They may optionally comprise opacifying agents and can be of a composition that they release the active ingredient(s) only, or preferentially, in a certain part of the intestinal tract, optionally, in a delayed manner. Examples of embedding compositions which can be used include polymeric substances and waxes. Solid compositions of a similar type may be employed as fillers in soft and hard-filled gelatin capsules using such excipients as lactose or milk sugar as well as high molecular weight polyethylene glycols and the like.

Properties of Pharmaceutical Compositions

The pharmaceutical compositions described herein can be characterized by one or more of bioavailability, therapeutic window and/or volume of distribution.

Bioavailability

The signal-sensor polynucleotides, primary constructs or mmRNA, when formulated into a composition with a delivery agent as described herein, can exhibit an increase in bioavailability as compared to a composition lacking a delivery agent as described herein. As used herein, the term "bioavailability" refers to the systemic availability of a given amount of signal-sensor polynucleotides, primary constructs or mmRNA administered to a mammal. Bioavailability can be assessed by measuring the area under the curve (AUC) or the maximum serum or plasma concentration ($C_{max}$) of the unchanged form of a compound following administration of the compound to a mammal. AUC is a determination of the area under the curve plotting the serum or plasma concentration of a compound along the ordinate (Y-axis) against time along the abscissa (X-axis). Generally, the AUC for a particular compound can be calculated using methods known to those of ordinary skill in the art and as described in G. S. Banker, Modern Pharmaceutics, Drugs and the Pharmaceutical Sciences, v. 72, Marcel Dekker, New York, Inc., 1996, herein incorporated by reference.

The $C_{max}$ value is the maximum concentration of the compound achieved in the serum or plasma of a mammal following administration of the compound to the mammal. The $C_{max}$ value of a particular compound can be measured using methods known to those of ordinary skill in the art. The phrases "increasing bioavailability" or "improving the pharmacokinetics," as used herein mean that the systemic availability of a first signal-sensor polynucleotide, primary construct or mmRNA, measured as AUC, $C_{max}$, or $C_{min}$ in a mammal is greater, when co-administered with a delivery agent as described herein, than when such co-administration does not take place. In some embodiments, the bioavailability of the signal-sensor polynucleotide, primary construct or mmRNA can increase by at least about 2%, at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, or about 100%.

Therapeutic Window

The signal-sensor polynucleotides, primary constructs or mmRNA, when formulated into a composition with a delivery agent as described herein, can exhibit an increase in the therapeutic window of the administered signal-sensor polynucleotide, primary construct or mmRNA composition as compared to the therapeutic window of the administered signal-sensor polynucleotide, primary construct or mmRNA composition lacking a delivery agent as described herein. As used herein "therapeutic window" refers to the range of plasma concentrations, or the range of levels of therapeutically active substance at the site of action, with a high probability of eliciting a therapeutic effect. In some embodiments, the therapeutic window of the signal-sensor polynucleotide, primary construct or mmRNA when co-administered with a delivery agent as described herein can increase by at least about 2%, at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, or about 100%.

Volume of Distribution

The signal-sensor polynucleotides, primary constructs or mmRNA, when formulated into a composition with a delivery agent as described herein, can exhibit an improved volume of distribution ($V_{dist}$), e.g., reduced or targeted, relative to a composition lacking a delivery agent as described herein. The volume of distribution ($V_{dist}$) relates the amount of the drug in the body to the concentration of the drug in the blood or plasma. As used herein, the term "volume of distribution" refers to the fluid volume that would be required to contain the total amount of the drug in the body at the same concentration as in the blood or plasma: $V_{dist}$ equals the amount of drug in the body/concentration of drug in blood or plasma. For example, for a 10 mg dose and a plasma concentration of 10 mg/L, the volume of distribution would be 1 liter. The volume of distribution reflects the extent to which the drug is present in the extravascular tissue. A large volume of distribution reflects the tendency of a compound to bind to the tissue components compared with plasma protein binding. In a clinical setting, $V_{dist}$ can be used to determine a loading dose to achieve a steady state concentration. In some embodiments, the volume of distribution of the signal-sensor polynucleotide, primary construct or mmRNA when co-administered with a delivery agent as described herein can decrease at least about 2%, at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%.

Biological Effect

In one embodiment, the biological effect of the signal-sensor modified mRNA delivered to the animals may be categorized by analyzing the protein expression in the animals. The protein expression may be determined from analyzing a biological sample collected from a mammal administered the signal-sensor modified mRNA of the present invention. In one embodiment, the expression protein encoded by the signal-sensor modified mRNA administered to the mammal of at least 50 pg/ml may be preferred. For example, a protein expression of 50-200 pg/ml for the protein encoded by the signal-sensor modified mRNA delivered to the mammal may be seen as a therapeutically effective amount of protein in the mammal.

Detection of Modified Nucleic Acids by Mass Spectrometry

Mass spectrometry (MS) is an analytical technique that can provide structural and molecular mass/concentration information on molecules after their conversion to ions. The molecules are first ionized to acquire positive or negative charges and then they travel through the mass analyzer to arrive at different areas of the detector according to their mass/charge (m/z) ratio.

Mass spectrometry is performed using a mass spectrometer which includes an ion source for ionizing the fractionated sample and creating charged molecules for further analysis. For example ionization of the sample may be performed by electrospray ionization (ESI), atmospheric pressure chemical ionization (APCI), photoionization, electron ionization, fast atom bombardment (FAB)/liquid secondary ionization (LSIMS), matrix assisted laser desorption/ionization (MALDI), field ionization, field desorption, thermospray/plasmaspray ionization, and particle beam ionization. The skilled artisan will understand that the choice of ionization method can be determined based on the analyte to be measured, type of sample, the type of detector, the choice of positive versus negative mode, etc.

After the sample has been ionized, the positively charged or negatively charged ions thereby created may be analyzed to determine a mass-to-charge ratio (i.e., m/z). Suitable analyzers for determining mass-to-charge ratios include quadrupole analyzers, ion traps analyzers, and time-of-flight analyzers. The ions may be detected using several detection modes. For example, selected ions may be detected (i.e., using a selective ion monitoring mode (SIM)), or alternatively, ions may be detected using a scanning mode, e.g., multiple reaction monitoring (MRM) or selected reaction monitoring (SRM).

Liquid chromatography-multiple reaction monitoring (LC-MS/MRM) coupled with stable isotope labeled dilution of peptide standards has been shown to be an effective method for protein verification (e.g., Keshishian et al., Mol Cell Proteomics 2009 8: 2339-2349; Kuhn et al., Clin Chem 2009 55:1108-1117; Lopez et al., Clin Chem 2010 56:281-290). Unlike untargeted mass spectrometry frequently used in biomarker discovery studies, targeted MS methods are peptide sequence-based modes of MS that focus the full analytical capacity of the instrument on tens to hundreds of selected peptides in a complex mixture. By restricting detection and fragmentation to only those peptides derived from proteins of interest, sensitivity and reproducibility are improved dramatically compared to discovery-mode MS methods. This method of mass spectrometry-based multiple reaction monitoring (MRM) quantitation of proteins can dramatically impact the discovery and quantitation of biomarkers via rapid, targeted, multiplexed protein expression profiling of clinical samples.

In one embodiment, a biological sample which may contain at least one protein encoded by at least one modified mRNA of the present invention may be analyzed by the method of MRM-MS. The quantification of the biological sample may further include, but is not limited to, isotopically labeled peptides or proteins as internal standards.

According to the present invention, the biological sample, once obtained from the subject, may be subjected to enzyme digestion. As used herein, the term "digest" means to break apart into shorter peptides. As used herein, the phrase "treating a sample to digest proteins" means manipulating a sample in such a way as to break down proteins in a sample. These enzymes include, but are not limited to, trypsin, endoproteinase Glu-C and chymotrypsin. In one embodiment, a biological sample which may contain at least one protein encoded by at least one modified mRNA of the present invention may be digested using enzymes.

In one embodiment, a biological sample which may contain protein encoded by modified mRNA of the present invention may be analyzed for protein using electrospray ionization. Electrospray ionization (ESI) mass spectrometry (ESIMS) uses electrical energy to aid in the transfer of ions from the solution to the gaseous phase before they are analyzed by mass spectrometry. Samples may be analyzed using methods known in the art (e.g., Ho et al., Clin Biochem Rev. 2003 24(1):3-12). The ionic species contained in solution may be transferred into the gas phase by dispersing a fine spray of charge droplets, evaporating the solvent and ejecting the ions from the charged droplets to generate a mist of highly charged droplets. The mist of highly charged droplets may be analyzed using at least 1, at least 2, at least 3 or at least 4 mass analyzers such as, but not limited to, a quadrupole mass analyzer. Further, the mass spectrometry method may include a purification step. As a non-limiting example, the first quadrupole may be set to select a single m/z ratio so it may filter out other molecular ions having a different m/z ratio which may eliminate complicated and time-consuming sample purification procedures prior to MS analysis.

In one embodiment, a biological sample which may contain protein encoded by modified mRNA of the present invention may be analyzed for protein in a tandem ESIMS system (e.g., MS/MS). As non-limiting examples, the droplets may be analyzed using a product scan (or daughter scan) a precursor scan (parent scan) a neutral loss or a multiple reaction monitoring.

In one embodiment, a biological sample which may contain protein encoded by modified mRNA of the present invention may be analyzed using matrix-assisted laser desorption/ionization (MALDI) mass spectrometry (MALDIMS). MALDI provides for the nondestructive vaporization and ionization of both large and small molecules, such as proteins. In MALDI analysis, the analyte is first co-crystallized with a large molar excess of a matrix compound, which may also include, but is not limited to, an ultraviolet absorbing weak organic acid. Non-limiting examples of matrices used in MALDI are α-cyano-4-hydroxycinnamic acid, 3,5-dimethoxy-4-hydroxycinnamic acid and 2,5-dihydroxybenzoic acid. Laser radiation of the analyte-matrix mixture may result in the vaporization of the matrix and the analyte. The laser induced desorption provides high ion yields of the intact analyte and allows for measurement of compounds with high accuracy. Samples may be analyzed using methods known in the art (e.g., Lewis, Wei and Siuzdak, Encyclopedia of Analytical Chemistry 2000:5880-5894). As non-limiting examples, mass analyzers used in the MALDI analysis may include a linear time-of-flight (TOF), a TOF reflectron or a Fourier transform mass analyzer.

In one embodiment, the analyte-matrix mixture may be formed using the dried-droplet method. A biologic sample is mixed with a matrix to create a saturated matrix solution where the matrix-to-sample ratio is approximately 5000:1. An aliquot (approximately 0.5-2.0 uL) of the saturated matrix solution is then allowed to dry to form the analyte-matrix mixture.

In one embodiment, the analyte-matrix mixture may be formed using the thin-layer method. A matrix homogeneous film is first formed and then the sample is then applied and may be absorbed by the matrix to form the analyte-matrix mixture.

In one embodiment, the analyte-matrix mixture may be formed using the thick-layer method. A matrix homogeneous film is formed with a nitro-cellulose matrix additive. Once the uniform nitro-cellulose matrix layer is obtained the sample is applied and absorbed into the matrix to form the analyte-matrix mixture.

In one embodiment, the analyte-matrix mixture may be formed using the sandwich method. A thin layer of matrix crystals is prepared as in the thin-layer method followed by the addition of droplets of aqueous trifluoroacetic acid, the sample and matrix. The sample is then absorbed into the matrix to form the analyte-matrix mixture.

V. Uses of Signal-Sensor Polynucleotides, Primary Constructs and mmRNA of the Invention The signal-sensor polynucleotides, primary constructs and mmRNA of the present invention are designed, in preferred embodiments, to provide for avoidance or evasion of deleterious bio-responses such as the immune response and/or degradation pathways, overcoming the threshold of expression and/or improving protein production capacity, improved expression rates or translation efficiency, improved drug or protein half life and/or protein concentrations, optimized protein localization, to improve one or more of the stability and/or clearance in tissues, receptor uptake and/or kinetics, cellular access by the compositions, engagement with translational machinery, secretion efficiency

Therapeutics

Therapeutic Agents

The signal-sensor polynucleotides, primary constructs or mmRNA of the present invention, such as modified nucleic acids and modified RNAs, and the proteins translated from them described herein can be used as therapeutic or prophylactic agents. They are provided for use in medicine. For example, signal-sensor polynucleotide, primary construct or mmRNA described herein can be administered to a subject, wherein the signal-sensor polynucleotide, primary construct or mmRNA is translated in vivo to produce a therapeutic or prophylactic oncology-related polypeptide in the subject. Provided are compositions, methods, kits, and reagents for diagnosis, treatment or prevention of a disease or condition in humans and other mammals. The active therapeutic agents of the invention include signal-sensor polynucleotides, primary constructs or mmRNA, cells containing polynucleotides, primary constructs or mmRNA or polypeptides translated from the signal-sensor polynucleotides, primary constructs or mmRNA.

In certain embodiments, provided herein are combination therapeutics containing one or more signal-sensor polynucleotide, primary construct or mmRNA containing translatable regions that encode for a protein or proteins that boost a mammalian subject's immunity along with a protein that induces antibody-dependent cellular toxicity.

Provided herein are methods of inducing translation of a recombinant polypeptide in a cell population using the signal-sensor polynucleotide, primary construct or mmRNA described herein. Such translation can be in vivo, ex vivo, in culture, or in vitro. The cell population is contacted with an effective amount of a composition containing the signal-sensor nucleic acid that has at least one nucleoside modification, and a translatable region encoding the recombinant oncology-related polypeptide. The population is contacted under conditions such that the signal-sensor nucleic acid is localized into one or more cells of the cell population and the recombinant oncology-related polypeptide is translated in the cell from the signal-sensor nucleic acid.

An "effective amount" of the composition is provided based, at least in part, on the target tissue, target cell type, means of administration, physical characteristics of the nucleic acid (e.g., size, and extent of modified nucleosides), and other determinants. In general, an effective amount of the composition provides efficient protein production in the cell, preferably more efficient than a composition containing a corresponding unmodified nucleic acid. Increased efficiency may be demonstrated by increased cell transfection (i.e., the percentage of cells transfected with the nucleic acid), increased protein translation from the nucleic acid, decreased nucleic acid degradation (as demonstrated, e.g., by increased duration of protein translation from a modified nucleic acid), or reduced innate immune response of the host cell.

Aspects of the invention are directed to methods of inducing in vivo translation of a recombinant polypeptide in a mammalian subject in need thereof. Therein, an effective amount of a composition containing a nucleic acid that has at least one structural or chemical modification and a translatable region encoding the recombinant polypeptide is administered to the subject using the delivery methods described herein. The nucleic acid is provided in an amount and under other conditions such that the nucleic acid is localized into a cell of the subject and the recombinant polypeptide is translated in the cell from the nucleic acid. The cell in which the nucleic acid is localized, or the tissue in which the cell is present, may be targeted with one or more than one rounds of nucleic acid administration.

In certain embodiments, the administered signal-sensor polynucleotide, primary construct or mmRNA directs production of one or more recombinant polypeptides that provide a functional activity which is substantially absent in the cell, tissue or organism in which the recombinant oncology-related polypeptide is translated. For example, the missing functional activity may be enzymatic, structural, or gene regulatory in nature. In related embodiments, the administered signal-sensor polynucleotide, primary construct or mmRNA directs production of one or more recombinant oncology-related polypeptides that increases (e.g., synergistically) a functional activity which is present but substantially deficient in the cell in which the recombinant oncology-related polypeptide is translated.

In other embodiments, the administered signal-sensor polynucleotide, primary construct or mmRNA directs production of one or more recombinant polypeptides that replace an oncology-related polypeptide (or multiple oncology-related polypeptides) that is substantially absent in the cell in which the recombinant oncology-related polypeptide is translated. Such absence may be due to genetic mutation of the encoding gene or regulatory pathway thereof. In some embodiments, the recombinant oncology-related polypeptide increases the level of an endogenous oncology-related protein in the cell to a desirable level; such an increase may bring the level of the endogenous oncology-related protein from a subnormal level to a normal level or from a normal level to a super-normal level.

Alternatively, the recombinant oncology-related polypeptide functions to antagonize the activity of an endogenous protein present in, on the surface of, or secreted from the cell. Usually, the activity of the endogenous oncology-related protein is deleterious to the subject; for example, due to mutation of the endogenous oncology-related protein resulting in altered activity or localization. Additionally, the recombinant oncology-related polypeptide antagonizes, directly or indirectly, the activity of a biological moiety present in, on the surface of, or secreted from the cell. Examples of antagonized biological moieties include lipids (e.g., cholesterol), a lipoprotein (e.g., low density lipoprotein), a nucleic acid, a carbohydrate, a protein toxin such as shiga and tetanus toxins, or a small molecule toxin such as botulinum, cholera, and diphtheria toxins. Additionally, the antagonized biological molecule may be an endogenous protein that exhibits an undesirable activity, such as a cytotoxic or cytostatic activity.

The recombinant oncology-related proteins described herein may be engineered for localization within the cell, potentially within a specific compartment such as the nucleus, or are engineered for secretion from the cell or translocation to the plasma membrane of the cell.

In some embodiments, modified signal-sensor mRNAs and their encoded oncology-related polypeptides in accordance with the present invention may be used for treatment of any of a variety of diseases, disorders, and/or conditions described herein.

Oncology-Related Applications

In one embodiment, the signal-sensor polynucleotides, primary constructs and/or mmRNA may be used in the treatment, management, characterization and/or diagnosis of cancer, a cancer-related and/or a cancer treatment-related disorder, side effect and/or condition. Such disease, disorders and conditions include, but are not limited to, adrenal cortical cancer, advanced cancer, anal cancer, aplastic anemia, bileduct cancer, bladder cancer, bone cancer, bone metastasis, brain tumors, brain cancer, breast cancer, childhood cancer, cancer of unknown primary origin, Castleman disease, cervical cancer, colon/rectal cancer, endometrial cancer, esophagus cancer, Ewing family of tumors, eye cancer, fallopian tube cancer, gallbladder cancer, gastrointestinal carcinoid tumors, gastrointestinal stromal tumors, gestational trophoblastic disease, Hodgkin disease, Kaposi sarcoma, renal cell carcinoma, laryngeal and hypopharyngeal cancer, acute lymphocytic leukemia, acute myeloid leukemia, chronic lymphocytic leukemia, chronic myeloid leukemia, chronic myelomonocytic leukemia, liver cancer, non-small cell lung cancer, small cell lung cancer, lung carcinoid tumor, lymphoma of the skin, malignant mesothelioma, multiple myeloma, myelodysplastic syndrome, nasal cavity and paranasal sinus cancer, nasopharyngeal cancer, neuroblastoma, non-Hodgkin lymphoma, oral cavity and oropharyngeal cancer, osteosarcoma, ovarian cancer, pancreatic cancer, penile cancer, pituitary tumors, prostate cancer, retinoblastoma, rhabdomyosarcoma, salivary gland cancer, sarcoma in adult soft tissue, basal and squamous cell skin cancer, melanoma, small intestine cancer, stomach cancer, testicular cancer, thymus cancer, thyroid cancer, uterine sarcoma, vaginal cancer, vulvar cancer, Waldenstrom macroglobulinemia, Wilms tumor.

In another embodiment, the signal-sensor polynucleotides, primary constructs and/or mmRNA may be used in the treating, managing or manipulating at least one cancer-related or cancer treatment-related disorder, side effect or condition such as chemo brain, peripheral neuropathy, fatigue, depression, nausea and vomiting, pain, anemia, lymphedema, infections, second cancers caused by cancer treatment, sexual side effects, reduced fertility or infertility, ostomies, insomnia and hair loss.

In one embodiment, the signal-sensor polynucleotides, primary constructs and/or mmRNA may be used to reduce the effect of at least one symptom of cancer in a subject. The symptom may include, but is not limited to, weakness, aches and pains, fever, fatigue, weight loss, blood clots, increased blood calcium levels, low white blood cell count, short of breath, dizziness, headaches, hyperpigmentation, jaundice, erthema, pruritis, excessive hair growth, change in bowel habits, change in bladder function, long-lasting sores, white patches inside the mouth, white spots on the tongue, unusual bleeding or discharge, thickening or lump on parts of the body, indigestion, trouble swallowing, changes in warts or moles, change in new skin and nagging cough or hoarseness.

In one embodiment, the signal-sensor polynucleotides may be investigated in any number of cancer or normal cell lines. Non-limiting examples of cell lines which may be useful in these investigations include those from ATCC (Manassas, Va.) including MRC-5, A549, T84, NCI-H2126 [H2126], NCI-H1688 [H1688], WI-38, WI-38 VA-13 subline 2RA, WI-26 VA4, C3A [HepG2/C3A, derivative of Hep G2 (ATCC HB-8065)], THLE-3, H69AR, NCI-H292 [H292], CFPAC-1, NTERA-2 cl.D1 [NT2/D1], DMS 79, DMS 53, DMS 153, DMS 114, MSTO-211H, SW 1573 [SW-1573, SW1573], SW 1271 [SW-1271, SW1271], SHP-77, SNU-398, SNU-449, SNU-182, SNU-475, SNU-387, SNU-423, NL20, NL20-TA [NL20T-A], THLE-2, HBE135-E6E7, HCC827, HCC4006, NCI-H23 [H23], NCI-H1299, NCI-H187 [H187], NCI-H358 [H-358, H358], NCI-H378 [H378], NCI-H522 [H522], NCI-H526 [H526], NCI-H727 [H727], NCI-H810 [H810], NCI-H889 [H889], NCI-H1155 [H1155], NCI-H1404 [H1404], NCI-N87 [N87], NCI-H196 [H196], NCI-H211 [H211], NCI-H220 [H220], NCI-H250 [H250], NCI-H524 [H524], NCI-H647 [H647], NCI-H650 [H650], NCI-H711 [H711], NCI-H719 [H719], NCI-H740 [H740], NCI-H748 [H748], NCI-H774 [H774], NCI-H838 [H838], NCI-H841 [H841], NCI-H847 [H847], NCI-H865 [H865], NCI-H920 [H920], NCI-H1048 [H1048], NCI-H1092 [H1092], NCI-H1105 [H1105], NCI-H1184 [H1184], NCI-H1238 [H1238], NCI-H1341 [H1341], NCI-H1385 [H1385], NCI-H1417 [H1417], NCI-H1435 [H1435], NCI-H1436 [H1436], NCI-H1437 [H1437], NCI-H1522 [H1522], NCI-H1563 [H1563], NCI-H1568 [H1568], NCI-H1573 [H1573], NCI-H1581 [H1581], NCI-H1618 [H1618], NCI-H1623 [H1623], NCI-H1650 [H-1650, H1650], NCI-H1651 [H1651], NCI-H1666 [H-1666, H1666], NCI-H1672 [H1672], NCI-H1693 [H1693], NCI-H1694 [H1694], NCI-H1703 [H1703], NCI-H1734 [H-1734, 141734], NCI-H1755 [H1755], NCI-H1755 [H1755], NCI-H1770 [H1770], NCI-H1793 [H1793], NCI-H1836 [H1836], NCI-H1838 [H1838], NCI-H1869 [H1869], NCI-H1876 [H1876], NCI-H1882 [H1882], NCI-H1915 [H1915], NCI-H1930 [H1930], NCI-H1944 [H1944], NCI-H1975 [H-1975, H1975], NCI-H1993 [H1993], NCI-H2023 [H2023], NCI-H2029 [H2029], NCI-H2030 [H2030], NCI-H2066 [H2066], NCI-H2073 [H2073], NCI-H2081 [H2081], NCI-H2085 [H2085], NCI-H2087 [H2087], NCI-H2106 [H2106], NCI-H2110 [H2110], NCI-H2135 [H2135], NCI-H2141 [H2141], NCI-H2171 [H2171], NCI-H2172 [H2172], NCI-H2195 [H2195], NCI-H2196 [H2196], NCI-H2198 [H2198], NCI-H2227 [H2227], NCI-H2228 [H2228], NCI-H2286 [H2286], NCI-H2291 [H2291], NCI-H2330 [H2330], NCI-H2342 [H2342], NCI-H2347 [H2347], NCI-H2405 [H2405], NCI-H2444 [H2444], UMC-11, NCI-H64 [H64], NCI-H735 [H735], NCI-H735 [H735], NCI-H1963 [H1963], NCI-H2107 [H2107], NCI-H2108 [H2108], NCI-H2122 [H2122], Hs 573.T, Hs 573.Lu, PLC/PRF/5, BEAS-2B, Hep G2, Tera-1, Tera-2, NCI-H69 [H69], NCI-H128 [H128], ChaGo-K-1, NCI-H446 [H446], NCI-H209 [H209], NCI-H146 [H146], NCI-H441 [H441], NCI-H82 [H82], NCI-H460 [H460], NCI-H596 [H596], NCI-H676B [H676B], NCI-H345 [H345], NCI-H820 [H820], NCI-H520 [H520], NCI-H661 [H661], NCI-H510A [H510A, NCI-H510], SK-HEP-1, A-427, Calu-1, Calu-3, Calu-6, SK-LU-1, SK-MES-1, SW 900 [SW-900, SW900], Malme-3M, and Capan-1.

In one embodiment, the signal-sensor polynucleotides described herein may be investigated in human lung adenocarcinoma. As a non-limiting example, a signal-sensor polynucleotide encoding constitutively active caspase 3 fully modified with 5-methylcytidine and 1-methylpseudouridine or fully modified with 1-methylpseudouridine may be delivered to cultured human lung adenocarcinoma A549 cells (see e.g., the experiment outlined in Example 53). As another non-limiting example, a signal-sensor polynucleotide encoding constitutively active caspase 6 fully modified with 5-methylcytidine and 1-methylpseudouridine or fully modified with 1-methylpseudouridine may be delivered to cultured human lung adenocarcinoma A549 cells (see e.g., the experiment outlined in Example 53).

In another embodiment, the signal-sensor polynucleotides described herein may be investigated in human hepatocellular carcinoma. As a non-limiting example, a signal-sensor polynucleotide encoding constitutively active caspase 3 fully modified with 5-methylcytidine and 1-methylpseudouridine or fully modified with 1-methylpseudouridine may be delivered to human hepatocellular carcinoma Hep3B cells (see e.g., the experiment outlined in Example 54).

In one embodiment, the signal-sensor polynucleotides may be investigated in an animal model. As a non-limiting example, the animal model may be for lung cancer such as the lung cancer model of Fukazawa et al (Anticancer Research, 2010; 30: 4193-4200) where a congenic mouse is created by crossing a ubiquitously expressing dominant negative Myc (Omomyc) mouse with a KRAS mutation-positive lung cancer model mouse. In the presence of Omomyc, lung tumors caused by the expression of mutated KRAS regresses in the congenic mouse, indicating that Omomyc caused tumor cell death of KRAS mutation-positive lung cancer.

As another non-limiting example, Human lung cancer xenografts are also prepared by the method of Fukazawa where human lung cancer xenografts are established in 4-week-old female BALB/C nude mice (Charles River Laboratories Japan, Kanagawa, Japan) by subcutaneous inoculation of $4 \times 10^6$ A549 cells into the dorsal flank. The mice are randomly assigned into six groups (n=6/group). After the tumors reach a diameter of about 0.5 cm (approximately 6 days after tumor inoculations), each group of mice are injected with 100 µl solution containing PBS, $5 \times 10^{10}$ vp of control or signal-sensor polynucleotide into the dorsal flank tumor for the selected dosing regimen. Animals are then observed closely and survival studies or other analyses are performed.

In one embodiment, the signal-sensor polynucleotides may be investigated in a transgenic animal model. As a non-limiting example, the transgenic animal model is a LSL-KRAS$^{G12D}$: TRE Omomyc:CMV rtTA triple transgenic model which involves the use of an adenovirus expressing Cre recombinase which is administered via inhalation to induce oncogene expression via excision of the foxed STOP codon, and ubiquitous Omomyc expression is controlled via doxycycline. The model is reported in Soucek et al. (Nature, 1-5 (2008)). As another non-limiting example, the mice of Soucek may be crossed with the LSLKRAS$^{G12D}$ single transgenic mice (Jackson Laboratories) and may be used for inhalation delivered or otherwise lung-delivered studies of signal-sensor polynucleotides expressing MYC inhibitor D or other oncology related polypeptide described herein.

In another embodiment, the signal-sensor polynucleotides may be investigated in a mouse-in-mouse model such as, but not limited to a model which is akin to the p53−/−:c-Myc overexpressing HCC model of Zender (Cell. 2006 Jun. 30; 125(7): 1253-1267).

In one embodiment, the signal-sensor polynucleotides may be investigated in a Nongermline genetically engineered mouse model (NGEMM). As a non-limiting example, the design of mouse-in-mouse model may involve starting with the WT or tumor suppressor deleted (such as p53−/−) 129 Sv/Ev Mm ES cell clone; introduction of liver activated protein (LAP) promoter directed tetracycline transactivator (tTA) and tetO-luciferase for liver specific imaging; freezing the resulting LAP-tTA: tetO-luciferase clones to be used for c-Myc as well as other liver relevant programs oncogene; adding tetO driven oncogene, e.g. tetOcMyc; Freeze resulting LAP-tTA: tetO-luciferase: tetO-MYC clones; injecting resulting ES clones into C57BU6 blastocytes and implant in pseudo pregnant mothers whereby the resulting chimeric animals are the tumor model upon removal of doxycycline (i.e. Tet-Off). The type of model will ideally evince inducible nodules of c-Myc-driven, luciferase-expressing HCC surrounded by normal hepatocytes.

In another embodiment, the signal-sensor polynucleotides may be investigated in Orthotopic HCC models using the HEP3B cell lines in mice (Crown Bio).

As a non-limiting example, any of the animal models described above may be used to investigate a signal-sensor polynucleotide encoding MYC inhibitor D. The study may also include a signal-sensor polynucleotide encoding a negative control such as, but not limited to, an untranslatable mRNA for MYC inhibitor D and a vehicle only delivery. The animal may be evaluated for gene expression, tumor status and/or for any of the hallmarks that are generally associated with cancer phenotypes or genotypes.

As another non-limiting example, any of the animal models described above may be used to investigate a signal-sensor polynucleotide encoding dominant negative hTERT. The study may also include a signal-sensor polynucleotide encoding a negative control such as, but not limited to, an untranslatable mRNA for dominant negative hTERT and a vehicle only delivery. The animal may be evaluated for gene expression, tumor status and/or for any of the hallmarks that are generally associated with cancer phenotypes or genotypes.

As another non-limiting example, any of the animal models described above may be used to investigate a signal-sensor polynucleotide encoding dominant negative survivin. The study may also include a signal-sensor polynucleotide encoding a negative control such as, but not limited to, an untranslatable mRNA for dominant negative survivin and a vehicle only delivery. The animal may be evaluated for gene expression, tumor status and/or for any of the hallmarks that are generally associated with cancer phenotypes or genotypes.

In one embodiment, signal-sensor polynucleotides may include at least one miRNA-binding site in the 3'UTR in order to direct cytotoxic or cytoprotective mRNA therapeutics to specific cells such as, but not limited to, normal and/or cancerous cells in an animal model described herein. As a non-limiting example, a strong apoptotic signal and at least one miR-122a binding site is encoded by the signal-sensor polynucleotide where the at least one miR-122a binding site is located in the 3'UTR. As another non-limiting example, apoptosis inducing factor short isoform (AIFsh) and at least one miR-122a binding site is encoded by the signal-sensor polynucleotide where the at least one miR-122a binding site is located in the 3'UTR. As yet another non-limiting example, constitutively active (C.A.) caspase 6 and at least one miR-122a binding site is encoded by the signal-sensor polynucleotide where the at least one miR-122a binding site is located in the 3'UTR. As another non-limiting example, HSV1-tk and at least one miR-122a binding site is encoded by the signal-sensor polynucleotide where the at least one miR-122a binding site is located in the 3'UTR.

In another embodiment, signal-sensor polynucleotides may include three miRNA-binding sites in the 3'UTR in order to direct cytotoxic or cytoprotective mRNA therapeutics to specific cells such as, but not limited to, normal and/or cancerous cells in an animal model described herein. As a non-limiting example, a strong apoptotic signal and three miR-122a binding sites are encoded by the signal-sensor polynucleotide where the three miR-122a binding sites are located in the 3'UTR. As another non-limiting example, apoptosis inducing factor short isoform (AIFsh) and three miR-122a binding sites are encoded by the signal-sensor polynucleotide where the three miR-122a binding sites are located in the 3'UTR. As yet another non-limiting example, constitutively active (C.A.) caspase 6 and three miR-122a binding sites are encoded by the signal-sensor polynucleotide where the three miR-122a binding sites are located in the 3'UTR. As another non-limiting example, HSV1-tk and three miR-122a binding sites are encoded by the signal-sensor polynucleotide where the three miR-122a binding sites are located in the 3'UTR.

Common Categories of Cancer

Brain Cancer

Brain cancer is the growth of abnormal cells in the tissues of the brain usually related to the growth of malignant brain tumors. Brain tumors grow and press on the nearby areas of the brain which can stop that part of the brain from working the way it should. Brain cancer rarely spreads into other tissues outside of the brain. The grade of tumor, based on how abnormal the cancer cells look under a microscope, may be used to tell the difference between slow- and fast-growing tumors. Grade I tumors grow slowly, rarely spreads into nearby tissues, has cells that look like normal cells and the entire tumor may be removable by surgery. Grade II tumors also grow slowly but may spread into nearby tissue and may recur. Grade III tumors grow quickly, is likely to spread into nearby tissue and the tumor cells look very different from normal cells. Grade IV, high-grade, grows and spreads very quickly and there may be areas of dead cells in the tumor. Symptoms of brain cancer may include, but are not limited to, morning headache or headache that goes away after vomiting, frequent nausea and vomiting, vision, hearing, and speech problems, loss of balance and trouble walking, weakness on one side of the body, unusual sleepiness or change in activity level, unusual changes in personality or behavior, seizures.

In one embodiment, the signal-sensor polynucleotides, primary constructs or mmRNA of the present invention may be used to treat a disease, disorder and/or condition in a subject who has been diagnosed or may be diagnosed with brain cancer by administering to said subject an isolated polynucleotide encoding an oncology-related polypeptide of interest. In one embodiment, the polynucleotides, primary constructs or mmRNA of the present invention may be used to reduce, eliminate, or prevent tumor growth in a subject who has been diagnosed or may be diagnosed with brain cancer by administering to said subject an isolated polynucleotide encoding an oncology-related polypeptide of interest. In one embodiment, the signal-sensor polynucleotides, primary constructs or mmRNA of the present invention may be used to reduce and/or ameliorate at least one symptom of cancer in a subject who has been diagnosed or may be diagnosed with brain cancer by administering to said subject an isolated polynucleotide encoding an oncology-related polypeptide of interest.

Breast Cancer

Breast cancer forms in the tissues of the breast, of both men and women, such as, but not limited to, the ducts and the lobules. The most common type of breast cancer is ductal carcinoma which begins in the cells of the ducts. Lobular cancer, which begins in the lobes or lobules, is often found in both breasts. An uncommon type of breast cancer, inflammatory breast cancer, causes the breast to be warm, red and swollen. Hereditary breast cancer makes up approximately 5-10% of all breast cancer and altered genes are common in some ethnic groups making that ethnic group more susceptible to breast cancer. Symptoms of breast cancer include, but are not limited to, a lump or thickening in or near the breast or in the underarm area, change in the size or shape of the breast, dimple or puckering in the skin of the breast, inward turned nipple of the breast, fluid from the nipple which is not breast milk, scaly, red or swollen skin on the breast, nipple, or areola, and dimples in the breast that look like the skin of orange (peau d'orange).

In one embodiment, the signal-sensor polynucleotides, primary constructs or mmRNA of the present invention may be used to treat a disease, disorder and/or condition in a subject who has been diagnosed or may be diagnosed with breast cancer by administering to said subject an isolated polynucleotide encoding an oncology-related polypeptide of interest. In one embodiment, the polynucleotides, primary constructs or mmRNA of the present invention may be used to reduce, eliminate, or prevent tumor growth in a subject who has been diagnosed or may be diagnosed with breast cancer by administering to said subject an isolated polynucleotide encoding an oncology-related polypeptide of interest. In one embodiment, the signal-sensor polynucleotides, primary constructs or mmRNA of the present invention may be used to reduce and/or ameliorate at least one symptom of cancer in a subject who has been diagnosed or may be diagnosed with breast cancer by administering to said subject an isolated polynucleotide encoding an oncology-related polypeptide of interest.

Cervical Cancer

Cervical cancer forms in the tissues of the cervix and is usually slow-growing. The cause of cervical cancer usually related to the human papillomavirus (NPV) infection. Although cervical cancer may not show any signs, possible symptoms may include, but are not limited to, vaginal bleeding, unusual vaginal discharge, pelvic pain and pain during sexual intercourse.

In one embodiment, the signal-sensor polynucleotides, primary constructs or mmRNA of the present invention may be used to treat a disease, disorder and/or condition in a subject who has been diagnosed or may be diagnosed with cervical cancer by administering to said subject an isolated polynucleotide encoding an oncology-related polypeptide of interest. In one embodiment, the signal-sensor polynucleotides, primary constructs or mmRNA of the present invention may be used to reduce, eliminate, or prevent tumor growth in a subject who has been diagnosed or may be diagnosed with cervical cancer by administering to said subject an isolated polynucleotide encoding an oncology-related polypeptide of interest. In one embodiment, the signal-sensor polynucleotides, primary constructs or mmRNA of the present invention may be used to reduce and/or ameliorate at least one symptom of cancer in a subject who has been diagnosed or may be diagnosed with cervical cancer by administering to said subject an isolated polynucleotide encoding an oncology-related polypeptide of interest.

Esophageal Cancer

Esophageal cancer is cancer that forms in the tissues lining the esophagus. There are two common types of esophageal cancer which are named for the type of cells that become malignant. Squamous cell carcinoma is cancer that forms in the thin, flat cells lining the esophagus (also called epidermoid carcinoma). Cancer that begins in the glandular (secretory) cells which produce and release fluids such as mucus is called adenocarcinoma. Common symptoms associated with esophageal cancer include, but are not limited to, painful or difficult swallowing, weight loss, pain behind the breastbone, hoarseness and cough, and indigestion and heartburn.

In one embodiment, the signal-sensor polynucleotides, primary constructs or mmRNA of the present invention may be used to treat a disease, disorder and/or condition in a subject who has been diagnosed or may be diagnosed with esophageal cancer by administering to said subject an isolated polynucleotide encoding an oncology-related polypeptide of interest. In one embodiment, the signal-sensor polynucleotides, primary constructs or mmRNA of the present invention may be used to reduce, eliminate, or prevent tumor growth in a subject who has been diagnosed or may be diagnosed with esophageal cancer by administering to said subject an isolated polynucleotide encoding an oncology-related polypeptide of interest. In one embodiment, the signal-sensor polynucleotides, primary constructs or mmRNA of the present invention may be used to reduce and/or ameliorate at least one symptom of cancer in a subject who has been diagnosed or may be diagnosed with esophageal cancer by administering to said subject an isolated polynucleotide encoding an oncology-related polypeptide.

Familial Cancer Syndrome

Familial cancer syndrome describes the genetic predisposition of a subject to develop cancer. 5-10% of all cancers are hereditary and are passed on through specific in specific genes passed from one blood relative to another. Subjects that inherit one of these gene changes may have a higher likelihood of developing cancer within their lifetime. Familial cancer syndrome includes disorder such as, but not limited to, Ataxia Telangiectasia, Basal Cell Nevus Syndrome, Nevoid Basal Cell Carcinoma Syndrome, Gorlin Syndrome, Beck-with Wiedemann Syndrome, Birt-Hogg-Dube Syndrome, Bloom Syndrome, hereditary breast and/or ovarian cancer, Carney Complex, Types I and II, Familial Chordoma, Colon Cancer, Hereditary Nonpolyposis-Lynch Syndrome, Costello Syndrome, Facio-Cutaneous-Skeletal Syndrome, Cowden Syndrome, Dyskeratosis Congenita, Tylosis with Esophageal Cancer, Keratosis Palmaris et Plantaris with Esophageal Cancer, Howel-Evans Syndrome, Hereditary Multiple Exostosis, Fanconi Anemia, Hereditary Diffuse Gastric Cancer, Gastrointestinal Stromal Tumor, Multiple Gastrointestinal Stromal Tumor, Familial Hyperparathyroidism, Acute Myeloid Leukemia, Familial Leukemia, Chronic Lymphocytic Leukemia, Li-Fraumeni Syndrome, Hodgkin Lymphoma, Non-Hodgkin Lymphoma, Hereditary Multiple Melanoma, Mosaic Varigated Aneuploidy, Multiple Endocrine Neoplasia Type I, Type 2A and 2B, Familial Medullary Thyroid Cancer, Familial Multiple Myeloma, Hereditary Neuroblastoma, Neurofibromatosis Type 1 and 2, Nijmegen Breakage Syndrome, Hereditary Pancreatic Cancer, Hereditary Paraganglioma, Peutz-Jeghers Syndrome, Familial Adenomatous Polyposis, Familial Juvenile Polyposis, MYH-Associated Polyposis, Hereditary Prostate Cancer, Hereditary Renal Cell Carcinoma with Multiple Cutaneous and Uterine Leiomyomas, Hereditary Renal Cell Carcinoma, Hereditary Papillary Renal Cell Carcinoma, Rhabdoid Predisposition Syndrome, Rothmund-Thomson Syndrome, Simpson-Golabi-Behmel Syndrome, Familial Testicular Germ Cell Tumor, Familial Non-medullary Thyroid Carcinoma, Tuberous Sclerosis Complex, von Hippel-Lindau Syndrome, Familial Waldenstrom Macroglobulinemia, Werner Syndrome, Familial Wilms Tumor and Xeroderma Pigmentosum.

In one embodiment, the signal-sensor polynucleotides, primary constructs or mmRNA of the present invention may be used to treat a disease, disorder and/or condition in a subject who has been diagnosed or may be diagnosed with Familial cancer syndrome by administering to said subject an isolated polynucleotide encoding an oncology-related polypeptide of interest. In one embodiment, the signal-sensor polynucleotides, primary constructs or mmRNA of the present invention may be used to reduce, eliminate, or prevent tumor growth in a subject who has been diagnosed or may be diagnosed with Familial cancer syndrome by administering to said subject an isolated polynucleotide encoding an oncology-related polypeptide of interest. In one embodiment, the signal-sensor polynucleotides, primary constructs or mmRNA of the present invention may be used to reduce and/or ameliorate at least one symptom of cancer in a subject who has been diagnosed or may be diagnosed with Familial cancer syndrome by administering to said subject an isolated polynucleotide encoding an oncology-related polypeptide of interest.

Leukemia

Leukemia is a form of cancer that starts in blood-forming tissue such as the bone marrow which can cause a large number of blood cells to be produced and enter the blood stream. Leukemia can also spread to the central nervous system and cause brain and spinal cord cancer. Types of leukemia include, but are not limited to, adult acute lymphoblastic, childhood acute lymphoblastic, adduct acute myeloid, chronic lymphocytic, chronic myelogenous and hairy cell. Non-limiting examples of symptoms of leukemia include weakness or feeling tired, fever, easy bruising or bleeding, petechiae, shortness of breath, weight loss or loss of appetite, pain in the bones or stomach, pain or feeling of fullness below the ribs, and painless lumps in the neck, underarm, stomach or groin.

In one embodiment, the signal-sensor polynucleotides, primary constructs or mmRNA of the present invention may be used to treat a disease, disorder and/or condition in a subject who has been diagnosed or may be diagnosed with leukemia by administering to said subject an isolated polynucleotide encoding an oncology-related polypeptide of interest. In one embodiment, the signal-sensor polynucleotides, primary constructs or mmRNA of the present invention may be used to reduce, eliminate, or prevent tumor growth in a subject who has been diagnosed or may be diagnosed with leukemia by administering to said subject an isolated polynucleotide encoding an oncology-related polypeptide of interest. In one embodiment, the signal-sensor polynucleotides, primary constructs or mmRNA of the present invention may be used to reduce and/or ameliorate at least one symptom of cancer in a subject who has been diagnosed or may be diagnosed with leukemia by administering to said subject an isolated polynucleotide encoding an oncology-related polypeptide of interest.

Liver Cancer

There are two types of liver cancer, primary liver cancer which forms in the tissue of the liver and secondary liver cancer, or metastatic liver cancer, that spreads to the liver from another part of the body. Possible symptoms of liver cancer include, but are not limited to, a hard lump on the right side just below the rib cage, discomfort in the upper abdomen on the right side, pain around the right shoulder blade, unexplained weight loss, jaundice, unusual tiredness, nausea and loss of appetite.

In one embodiment, the signal-sensor polynucleotides, primary constructs or mmRNA of the present invention may be used to treat a disease, disorder and/or condition in a subject who has been diagnosed or may be diagnosed with liver cancer by administering to said subject an isolated polynucleotide encoding an oncology-related polypeptide of interest. In one embodiment, the signal-sensor polynucleotides, primary constructs or mmRNA of the present invention may be used to reduce, eliminate, or prevent tumor growth in a subject who has been diagnosed or may be diagnosed with liver cancer by administering to said subject an isolated polynucleotide encoding an oncology-related polypeptide of interest. In one embodiment, the signal-sensor polynucleotides, primary constructs or mmRNA of the present invention may be used to reduce and/or ameliorate at least one symptom of cancer in a subject who has been diagnosed or may be diagnosed with liver cancer by administering to said subject an isolated polynucleotide encoding an oncology-related polypeptide of interest.

Hepatocellular Carcinoma

The c-myc protein is a multifunctional bHLHZip transcription factor with critical roles in normal cellular processes and aberrantly regulated in the majority of human cancers. c-, N- and L-Myc are family members that can dimerize with partners such as Max, Mad and Miz-1. The protein is implicated in the transactivation and repression of a vast number of proposed transcriptional targets and recent work has demonstrated a role for Myc as "transcriptional amplifier" of otherwise transactivated genes in developing cancers. It has a well established function in cancer cell proliferation, growth, biosynthetic metabolism, ribogenesis and translation and possibly a non-redundant node through which oncogenic signals must navigate.

MYC inhibitor D (also known as Omomyc) is a unique dominant-negative 90 a.a. protein comprised of the human c-Myc oligomerization domain with 4 introduced mutations E57T, E64I, R70Q, R71N (Soucek et al., Oncogene, 1998; 17, 2463-2472). Importantly, it exhibits selectivity in binding and inhibitory capability: binding c-Myc, N-Myc, Max and Miz-1. It also prevents E-box mediated transactivation while retaining Miz-1 directed transrepression. The therapeutic potential of MYC inhibitor D has been specifically exhibited in vivo where transgenic expression of OMOMYC blocked MycERTAM induced keratinocyte proliferation (Soucek et al., CDD 2004; 11, 1038-1045); transgenic Omomyc prevented the establishment and induced the regression of forming and mature lung tumors, respectively, in the LSL-KrasG12D mouse model with reversible toxicity (Soucek et al., Nature 2008, 455, 679-683); transgenic Omomyc prevents tumor formation and regresses established tumors in the RIP1-TAG2 model of pancreatic neuroendocrine cancer with controllable side effects, and further shows a role for cancer cell Myc in the maintenance of a permissive tumor microenvironment (Sodir et al., Genes and Development 2011, 25, 907-916); and it was reported "that Omomyc induces cell death of KRAS-mutated human lung adenocarcinoma A549 cells in vitro and in vivo" (Fukazawa et al., Anticancer Res, 2010, 30, 4193-4200).

Although it stands to reason that the inhibition of oncogenic c-Myc via the directed expression of MYC inhibitor D might prove to be an effective therapy in at least a subset of HCCs, proof of concept in HCC remains to be demonstrated.

In some embodiments, the present invention includes signal-sensor polynucleotides encoding MYC inhibitor D as the oncology-related polypeptide; with or without a sensor sequence for the treatment of hepatocellular carcinoma (HCC). The studies of HCC may be performed in any of the subclasses of HCC cell lines as described by Hoshida et al (Cancer Research 2009; 69: 7385-7392). These include S2 cells which have higher TGF-beta and WNT signaling and demonstrate and associated with a greater risk of early recurrence, S2 which exhibit increased myc and AKT expression and the highest level of alpha feto-protein or S3 which retain the hepatocyte like phenotype. S1 and S2 types have also been shown to exhibit increased E2F1 and decreased p53 expression; while S2 alone has shown decreased levels of interferon. S1 cell lines include SNU-387, SNU-423, SNU-449, SNU-475, SNU-182, SK-Hep1, HLE, HLF, and Focus, whereas S2 cell lines include Huh-1, Huh-6, Huh-7, HepG2, Hep3B, Hep3B-TR, Hep40, and PLC/PRF/5 cells.

Lung Cancer

Lung cancer forms in the tissues of the lung usually in the cells lining the air passages and is classified as either small cell lung cancer or non-small cell lung cancer. There are two types of small cell lung cancer, small cell carcinoma and combined small cell carcinoma. The types of on-small cell lung cancer are squamous cell carcinoma (cancer begins in the squamous cells), large cell carcinoma (cancer may begin in several types of cells) and adenocarcinoma (cancer begins in the cells that line the alveoli and in cells that make mucus). Symptoms of lung cancer include, but are not limited to, chest discomfort or pain, cough that does not go away or gets worse over time, trouble breathing, wheezing, blood in the sputum, hoarseness, loss of appetite, weight loss for no known reason, feeling very tired, trouble swallowing and swelling in the face and/or veins in the neck.

In one embodiment, the signal-sensor polynucleotides, primary constructs or mmRNA of the present invention may be used to treat a disease, disorder and/or condition in a subject who has been diagnosed or may be diagnosed with lung cancer by administering to said subject an isolated polynucleotide encoding an oncology-related polypeptide of interest. In one embodiment, the signal-sensor polynucleotides, primary constructs or mmRNA of the present invention may be used to reduce, eliminate, or prevent tumor growth in a subject who has been diagnosed or may be diagnosed with lung cancer by administering to said subject an isolated polynucleotide encoding a polypeptide of interest. In one embodiment, the signal-sensor polynucleotides, primary constructs or mmRNA of the present invention may be used to reduce and/or ameliorate at least one symptom of cancer in a subject who has been diagnosed or may be diagnosed with lung cancer by administering to said subject an isolated polynucleotide encoding an oncology-related polypeptide of interest.

Lymphoma

Lymphoma is cancer that beings in the cells of the immune system. Subjects who have Hodgkin lymphoma have a cell called Reed-Sternberg cell and non-Hodgkin lymphoma includes a large group of cancers of immune system cells. Examples of Lymphoma include, but are not limited to, painless, swollen lymph nodes in the neck, underarm or groin, fever for no known reason, drenching night sweats, weight loss for no known reason, itchy skin and fatigue.

In one embodiment, the signal-sensor polynucleotides, primary constructs or mmRNA of the present invention may be used to treat a disease, disorder and/or condition in a subject who has been diagnosed or may be diagnosed with lymphoma by administering to said subject an isolated polynucleotide encoding a polypeptide of interest. In one embodiment, the signal-sensor polynucleotides, primary constructs or mmRNA of the present invention may be used to reduce, eliminate, or prevent tumor growth in a subject who has been diagnosed or may be diagnosed with lymphoma by administering to said subject an isolated polynucleotide encoding a polypeptide of interest. In one embodiment, the polynucleotides, primary constructs or mmRNA of the present invention may be used to reduce and/or ameliorate at least one symptom of cancer in a subject who has been diagnosed or may be diagnosed with lymphoma by administering to said subject an isolated polynucleotide encoding an oncology-related polypeptide of interest.

Ovarian Cancer

Ovarian cancer is cancer which forms in the tissues of the ovary which are either ovarian epithelial carcinomas (begins on the surface of the ovary) or malignant germ cell tumors (cancer that begins in the egg cells). Symptoms of ovarian cancer include, but are not limited to, pain or swelling in the abdomen, pain in the pelvis, gastrointestinal problems such as gas, bloating, or constipation and vaginal bleeding after menopause.

In one embodiment, the signal-sensor polynucleotides, primary constructs or mmRNA of the present invention may be used to treat a disease, disorder and/or condition in a subject who has been diagnosed or may be diagnosed with ovarian cancer by administering to said subject an isolated polynucleotide encoding an oncology-related polypeptide of interest. In one embodiment, the signal-sensor polynucleotides, primary constructs or signal-sensor mmRNA of the present invention may be used to reduce, eliminate, or prevent tumor growth in a subject who has been diagnosed or may be diagnosed with ovarian cancer by administering to said subject an isolated polynucleotide encoding an oncology-related polypeptide of interest. In one embodiment, the signal-sensor polynucleotides, primary constructs or signal-sensor mmRNA of the present invention may be used to reduce and/or ameliorate at least one symptom of cancer in a subject who has been diagnosed or may be diagnosed with ovarian cancer by administering to said subject an isolated polynucleotide encoding an oncology-related polypeptide of interest.

Prostate Cancer

Prostate that forms in the tissue of the prostate mainly affects older men. Non-limiting examples of prostate cancer include, but are not limited to, weak or interrupted flow of urine, frequent urination, trouble urinating, pain or burning during urination, blood in the urine or semen, pain in the back, hips or pelvis that does not go away and painful ejaculation.

In one embodiment, the signal-sensor polynucleotides, primary constructs or mmRNA of the present invention may be used to treat a disease, disorder and/or condition in a subject who has been diagnosed or may be diagnosed with prostate cancer by administering to said subject an isolated polynucleotide encoding an oncology-related polypeptide of interest. In one embodiment, the signal-sensor polynucleotides, primary constructs or mmRNA of the present invention may be used to reduce, eliminate, or prevent tumor growth in a subject who has been diagnosed or may be diagnosed with prostate cancer by administering to said subject an isolated polynucleotide encoding an oncology-related polypeptide of interest. In one embodiment, the signal-sensor polynucleotides, primary constructs or mmRNA of the present invention may be used to reduce and/or ameliorate at least one symptom of cancer in a subject who has been diagnosed or may be diagnosed with prostate cancer by administering to said subject an isolated polynucleotide encoding an oncology-related polypeptide of interest.

Testicular Cancer

Testicular cancer forms in the tissues of one or both testicles and is most common in young or middle-aged men. Most testicular cancers being in germ cells and are called testicular germ cell tumors. There are two types of testicular germ cell tumors called seminomas and nonseminomas. Common symptoms of testicular cancer include, but are not limited to, a painless lump or swelling in either testicle, change in how the testicle feels, dull ache in the lower abdomen or the groin, sudden build-up of fluid in the scrotum and pain or discomfort in a testicle or in the scrotum.

In one embodiment, the signal-sensor polynucleotides, primary constructs or mmRNA of the present invention may be used to treat a disease, disorder and/or condition in a subject who has been diagnosed or may be diagnosed with testicular cancer by administering to said subject an isolated polynucleotide encoding an oncology-related polypeptide of interest. In one embodiment, the signal-sensor polynucleotides, primary constructs or mmRNA of the present invention may be used to reduce, eliminate, or prevent tumor growth in a subject who has been diagnosed or may be diagnosed with testicular cancer by administering to said subject an isolated signal-sensor polynucleotide encoding an oncology-related polypeptide of interest. In one embodiment, the polynucleotides, primary constructs or mmRNA of the present invention may be used to reduce and/or ameliorate at least one symptom of cancer in a subject who has been diagnosed or may be diagnosed with testicular cancer by administering to said subject an isolated polynucleotide encoding an oncology-related polypeptide of interest.

Throat Cancer

Throat cancer forms in the tissues of the pharynx and includes cancer of the nasopharynx (nasopharyngeal cancer), oropharynx (oropharyngeal cancer), hypopharynx (hypopharyngeal cancer), and larynx (laryngeal cancer). Common symptoms of throat cancer include, but are not limited to, a sore throat that does not go away, ear pain, lump in the neck, painful or difficulty swallowing, change or hoarseness in the voice, trouble breathing or speaking, nosebleeds, trouble hearing, pain or ringing in the ear, headaches, dull pain behind the breast bone, cough and weight loss for no reason.

In one embodiment, the signal-sensor polynucleotides, primary constructs or mmRNA of the present invention may be used to treat a disease, disorder and/or condition in a subject who has been diagnosed or may be diagnosed with throat cancer by administering to said subject an isolated polynucleotide encoding an oncology-related polypeptide of interest. In one embodiment, the signal-sensor polynucleotides, primary constructs or mmRNA of the present invention may be used to reduce, eliminate, or prevent tumor growth in a subject who has been diagnosed or may be diagnosed with throat cancer by administering to said subject an isolated polynucleotide encoding an oncology-related polypeptide of interest. In one embodiment, the signal-sensor polynucleotides, primary constructs or mmRNA of the present invention may be used to reduce and/or ameliorate at least one symptom of cancer in a subject who has been diagnosed or may be diagnosed with throat cancer by administering to said subject an isolated polynucleotide encoding an oncology-related polypeptide of interest.

Inhibition of Hypoxia-Inducible Factors (HIFs)

Hypoxia-inducible factors (HIFs) control cellular adaptation to oxygen deprivation. Cancer cells engage HIFs to sustain their growth in adverse conditions, thus promoting a cellular reprograming that includes metabolism, proliferation, survival and mobility. HIFs overexpression in human cancer biopsies correlates with high metastasis and mortality.

HIFs regulate genes related to metabolism such as GLUT1, GLUT3, ALDOA, ENOI, GAPDH, HK1, HK2, PFKL, PGK1, PKM2, LDHA, proliferation such as IGF-2, TGFA, VEGFA, survival such as TERT, NANOG, OCT4 and cell migration-invasion such as ZEB1, ZEB2, SNAI2, MMP14, MMP9, AMF, MET, PTHrP. (Keith, et al Nat Rev Cancer 2012; 12:9-22).

In one embodiment, one or more signal-sensor polynucleotides may be administered to the cancer cell to investigate the destabilization of cancer, The selection of the sequence, dose or administrative route is optionally informed by diagnostic evaluation of the cell, tumor, tissue or organism including, but not limited to, expression profiling of the cancer, metabolic evaluation (hypoxic, acidotic), apoptotic vs. survival profiling, cell cycle vs. senescent profiling, immune sensitivities, and/or evaluation of stromal factors.

In one embodiment, the signal-sensor polynucleotides may encode either or both of the oncology related polypeptides, CITED4 and SHARP1. The signal-sensor polynucleotides are then administered where the administration of either or both results in the inhibition of the transcriptome of HIF-1 alpha in cancer cells. Suppression of HIF1-alpha gene regulated expression occurs upon administration with higher suppression when both polynucleotides are administered together. Reporter constructs such as luciferase under HIF1-alpha are used in the manner similar to the methods disclosed in van de Sluis et al, (J Clin Invest. 2010; 120(6): 2119-2130). It is known that both CITED4 and SHARP1 expression results in decreased HIF1-alpha and concomitant reduction in HIF1-alpha regulated gene expression. Cell death and/or proliferation may also be evaluated in order to determine the effectiveness of the signal-sensor polynucleotide.

In another embodiment, additional experiments can be conducted using a cancer cell line where CITED4 and SHARP1 are themselves down regulated either under hypoxic conditions. A positive result would demonstrate that specifically targeting the metabolic profile (in this case hypoxic-adaptations of CITED4 and SHAPR1) with replacement of native proteins via signal-sensor polynucleotides can directly impact the transcriptome and survival advantage of cancer cells with this profile. Further, the data could show that the relative impact of signal-sensor polynucleotide vs. vehicle under hypoxic conditions was more significant for cancer cells than for normal cells. (i.e., the cancer cells have a disproportionate survival advantage based on their CITED4+SHARP1 down regulation) that makes them more sensitive to the replacement of this protein then a normal cell is to overproduction of it. It is understood that a cancer cell will likely be experiencing hypoxic conditions and that a normal cell under normoxic conditions might be able to tolerate CITED4 and SHARP1 over expression because the normal cell is not dependent on HIF1alpha transcriptome for survival advantage.

In one embodiment, in vivo experiments are performed according to the design of the in vitro experiments where the animal model is one evincing metastasis in the cancer setting because HIF-1alpha appears to confer the largest portion of its advantage in metastasis. Animals are administered the signal-sensor polynucleotide compared to no treatment or a control polynucleotide. Animal cells, tissues and/or organs are then evaluated for alterations in gene expression profiles or transcriptome levels.

Titration Between Cofactors

Experiments may be conducted in order to titrate the binding affinity between two cofactors. As used herein, the term "titrate" refers to a method whereby one or more factors are introduced systematically (such as at increasing levels or wherein the one or more factors are systematically modified) to a solution, scenario or series thereof in order to assess a property of interest. In this embodiment, the property of interest is the binding affinity between two cofactors. In one embodiment, constructs encoding the two cofactors are obtained and/or synthesized and a series of mutant constructs are prepared and/or synthesized. Mutant constructs encode cofactor mutants that may include truncated mutants (mutant proteins lacking one or more amino acids from either the N- or C-terminal domains), mutants with regional deletions [proteins wherein internal regions (comprising one or more amino acids) of the protein are absent], mutants with single amino acid substitutions (wherein a normally expressed amino acid is replaced with an alternative amino acid), mutants with one or more additional amino acids added internally or at either terminus, mutants with regional substitutions [proteins wherein internal regions (comprising one or more amino acids) of the protein are substituted with alternative regions (comprising one or more amino acids) and/or combinations of any of these. Mutant constructs are mutated randomly or subjected to targeted mutation based on existing knowledge of the molecular interactions necessary for binding between the two cofactors being investigated.

In some embodiments, a series of mutant proteins are designed such that the mutations follow a progressive pattern along the polypeptide chain. Such series may allow for a better understanding of a particular aspect or feature of the interaction between cofactors. A mutant series may include, for example, the production of a series of mutants, each with a single amino acid substitution, wherein each mutant has a different amino acid along it's polypeptide sequence mutated (e.g. alanine is substituted, thereby eliminating the influence of an amino acid side chain at each position). In another example, a series of mutants are designed such that the mutants in the series comprise truncations of increasing size. In another example, amino acids capable of being post-translationally modified (e.g. phosphorylated, acetylated, ubiquitinated, glycosylated, etc.) in a similar manner may be mutated along the polypeptide sequence in a series of mutants.

For titration experiments with mutant cofactors, a baseline affinity between the two cofactors is established by combining both cofactors under conditions favorable for binding and the binding affinity between the cofactors is assayed. Binding affinity may be assessed using any of a variety of methods known in the art. Such methods may include, but are not limited to Western blot analysis, immunoprecipitation, enzyme-linked immunosorbent assay (ELISA), fluorescence resonance energy transfer (FRET), fluorescence recovery after photobleaching (FRAP), fluorescence polarization technologies and/or surface plasmon resonance (SPR) based technologies. For titration, according to one method, a mutant series of one or both cofactors are combined with the two unmutated cofactors (to allow for binding competition between the wild type and mutated proteins). Changes in affinity between the two cofactors in the presence of increasing concentrations of different mutants are assessed and compared and/or plotted against the specific mutations present in the series of mutants that are competing for binding. Alternatively, mutant cofactors in a series are individually combined with a corresponding unmutated binding partner and assessed for binding affinity. Increasing concentrations of the wild type cofactor (corresponding to the mutant cofactor) are introduced and changes in binding between the mutant cofactors and the corresponding unmutated binding partner are assessed. Comparisons are made between the resulting binding curves and the binding curves of other mutants tested.

In some embodiments, titration of the binding affinity between two cofactors is assessed in the presence or absence of increasing concentrations of a third factor. Such a third factor may be an inhibitor or activator of binding between the two cofactors. A series of mutants, as described above, may be generated for a third factor and such a series may be used in titration experiments to assess the effect of mutations on binding between the two cofactors.

Information obtained from titration experiments may be used to design modified mRNA molecules to encode factors that modulate the interaction between cofactors.

In some embodiments, titration experiments are carried out wherein the binding affinity between HIF1 subunits (HIF1-alpha, HIF2-alpha and ARNT) and/or mutated HIF1 subunits and/or other proteins that interact with HIF1 is assessed. Titration experiments may utilize mutant series generated using constructs for one or more of HIF1-alpha, HIF2-alpha, ARNT and/or a third interacting factor. In some embodiments, a mutant series is generated for HIF1-alpha. HIF1-alpha and HIF2-alpha are hydroxylated by HIF hydroxylase enzymes under normal levels of oxygen in the cell, facilitating degradation and/or blocking transcriptional activity. Hydroxylation decreases as oxygen levels drop, allowing HIF1-alpha and/or HIF2-alpha to associate with their cofactor, ARNT leading to elevated expression of genes comprising HIF-response elements (HREs) (Keith, B. et al., HIF1α and HIF2α: sibling rivalry in hypoxic tumour growth and progression. Nat Rev Cancer. 2011 Dec. 15; 12(1):9-22). In one embodiment, HIF1-alpha mutant series are generated wherein mutations in the series progressively eliminate one or more hydroxylation sites along the polypeptide chain (including, but not limited to proline 402, proline 564 and/or asparagine 803), thereby modulating stability and/or transcriptional activity in mutant versions of HIF1-alpha. In another embodiment, an alternative cofactor, HIF2-alpha is used to generate a mutant series. Such a mutant series may progressively eliminate one or more hydroxylation sites along the polypeptide chain (including, but not limited to proline 405, proline 531 and/or asparagine 847), thereby modulating stability and/or transcriptional activity in mutant versions of HIF2-alpha. In another embodiment, HIF1-alpha and/or HIF2-alpha mutant series are generated that progressively mutate regions necessary for interaction with ARNT, thereby creating mutants with altered abilities to bind ARNT and modulate HIF-dependent gene expression. In another embodiment, ARNT mutant series are generated that progressively mutate regions necessary for interactions with other HIF subunits, thereby creating mutants with altered abilities to bind HIF subunits and modulate HIF-dependent gene expression.

In some embodiments, mutant series are generated for Von Hippel-Landau tumor suppressor protein (pVHL). This protein binds hydroxylated HIF1-alpha and HIF2-alpha, facilitating their ubiquitination and degradation. In one embodiment, mutant series are generated that progressively mutate regions necessary for interaction with HIF1 subunits, thereby creating mutants with altered abilities to bind HIF1 subunits and modulate HIF-dependent gene expression.

Non-limiting examples of transcript and polypeptide sequences which may be used for the titration experiments are shown in Table 27 (transcript) and Table 28 (polypeptide).

VI. Kits and Devices

Kits

The invention provides a variety of kits for conveniently and/or effectively carrying out methods of the present invention. Typically kits will comprise sufficient amounts and/or numbers of components to allow a user to perform multiple treatments of a subject(s) and/or to perform multiple experiments.

In one aspect, the present invention provides kits comprising the molecules (signal-sensor polynucleotides, primary constructs or mmRNA) of the invention. In one embodiment, the kit comprises one or more functional antibodies or function fragments thereof.

Said kits can be for oncology-related protein production, comprising a first signal-sensor polynucleotide, primary construct or mmRNA comprising a translatable region. The kit may further comprise packaging and instructions and/or a delivery agent to form a formulation composition. The delivery agent may comprise a saline, a buffered solution, a lipidoid or any delivery agent disclosed herein.

In one embodiment, the buffer solution may include sodium chloride, calcium chloride, phosphate and/or EDTA. In another embodiment, the buffer solution may include, but is not limited to, saline, saline with 2 mM calcium, 5% sucrose, 5% sucrose with 2 mM calcium, 5% Mannitol, 5% Mannitol with 2 mM calcium, Ringer's lactate, sodium chloride, sodium chloride with 2 mM calcium. In a further embodiment, the buffer solutions may be precipitated or it may be lyophilized. The amount of each component may be varied to enable consistent, reproducible higher concentration saline or simple buffer formulations. The components may also be varied in order to increase the stability of modified RNA in the buffer solution over a period of time and/or under a variety of conditions. In one aspect, the present invention provides kits for oncology-related protein production, comprising: signal-sensor polynucleotide, primary construct or mmRNA comprising a translatable region, provided in an amount effective to produce a desired amount of an oncology-related protein encoded by the translatable region when introduced into a target cell; a second signal-sensor polynucleotide comprising an inhibitory nucleic acid, provided in an amount effective to substantially inhibit the innate immune response of the cell; and packaging and instructions.

In one aspect, the present invention provides kits for oncology-related protein production, comprising signal-sensor polynucleotide, primary construct or mmRNA comprising a translatable region, wherein the signal-sensor polynucleotide exhibits reduced degradation by a cellular nuclease, and packaging and instructions.

In one aspect, the present invention provides kits for oncology-related protein production, comprising signal-sensor polynucleotide, primary construct or mmRNA comprising a translatable region, wherein the polynucleotide exhibits reduced degradation by a cellular nuclease, and a mammalian cell suitable for translation of the translatable region of the first nucleic acid.

Devices

The present invention provides for devices which may incorporate signal-sensor polynucleotides, primary constructs or mmRNA that encode polypeptides of interest. These devices contain in a stable formulation the reagents to synthesize a signal-sensor polynucleotide in a formulation available to be immediately delivered to a subject in need thereof, such as a human patient.

In some embodiments the device is self-contained, and is optionally capable of wireless remote access to obtain instructions for synthesis and/or analysis of the generated signal-sensor polynucleotide, primary construct or mmRNA. The device is capable of mobile synthesis of at least one signal-sensor polynucleotide, primary construct or mmRNA and preferably an unlimited number of different signal-sensor polynucleotides, primary constructs or mmRNA. In certain embodiments, the device is capable of being transported by one or a small number of individuals. In other embodiments, the device is scaled to fit on a benchtop or desk. In other embodiments, the device is scaled to fit into a suitcase, backpack or similarly sized object. In another embodiment, the device may be a point of care or handheld device. In further embodiments, the device is scaled to fit into a vehicle, such as a car, truck or ambulance, or a military vehicle such as a tank or personnel carrier. The information necessary to generate a modified signal-sensor mRNA encoding oncology-related polypeptide of interest is present within a computer readable medium present in the device.

In one embodiment, a device may be used to assess levels of an oncology-related protein which has been administered in the form of signal-sensor polynucleotide, primary construct or mmRNA. The device may comprise a blood, urine or other biofluidic test.

In some embodiments, the device is capable of communication (e.g., wireless communication) with a database of nucleic acid and polypeptide sequences which may be signal-sensor nucleic acid and oncology-related polypeptide sequences. The device contains at least one sample block for insertion of one or more sample vessels. Such sample vessels are capable of accepting in liquid or other form any number of materials such as template DNA, nucleotides, enzymes, buffers, and other reagents. The sample vessels are also capable of being heated and cooled by contact with the sample block. The sample block is generally in communication with a device base with one or more electronic control units for the at least one sample block. The sample block preferably contains a heating module, such heating molecule capable of heating and/or cooling the sample vessels and contents thereof to temperatures between about −20 C and above +100 C. The device base is in communication with a voltage supply such as a battery or external voltage supply. The device also contains means for storing and distributing the materials for RNA synthesis.

Optionally, the sample block contains a module for separating the synthesized nucleic acids. Alternatively, the device contains a separation module operably linked to the sample block. Preferably the device contains a means for analysis of the synthesized nucleic acid. Such analysis includes sequence identity (demonstrated such as by hybridization), absence of non-desired sequences, measurement of integrity of synthesized mRNA (such has by microfluidic viscometry combined with spectrophotometry), and concentration and/or potency of modified RNA (such as by spectrophotometry).

In certain embodiments, the device is combined with a means for detection of pathogens present in a biological material obtained from a subject, e.g., the IBIS PLEX-ID system (Abbott, Abbott Park, Ill.) for microbial identification.

Suitable devices for use in delivering intradermal pharmaceutical compositions described herein include short needle devices such as those described in U.S. Pat. Nos. 4,886,499; 5,190,521; 5,328,483; 5,527,288; 4,270,537; 5,015,235; 5,141,496; and 5,417,662. Intradermal compositions may be administered by devices which limit the effective penetration length of a needle into the skin, such as those described in PCT publication WO 99/34850 and functional equivalents thereof. Jet injection devices which deliver liquid compositions to the dermis via a liquid jet injector and/or via a needle which pierces the stratum corneum and produces a jet which reaches the dermis are suitable. Jet injection devices are described, for example, in U.S. Pat. Nos. 5,480,381; 5,599,302; 5,334,144; 5,993,412; 5,649,912; 5,569,189; 5,704,911; 5,383,851; 5,893,397; 5,466,220; 5,339,163; 5,312,335; 5,503,627; 5,064,413; 5,520,639; 4,596,556; 4,790,824; 4,941,880; 4,940,460; and PCT publications WO 97/37705 and WO 97/13537. Ballistic powder/particle delivery devices which use compressed gas to accelerate vaccine in powder form through the outer layers of the skin to the dermis are suitable. Alternatively or additionally, conventional syringes may be used in the classical mantoux method of intradermal administration.

In some embodiments, the device may be a pump or comprise a catheter for administration of compounds or compositions of the invention across the blood brain barrier. Such devices include but are not limited to a pressurized olfactory delivery device, iontophoresis devices, multi-layered microfluidic devices, and the like. Such devices may be portable or stationary. They may be implantable or externally tethered to the body or combinations thereof.

Devices for administration may be employed to deliver the signal-sensor polynucleotides, primary constructs or mmRNA of the present invention according to single, multi- or split-dosing regimens taught herein. Such devices are described below.

Method and devices known in the art for multi-administration to cells, organs and tissues are contemplated for use in conjunction with the methods and compositions disclosed herein as embodiments of the present invention. These include, for example, those methods and devices having multiple needles, hybrid devices employing for example lumens or catheters as well as devices utilizing heat, electric current or radiation driven mechanisms.

According to the present invention, these multi-administration devices may be utilized to deliver the single, multi- or split doses contemplated herein.

A method for delivering therapeutic agents to a solid tissue has been described by Bahrami et al. and is taught for example in US Patent Publication 20110230839, the contents of which are incorporated herein by reference in their entirety. According to Bahrami, an array of needles is incorporated into a device which delivers a substantially equal amount of fluid at any location in said solid tissue along each needle's length.

A device for delivery of biological material across the biological tissue has been described by Kodgule et al. and is taught for example in US Patent Publication 20110172610, the contents of which are incorporated herein by reference in their entirety. According to Kodgule, multiple hollow microneedles made of one or more metals and having outer diameters from about 200 microns to about 350 microns and lengths of at least 100 microns are incorporated into the device which delivers peptides, proteins, carbohydrates, nucleic acid molecules, lipids and other pharmaceutically active ingredients or combinations thereof.

A delivery probe for delivering a therapeutic agent to a tissue has been described by Gunday et al. and is taught for example in US Patent Publication 20110270184, the contents of which are incorporated herein by reference in their entirety. According to Gunday, multiple needles are incorporated into the device which moves the attached capsules between an activated position and an inactivated position to force the agent out of the capsules through the needles.

A multiple-injection medical apparatus has been described by Assaf and is taught for example in US Patent Publication 20110218497, the contents of which are incorporated herein by reference in their entirety. According to Assaf, multiple needles are incorporated into the device which has a chamber connected to one or more of said needles and a means for continuously refilling the chamber with the medical fluid after each injection.

In one embodiment, the signal-sensor polynucleotide, primary construct, or mmRNA is administered subcutaneously or intramuscularly via at least 3 needles to three different, optionally adjacent, sites simultaneously, or within a 60 minutes period (e.g., administration to 4, 5, 6, 7, 8, 9, or 10 sites simultaneously or within a 60 minute period). The split doses can be administered simultaneously to adjacent tissue using the devices described in U.S. Patent Publication Nos. 20110230839 and 20110218497, each of which is incorporated herein by reference.

An at least partially implantable system for injecting a substance into a patient's body, in particular a penis erection stimulation system has been described by Forsell and is taught for example in US Patent Publication 20110196198, the contents of which are incorporated herein by reference in their entirety. According to Forsell, multiple needles are incorporated into the device which is implanted along with one or more housings adjacent the patient's left and right corpora cavernosa. A reservoir and a pump are also implanted to supply drugs through the needles.

A method for the transdermal delivery of a therapeutic effective amount of iron has been described by Berenson and is taught for example in US Patent Publication 20100130910, the contents of which are incorporated herein by reference in their entirety. According to Berenson, multiple needles may be used to create multiple micro channels in stratum corneum to enhance transdermal delivery of the ionic iron on an iontophoretic patch.

A method for delivery of biological material across the biological tissue has been described by Kodgule et al and is taught for example in US Patent Publication 20110196308, the contents of which are incorporated herein by reference in their entirety. According to Kodgule, multiple biodegradable microneedles containing a therapeutic active ingredient are incorporated in a device which delivers proteins, carbohydrates, nucleic acid molecules, lipids and other pharmaceutically active ingredients or combinations thereof.

A transdermal patch comprising a botulinum toxin composition has been described by Donovan and is taught for example in US Patent Publication 20080220020, the contents of which are incorporated herein by reference in their entirety. According to Donovan, multiple needles are incorporated into the patch which delivers botulinum toxin under stratum corneum through said needles which project through the stratum corneum of the skin without rupturing a blood vessel.

A small, disposable drug reservoir, or patch pump, which can hold approximately 0.2 to 15 mL of liquid formulations can be placed on the skin and deliver the formulation continuously subcutaneously using a small bore needed (e.g., 26 to 34 gauge). As non-limiting examples, the patch pump may be 50 mm by 76 mm by 20 mm spring loaded having a 30 to 34 gauge needle (BD™ Microinfuser, Franklin Lakes N.J.), 41 mm by 62 mm by 17 mm with a 2 mL reservoir used for drug delivery such as insulin (OMNIPOD®, Insulet Corporation Bedford, Mass.), or 43-60 mm diameter, 10 mm thick with a 0.5 to 10 mL reservoir (PATCHPUMP®, SteadyMed Therapeutics, San Francisco, Calif.). Further, the patch pump may be battery powered and/or rechargeable.

A cryoprobe for administration of an active agent to a location of cryogenic treatment has been described by Toubia and is taught for example in US Patent Publication 20080140061, the contents of which are incorporated herein by reference in their entirety. According to Toubia, multiple needles are incorporated into the probe which receives the active agent into a chamber and administers the agent to the tissue.

A method for treating or preventing inflammation or promoting healthy joints has been described by Stock et al and is taught for example in US Patent Publication 20090155186, the contents of which are incorporated herein by reference in their entirety. According to Stock, multiple needles are incorporated in a device which administers compositions containing signal transduction modulator compounds.

A multi-site injection system has been described by Kimmell et al. and is taught for example in US Patent Publication 20100256594, the contents of which are incorporated herein by reference in their entirety. According to Kimmell, multiple needles are incorporated into a device which delivers a medication into a stratum corneum through the needles.

A method for delivering interferons to the intradermal compartment has been described by Dekker et al. and is taught for example in US Patent Publication 20050181033, the contents of which are incorporated herein by reference in their entirety. According to Dekker, multiple needles having an outlet with an exposed height between 0 and 1 mm are incorporated into a device which improves pharmacokinetics and bioavailability by delivering the substance at a depth between 0.3 mm and 2 mm.

A method for delivering genes, enzymes and biological agents to tissue cells has described by Desai and is taught for example in US Patent Publication 20030073908, the contents of which are incorporated herein by reference in their entirety. According to Desai, multiple needles are incorporated into a device which is inserted into a body and delivers a medication fluid through said needles.

A method for treating cardiac arrhythmias with fibroblast cells has been described by Lee et al and is taught for example in US Patent Publication 20040005295, the contents of which are incorporated herein by reference in their entirety. According to Lee, multiple needles are incorporated into the device which delivers fibroblast cells into the local region of the tissue.

A method using a magnetically controlled pump for treating a brain tumor has been described by Shachar et al. and is taught for example in U.S. Pat. No. 7,799,012 (method) and U.S. Pat. No. 7,799,016 (device), the contents of which are incorporated herein by reference in their entirety. According Shachar, multiple needles were incorporated into the pump which pushes a medicating agent through the needles at a controlled rate.

Methods of treating functional disorders of the bladder in mammalian females have been described by Versi et al. and are taught for example in U.S. Pat. No. 8,029,496, the contents of which are incorporated herein by reference in their entirety. According to Versi, an array of micro-needles is incorporated into a device which delivers a therapeutic agent through the needles directly into the trigone of the bladder.

A micro-needle transdermal transport device has been described by Angel et al and is taught for example in U.S. Pat. No. 7,364,568, the contents of which are incorporated herein by reference in their entirety. According to Angel, multiple needles are incorporated into the device which transports a substance into a body surface through the needles which are inserted into the surface from different directions. The micro-needle transdermal transport device may be a solid micro-needle system or a hollow micro-needle system. As a non-limiting example, the solid micro-needle system may have up to a 0.5 mg capacity, with 300-1500 solid micro-needles per $cm^2$ about 150-700 µm tall coated with a drug. The micro-needles penetrate the stratum corneum and remain in the skin for short duration (e.g., 20 seconds to 15 minutes). In another example, the hollow micro-needle system has up to a 3 mL capacity to deliver liquid formulations using 15-20 microneedles per cm2 being approximately 950 μm tall. The micro-needles penetrate the skin to allow the liquid formulations to flow from the device into the skin. The hollow micro-needle system may be worn from 1 to 30 minutes depending on the formulation volume and viscosity.

A device for subcutaneous infusion has been described by Dalton et al and is taught for example in U.S. Pat. No. 7,150,726, the contents of which are incorporated herein by reference in their entirety. According to Dalton, multiple needles are incorporated into the device which delivers fluid through the needles into a subcutaneous tissue.

A device and a method for intradermal delivery of vaccines and gene therapeutic agents through microcannula have been described by Mikszta et al. and are taught for example in U.S. Pat. No. 7,473,247, the contents of which are incorporated herein by reference in their entirety. According to Mitszta, at least one hollow micro-needle is incorporated into the device which delivers the vaccines to the subject's skin to a depth of between 0.025 mm and 2 mm.

A method of delivering insulin has been described by Pettis et al and is taught for example in U.S. Pat. No. 7,722,595, the contents of which are incorporated herein by reference in their entirety. According to Pettis, two needles are incorporated into a device wherein both needles insert essentially simultaneously into the skin with the first at a depth of less than 2.5 mm to deliver insulin to intradermal compartment and the second at a depth of greater than 2.5 mm and less than 5.0 mm to deliver insulin to subcutaneous compartment.

Cutaneous injection delivery under suction has been described by Kochamba et al. and is taught for example in U.S. Pat. No. 6,896,666, the contents of which are incorporated herein by reference in their entirety. According to Kochamba, multiple needles in relative adjacency with each other are incorporated into a device which injects a fluid below the cutaneous layer.

A device for withdrawing or delivering a substance through the skin has been described by Down et al and is taught for example in U.S. Pat. No. 6,607,513, the contents of which are incorporated herein by reference in their entirety. According to Down, multiple skin penetrating members which are incorporated into the device have lengths of about 100 microns to about 2000 microns and are about 30 to 50 gauge.

A device for delivering a substance to the skin has been described by Palmer et al and is taught for example in U.S. Pat. No. 6,537,242, the contents of which are incorporated herein by reference in their entirety. According to Palmer, an array of micro-needles is incorporated into the device which uses a stretching assembly to enhance the contact of the needles with the skin and provides a more uniform delivery of the substance.

A perfusion device for localized drug delivery has been described by Zamoyski and is taught for example in U.S. Pat. No. 6,468,247, the contents of which are incorporated herein by reference in their entirety. According to Zamoyski, multiple hypodermic needles are incorporated into the device which injects the contents of the hypodermics into a tissue as said hypodermics are being retracted.

A method for enhanced transport of drugs and biological molecules across tissue by improving the interaction between micro-needles and human skin has been described by Prausnitz et al. and is taught for example in U.S. Pat. No. 6,743,211, the contents of which are incorporated herein by reference in their entirety. According to Prausnitz, multiple micro-needles are incorporated into a device which is able to present a more rigid and less deformable surface to which the micro-needles are applied.

A device for intraorgan administration of medicinal agents has been described by Ting et al and is taught for example in U.S. Pat. No. 6,077,251, the contents of which are incorporated herein by reference in their entirety. According to Ting, multiple needles having side openings for enhanced administration are incorporated into a device which by extending and retracting said needles from and into the needle chamber forces a medicinal agent from a reservoir into said needles and injects said medicinal agent into a target organ.

A multiple needle holder and a subcutaneous multiple channel infusion port has been described by Brown and is taught for example in U.S. Pat. No. 4,695,273, the contents of which are incorporated herein by reference in their entirety. According to Brown, multiple needles on the needle holder are inserted through the septum of the infusion port and communicate with isolated chambers in said infusion port.

A dual hypodermic syringe has been described by Horn and is taught for example in U.S. Pat. No. 3,552,394, the contents of which are incorporated herein by reference in their entirety. According to Horn, two needles incorporated into the device are spaced apart less than 68 mm and may be of different styles and lengths, thus enabling injections to be made to different depths.

A syringe with multiple needles and multiple fluid compartments has been described by Hershberg and is taught for example in U.S. Pat. No. 3,572,336, the contents of which are incorporated herein by reference in their entirety. According to Hershberg, multiple needles are incorporated into the syringe which has multiple fluid compartments and is capable of simultaneously administering incompatible drugs which are not able to be mixed for one injection.

A surgical instrument for intradermal injection of fluids has been described by Eliscu et al. and is taught for example in U.S. Pat. No. 2,588,623, the contents of which are incorporated herein by reference in their entirety. According to Eliscu, multiple needles are incorporated into the instrument which injects fluids intradermally with a wider disperse.

An apparatus for simultaneous delivery of a substance to multiple breast milk ducts has been described by Hung and is taught for example in EP 1818017, the contents of which are incorporated herein by reference in their entirety. According to Hung, multiple lumens are incorporated into the device which inserts though the orifices of the ductal networks and delivers a fluid to the ductal networks.

A catheter for introduction of medications to the tissue of a heart or other organs has been described by Tkebuchava and is taught for example in WO2006138109, the contents of which are incorporated herein by reference in their entirety. According to Tkebuchava, two curved needles are incorporated which enter the organ wall in a flattened trajectory.

Devices for delivering medical agents have been described by Mckay et al. and are taught for example in WO2006118804, the content of which are incorporated herein by reference in their entirety. According to Mckay, multiple needles with multiple orifices on each needle are incorporated into the devices to facilitate regional delivery to a tissue, such as the interior disc space of a spinal disc.

A method for directly delivering an immunomodulatory substance into an intradermal space within a mammalian skin has been described by Pettis and is taught for example in WO2004020014, the contents of which are incorporated herein by reference in their entirety. According to Pettis, multiple needles are incorporated into a device which delivers the substance through the needles to a depth between 0.3 mm and 2 mm.

Methods and devices for administration of substances into at least two compartments in skin for systemic absorption and improved pharmacokinetics have been described by Pettis et al. and are taught for example in WO2003094995, the contents of which are incorporated herein by reference in their entirety. According to Pettis, multiple needles having lengths between about 300 μm and about 5 mm are incorporated into a device which delivers to intradermal and subcutaneous tissue compartments simultaneously.

A drug delivery device with needles and a roller has been described by Zimmerman et al. and is taught for example in WO2012006259, the contents of which are incorporated herein by reference in their entirety. According to Zimmerman, multiple hollow needles positioned in a roller are incorporated into the device which delivers the content in a reservoir through the needles as the roller rotates.

Methods and Devices Utilizing Catheters and/or Lumens

Methods and devices using catheters and lumens may be employed to administer the mmRNA of the present invention on a single, multi- or split dosing schedule. Such methods and devices are described below.

A catheter-based delivery of skeletal myoblasts to the myocardium of damaged hearts has been described by Jacoby et al and is taught for example in US Patent Publication 20060263338, the contents of which are incorporated herein by reference in their entirety. According to Jacoby, multiple needles are incorporated into the device at least part of which is inserted into a blood vessel and delivers the cell composition through the needles into the localized region of the subject's heart.

An apparatus for treating asthma using neurotoxin has been described by Deem et al and is taught for example in US Patent Publication 20060225742, the contents of which are incorporated herein by reference in their entirety. According to Deem, multiple needles are incorporated into the device which delivers neurotoxin through the needles into the bronchial tissue.

A method for administering multiple-component therapies has been described by Nayak and is taught for example in U.S. Pat. No. 7,699,803, the contents of which are incorporated herein by reference in their entirety. According to Nayak, multiple injection cannulas may be incorporated into a device wherein depth slots may be included for controlling the depth at which the therapeutic substance is delivered within the tissue.

A surgical device for ablating a channel and delivering at least one therapeutic agent into a desired region of the tissue has been described by McIntyre et al and is taught for example in U.S. Pat. No. 8,012,096, the contents of which are incorporated herein by reference in their entirety. According to McIntyre, multiple needles are incorporated into the device which dispenses a therapeutic agent into a region of tissue surrounding the channel and is particularly well suited for transmyocardial revascularization operations.

Methods of treating functional disorders of the bladder in mammalian females have been described by Versi et al and are taught for example in U.S. Pat. No. 8,029,496, the contents of which are incorporated herein by reference in their entirety. According to Versi, an array of micro-needles is incorporated into a device which delivers a therapeutic agent through the needles directly into the trigone of the bladder.

A device and a method for delivering fluid into a flexible biological barrier have been described by Yeshurun et al. and are taught for example in U.S. Pat. No. 7,998,119 (device) and U.S. Pat. No. 8,007,466 (method), the contents of which are incorporated herein by reference in their entirety. According to Yeshurun, the micro-needles on the device penetrate and extend into the flexible biological barrier and fluid is injected through the bore of the hollow micro-needles.

A method for epicardially injecting a substance into an area of tissue of a heart having an epicardial surface and disposed within a torso has been described by Bonner et al and is taught for example in U.S. Pat. No. 7,628,780, the contents of which are incorporated herein by reference in their entirety. According to Bonner, the devices have elongate shafts and distal injection heads for driving needles into tissue and injecting medical agents into the tissue through the needles.

A device for sealing a puncture has been described by Nielsen et al and is taught for example in U.S. Pat. No. 7,972,358, the contents of which are incorporated herein by reference in their entirety. According to Nielsen, multiple needles are incorporated into the device which delivers a closure agent into the tissue surrounding the puncture tract.

A method for myogenesis and angiogenesis has been described by Chiu et al. and is taught for example in U.S. Pat. No. 6,551,338, the contents of which are incorporated herein by reference in their entirety. According to Chiu, 5 to 15 needles having a maximum diameter of at least 1.25 mm and a length effective to provide a puncture depth of 6 to 20 mm are incorporated into a device which inserts into proximity with a myocardium and supplies an exogeneous angiogenic or myogenic factor to said myocardium through the conduits which are in at least some of said needles.

A method for the treatment of prostate tissue has been described by Bolmsj et al. and is taught for example in U.S. Pat. No. 6,524,270, the contents of which are incorporated herein by reference in their entirety. According to Bolmsj, a device comprising a catheter which is inserted through the urethra has at least one hollow tip extendible into the surrounding prostate tissue. An astringent and analgesic medicine is administered through said tip into said prostate tissue.

A method for infusing fluids to an intraosseous site has been described by Findlay et al. and is taught for example in U.S. Pat. No. 6,761,726, the contents of which are incorporated herein by reference in their entirety. According to Findlay, multiple needles are incorporated into a device which is capable of penetrating a hard shell of material covered by a layer of soft material and delivers a fluid at a predetermined distance below said hard shell of material.

A device for injecting medications into a vessel wall has been described by Vigil et al. and is taught for example in U.S. Pat. No. 5,713,863, the contents of which are incorporated herein by reference in their entirety. According to Vigil, multiple injectors are mounted on each of the flexible tubes in the device which introduces a medication fluid through a multi-lumen catheter, into said flexible tubes and out of said injectors for infusion into the vessel wall.

A catheter for delivering therapeutic and/or diagnostic agents to the tissue surrounding a bodily passageway has been described by Faxon et al. and is taught for example in U.S. Pat. No. 5,464,395, the contents of which are incorporated herein by reference in their entirety. According to Faxon, at least one needle cannula is incorporated into the catheter which delivers the desired agents to the tissue through said needles which project outboard of the catheter.

Balloon catheters for delivering therapeutic agents have been described by Orr and are taught for example in WO2010024871, the contents of which are incorporated herein by reference in their entirety. According to Orr, multiple needles are incorporated into the devices which deliver the therapeutic agents to different depths within the tissue.

Methods and Devices Utilizing Electrical Current

Methods and devices utilizing electric current may be employed to deliver the mmRNA of the present invention according to the single, multi- or split dosing regimens taught herein. Such methods and devices are described below.

An electro collagen induction therapy device has been described by Marquez and is taught for example in US Patent Publication 20090137945, the contents of which are incorporated herein by reference in their entirety. According to Marquez, multiple needles are incorporated into the device which repeatedly pierce the skin and draw in the skin a portion of the substance which is applied to the skin first.

An electrokinetic system has been described by Etheredge et al. and is taught for example in US Patent Publication 20070185432, the contents of which are incorporated herein by reference in their entirety. According to Etheredge, micro-needles are incorporated into a device which drives by an electrical current the medication through the needles into the targeted treatment site.

An iontophoresis device has been described by Matsumura et al. and is taught for example in U.S. Pat. No. 7,437,189, the contents of which are incorporated herein by reference in their entirety. According to Matsumura, multiple needles are incorporated into the device which is capable of delivering ionizable drug into a living body at higher speed or with higher efficiency.

Intradermal delivery of biologically active agents by needle-free injection and electroporation has been described by Hoffmann et al and is taught for example in U.S. Pat. No. 7,171,264, the contents of which are incorporated herein by reference in their entirety. According to Hoffmann, one or more needle-free injectors are incorporated into an electroporation device and the combination of needle-free injection and electroporation is sufficient to introduce the agent into cells in skin, muscle or mucosa.

A method for electropermeabilization-mediated intracellular delivery has been described by Lundkvist et al. and is taught for example in U.S. Pat. No. 6,625,486, the contents of which are incorporated herein by reference in their entirety. According to Lundkvist, a pair of needle electrodes is incorporated into a catheter. Said catheter is positioned into a body lumen followed by extending said needle electrodes to penetrate into the tissue surrounding said lumen. Then the device introduces an agent through at least one of said needle electrodes and applies electric field by said pair of needle electrodes to allow said agent pass through the cell membranes into the cells at the treatment site.

A delivery system for transdermal immunization has been described by Levin et al. and is taught for example in WO2006003659, the contents of which are incorporated herein by reference in their entirety. According to Levin, multiple electrodes are incorporated into the device which applies electrical energy between the electrodes to generate micro channels in the skin to facilitate transdermal delivery.

A method for delivering RF energy into skin has been described by Schomacker and is taught for example in WO2011163264, the contents of which are incorporated herein by reference in their entirety. According to Schomacker, multiple needles are incorporated into a device which applies vacuum to draw skin into contact with a plate so that needles insert into skin through the holes on the plate and deliver RF energy.

VII. Definitions

At various places in the present specification, substituents of compounds of the present disclosure are disclosed in groups or in ranges. It is specifically intended that the present disclosure include each and every individual subcombination of the members of such groups and ranges. For example, the term "$C_{1-6}$ alkyl" is specifically intended to individually disclose methyl, ethyl, $C_3$ alkyl, $C_4$ alkyl, $C_5$ alkyl, and $C_6$ alkyl.

About: As used herein, the term "about" means +/−10% of the recited value.

Administered in combination: As used herein, the term "administered in combination" or "combined administration" means that two or more agents are administered to a subject at the same time or within an interval such that there may be an overlap of an effect of each agent on the patient. In some embodiments, they are administered within about 60, 30, 15, 10, 5, or 1 minute of one another. In some embodiments, the administrations of the agents are spaced sufficiently closely together such that a combinatorial (e.g., a synergistic) effect is achieved.

Animal: As used herein, the term "animal" refers to any member of the animal kingdom. In some embodiments, "animal" refers to humans at any stage of development. In some embodiments, "animal" refers to non-human animals at any stage of development. In certain embodiments, the non-human animal is a mammal (e.g., a rodent, a mouse, a rat, a rabbit, a monkey, a dog, a cat, a sheep, cattle, a primate, or a pig). In some embodiments, animals include, but are not limited to, mammals, birds, reptiles, amphibians, fish, and worms. In some embodiments, the animal is a transgenic animal, genetically-engineered animal, or a clone.

Antigens of interest or desired antigens: As used herein, the terms "antigens of interest" or "desired antigens" include those proteins and other biomolecules provided herein that are immunospecifically bound by the antibodies and fragments, mutants, variants, and alterations thereof described herein. Examples of antigens of interest include, but are not limited to, insulin, insulin-like growth factor, hGH, tPA, cytokines, such as interleukins (IL), e.g., IL-1, IL-2, IL-3, IL-4, IL-5, IL-6, IL-7, IL-8, IL-9, IL-10, IL-11, IL-12, IL-13, IL-14, IL-15, IL-16, IL-17, IL-18, interferon (IFN) alpha, IFN beta, IFN gamma, IFN omega or IFN tau, tumor necrosis factor (TNF), such as TNF alpha and TNF beta, TNF gamma, TRAIL; G-CSF, GM-CSF, M-CSF, MCP-1 and VEGF.

Approximately: As used herein, the term "approximately" or "about," as applied to one or more values of interest, refers to a value that is similar to a stated reference value. In certain embodiments, the term "approximately" or "about" refers to a range of values that fall within 25%, 20%, 19%, 18%, 17%, 16%, 15%, 14%, 13%, 12%, 11%, 10%, 9%, 8%, 7%, 6%, 5%, 4%, 3%, 2%, 1%, or less in either direction (greater than or less than) of the stated reference value unless otherwise stated or otherwise evident from the context (except where such number would exceed 100% of a possible value).

Associated with: As used herein, the terms "associated with," "conjugated," "linked," "attached," and "tethered," when used with respect to two or more moieties, means that the moieties are physically associated or connected with one another, either directly or via one or more additional moieties that serves as a linking agent, to form a structure that is sufficiently stable so that the moieties remain physically associated under the conditions in which the structure is used, e.g., physiological conditions. An "association" need not be strictly through direct covalent chemical bonding. It may also suggest ionic or hydrogen bonding or a hybridization based connectivity sufficiently stable such that the "associated" entities remain physically associated.

Bifunctional: As used herein, the term "bifunctional" refers to any substance, molecule or moiety which is capable of or maintains at least two functions. The functions may effect the same outcome or a different outcome. The structure that produces the function may be the same or different. For example, bifunctional modified RNAs of the present invention may encode a cytotoxic peptide (a first function) while those nucleosides which comprise the encoding RNA are, in and of themselves, cytotoxic (second function). In this example, delivery of the bifunctional modified RNA to a cancer cell would produce not only a peptide or protein molecule which may ameliorate or treat the cancer but would also deliver a cytotoxic payload of nucleosides to the cell should degradation, instead of translation of the modified RNA, occur.

Biocompatible: As used herein, the term "biocompatible" means compatible with living cells, tissues, organs or systems posing little to no risk of injury, toxicity or rejection by the immune system.

Biodegradable: As used herein, the term "biodegradable" means capable of being broken down into innocuous products by the action of living things.

Biologically active: As used herein, the phrase "biologically active" refers to a characteristic of any substance that has activity in a biological system and/or organism. For instance, a substance that, when administered to an organism, has a biological effect on that organism, is considered to be biologically active. In particular embodiments, signal-sensor polynucleotide, primary construct or mmRNA of the present invention may be considered biologically active if even a portion of the signal-sensor polynucleotide, primary construct or mmRNA is biologically active or mimics an activity considered biologically relevant.

Cancer: As used herein, the term "cancer" in a subject refers to the presence of cells possessing characteristics, such as uncontrolled proliferation, immortality, metastatic potential, rapid growth and proliferation rate, and certain characteristic morphological features. Often, cancer cells will be in the form of a tumor, but such cells may exist alone within a subject, or may circulate in the blood stream as independent cells, such as leukemic cells.

Cell growth: As used herein, the term "cell growth" is principally associated with growth in cell numbers, which occurs by means of cell reproduction (i.e. proliferation) when the rate of the latter is greater than the rate of cell death (e.g. by apoptosis or necrosis).

Chemical terms: The following provides the definition of various chemical terms from "acyl" to "thiol."

The term "acyl," as used herein, represents a hydrogen or an alkyl group (e.g., a haloalkyl group), as defined herein, that is attached to the parent molecular group through a carbonyl group, as defined herein, and is exemplified by formyl (i.e., a carboxyaldehyde group), acetyl, propionyl, butanoyl and the like. Exemplary unsubstituted acyl groups include from 1 to 7, from 1 to 11, or from 1 to 21 carbons. In some embodiments, the alkyl group is further substituted with 1, 2, 3, or 4 substituents as described herein.

The term "acylamino," as used herein, represents an acyl group, as defined herein, attached to the parent molecular group though an amino group, as defined herein (i.e., —N($R^{N1}$)—C(O)—R, where R is H or an optionally substituted $C_{1-6}$, $C_{1-10}$, or $C_{1-20}$ alkyl group and $R^{N1}$ is as defined herein). Exemplary unsubstituted acylamino groups include from 1 to 41 carbons (e.g., from 1 to 7, from 1 to 13, from 1 to 21, from 2 to 7, from 2 to 13, from 2 to 21, or from 2 to 41 carbons). In some embodiments, the alkyl group is further substituted with 1, 2, 3, or 4 substituents as described herein, and/or the amino group is —$NH_2$ or —$NHR^{N1}$, wherein $R^{N1}$ is, independently, OH, $NO_2$, $NH_2$, $NR^{N2}{}_2$, $SO_2OR^{N2}$, $SO_2R^{N2}$, $SOR^{N2}$, alkyl, or aryl, and each $R^{N2}$ can be H, alkyl, or aryl.

The term "acyloxy," as used herein, represents an acyl group, as defined herein, attached to the parent molecular group though an oxygen atom (i.e., —O—C(O)—R, where R is H or an optionally substituted $C_{1-6}$, $C_{1-10}$, or $C_{1-20}$ alkyl group). Exemplary unsubstituted acyloxy groups include from 1 to 21 carbons (e.g., from 1 to 7 or from 1 to 11 carbons). In some embodiments, the alkyl group is further substituted with 1, 2, 3, or 4 substituents as described herein, and/or the amino group is —$NH_2$, or —$NHR^{N1}$, wherein is, independently, OH, $NO_2$, $NH_2$, $NR^{N2}{}_2$, $SO_2OR^{N2}$, $SO_2R^{N2}$, $SOR^{N2}$, alkyl, or aryl, and each $R^{N2}$ can be H, alkyl, or aryl.

The term "alkaryl," as used herein, represents an aryl group, as defined herein, attached to the parent molecular group through an alkylene group, as defined herein. Exemplary unsubstituted alkaryl groups are from 7 to 30 carbons (e.g., from 7 to 16 or from 7 to 20 carbons, such as $C_{1-6}$ alk-$C_{6-10}$ aryl, $C_{1-10}$ alk-$C_{6-10}$ aryl, or $C_{1-20}$ alk-$C_{6-10}$ aryl). In some embodiments, the alkylene and the aryl each can be further substituted with 1, 2, 3, or 4 substituent groups as defined herein for the respective groups. Other groups preceded by the prefix "alk-" are defined in the same manner, where "alk" refers to a $C_{1-6}$ alkylene, unless otherwise noted, and the attached chemical structure is as defined herein.

The term "alkcycloalkyl" represents a cycloalkyl group, as defined herein, attached to the parent molecular group through an alkylene group, as defined herein (e.g., an alkylene group of from 1 to 4, from 1 to 6, from 1 to 10, or form 1 to 20 carbons). In some embodiments, the alkylene and the cycloalkyl each can be further substituted with 1, 2, 3, or 4 substituent groups as defined herein for the respective group.

The term "alkenyl," as used herein, represents monovalent straight or branched chain groups of, unless otherwise specified, from 2 to 20 carbons (e.g., from 2 to 6 or from 2 to 10 carbons) containing one or more carbon-carbon double bonds and is exemplified by ethenyl, 1-propenyl, 2-propenyl, 2-methyl-1-propenyl, 1-butenyl, 2-butenyl, and the like. Alkenyls include both cis and trans isomers. Alkenyl groups may be optionally substituted with 1, 2, 3, or 4 substituent groups that are selected, independently, from amino, aryl, cycloalkyl, or heterocyclyl (e.g., heteroaryl), as defined herein, or any of the exemplary alkyl substituent groups described herein.

The term "alkenyloxy" represents a chemical substituent of formula —OR, where R is a $C_{2-20}$ alkenyl group (e.g., $C_{2-6}$ or $C_{2-10}$ alkenyl), unless otherwise specified. Exemplary alkenyloxy groups include ethenyloxy, propenyloxy, and the like. In some embodiments, the alkenyl group can be further substituted with 1, 2, 3, or 4 substituent groups as defined herein (e.g., a hydroxy group).

The term "alkheteroaryl" refers to a heteroaryl group, as defined herein, attached to the parent molecular group through an alkylene group, as defined herein. Exemplary unsubstituted alkheteroaryl groups are from 2 to 32 carbons (e.g., from 2 to 22, from 2 to 18, from 2 to 17, from 2 to 16, from 3 to 15, from 2 to 14, from 2 to 13, or from 2 to 12 carbons, such as $C_{1-6}$ alk-$C_{1-12}$ heteroaryl, $C_{1-10}$ alk-$C_{1-12}$ heteroaryl, or $C_{1-20}$ alk-$C_{1-12}$ heteroaryl). In some embodiments, the alkylene and the heteroaryl each can be further substituted with 1, 2, 3, or 4 substituent groups as defined herein for the respective group. Alkheteroaryl groups are a subset of alkheterocyclyl groups.

The term "alkheterocyclyl" represents a heterocyclyl group, as defined herein, attached to the parent molecular group through an alkylene group, as defined herein. Exemplary unsubstituted alkheterocyclyl groups are from 2 to 32 carbons (e.g., from 2 to 22, from 2 to 18, from 2 to 17, from 2 to 16, from 3 to 15, from 2 to 14, from 2 to 13, or from 2 to 12 carbons, such as $C_{1-6}$ alk-$C_{1-12}$ heterocyclyl, $C_{1-10}$ alk-$C_{1-12}$ heterocyclyl, or alk-$C_{1-12}$ heterocyclyl). In some embodiments, the alkylene and the heterocyclyl each can be further substituted with 1, 2, 3, or 4 substituent groups as defined herein for the respective group.

The term "alkoxy" represents a chemical substituent of formula —OR, where R is a $C_{1-20}$ alkyl group (e.g., $C_{1-6}$ or $C_{1-10}$ alkyl), unless otherwise specified. Exemplary alkoxy groups include methoxy, ethoxy, propoxy (e.g., n-propoxy and isopropoxy), t-butoxy, and the like. In some embodiments, the alkyl group can be further substituted with 1, 2, 3, or 4 substituent groups as defined herein (e.g., hydroxy or alkoxy).

The term "alkoxyalkoxy" represents an alkoxy group that is substituted with an alkoxy group. Exemplary unsubstituted alkoxyalkoxy groups include between 2 to 40 carbons (e.g., from 2 to 12 or from 2 to 20 carbons, such as $C_{1-6}$ alkoxy-$C_{1-6}$ alkoxy, $C_{1-10}$ alkoxy-$C_{1-10}$ alkoxy, or $C_{1-20}$ alkoxy-$C_{1-20}$ alkoxy). In some embodiments, the each alkoxy group can be further substituted with 1, 2, 3, or 4 substituent groups as defined herein.

The term "alkoxyalkyl" represents an alkyl group that is substituted with an alkoxy group. Exemplary unsubstituted alkoxyalkyl groups include between 2 to 40 carbons (e.g., from 2 to 12 or from 2 to 20 carbons, such as $C_{1-6}$ alkoxy-$C_{1-6}$ alkyl, $C_{1-10}$ alkoxy-$C_{1-10}$ alkyl, or $C_{1-20}$ alkoxy-$C_{1-20}$ alkyl). In some embodiments, the alkyl and the alkoxy each can be further substituted with 1, 2, 3, or 4 substituent groups as defined herein for the respective group.

The term "alkoxycarbonyl," as used herein, represents an alkoxy, as defined herein, attached to the parent molecular group through a carbonyl atom (e.g., —C(O)—OR, where R is H or an optionally substituted $C_{1-6}$, $C_{1-10}$, or $C_{1-20}$ alkyl group). Exemplary unsubstituted alkoxycarbonyl include from 1 to 21 carbons (e.g., from 1 to 11 or from 1 to 7 carbons). In some embodiments, the alkoxy group is further substituted with 1, 2, 3, or 4 substituents as described herein.

The term "alkoxycarbonylalkoxy," as used herein, represents an alkoxy group, as defined herein, that is substituted with an alkoxycarbonyl group, as defined herein (e.g., —O-alkyl-C(O)—OR, where R is an optionally substituted $C_{1-6}$, $C_{1-10}$, or $C_{1-20}$ alkyl group). Exemplary unsubstituted alkoxycarbonylalkoxy include from 3 to 41 carbons (e.g., from 3 to 10, from 3 to 13, from 3 to 17, from 3 to 21, or from 3 to 31 carbons, such as $C_{1-6}$ alkoxycarbonyl-$C_{1-6}$ alkoxy, $C_{1-10}$ alkoxycarbonyl-$C_{1-10}$ alkoxy, or $C_{1-20}$ alkoxycarbonyl-$C_{1-20}$ alkoxy). In some embodiments, each alkoxy group is further independently substituted with 1, 2, 3, or 4 substituents, as described herein (e.g., a hydroxy group).

The term "alkoxycarbonylalkyl," as used herein, represents an alkyl group, as defined herein, that is substituted with an alkoxycarbonyl group, as defined herein (e.g., -alkyl-C(O)—OR, where R is an optionally substituted $C_{1-20}$, $C_{1-10}$, or $C_{1-6}$ alkyl group). Exemplary unsubstituted alkoxycarbonylalkyl include from 3 to 41 carbons (e.g., from 3 to 10, from 3 to 13, from 3 to 17, from 3 to 21, or from 3 to 31 carbons, such as $C_{1-6}$ alkoxycarbonyl-$C_{1-6}$ alkyl, $C_{1-10}$ alkoxycarbonyl-$C_{1-10}$ alkyl, or $C_{1-20}$ alkoxycarbonyl-$C_{1-20}$ alkyl). In some embodiments, each alkyl and alkoxy group is further independently substituted with 1, 2, 3, or 4 substituents as described herein (e.g., a hydroxy group).

The term "alkyl," as used herein, is inclusive of both straight chain and branched chain saturated groups from 1 to 20 carbons (e.g., from 1 to 10 or from 1 to 6), unless otherwise specified. Alkyl groups are exemplified by methyl, ethyl, n- and isopropyl, n-, sec-, iso- and tert-butyl, neopentyl, and the like, and may be optionally substituted with one, two, three, or, in the case of alkyl groups of two carbons or more, four substituents independently selected from the group consisting of: (1) $C_{1-6}$ alkoxy; (2) $C_{1-6}$ alkylsulfinyl; (3) amino, as defined herein (e.g., unsubstituted amino (i.e., —$NH_2$) or a substituted amino (i.e., —$N(R^{N1})_2$, where $R^{N1}$ is as defined for amino); (4) $C_{6-10}$ aryl-$C_{1-6}$ alkoxy; (5) azido; (6) halo; (7) ($C_{2-9}$ heterocyclyl)oxy; (8) hydroxy; (9) nitro; (10) oxo (e.g., carboxyaldehyde or acyl); (11) $C_{1-7}$ spirocyclyl; (12) thioalkoxy; (13) thiol; (14) —$CO_2R^{A'}$, where $R^{A'}$ is selected from the group consisting of (a) $C_{1-20}$ alkyl (e.g., $C_{1-6}$ alkyl), (b) $C_{2-20}$ alkenyl (e.g., $C_{2-6}$ alkenyl), (c) $C_{6-10}$ aryl, (d) hydrogen, (e) $C_{1-6}$ alk-$C_{6-10}$ aryl, (f) amino-$C_{1-20}$ alkyl, (g) polyethylene glycol of —$(CH_2)_{s2}$$(OCH_2CH_2)_{s1}(CH_2)_{s3}OR'$, wherein s1 is an integer from 1 to 10 (e.g., from 1 to 6 or from 1 to 4), each of s2 and s3, independently, is an integer from 0 to 10 (e.g., from 0 to 4, from 0 to 6, from 1 to 4, from 1 to 6, or from 1 to 10), and R' is H or $C_{1-20}$ alkyl, and (h) amino-polyethylene glycol of —$NR^{N1}(CH_2)_{s2}(CH_2CH_2O)_{s1}(CH_2)_{s3}NR^{N1}$, wherein s1 is an integer from 1 to 10 (e.g., from 1 to 6 or from 1 to 4), each of s2 and s3, independently, is an integer from 0 to 10 (e.g., from 0 to 4, from 0 to 6, from 1 to 4, from 1 to 6, or from 1 to 10), and each $R^{N1}$ is, independently, hydrogen or optionally substituted $C_{1-6}$ alkyl; (15) —$C(O)NR^{B'}R^{C'}$, where each of $R^{B'}$ and $R^{C'}$ is, independently, selected from the group consisting of (a) hydrogen, (b) $C_{1-6}$ alkyl, (c) $C_{6-10}$ aryl, and (d) $C_{1-6}$ alk-$C_{6-10}$ aryl; (16) —$SO_2R^{D'}$, where $R^{D'}$ is selected from the group consisting of (a) $C_{1-6}$ alkyl, (b) $C_{6-10}$ aryl, (c) $C_{1-6}$ alk-$C_{6-10}$ aryl, and (d) hydroxy; (17) —$SO_2NR^{E'}R^{F'}$, where each of $R^{E'}$ and $R^{F'}$ is, independently, selected from the group consisting of (a) hydrogen, (b) $C_{1-6}$ alkyl, (c) $C_{6-10}$ aryl and (d) $C_{1-6}$ alk-$C_{6-10}$ aryl; (18) —$C(O)R^{G'}$, where $R^{G'}$ is selected from the group consisting of (a) $C_{1-20}$ alkyl (e.g., $C_{1-6}$ alkyl), (b) $C_{2-20}$ alkenyl (e.g., $C_{2-6}$ alkenyl), (c) $C_{6-10}$ aryl, (d) hydrogen, (e) $C_{1-6}$ alk-$C_{6-10}$ aryl, (f) amino-$C_{1-20}$ alkyl, (g) polyethylene glycol of —$(CH_2)_{s2}$$(OCH_2CH_2)_{s1}(CH_2)_{s3}OR'$, wherein s1 is an integer from 1 to 10 (e.g., from 1 to 6 or from 1 to 4), each of s2 and s3, independently, is an integer from 0 to 10 (e.g., from 0 to 4, from 0 to 6, from 1 to 4, from 1 to 6, or from 1 to 10), and R' is H or $C_{1-20}$ alkyl, and (h) amino-polyethylene glycol of —$NR^{N1}(CH_2)_{s2}(CH_2CH_2O)_{s1}(CH_2)_{s3}NR^{N1}$, wherein s1 is an integer from 1 to 10 (e.g., from 1 to 6 or from 1 to 4), each of s2 and s3, independently, is an integer from 0 to 10 (e.g., from 0 to 4, from 0 to 6, from 1 to 4, from 1 to 6, or from 1 to 10), and each $R^{N1}$ is, independently, hydrogen or optionally substituted $C_{1-6}$ alkyl; (19) —$NR^{H'}C(O)R^{I'}$, wherein $R^{H'}$ is selected from the group consisting of (a1) hydrogen and (b1) $C_{1-6}$ alkyl, and $R^{I'}$ is selected from the group consisting of (a2) $C_{1-20}$ alkyl (e.g., $C_{1-6}$ alkyl), (b2)

$C_{2-20}$ alkenyl (e.g., $C_{2-6}$ alkenyl), (c2) $C_{6-10}$ aryl, (d2) hydrogen, (e2) $C_{1-6}$ alk-$C_{6-10}$ aryl, (f2) amino-$C_{1-20}$ alkyl, (g2) polyethylene glycol of —$(CH_2)_{s2}(OCH_2CH_2)_{s1}(CH_2)_{s3}OR'$, wherein s1 is an integer from 1 to 10 (e.g., from 1 to 6 or from 1 to 4), each of s2 and s3, independently, is an integer from 0 to 10 (e.g., from 0 to 4, from 0 to 6, from 1 to 4, from 1 to 6, or from 1 to 10), and R' is H or $C_{1-20}$ alkyl, and (h2) amino-polyethylene glycol of —$NR^{N1}(CH_2)_{s2}(CH_2CH_2O)_{s1}(CH_2)_{s3}NR^{N1}$, wherein s1 is an integer from 1 to 10 (e.g., from 1 to 6 or from 1 to 4), each of s2 and s3, independently, is an integer from 0 to 10 (e.g., from 0 to 4, from 0 to 6, from 1 to 4, from 1 to 6, or from 1 to 10), and each $R^{N1}$ is, independently, hydrogen or optionally substituted $C_{1-6}$ alkyl; (20) —$NR^{J'}C(O)OR^{K'}$, wherein $R^{J'}$ is selected from the group consisting of (a1) hydrogen and (b1) $C_{1-6}$ alkyl, and $R^{K'}$ is selected from the group consisting of (a2) $C_{1-20}$ alkyl (e.g., $C_{1-6}$ alkyl), (b2) $C_{2-20}$ alkenyl (e.g., $C_{2-6}$ alkenyl), (c2) $C_{6-10}$ aryl, (d2) hydrogen, (e2) alk-$C_{6-10}$ aryl, (f2) amino-$C_{1-20}$ alkyl, (g2) polyethylene glycol of —$(CH_2)_{s2}(OCH_2CH_2)_{s1}(CH_2)_{s3}OR'$, wherein s1 is an integer from 1 to 10 (e.g., from 1 to 6 or from 1 to 4), each of s2 and s3, independently, is an integer from 0 to 10 (e.g., from 0 to 4, from 0 to 6, from 1 to 4, from 1 to 6, or from 1 to 10), and R' is H or $C_{1-20}$ alkyl, and (h2) amino-polyethylene glycol of —$NR^{N1}(CH_2)_{s2}(CH_2CH_2O)_{s1}(CH_2)_{s3}NR^{N1}$, wherein s1 is an integer from 1 to 10 (e.g., from 1 to 6 or from 1 to 4), each of s2 and s3, independently, is an integer from 0 to 10 (e.g., from 0 to 4, from 0 to 6, from 1 to 4, from 1 to 6, or from 1 to 10), and each $R^{N1}$ is, independently, hydrogen or optionally substituted $C_{1-6}$ alkyl; and (21) amidine. In some embodiments, each of these groups can be further substituted as described herein. For example, the alkylene group of a $C_1$-alkaryl can be further substituted with an oxo group to afford the respective aryloyl substituent.

The term "alkylene" and the prefix "alk-," as used herein, represent a saturated divalent hydrocarbon group derived from a straight or branched chain saturated hydrocarbon by the removal of two hydrogen atoms, and is exemplified by methylene, ethylene, isopropylene, and the like. The term "$C_{x-y}$ alkylene" and the prefix "$C_{x-y}$ alk-" represent alkylene groups having between x and y carbons. Exemplary values for x are 1, 2, 3, 4, 5, and 6, and exemplary values for y are 2, 3, 4, 5, 6, 7, 8, 9, 10, 12, 14, 16, 18, or 20 (e.g., $C_{1-6}$, $C_{1-10}$, $C_{2-20}$, $C_{2-6}$, $C_{2-10}$, or $C_{2-20}$ alkylene). In some embodiments, the alkylene can be further substituted with 1, 2, 3, or 4 substituent groups as defined herein for an alkyl group.

The term "alkylsulfinyl," as used herein, represents an alkyl group attached to the parent molecular group through an —S(O)— group. Exemplary unsubstituted alkylsulfinyl groups are from 1 to 6, from 1 to 10, or from 1 to 20 carbons. In some embodiments, the alkyl group can be further substituted with 1, 2, 3, or 4 substituent groups as defined herein.

The term "alkylsulfinylalkyl," as used herein, represents an alkyl group, as defined herein, substituted by an alkylsulfinyl group. Exemplary unsubstituted alkylsulfinylalkyl groups are from 2 to 12, from 2 to 20, or from 2 to 40 carbons. In some embodiments, each alkyl group can be further substituted with 1, 2, 3, or 4 substituent groups as defined herein.

The term "alkynyl," as used herein, represents monovalent straight or branched chain groups from 2 to 20 carbon atoms (e.g., from 2 to 4, from 2 to 6, or from 2 to 10 carbons) containing a carbon-carbon triple bond and is exemplified by ethynyl, 1-propynyl, and the like. Alkynyl groups may be optionally substituted with 1, 2, 3, or 4 substituent groups that are selected, independently, from aryl, cycloalkyl, or heterocyclyl (e.g., heteroaryl), as defined herein, or any of the exemplary alkyl substituent groups described herein.

The term "alkynyloxy" represents a chemical substituent of formula —OR, where R is a $C_{2-20}$ alkynyl group (e.g., $C_{2-6}$ or $C_{2-10}$ alkynyl), unless otherwise specified. Exemplary alkynyloxy groups include ethynyloxy, propynyloxy, and the like. In some embodiments, the alkynyl group can be further substituted with 1, 2, 3, or 4 substituent groups as defined herein (e.g., a hydroxy group).

The term "amidine," as used herein, represents a —$C(=NH)NH_2$ group.

The term "amino," as used herein, represents —$N(R^{N1})_2$, wherein each $R^{N1}$ is, independently, H, OH, $NO_2$, $N(R^{N2})_2$, $SO_2OR^{N2}$, $SO_2R^{N2}$, $SOR^{N2}$, an A-protecting group, alkyl, alkenyl, alkynyl, alkoxy, aryl, alkaryl, cycloalkyl, alkcycloalkyl, carboxyalkyl, sulfoalkyl, heterocyclyl (e.g., heteroaryl), or alkheterocyclyl (e.g., alkheteroaryl), wherein each of these recited $R^{N1}$ groups can be optionally substituted, as defined herein for each group; or two $R^{N1}$ combine to form a heterocyclyl or an N-protecting group, and wherein each $R^{N2}$ is, independently, H, alkyl, or aryl. The amino groups of the invention can be an unsubstituted amino (i.e., —$NH_2$) or a substituted amino (i.e., —$N(R^{N1})_2$). In a preferred embodiment, amino is —$NH_2$ or —$NHR^{N1}$, wherein $R^{N1}$ is, independently, OH, $NO_2$, $NH_2$, $NR^{N2}_2$, $SO_2OR^{N2}$, $SO_2R^{N2}$, $SOR^{N2}$, alkyl, carboxyalkyl, sulfoalkyl, or aryl, and each $R^{N2}$ can be H, $C_{1-20}$ alkyl (e.g., $C_{1-6}$ alkyl), or $C_{6-10}$ aryl.

The term "amino acid," as described herein, refers to a molecule having a side chain, an amino group, and an acid group (e.g., a carboxy group of —$CO_2H$ or a sulfo group of —$SO_3H$), wherein the amino acid is attached to the parent molecular group by the side chain, amino group, or acid group (e.g., the side chain). In some embodiments, the amino acid is attached to the parent molecular group by a carbonyl group, where the side chain or amino group is attached to the carbonyl group. Exemplary side chains include an optionally substituted alkyl, aryl, heterocyclyl, alkaryl, alkheterocyclyl, aminoalkyl, carbamoylalkyl, and carboxyalkyl. Exemplary amino acids include alanine, arginine, asparagine, aspartic acid, cysteine, glutamic acid, glutamine, glycine, histidine, hydroxynorvaline, isoleucine, leucine, lysine, methionine, norvaline, ornithine, phenylalanine, proline, pyrrolysine, selenocysteine, serine, taurine, threonine, tryptophan, tyrosine, and valine. Amino acid groups may be optionally substituted with one, two, three, or, in the case of amino acid groups of two carbons or more, four substituents independently selected from the group consisting of: (1) $C_{1-6}$ alkoxy; (2) $C_{1-6}$ alkylsulfinyl; (3) amino, as defined herein (e.g., unsubstituted amino (i.e., —$NH_2$) or a substituted amino (i.e., —$N(R^{N1})_2$, where $R^{N1}$ is as defined for amino); (4) $C_{6-10}$ aryl-$C_{1-6}$ alkoxy; (5) azido; (6) halo; (7) ($C_{2-9}$ heterocyclyl)oxy; (8) hydroxy; (9) nitro; (10) oxo (e.g., carboxyaldehyde or acyl); (11) $C_{1-7}$ spirocyclyl; (12) thioalkoxy; (13) thiol; (14) —$CO_2R^{A'}$, where $R^{A'}$ is selected from the group consisting of (a) $C_{1-20}$ alkyl (e.g., $C_{1-6}$ alkyl), (b) $C_{2-20}$ alkenyl (e.g., $C_{2-6}$ alkenyl), (c) $C_{6-10}$ aryl, (d) hydrogen, (e) $C_{1-6}$ alk-$C_{6-10}$ aryl, (f) amino-$C_{1-20}$ alkyl, (g) polyethylene glycol of —$(CH_2)_{s2}(OCH_2CH_2)_{s1}(CH_2)_{s3}OR'$, wherein s1 is an integer from 1 to 10 (e.g., from 1 to 6 or from 1 to 4), each of s2 and s3, independently, is an integer from 0 to 10 (e.g., from 0 to 4, from 0 to 6, from 1 to 4, from 1 to 6, or from 1 to 10), and R' is H or $C_{1-20}$ alkyl, and (h) amino-polyethylene glycol of —$NR^{N1}(CH_2)_{s2}(CH_2CH_2O)_{s1}(CH_2)_{s3}NR^{N1}$, wherein s1 is an integer from 1 to 10 (e.g., from 1 to 6 or from 1 to 4), each of s2 and s3, independently, is an integer from 0 to 10 (e.g., from 0 to 4, from 0 to 6, from 1 to 4, from 1 to 6, or from 1 to 10), and each $R^{N1}$ is, independently, hydrogen or optionally substituted $C_{1-6}$ alkyl; (15) —C(O)NR$^{B'}$R$^{C'}$, where each of R$^{B'}$ and R$^{C'}$ is, independently, selected from the group consisting of (a) hydrogen, (b) $C_{1-6}$ alkyl, (c) $C_{6-10}$ aryl, and (d) $C_{1-6}$ alk-$C_{6-10}$ aryl; (16) —SO$_2$R$^{D'}$, where R$^{D'}$ is selected from the group consisting of (a) $C_{1-6}$ alkyl, (b) $C_{6-10}$ aryl, (c) $C_{1-6}$ alk-$C_{6-10}$ aryl, and (d) hydroxy; (17) —SO$_2$NR$^{E'}$R$^{F'}$, where each of R$^{E'}$ and R$^{F'}$ is, independently, selected from the group consisting of (a) hydrogen, (b) $C_{1-6}$ alkyl, (c) $C_{6-10}$ aryl and (d) $C_{1-6}$ alk-$C_{6-10}$ aryl; (18) —C(O)R$^{G'}$, where R$^{G'}$ is selected from the group consisting of (a) $C_{1-20}$ alkyl (e.g., $C_{1-6}$ alkyl), (b) $C_{2-20}$ alkenyl (e.g., $C_{2-6}$ alkenyl), (c) $C_{6-10}$ aryl, (d) hydrogen, (e) $C_{1-6}$ alk-$C_{6-10}$ aryl, (f) amino-$C_{1-20}$ alkyl, (g) polyethylene glycol of —(CH$_2$)$_{s2}$(OCH$_2$CH$_2$)$_{s1}$(CH$_2$)$_{s3}$OR', wherein s1 is an integer from 1 to 10 (e.g., from 1 to 6 or from 1 to 4), each of s2 and s3, independently, is an integer from 0 to 10 (e.g., from 0 to 4, from 0 to 6, from 1 to 4, from 1 to 6, or from 1 to 10), and R' is H or $C_{1-20}$ alkyl, and (h) amino-polyethylene glycol of —NR$^{N1}$(CH$_2$)$_{s2}$(CH$_2$CH$_2$O)$_{s1}$(CH$_2$)$_{s3}$NR$^{N1}$, wherein s1 is an integer from 1 to 10 (e.g., from 1 to 6 or from 1 to 4), each of s2 and s3, independently, is an integer from 0 to 10 (e.g., from 0 to 4, from 0 to 6, from 1 to 4, from 1 to 6, or from 1 to 10), and each $R^{N1}$ is, independently, hydrogen or optionally substituted $C_{1-6}$ alkyl; (19) —NR$^{H'}$C(O)R$^{I'}$, wherein R$^{H'}$ is selected from the group consisting of (a1) hydrogen and (b1) $C_{1-6}$ alkyl, and R$^{I'}$ is selected from the group consisting of (a2) $C_{1-20}$ alkyl (e.g., $C_{1-6}$ alkyl), (b2) $C_{2-20}$ alkenyl (e.g., $C_{2-6}$ alkenyl), (c2) $C_{6-10}$ aryl, (d2) hydrogen, (e2) $C_{1-6}$ alk-$C_{6-10}$ aryl, (f2) amino-$C_{1-20}$ alkyl, (g2) polyethylene glycol of —(CH$_2$)$_{s2}$(OCH$_2$CH$_2$)$_{s1}$(CH$_2$)$_{s3}$OR', wherein s1 is an integer from 1 to 10 (e.g., from 1 to 6 or from 1 to 4), each of s2 and s3, independently, is an integer from 0 to 10 (e.g., from 0 to 4, from 0 to 6, from 1 to 4, from 1 to 6, or from 1 to 10), and R' is H or $C_{1-20}$ alkyl, and (h2) amino-polyethylene glycol of —NR$^{N1}$(CH$_2$)$_{s2}$(CH$_2$CH$_2$O)$_{s1}$(CH$_2$)$_{s3}$NR$^{N1}$, wherein s1 is an integer from 1 to 10 (e.g., from 1 to 6 or from 1 to 4), each of s2 and s3, independently, is an integer from 0 to 10 (e.g., from 0 to 4, from 0 to 6, from 1 to 4, from 1 to 6, or from 1 to 10), and each $R^{N1}$ is, independently, hydrogen or optionally substituted $C_{1-6}$ alkyl; (20) —NR$^{J'}$C(O)OR$^{K'}$, wherein R$^{J'}$ is selected from the group consisting of (a1) hydrogen and (b1) $C_{1-6}$ alkyl, and R$^{K'}$ is selected from the group consisting of (a2) $C_{1-20}$ alkyl (e.g., $C_{1-6}$ alkyl), (b2) $C_{2-20}$ alkenyl (e.g., $C_{2-6}$ alkenyl), (c2) $C_{6-10}$ aryl, (d2) hydrogen, (e2) $C_{1-6}$ alk-$C_{6-10}$ aryl, (f2) amino-$C_{1-20}$ alkyl, (g2) polyethylene glycol of —(CH$_2$)$_{s2}$(OCH$_2$CH$_2$)$_{s1}$(CH$_2$)$_{s3}$OR', wherein s1 is an integer from 1 to 10 (e.g., from 1 to 6 or from 1 to 4), each of s2 and s3, independently, is an integer from 0 to 10 (e.g., from 0 to 4, from 0 to 6, from 1 to 4, from 1 to 6, or from 1 to 10), and R' is H or $C_{1-20}$ alkyl, and (h2) amino-polyethylene glycol of —NR$^{N1}$(CH$_2$)$_{s2}$(CH$_2$CH$_2$O)$_{s1}$(CH$_2$)$_{s3}$NR$^{N1}$, wherein s1 is an integer from 1 to 10 (e.g., from 1 to 6 or from 1 to 4), each of s2 and s3, independently, is an integer from 0 to 10 (e.g., from 0 to 4, from 0 to 6, from 1 to 4, from 1 to 6, or from 1 to 10), and each $R^{N1}$ is, independently, hydrogen or optionally substituted $C_{1-6}$ alkyl; and (21) amidine. In some embodiments, each of these groups can be further substituted as described herein.

The term "aminoalkoxy," as used herein, represents an alkoxy group, as defined herein, substituted by an amino group, as defined herein. The alkyl and amino each can be further substituted with 1, 2, 3, or 4 substituent groups as described herein for the respective group (e.g., CO$_2$R$^{A'}$, where R$^{A'}$ is selected from the group consisting of (a) $C_{1-6}$ alkyl, (b) $C_{6-10}$ aryl, (c) hydrogen, and (d) $C_{1-6}$ alk-$C_{6-10}$ aryl, e.g., carboxy).

The term "aminoalkyl," as used herein, represents an alkyl group, as defined herein, substituted by an amino group, as defined herein. The alkyl and amino each can be further substituted with 1, 2, 3, or 4 substituent groups as described herein for the respective group (e.g., CO$_2$R$^{A'}$, where R$^{A'}$ is selected from the group consisting of (a) $C_{1-6}$ alkyl, (b) $C_{6-10}$ aryl, (c) hydrogen, and (d) $C_{1-6}$ alk-$C_{6-10}$ aryl, e.g., carboxy).

The term "aryl," as used herein, represents a mono-, bicyclic, or multicyclic carbocyclic ring system having one or two aromatic rings and is exemplified by phenyl, naphthyl, 1,2-dihydronaphthyl, 1,2,3,4-tetrahydronaphthyl, anthracenyl, phenanthrenyl, fluorenyl, indanyl, indenyl, and the like, and may be optionally substituted with 1, 2, 3, 4, or 5 substituents independently selected from the group consisting of: (1) $C_{1-7}$ acyl (e.g., carboxyaldehyde); (2) $C_{1-20}$ alkyl (e.g., $C_{1-6}$ alkyl, $C_{1-6}$ alkoxy-$C_{1-6}$ alkyl, $C_{1-6}$ alkylsulfinyl-$C_{1-6}$ alkyl, amino-$C_{1-6}$ alkyl, azido-$C_{1-6}$ alkyl, (carboxyaldehyde)-$C_{1-6}$ alkyl, halo-$C_{1-6}$ alkyl (e.g., perfluoroalkyl), hydroxy-$C_{1-6}$ alkyl, nitro-$C_{1-6}$ alkyl, or $C_{1-6}$ thioalkoxy-$C_{1-6}$ alkyl); (3) $C_{1-20}$ alkoxy (e.g., $C_{1-6}$ alkoxy, such as perfluoroalkoxy); (4) $C_{1-6}$ alkylsulfinyl; (5) $C_{6-10}$ aryl; (6) amino; (7) $C_{1-6}$ alk-$C_{6-10}$ aryl; (8) azido; (9) $C_{3-8}$ cycloalkyl; (10) $C_{1-6}$ alk-$C_{3-8}$ cycloalkyl; (11) halo; (12) $C_{1-12}$ heterocyclyl (e.g., $C_{1-12}$ heteroaryl); (13) ($C_{1-12}$ heterocyclyl)oxy; (14) hydroxy; (15) nitro; (16) $C_{1-20}$ thioalkoxy (e.g., $C_{1-6}$ thioalkoxy); (17) —(CH$_2$)$_q$CO$_2$R$^{A'}$, where q is an integer from zero to four, and R$^{A'}$ is selected from the group consisting of (a) $C_{1-6}$ alkyl, (b) $C_{6-10}$ aryl, (c) hydrogen, and (d) $C_{1-6}$ alk-$C_{6-10}$ aryl; (18) —(CH$_2$)$_q$CONR$^{B'}$R$^{C'}$, where q is an integer from zero to four and where R$^{B'}$ and R$^{C'}$ are independently selected from the group consisting of (a) hydrogen, (b) $C_{1-6}$ alkyl, (c) $C_{6-10}$ aryl, and (d) $C_{1-6}$ alk-$C_{6-10}$ aryl; (19) —(CH$_2$)$_q$SO$_2$R$^{D'}$, where q is an integer from zero to four and where R$^{D'}$ is selected from the group consisting of (a) alkyl, (b) $C_{6-10}$ aryl, and (c) alk-$C_{6-10}$ aryl; (20) —(CH$_2$)$_q$SO$_2$NR$^{E'}$R$^{F'}$, where q is an integer from zero to four and where each of R$^{E'}$ and R$^{F'}$ is, independently, selected from the group consisting of (a) hydrogen, (b) $C_{6-10}$ alkyl, (c) $C_{6-10}$ aryl, and (d) $C_{1-6}$ alk-$C_{6-10}$ aryl; (21) thiol; (22) $C_{6-10}$ aryloxy; (23) $C_{3-5}$ cycloalkoxy; (24) $C_{6-10}$ aryl-$C_{1-6}$ alkoxy; (25) $C_{1-6}$ alk-$C_{1-12}$ heterocyclyl (e.g., $C_{1-6}$ alk-$C_{1-12}$ heteroaryl); (26) $C_{2-20}$ alkenyl; and (27) $C_{2-20}$ alkynyl. In some embodiments, each of these groups can be further substituted as described herein. For example, the alkylene group of a $C_1$-alkaryl or a $C_1$-alkheterocyclyl can be further substituted with an oxo group to afford the respective aryloyl and (heterocyclyl)oyl substituent group.

The term "arylalkoxy," as used herein, represents an alkaryl group, as defined herein, attached to the parent molecular group through an oxygen atom. Exemplary unsubstituted alkoxyalkyl groups include from 7 to 30 carbons (e.g., from 7 to 16 or from 7 to 20 carbons, such as $C_{6-10}$ aryl-$C_{1-6}$ alkoxy, $C_{6-10}$ aryl-$C_{1-10}$ alkoxy, or $C_{6-10}$ aryl-$C_{1-20}$ alkoxy). In some embodiments, the arylalkoxy group can be substituted with 1, 2, 3, or 4 substituents as defined herein The term "aryloxy" represents a chemical substituent of formula —OR', where R' is an aryl group of 6 to 18 carbons, unless otherwise specified. In some embodiments, the aryl group can be substituted with 1, 2, 3, or 4 substituents as defined herein.

The term "aryloyl," as used herein, represents an aryl group, as defined herein, that is attached to the parent molecular group through a carbonyl group. Exemplary unsubstituted aryloyl groups are of 7 to 11 carbons. In some embodiments, the aryl group can be substituted with 1, 2, 3, or 4 substituents as defined herein.

The term "azido" represents an —$N_3$ group, which can also be represented as —N=N=N.

The term "bicyclic," as used herein, refer to a structure having two rings, which may be aromatic or non-aromatic. Bicyclic structures include spirocyclyl groups, as defined herein, and two rings that share one or more bridges, where such bridges can include one atom or a chain including two, three, or more atoms. Exemplary bicyclic groups include a bicyclic carbocyclyl group, where the first and second rings are carbocyclyl groups, as defined herein; a bicyclic aryl groups, where the first and second rings are aryl groups, as defined herein; bicyclic heterocyclyl groups, where the first ring is a heterocyclyl group and the second ring is a carbocyclyl (e.g., aryl) or heterocyclyl (e.g., heteroaryl) group; and bicyclic heteroaryl groups, where the first ring is a heteroaryl group and the second ring is a carbocyclyl (e.g., aryl) or heterocyclyl (e.g., heteroaryl) group. In some embodiments, the bicyclic group can be substituted with 1, 2, 3, or 4 substituents as defined herein for cycloalkyl, heterocyclyl, and aryl groups.

The terms "carbocyclic" and "carbocyclyl," as used herein, refer to an optionally substituted $C_{3-12}$ monocyclic, bicyclic, or tricyclic structure in which the rings, which may be aromatic or non-aromatic, are formed by carbon atoms. Carbocyclic structures include cycloalkyl, cycloalkenyl, and aryl groups.

The term "carbamoyl," as used herein, represents —C(O)—N($R^{N1}$)$_2$, where the meaning of each $R^{N1}$ is found in the definition of "amino" provided herein.

The term "carbamoylalkyl," as used herein, represents an alkyl group, as defined herein, substituted by a carbamoyl group, as defined herein. The alkyl group can be further substituted with 1, 2, 3, or 4 substituent groups as described herein.

The term "carbamyl," as used herein, refers to a carbamate group having the structure —N$R^{N1}$C(=O)OR or —OC(=O)N($R^{N1}$)$_2$, where the meaning of each $R^{N1}$ is found in the definition of "amino" provided herein, and R is alkyl, cycloalkyl, alkcycloalkyl, aryl, alkaryl, heterocyclyl (e.g., heteroaryl), or alkheterocyclyl (e.g., alkheteroaryl), as defined herein.

The term "carbonyl," as used herein, represents a C(O) group, which can also be represented as C=O.

The term "carboxyaldehyde" represents an acyl group having the structure —CHO.

The term "carboxy," as used herein, means —$CO_2H$.

The term "carboxyalkoxy," as used herein, represents an alkoxy group, as defined herein, substituted by a carboxy group, as defined herein. The alkoxy group can be further substituted with 1, 2, 3, or 4 substituent groups as described herein for the alkyl group.

The term "carboxyalkyl," as used herein, represents an alkyl group, as defined herein, substituted by a carboxy group, as defined herein. The alkyl group can be further substituted with 1, 2, 3, or 4 substituent groups as described herein.

The term "cyano," as used herein, represents an —CN group.

The term "cycloalkoxy" represents a chemical substituent of formula —OR, where R is a $C_{3-8}$ cycloalkyl group, as defined herein, unless otherwise specified. The cycloalkyl group can be further substituted with 1, 2, 3, or 4 substituent groups as described herein. Exemplary unsubstituted cycloalkoxy groups are from 3 to 8 carbons. In some embodiment, the cycloalkyl group can be further substituted with 1, 2, 3, or 4 substituent groups as described herein.

The term "cycloalkyl," as used herein represents a monovalent saturated or unsaturated non-aromatic cyclic hydrocarbon group from three to eight carbons, unless otherwise specified, and is exemplified by cyclopropyl, cyclobutyl, cyclopentyl, cyclohexyl, cycloheptyl, bicyclo[2.2.1]heptyl, and the like. When the cycloalkyl group includes one carbon-carbon double bond, the cycloalkyl group can be referred to as a "cycloalkenyl" group. Exemplary cycloalkenyl groups include cyclopentenyl, cyclohexenyl, and the like. The cycloalkyl groups of this invention can be optionally substituted with: (1) $C_{1-7}$ acyl (e.g., carboxyaldehyde); (2) $C_{1-20}$ alkyl (e.g., $C_{1-6}$ alkyl, $C_{1-6}$ alkoxy-$C_{1-6}$ alkyl, $C_{1-6}$ alkylsulfinyl-$C_{1-6}$ alkyl, amino-$C_{1-6}$ alkyl, azido-$C_{1-6}$ alkyl, (carboxyaldehyde)-$C_{1-6}$ alkyl, halo-$C_{1-6}$ alkyl (e.g., perfluoroalkyl), hydroxy-$C_{1-6}$ alkyl, nitro-$C_{1-6}$ alkyl, or $C_{1-6}$ thioalkoxy-$C_{1-6}$ alkyl); (3) $C_{1-20}$ alkoxy (e.g., $C_{1-6}$ alkoxy, such as perfluoroalkoxy); (4) $C_{1-6}$ alkylsulfinyl; (5) $C_{6-10}$ aryl; (6) amino; (7) $C_{1-6}$ alk-$C_{6-10}$ aryl, (8) azido; (9) $C_{3-8}$ cycloalkyl; (10) $C_{1-6}$ alk-$C_{3-8}$ cycloalkyl; (11) halo; (12) $C_{1-12}$ heterocyclyl (e.g., $C_{1-12}$ heteroaryl); (13) ($C_{1-12}$ heterocyclyl)oxy; (14) hydroxy; (15) nitro; (16) $C_{1-20}$ thioalkoxy (e.g., $C_{1-6}$ thioalkoxy); (17) —(CH$_2$)$_q$CO$_2R^{A'}$, where q is an integer from zero to four, and $R^{A'}$ is selected from the group consisting of (a) $C_{1-6}$ alkyl, (b) $C_{6-10}$ aryl, (c) hydrogen, and (d) $C_{1-6}$ alk-$C_{6-10}$ aryl; (18) —(CH$_2$)$_q$CONR$^{B'}R^{C'}$, where q is an integer from zero to four and where $R^{B'}$ and $R^{C'}$ are independently selected from the group consisting of (a) hydrogen, (b) $C_{6-10}$ alkyl, (c) $C_{6-10}$ aryl, and (d) $C_{1-6}$ alk-$C_{6-10}$ aryl, (19) —(CH$_2$)$_q$SO$_2R^{D'}$, where q is an integer from zero to four and where $R^{D'}$ is selected from the group consisting of (a) $C_{6-10}$ alkyl, (b) $C_{6-10}$ aryl, and (c) $C_{1-6}$ alk-$C_{6-10}$ aryl; (20) —(CH$_2$)$_q$SO$_2$NR$^{E'}R^{F'}$, where q is an integer from zero to four and where each of $R^{E'}$ and $R^{F'}$ is, independently, selected from the group consisting of (a) hydrogen, (b) $C_{6-10}$ alkyl, (c) $C_{6-10}$ aryl, and (d) $C_{1-6}$ alk-$C_{6-10}$ aryl; (21) thiol; (22) $C_{6-10}$ aryloxy; (23) $C_{3-8}$ cycloalkoxy; (24) $C_{6-10}$ aryl-$C_{1-6}$ alkoxy; (25) $C_{1-6}$ alk-$C_{1-12}$ heterocyclyl (e.g., $C_{1-6}$ alk-$C_{1-12}$ heteroaryl); (26) oxo; (27) $C_{2-20}$ alkenyl; and (28) $C_{2-20}$ alkynyl. In some embodiments, each of these groups can be further substituted as described herein. For example, the alkylene group of a $C_1$-alkaryl or a $C_1$-alkheterocyclyl can be further substituted with an oxo group to afford the respective aryloyl and (heterocyclyl)oyl substituent group.

The term "diastereomer," as used herein means stereoisomers that are not mirror images of one another and are non-superimposable on one another.

The term "effective amount" of an agent, as used herein, is that amount sufficient to effect beneficial or desired results, for example, clinical results, and, as such, an "effective amount" depends upon the context in which it is being applied. For example, in the context of administering an agent that treats cancer, an effective amount of an agent is, for example, an amount sufficient to achieve treatment, as defined herein, of cancer, as compared to the response obtained without administration of the agent.

The term "enantiomer," as used herein, means each individual optically active form of a compound of the invention, having an optical purity or enantiomeric excess (as determined by methods standard in the art) of at least 80% (i.e., at least 90% of one enantiomer and at most 10% of the other enantiomer), preferably at least 90% and more preferably at least 98%.

The term "halo," as used herein, represents a halogen selected from bromine, chlorine, iodine, or fluorine.

The term "haloalkoxy," as used herein, represents an alkoxy group, as defined herein, substituted by a halogen group (i.e., F, Cl, Br, or I). A haloalkoxy may be substituted with one, two, three, or, in the case of alkyl groups of two carbons or more, four halogens. Haloalkoxy groups include perfluoroalkoxys (e.g., —OCF$_3$), —OCHF$_2$, —OCH$_2$F, —OCCl$_3$, —OCH$_2$CH$_2$Br, —OCH$_2$CH(CH$_2$CH$_2$Br)CH$_3$, and —OCHICH$_3$. In some embodiments, the haloalkoxy group can be further substituted with 1, 2, 3, or 4 substituent groups as described herein for alkyl groups.

The term "haloalkyl," as used herein, represents an alkyl group, as defined herein, substituted by a halogen group (i.e., F, Cl, Br, or I). A haloalkyl may be substituted with one, two, three, or, in the case of alkyl groups of two carbons or more, four halogens. Haloalkyl groups include perfluoroalkyls (e.g., —CF$_3$), —CHF$_2$, —CH$_2$F, —CCl$_3$, —CH$_2$CH$_2$Br, —CH$_2$CH(CH$_2$CH$_2$Br)CH$_3$, and —CHICH$_3$. In some embodiments, the haloalkyl group can be further substituted with 1, 2, 3, or 4 substituent groups as described herein for alkyl groups.

The term "heteroalkylene," as used herein, refers to an alkylene group, as defined herein, in which one or two of the constituent carbon atoms have each been replaced by nitrogen, oxygen, or sulfur. In some embodiments, the heteroalkylene group can be further substituted with 1, 2, 3, or 4 substituent groups as described herein for alkylene groups.

The term "heteroaryl," as used herein, represents that subset of heterocyclyls, as defined herein, which are aromatic: i.e., they contain 4n+2 pi electrons within the mono- or multicyclic ring system. Exemplary unsubstituted heteroaryl groups are of 1 to 12 (e.g., 1 to 11, 1 to 10, 1 to 9, 2 to 12, 2 to 11, 2 to 10, or 2 to 9) carbons. In some embodiment, the heteroaryl is substituted with 1, 2, 3, or 4 substituents groups as defined for a heterocyclyl group.

The term "heterocyclyl," as used herein represents a 5-, 6- or 7-membered ring, unless otherwise specified, containing one, two, three, or four heteroatoms independently selected from the group consisting of nitrogen, oxygen, and sulfur. The 5-membered ring has zero to two double bonds, and the 6- and 7-membered rings have zero to three double bonds. Exemplary unsubstituted heterocyclyl groups are of 1 to 12 (e.g., 1 to 11, 1 to 10, 1 to 9, 2 to 12, 2 to 11, 2 to 10, or 2 to 9) carbons. The term "heterocyclyl" also represents a heterocyclic compound having a bridged multicyclic structure in which one or more carbons and/or heteroatoms bridges two non-adjacent members of a monocyclic ring, e.g., a quinuclidinyl group. The term "heterocyclyl" includes bicyclic, tricyclic, and tetracyclic groups in which any of the above heterocyclic rings is fused to one, two, or three carbocyclic rings, e.g., an aryl ring, a cyclohexane ring, a cyclohexene ring, a cyclopentane ring, a cyclopentene ring, or another monocyclic heterocyclic ring, such as indolyl, quinolyl, isoquinolyl, tetrahydroquinolyl, benzofiiryl, benzothienyl and the like. Examples of fused heterocyclyls include tropanes and 1,2,3,5,8,8a-hexahydroindolizine. Heterocyclics include pyrrolyl, pyrrolinyl, pyrrolidinyl, pyrazolyl, pyrazolinyl, pyrazolidinyl, imidazolyl, imidazolinyl, imidazolidinyl, pyridyl, piperidinyl, homopiperidinyl, pyrazinyl, piperazinyl, pyrimidinyl, pyridazinyl, oxazolyl, oxazolidinyl, isoxazolyl, isoxazolidiniyl, morpholinyl, thiomorpholinyl, thiazolyl, thiazolidinyl, isothiazolyl, isothiazolidinyl, indolyl, indazolyl, quinolyl, isoquinolyl, quinoxalinyl, dihydroquinoxalinyl, quinazolinyl, cinnolinyl, phthalazinyl, benzimidazolyl, benzothiazolyl, benzoxazolyl, benzothiadiazolyl, furyl, thienyl, thiazolidinyl, isothiazolyl, triazolyl, tetrazolyl, oxadiazolyl (e.g., 1,2,3-oxadiazolyl), purinyl, thiadiazolyl (e.g., 1,2,3-thiadiazolyl), tetrahydrofuranyl, dihydrofuranyl, tetrahydrothienyl, dihydrothienyl, dihydroindolyl, dihydroquinolyl, tetrahydroquinolyl, tetrahydroisoquinolyl, dihydroisoquinolyl, pyranyl, dihydropyranyl, dithiazolyl, benzofuranyl, isobenzofuranyl, benzothienyl, and the like, including dihydro and tetrahydro forms thereof, where one or more double bonds are reduced and replaced with hydrogens. Still other exemplary heterocyclyls include: 2,3,4,5-tetrahydro-2-oxo-oxazolyl; 2,3-dihydro-2-oxo-1H-imidazolyl; 2,3,4,5-tetrahydro-5-oxo-1H-pyrazolyl (e.g., 2,3,4,5-tetrahydro-2-phenyl-5-oxo-1H-pyrazolyl); 2,3,4,5-tetrahydro-2,4-dioxo-1H-imidazolyl (e.g., 2,3,4,5-tetrahydro-2,4-dioxo-5-methyl-5-phenyl-1H-imidazolyl); 2,3-dihydro-2-thioxo-1,3,4-oxadiazolyl (e.g., 2,3-dihydro-2-thioxo-5-phenyl-1,3,4-oxadiazolyl); 4,5-dihydro-5-oxo-1H-triazolyl (e.g., 4,5-dihydro-3-methyl-4-amino 5-oxo-1H-triazolyl); 1,2,3,4-tetrahydro-2,4-dioxopyridinyl (e.g., 1,2,3,4-tetrahydro-2,4-dioxo-3,3-diethylpyridinyl); 2,6-dioxo-piperidinyl (e.g., 2,6-dioxo-3-ethyl-3-phenylpiperidinyl); 1,6-dihydro-6-oxopyridiminyl; 1,6-dihydro-4-oxopyrimidinyl (e.g., 2-(methylthio)-1,6-dihydro-4-oxo-5-methylpyrimidin-1-yl); 1,2,3,4-tetrahydro-2,4-dioxopyrimidinyl (e.g., 1,2,3,4-tetrahydro-2,4-dioxo-3-ethylpyrimidinyl); 1,6-dihydro-6-oxo-pyridazinyl (e.g., 1,6-dihydro-6-oxo-3-ethylpyridazinyl); 1,6-dihydro-6-oxo-1,2,4-triazinyl (e.g., 1,6-dihydro-5-isopropyl-6-oxo-1,2,4-triazinyl); 2,3-dihydro-2-oxo-1H-indolyl (e.g., 3,3-dimethyl-2,3-dihydro-2-oxo-1H-indolyl and 2,3-dihydro-2-oxo-3,3'-spiropropane-1H-indol-1-yl); 1,3-dihydro-1-oxo-2H-iso-indolyl; 1,3-dihydro-1,3-dioxo-2H-iso-indolyl; 1H-benzopyrazolyl (e.g., 1-(ethoxycarbonyl)-1H-benzopyrazolyl); 2,3-dihydro-2-oxo-1H-benzimidazolyl (e.g., 3-ethyl-2,3-dihydro-2-oxo-1H-benzimidazolyl); 2,3-dihydro-2-oxo-benzoxazolyl (e.g., 5-chloro-2,3-dihydro-2-oxo-benzoxazolyl); 2,3-dihydro-2-oxo-benzoxazolyl; 2-oxo-2H-benzopyranyl; 1,4-benzodioxanyl; 1,3-benzodioxanyl; 2,3-dihydro-3-oxo,4H-1,3-benzothiazinyl; 3,4-dihydro-4-oxo-3H-quinazolinyl (e.g., 2-methyl-3,4-dihydro-4-oxo-3H-quinazolinyl); 1,2,3,4-tetrahydro-2,4-dioxo-3H-quinazolyl (e.g., 1-ethyl-1,2,3,4-tetrahydro-2,4-dioxo-3H-quinazolyl); 1,2,3,6-tetrahydro-2,6-dioxo-7H-purinyl (e.g., 1,2,3,6-tetrahydro-1,3-dimethyl-2,6-dioxo-7H-purinyl); 1,2,3,6-tetrahydro-2,6-dioxo-1H-purinyl (e.g., 1,2,3,6-tetrahydro-3,7-dimethyl-2,6-dioxo-1H-purinyl); 2-oxobenz[c,d]indolyl; 1,1-dioxo-2H-naphth[1,8-c,d]isothiazolyl; and 1,8-naphthylenedicarboxamido. Additional heterocyclics include 3,3a,4,5,6,6a-hexahydro-pyrrolo[3,4-b]pyrrol-(2H)-yl, and 2,5-diazabicyclo[2.2.1]heptan-2-yl, homopiperazinyl (or diazepanyl), tetrahydropyranyl, dithiazolyl, benzofuranyl, benzothienyl, oxepanyl, thiepanyl, azocanyl, oxecanyl, and thiocanyl. Heterocyclic groups also include groups of the formula

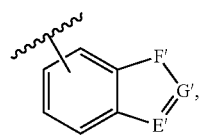

where
E' is selected from the group consisting of —N— and —CH—; F' is selected from the group consisting of —N=CH—, —NH—CH$_2$—, —NH—C(O)—, —NH—, —CH=N—, —CH$_2$—NH—, —C(O)—NH—, —CH=CH—, —CH$_2$—, —CH$_2$CH$_2$—, —CH$_2$O—, —OCH$_2$—, —O—, and —S—; and G' is selected from the group consisting of —CH— and —N—. Any of the heterocyclyl groups mentioned herein may be optionally substituted with one, two, three, four or five substituents independently selected from the group consisting of: (1) C$_{1-7}$ acyl (e.g., carboxyaldehyde); (2) C$_{1-20}$ alkyl (e.g., C$_{1-6}$ alkyl, C$_{1-6}$ alkoxy-C$_{1-6}$ alkyl, C$_{1-6}$ alkylsulfinyl-C$_{1-6}$ alkyl, amino-C$_{1-6}$ alkyl, azido-C$_{1-6}$ alkyl, (carboxyaldehyde)-C$_{1-6}$ alkyl, halo-C$_{1-6}$ alkyl (e.g., perfluoroalkyl), hydroxy-C$_{1-6}$ alkyl, nitro-C$_{1-6}$ alkyl, or C$_{1-6}$ thioalkoxy-C$_{1-6}$ alkyl); (3) C$_{1-20}$ alkoxy (e.g., C$_{1-6}$ alkoxy, such as perfluoroalkoxy); (4) C$_{1-6}$ alkylsulfinyl; (5) C$_{6-10}$ aryl; (6) amino; (7) C$_{1-6}$ alk-C$_{6-10}$ aryl; (8) azido; (9) C$_{3-8}$ cycloalkyl; (10) C$_{1-6}$ alk-C$_{3-8}$ cycloalkyl; (11) halo; (12) C$_{1-12}$ heterocyclyl (e.g., C$_{2-12}$ heteroaryl); (13) (C$_{1-12}$ heterocyclyl)oxy; (14) hydroxy; (15) nitro; (16) C$_{1-20}$ thioalkoxy (e.g., C$_{1-6}$ thioalkoxy); (17) —(CH$_2$)$_q$CO$_2$R$^{A'}$, where q is an integer from zero to four, and R$^{A'}$ is selected from the group consisting of (a) C$_{1-6}$ alkyl, (b) C$_{6-10}$ aryl, (c) hydrogen, and (d) C$_{1-6}$ alk-C$_{6-10}$ aryl; (18) —(CH$_2$)$_q$CONR$^{B'}$R$^{C'}$, where q is an integer from zero to four and where R$^{B'}$ and R$^{C'}$ are independently selected from the group consisting of (a) hydrogen, (b) C$_{1-6}$ alkyl, (c) C$_{6-10}$ aryl, and (d) C$_{1-6}$ alk-C$_{6-10}$ aryl; (19) —(CH$_2$)$_q$SO$_2$R$^{D'}$, where q is an integer from zero to four and where R$^{D'}$ is selected from the group consisting of (a) C$_{1-6}$ alkyl, (b) C$_{6-10}$ aryl, and (c) C$_{1-6}$ alk-C$_{6-10}$ aryl; (20) —(CH$_2$)$_q$SO$_2$NR$^{E'}$R$^{F'}$, where q is an integer from zero to four and where each of R$^{E'}$ and R$^{F'}$ is, independently, selected from the group consisting of (a) hydrogen, (b) C$_{1-6}$ alkyl, (c) C$_{6-10}$ aryl, and (d) C$_{1-6}$ alk-C$_{6-10}$ aryl; (21) thiol; (22) C$_{6-10}$ aryloxy; (23) C$_{3-8}$ cycloalkoxy; (24) arylalkoxy; (25) C$_{1-6}$ alk-C$_{1-12}$ heterocyclyl (e.g., C$_{1-6}$ alk-C$_{1-12}$ heteroaryl); (26) oxo; (27) (C$_{1-12}$ heterocyclyl)imino; (28) C$_{2-20}$ alkenyl; and (29) C$_{2-20}$ alkynyl. In some embodiments, each of these groups can be further substituted as described herein. For example, the alkylene group of a C$_1$-alkaryl or a C$_1$-alkheterocyclyl can be further substituted with an oxo group to afford the respective aryloyl and (heterocyclyl)oyl substituent group.

The term "(heterocyclyl)imino," as used herein, represents a heterocyclyl group, as defined herein, attached to the parent molecular group through an imino group. In some embodiments, the heterocyclyl group can be substituted with 1, 2, 3, or 4 substituent groups as defined herein.

The term "(heterocyclyl)oxy," as used herein, represents a heterocyclyl group, as defined herein, attached to the parent molecular group through an oxygen atom. In some embodiments, the heterocyclyl group can be substituted with 1, 2, 3, or 4 substituent groups as defined herein.

The term "(heterocyclyl)oyl," as used herein, represents a heterocyclyl group, as defined herein, attached to the parent molecular group through a carbonyl group. In some embodiments, the heterocyclyl group can be substituted with 1, 2, 3, or 4 substituent groups as defined herein.

The term "hydrocarbon," as used herein, represents a group consisting only of carbon and hydrogen atoms.

The term "hydroxy," as used herein, represents an —OH group.

The term "hydroxyalkenyl," as used herein, represents an alkenyl group, as defined herein, substituted by one to three hydroxy groups, with the proviso that no more than one hydroxy group may be attached to a single carbon atom of the alkyl group, and is exemplified by dihydroxypropenyl, hydroxyisopentenyl, and the like.

The term "hydroxyalkyl," as used herein, represents an alkyl group, as defined herein, substituted by one to three hydroxy groups, with the proviso that no more than one hydroxy group may be attached to a single carbon atom of the alkyl group, and is exemplified by hydroxymethyl, dihydroxypropyl, and the like.

The term "isomer," as used herein, means any tautomer, stereoisomer, enantiomer, or diastereomer of any compound of the invention. It is recognized that the compounds of the invention can have one or more chiral centers and/or double bonds and, therefore, exist as stereoisomers, such as double-bond isomers (i.e., geometric E/Z isomers) or diastereomers (e.g., enantiomers (i.e., (+) or (−)) or cis/trans isomers). According to the invention, the chemical structures depicted herein, and therefore the compounds of the invention, encompass all of the corresponding stereoisomers, that is, both the stereomerically pure form (e.g., geometrically pure, enantiomerically pure, or diastereomerically pure) and enantiomeric and stereoisomeric mixtures, e.g., racemates. Enantiomeric and stereoisomeric mixtures of compounds of the invention can typically be resolved into their component enantiomers or stereoisomers by well-known methods, such as chiral-phase gas chromatography, chiral-phase high performance liquid chromatography, crystallizing the compound as a chiral salt complex, or crystallizing the compound in a chiral solvent. Enantiomers and stereoisomers can also be obtained from stereomerically or enantiomerically pure intermediates, reagents, and catalysts by well-known asymmetric synthetic methods.

The term "N-protected amino," as used herein, refers to an amino group, as defined herein, to which is attached one or two N-protecting groups, as defined herein.

The term "N-protecting group," as used herein, represents those groups intended to protect an amino group against undesirable reactions during synthetic procedures. Commonly used N-protecting groups are disclosed in Greene, "Protective Groups in Organic Synthesis," 3$^{rd}$ Edition (John Wiley & Sons, New York, 1999), which is incorporated herein by reference. N-protecting groups include acyl, aryloyl, or carbamyl groups such as formyl, acetyl, propionyl, pivaloyl, t-butylacetyl, 2-chloroacetyl, 2-bromoacetyl, trifluoroacetyl, trichloroacetyl, phthalyl, o-nitrophenoxyacetyl, α-chlorobutyryl, benzoyl, 4-chlorobenzoyl, 4-bromobenzoyl, 4-nitrobenzoyl, and chiral auxiliaries such as protected or unprotected D, L or D, L-amino acids such as alanine, leucine, phenylalanine, and the like; sulfonyl-containing groups such as benzenesulfonyl, p-toluenesulfonyl, and the like; carbamate forming groups such as benzyloxycarbonyl, p-chlorobenzyloxycarbonyl, p-methoxybenzyloxycarbonyl, p-nitrobenzyloxycarbonyl, 2-nitrobenzyloxycarbonyl, p-bromobenzyloxycarbonyl, 3,4-dimethoxybenzyloxycarbonyl, 3,5-dimethoxybenzyloxycarbonyl, 2,4-dimethoxybenzyloxycarbonyl, 4-methoxybenzyloxycarbonyl, 2-nitro-4,5-dimethoxybenzyloxycarbonyl, 3,4,5-trimethoxybenzyloxycarbonyl, 1-(p-biphenylyl)-1-methylethoxycarbonyl, α,α-dimethyl-3,5-dimethoxybenzyloxycarbonyl, benzhydryloxy carbonyl, t-butyloxycarbonyl, diisopropylmethoxycarbonyl, isopropyloxycarbonyl, ethoxycarbonyl, methoxycarbonyl, allyloxycarbonyl, 2,2,2,-trichloroethoxycarbonyl, phenoxycarbonyl, 4-nitrophenoxy carbonyl, fluorenyl-9-methoxycarbonyl, cyclopentyloxycarbonyl, adamantyloxycarbonyl, cyclohexyloxycarbonyl, phenylthiocarbonyl, and the like, alkaryl groups such as benzyl, triphenylmethyl, benzyloxymethyl, and the like and say (groups, such as trimethylsilyl, and the like. Preferred N-protecting groups are formyl, acetyl, benzoyl, pivaloyl, t-butylacetyl, alanyl, phenylsulfonyl, benzyl, t-butyloxycarbonyl (Boc), and benzyloxycarbonyl (Cbz).

The term "nitro," as used herein, represents an —NO$_2$ group.

The term "oxo" as used herein, represents =O.

The term "perfluoroalkyl," as used herein, represents an alkyl group, as defined herein, where each hydrogen radical bound to the alkyl group has been replaced by a fluoride radical. Perfluoroalkyl groups are exemplified by trifluoromethyl, pentafluoroethyl, and the like.

The term "perfluoroalkoxy," as used herein, represents an alkoxy group, as defined herein, where each hydrogen radical bound to the alkoxy group has been replaced by a fluoride radical. Perfluoroalkoxy groups are exemplified by trifluoromethoxy, pentafluoroethoxy, and the like.

The term "spirocyclyl," as used herein, represents a $C_{2-7}$ alkylene diradical, both ends of which are bonded to the same carbon atom of the parent group to form a spirocyclic group, and also a $C_{1-6}$ heteroalkylene diradical, both ends of which are bonded to the same atom. The heteroalkylene radical forming the spirocyclyl group can containing one, two, three, or four heteroatoms independently selected from the group consisting of nitrogen, oxygen, and sulfur. In some embodiments, the spirocyclyl group includes one to seven carbons, excluding the carbon atom to which the diradical is attached. The spirocyclyl groups of the invention may be optionally substituted with 1, 2, 3, or 4 substituents provided herein as optional substituents for cycloalkyl and/or heterocyclyl groups.

The term "stereoisomer," as used herein, refers to all possible different isomeric as well as conformational forms which a compound may possess (e.g., a compound of any formula described herein), in particular all possible stereochemically and conformationally isomeric forms, all diastereomers, enantiomers and/or conformers of the basic molecular structure. Some compounds of the present invention may exist in different tautomeric forms, all of the latter being included within the scope of the present invention.

The term "sulfoalkyl," as used herein, represents an alkyl group, as defined herein, substituted by a sulfo group of —SO$_3$H. In some embodiments, the alkyl group can be further substituted with 1, 2, 3, or 4 substituent groups as described herein.

The term "sulfonyl," as used herein, represents an —S(O)$_2$— group.

The term "thioalkaryl," as used herein, represents a chemical substituent of formula —SR, where R is an alkaryl group. In some embodiments, the alkaryl group can be further substituted with 1, 2, 3, or 4 substituent groups as described herein.

The term "thioalkheterocyclyl," as used herein, represents a chemical substituent of formula —SR, where R is an alkheterocyclyl group. In some embodiments, the alkheterocyclyl group can be further substituted with 1, 2, 3, or 4 substituent groups as described herein.

The term "thioalkoxy," as used herein, represents a chemical substituent of formula —SR, where R is an alkyl group, as defined herein. In some embodiments, the alkyl group can be further substituted with 1, 2, 3, or 4 substituent groups as described herein.

The term "thiol" represents an —SH group.

Compound: As used herein, the term "compound," is meant to include all stereoisomers, geometric isomers, tautomers, and isotopes of the structures depicted.

The compounds described herein can be asymmetric (e.g., having one or more stereocenters). All stereoisomers, such as enantiomers and diastereomers, are intended unless otherwise indicated. Compounds of the present disclosure that contain asymmetrically substituted carbon atoms can be isolated in optically active or racemic forms. Methods on how to prepare optically active forms from optically active starting materials are known in the art, such as by resolution of racemic mixtures or by stereoselective synthesis. Many geometric isomers of olefins, C=N double bonds, and the like can also be present in the compounds described herein, and all such stable isomers are contemplated in the present disclosure. Cis and trans geometric isomers of the compounds of the present disclosure are described and may be isolated as a mixture of isomers or as separated isomeric forms.

Compounds of the present disclosure also include tautomeric forms. Tautomeric forms result from the swapping of a single bond with an adjacent double bond and the concomitant migration of a proton. Tautomeric forms include prototropic tautomers which are isomeric protonation states having the same empirical formula and total charge. Examples prototropic tautomers include ketone-enol pairs, amide-imidic acid pairs, lactam-lactim pairs, amide-imidic acid pairs, enamine-imine pairs, and annular forms where a proton can occupy two or more positions of a heterocyclic system, such as, 1H- and 3H-imidazole, 1H-, 2H- and 4H-1,2,4-triazole, 1H- and 2H-isoindole, and 1H- and 2H-pyrazole. Tautomeric forms can be in equilibrium or sterically locked into one form by appropriate substitution.

Compounds of the present disclosure also include all of the isotopes of the atoms occurring in the intermediate or final compounds. "Isotopes" refers to atoms having the same atomic number but different mass numbers resulting from a different number of neutrons in the nuclei. For example, isotopes of hydrogen include tritium and deuterium.

The compounds and salts of the present disclosure can be prepared in combination with solvent or water molecules to form solvates and hydrates by routine methods.

Condition: As used herein, the term "condition" refers to a disorder that presents with observable symptoms.

Conserved: As used herein, the term "conserved" refers to nucleotides or amino acid residues of a polynucleotide sequence or polypeptide sequence, respectively, that are those that occur unaltered in the same position of two or more sequences being compared. Nucleotides or amino acids that are relatively conserved are those that are conserved amongst more related sequences than nucleotides or amino acids appearing elsewhere in the sequences.

In some embodiments, two or more sequences are said to be "completely conserved" if they are 100% identical to one another. In some embodiments, two or more sequences are said to be "highly conserved" if they are at least 70% identical, at least 80% identical, at least 90% identical, or at least 95% identical to one another. In some embodiments, two or more sequences are said to be "highly conserved" if they are about 70% identical, about 80% identical, about 90% identical, about 95%, about 98%, or about 99% identical to one another. In some embodiments, two or more sequences are said to be "conserved" if they are at least 30% identical, at least 40% identical, at least 50% identical, at least 60% identical, at least 70% identical, at least 80% identical, at least 90% identical, or at least 95% identical to one another. In some embodiments, two or more sequences are said to be "conserved" if they are about 30% identical, about 40% identical, about 50% identical, about 60% identical, about 70% identical, about 80% identical, about 90% identical, about 95% identical, about 98% identical, or about 99% identical to one another. Conservation of sequence may apply to the entire length of an oligonucleotide or polypeptide or may apply to a portion, region or feature thereof.

Cyclic or Cyclized: As used herein, the term "cyclic" refers to the presence of a continuous loop. Cyclic molecules need not be circular, only joined to form an unbroken chain of subunits. Cyclic molecules such as the engineered RNA or mRNA of the present invention may be single units or multimers or comprise one or more components of a complex or higher order structure.

Cytostatic: As used herein, "cytostatic" refers to inhibiting, reducing, suppressing the growth, division, or multiplication of a cell (e.g., a mammalian cell (e.g., a human cell)), bacterium, virus, fungus, protozoan, parasite, prion, or a combination thereof.

Cytotoxic: As used herein, "cytotoxic" refers to killing or causing injurious, toxic, or deadly effect on a cell (e.g., a mammalian cell (e.g., a human cell)), bacterium, virus, fungus, protozoan, parasite, prion, or a combination thereof.

Delivery: As used herein, "delivery" refers to the act or manner of delivering a compound, substance, entity, moiety, cargo or payload.

Delivery Agent: As used herein, "delivery agent" refers to any substance which facilitates, at least in part, the in vivo delivery of signal-sensor polynucleotide, primary construct or mmRNA to targeted cells.

Destabilized: As used herein, the term "destable," "destabilize," or "destabilizing region" means a region or molecule that is less stable than a starting, wild-type or native form of the same region or molecule.

Detectable label: As used herein, "detectable label" refers to one or more markers, signals, or moieties which are attached, incorporated or associated with another entity that is readily detected by methods known in the art including radiography, fluorescence, chemiluminescence, enzymatic activity, absorbance and the like. Detectable labels include radioisotopes, fluorophores, chromophores, enzymes, dyes, metal ions, ligands such as biotin, avidin, streptavidin and haptens, quantum dots, and the like. Detectable labels may be located at any position in the peptides or proteins disclosed herein. They may be within the amino acids, the peptides, or proteins, or located at the N- or C-termini.

Disease: As used herein, the term "disease" refers to an abnormal condition affecting the body of an organism often showing specific bodily symptoms.

Disorder: As used herein, the term "disorder," refers to a disruption of or an interference with normal functions or established systems of the body.

Digest: As used herein, the term "digest" means to break apart into smaller pieces or components. When referring to polypeptides or proteins, digestion results in the production of peptides.

Distal: As used herein, the term "distal" means situated away from the center or away from a point or region of interest.

Dose splitting factor (DSF)-ratio of PUD of dose split treatment divided by PUD of total daily dose or single unit dose. The value is derived from comparison of dosing regimens groups.

Encoded protein cleavage signal: As used herein, "encoded protein cleavage signal" refers to the nucleotide sequence which encodes a protein cleavage signal.

Engineered: As used herein, embodiments of the invention are "engineered" when they are designed to have a feature or property, whether structural or chemical, that varies from a starting point, wild type or native molecule.

Exosome: As used herein, "exosome" is a vesicle secreted by mammalian cells or a complex involved in RNA degradation.

Expression: As used herein, "expression" of a nucleic acid sequence refers to one or more of the following events: (1) production of an RNA template from a DNA sequence (e.g., by transcription); (2) processing of an RNA transcript (e.g., by splicing, editing, 5' cap formation, and/or 3' end processing); (3) translation of an RNA into a polypeptide or protein; and (4) post-translational modification of a polypeptide or protein.

Feature: As used herein, a "feature" refers to a characteristic, a property, or a distinctive element.

Formulation: As used herein, a "formulation" includes at least a signal-sensor polynucleotide, primary construct or mmRNA and a delivery agent.

Fragment: A "fragment," as used herein, refers to a portion. For example, fragments of proteins may comprise polypeptides obtained by digesting full-length protein isolated from cultured cells.

Functional: As used herein, a "functional" biological molecule is a biological molecule in a form in which it exhibits a property and/or activity by which it is characterized.

Genotype: As used herein, "genotype" refers to the change in the genotype, or genetic makeup, of a subject, cell, tissue, organ and/or organism.

Homology: As used herein, the term "homology" refers to the overall relatedness between polymeric molecules, e.g. between nucleic acid molecules (e.g. DNA molecules and/or RNA molecules) and/or between polypeptide molecules. In some embodiments, polymeric molecules are considered to be "homologous" to one another if their sequences are at least 25%, 30%, 35%, 40%, 45%, 50%, 55%, 60%, 65%, 70%, 75%, 80%, 85%, 90%, 95%, or 99% identical or similar. The term "homologous" necessarily refers to a comparison between at least two sequences (polynucleotide or polypeptide sequences). In accordance with the invention, two polynucleotide sequences are considered to be homologous if the polypeptides they encode are at least about 50%, 60%, 70%, 80%, 90%, 95%, or even 99% for at least one stretch of at least about 20 amino acids. In some embodiments, homologous polynucleotide sequences are characterized by the ability to encode a stretch of at least 4-5 uniquely specified amino acids. For polynucleotide sequences less than 60 nucleotides in length, homology is determined by the ability to encode a stretch of at least 4-5 uniquely specified amino acids. In accordance with the invention, two protein sequences are considered to be homologous if the proteins are at least about 50%, 60%, 70%, 80%, or 90% identical for at least one stretch of at least about 20 amino acids.

Identity: As used herein, the term "identity" refers to the overall relatedness between polymeric molecules, e.g., between oligonucleotide molecules (e.g. DNA molecules and/or RNA molecules) and/or between polypeptide molecules. Calculation of the percent identity of two polynucleotide sequences, for example, can be performed by aligning the two sequences for optimal comparison purposes (e.g., gaps can be introduced in one or both of a first and a second nucleic acid sequences for optimal alignment and non-identical sequences can be disregarded for comparison purposes). In certain embodiments, the length of a sequence aligned for comparison purposes is at least 30%, at least 40%, at least 50%, at least 60%, at least 70%, at least 80%, at least 90%, at least 95%, or 100% of the length of the reference sequence. The nucleotides at corresponding nucleotide positions are then compared. When a position in the first sequence is occupied by the same nucleotide as the corresponding position in the second sequence, then the molecules are identical at that position. The percent identity between the two sequences is a function of the number of identical positions shared by the sequences, taking into account the number of gaps, and the length of each gap, which needs to be introduced for optimal alignment of the two sequences. The comparison of sequences and determination of percent identity between two sequences can be accomplished using a mathematical algorithm. For example, the percent identity between two nucleotide sequences can be determined using methods such as those described in Computational Molecular Biology, Lesk, A. M., ed., Oxford University Press, New York, 1988; Biocomputing: Informatics and Genome Projects, Smith, D. W., ed., Academic Press, New York, 1993; Sequence Analysis in Molecular Biology, von Heinje, G., Academic Press, 1987; Computer Analysis of Sequence Data, Part I, Griffin, A. M., and Griffin, H. G., eds., Humana Press, New Jersey, 1994; and Sequence Analysis Primer, Gribskov, M. and Devereux, J., eds., M Stockton Press, New York, 1991; each of which is incorporated herein by reference. For example, the percent identity between two nucleotide sequences can be determined using the algorithm of Meyers and Miller (CABIOS, 1989, 4:11-17), which has been incorporated into the ALIGN program (version 2.0) using a PAM120 weight residue table, a gap length penalty of 12 and a gap penalty of 4. The percent identity between two nucleotide sequences can, alternatively, be determined using the GAP program in the GCG software package using an NWSgapdna.CMP matrix.

Methods commonly employed to determine percent identity between sequences include, but are not limited to those disclosed in Carillo, H., and Lipman, D., SIAM J Applied Math., 48:1073 (1988); incorporated herein by reference. Techniques for determining identity are codified in publicly available computer programs. Exemplary computer software to determine homology between two sequences include, but are not limited to, GCG program package, Devereux, J., et al., *Nucleic Acids Research,* 12(1), 387 (1984)), BLASTP, BLASTN, and FASTA Altschul, S. F. et al., *J. Molec. Biol.,* 215, 403 (1990)).

Inhibit expression of a gene: As used herein, the phrase "inhibit expression of a gene" means to cause a reduction in the amount of an expression product of the gene. The expression product can be an RNA transcribed from the gene (e.g., an mRNA) or a polypeptide translated from an mRNA transcribed from the gene. Typically a reduction in the level of an mRNA results in a reduction in the level of a polypeptide translated therefrom. The level of expression may be determined using standard techniques for measuring mRNA or protein.

In vitro: As used herein, the term "in vitro" refers to events that occur in an artificial environment, e.g., in a test tube or reaction vessel, in cell culture, in a Petri dish, etc., rather than within an organism (e.g., animal, plant, or microbe).

In vivo: As used herein, the term "in vivo" refers to events that occur within an organism (e.g., animal, plant, or microbe or cell or tissue thereof).

Isolated: As used herein, the term "isolated" refers to a substance or entity that has been separated from at least some of the components with which it was associated (whether in nature or in an experimental setting). Isolated substances may have varying levels of purity in reference to the substances from which they have been associated. Isolated substances and/or entities may be separated from at least about 10%, about 20%, about 30%, about 40%, about 50%, about 60%, about 70%, about 80%, about 90%, or more of the other components with which they were initially associated. In some embodiments, isolated agents are more than about 80%, about 85%, about 90%, about 91%, about 92%, about 93%, about 94%, about 95%, about 96%, about 97%, about 98%, about 99%, or more than about 99% pure. As used herein, a substance is "pure" if it is substantially free of other components. Substantially isolated: By "substantially isolated" is meant that the compound is substantially separated from the environment in which it was formed or detected. Partial separation can include, for example, a composition enriched in the compound of the present disclosure. Substantial separation can include compositions containing at least about 50%, at least about 60%, at least about 70%, at least about 80%, at least about 90%, at least about 95%, at least about 97%, or at least about 99% by weight of the compound of the present disclosure, or salt thereof. Methods for isolating compounds and their salts are routine in the art.

Linker: As used herein, a linker refers to a group of atoms, e.g., 10-1,000 atoms, and can be comprised of the atoms or groups such as, but not limited to, carbon, amino, alkylamino, oxygen, sulfur, sulfoxide, sulfonyl, carbonyl, and imine. The linker can be attached to a modified nucleoside or nucleotide on the nucleobase or sugar moiety at a first end, and to a payload, e.g., a detectable or therapeutic agent, at a second end. The linker may be of sufficient length as to not interfere with incorporation into a nucleic acid sequence. The linker can be used for any useful purpose, such as to form mmRNA multimers (e.g., through linkage of two or more signal-sensor polynucleotides, primary constructs, or mmRNA molecules) or mmRNA conjugates, as well as to administer a payload, as described herein. Examples of chemical groups that can be incorporated into the linker include, but are not limited to, alkyl, alkenyl, alkynyl, amido, amino, ether, thioether, ester, alkylene, heteroalkylene, aryl, or heterocyclyl, each of which can be optionally substituted, as described herein. Examples of linkers include, but are not limited to, unsaturated alkanes, polyethylene glycols (e.g., ethylene or propylene glycol monomeric units, e.g., diethylene glycol, dipropylene glycol, triethylene glycol, tripropylene glycol, tetraethylene glycol, or tetraethylene glycol), and dextran polymers, Other examples include, but are not limited to, cleavable moieties within the linker, such as, for example, a disulfide bond (—S—S—) or an azo bond (—N=N—), which can be cleaved using a reducing agent or photolysis. Non-limiting examples of a selectively cleavable bond include an amido bond can be cleaved for example by the use of tris(2-carboxyethyl)phosphine (TCEP), or other reducing agents, and/or photolysis, as well as an ester bond can be cleaved for example by acidic or basic hydrolysis.

Metastasis: As used herein, the term "metastasis" means the process by which cancer spreads from the place at which it first arose as a primary tumor to distant locations in the body.

Method of Treating: The phrase "a method of treating" or its equivalent, when applied to, for example, cancer refers to a procedure or course of action that is designed to reduce or eliminate the number of cancer cells, prevent the increase in the number of cancer cells, or to alleviate the symptoms of a cancer in a subject. A method of treating cancer or another oncology-related disorder does not necessarily mean that the cancer cells or other disorder will, in fact, be completely eliminated, that the number of cells or disorder will, in fact, be reduced, or that the symptoms of a cancer or other disorder will, in fact, be alleviated. Often, a method of treating cancer will be performed even with a low likelihood of success, but which, given the medical history and estimated survival expectancy of a subject, is nevertheless deemed an overall beneficial course of action.

MicroRNA (miRNA) binding site: As used herein, a microRNA (miRNA) binding site represents a nucleotide location or region of a nucleic acid transcript to which at least the "seed" region of a miRNA binds.

Modified: As used herein "modified" refers to a changed state or structure of a molecule of the invention. Molecules may be modified in many ways including chemically, structurally, and functionally. In one embodiment, the mRNA molecules of the present invention are modified by the introduction of non-natural nucleosides and/or nucleotides, e.g., as it relates to the natural ribonucleotides A, U, G, and C. Noncanonical nucleotides such as the cap structures are not considered "modified" although they differ from the chemical structure of the A, C, G, U ribonucleotides.

Mucus: As used herein, "mucus" refers to the natural substance that is viscous and comprises mucin glycoproteins.

Naturally occurring: As used herein, "naturally occurring" means existing in nature without artificial aid.

Non-human vertebrate: As used herein, a "non human vertebrate" includes all vertebrates except *Homo sapiens*, including wild and domesticated species. Examples of non-human vertebrates include, but are not limited to, mammals, such as alpaca, banteng, bison, camel, cat, cattle, deer, dog, donkey, gayal, goat, guinea pig, horse, llama, mule, pig, rabbit, reindeer, sheep water buffalo, and yak.

Off-target: As used herein, "off target" refers to any unintended effect on any one or more target, gene, or cellular transcript.

Oncology-related: As used herein, the term "oncology-related" refers to any disease, disorder, condition, treatment, process, substance or compound related to any aspect of one or more hyperproliferative diseases, disorders and/or conditions including, but not limited to, cancer.

Open reading frame: As used herein, "open reading frame" or "ORF" refers to a sequence which does not contain a stop codon in a given reading frame.

Operably linked: As used herein, the phrase "operably linked" refers to a functional connection between two or more molecules, constructs, transcripts, entities, moieties or the like.

Paratope: As used herein, a "paratope" refers to the antigen-binding site of an antibody.

Patient: As used herein, "patient" refers to a subject who may seek or be in need of treatment, requires treatment, is receiving treatment, will receive treatment, or a subject who is under care by a trained professional for a particular disease or condition.

Optionally substituted: Herein a phrase of the form "optionally substituted X" (e.g., optionally substituted alkyl) is intended to be equivalent to "X, wherein X is optionally substituted" (e.g., "alkyl, wherein said alkyl is optionally substituted"). It is not intended to mean that the feature "X" (e.g. alkyl) per se is optional.

Peptide: As used herein, "peptide" is less than or equal to 50 amino acids long, e.g., about 5, 10, 15, 20, 25, 30, 35, 40, 45, or 50 amino acids long.

Pharmaceutical composition: The phrase "pharmaceutical composition" refers to a composition that alters the etiology of a disease, disorder and/or condition.

Pharmaceutically acceptable: The phrase "pharmaceutically acceptable" is employed herein to refer to those compounds, materials, compositions, and/or dosage forms which are, within the scope of sound medical judgment, suitable for use in contact with the tissues of human beings and animals without excessive toxicity, irritation, allergic response, or other problem or complication, commensurate with a reasonable benefit/risk ratio.

Pharmaceutically acceptable excipients: The phrase "pharmaceutically acceptable excipient," as used herein, refers any ingredient other than the compounds described herein (for example, a vehicle capable of suspending or dissolving the active compound) and having the properties of being substantially nontoxic and non-inflammatory in a patient. Excipients may include, for example: antiadherents, antioxidants, binders, coatings, compression aids, disintegrants, dyes (colors), emollients, emulsifiers, fillers (diluents), film formers or coatings, flavors, fragrances, glidants (flow enhancers), lubricants, preservatives, printing inks, sorbents, suspending or dispersing agents, sweeteners, and waters of hydration. Exemplary excipients include, but are not limited to: butylated hydroxytoluene (BHT), calcium carbonate, calcium phosphate (dibasic), calcium stearate, croscarmellose, crosslinked polyvinyl pyrrolidone, citric acid, crospovidone, cysteine, ethylcellulose, gelatin, hydroxypropyl cellulose, hydroxypropyl methylcellulose, lactose, magnesium stearate, maltitol, mannitol, methionine, methylcellulose, methyl paraben, microcrystalline cellulose, polyethylene glycol, polyvinyl pyrrolidone, povidone, pregelatinized starch, propyl paraben, retinyl palmitate, shellac, silicon dioxide, sodium carboxymethyl cellulose, sodium citrate, sodium starch glycolate, sorbitol, starch (corn), stearic acid, sucrose, talc, titanium dioxide, vitamin A, vitamin E, vitamin C, and xylitol.

Pharmaceutically acceptable salts: The present disclosure also includes pharmaceutically acceptable salts of the compounds described herein. As used herein, "pharmaceutically acceptable salts" refers to derivatives of the disclosed compounds wherein the parent compound is modified by converting an existing acid or base moiety to its salt form (e.g., by reacting the free base group with a suitable organic acid). Examples of pharmaceutically acceptable salts include, but are not limited to, mineral or organic acid salts of basic residues such as amines; alkali or organic salts of acidic residues such as carboxylic acids; and the like. Representative acid addition salts include acetate, adipate, alginate, ascorbate, aspartate, benzenesulfonate, benzoate, bisulfate, borate, butyrate, camphorate, camphorsulfonate, citrate, cyclopentanepropionate, digluconate, dodecylsulfate, ethanesulfonate, fumarate, glucoheptonate, glycerophosphate, hemisulfate, heptonate, hexanoate, hydrobromide, hydrochloride, hydroiodide, 2-hydroxy-ethanesulfonate, lactobionate, lactate, laurate, lauryl sulfate, malate, maleate, malonate, methanesulfonate, 2-naphthalenesulfonate, nicotinate, nitrate, oleate, oxalate, palmitate, pamoate, pectinate, persulfate, 3-phenylpropionate, phosphate, picrate, pivalate, propionate, stearate, succinate, sulfate, tartrate, thiocyanate, toluenesulfonate, undecanoate, valerate salts, and the like. Representative alkali or alkaline earth metal salts include sodium, lithium, potassium, calcium, magnesium, and the like, as well as nontoxic ammonium, quaternary ammonium, and amine cations, including, but not limited to ammonium, tetramethylammonium, tetraethylammonium, methylamine, dimethylamine, trimethylamine, triethylamine, ethylamine, and the like. The pharmaceutically acceptable salts of the present disclosure include the conventional non-toxic salts of the parent compound formed, for example, from non-toxic inorganic or organic acids. The pharmaceutically acceptable salts of the present disclosure can be synthesized from the parent compound which contains a basic or acidic moiety by conventional chemical methods. Generally, such salts can be prepared by reacting the free acid or base forms of these compounds with a stoichiometric amount of the appropriate base or acid in water or in an organic solvent, or in a mixture of the two; generally, nonaqueous media like ether, ethyl acetate, ethanol, isopropanol, or acetonitrile are preferred. Lists of suitable salts are found in *Remington's Pharmaceutical Sciences*, 17$^{th}$ ed., Mack Publishing Company, Easton, Pa., 1985, p. 1418, *Pharmaceutical Salts: Properties, Selection, and Use*, P. H. Stahl and C. G. Wermuth (eds.), Wiley-VCH, 2008, and Berge et al., *Journal of Pharmaceutical Science*, 66, 1-19 (1977), each of which is incorporated herein by reference in its entirety.

Pharmaceutically acceptable solvate: The term "pharmaceutically acceptable solvate," as used herein, means a compound of the invention wherein molecules of a suitable solvent are incorporated in the crystal lattice. A suitable solvent is physiologically tolerable at the dosage administered. For example, solvates may be prepared by crystallization, recrystallization, or precipitation from a solution that includes organic solvents, water, or a mixture thereof. Examples of suitable solvents are ethanol, water (for example, mono-, di-, and tri-hydrates), N-methylpyrrolidinone (NMP), dimethyl sulfoxide (DMSO), N,N'-dimethylformamide (DMF), N,N'-dimethylacetamide (DMAC), 1,3-dimethyl-2-imidazolidinone (DMEU), 1,3-dimethyl-3,4,5, 6-tetrahydro-2-(1H)-pyrimidinone (DMPU), acetonitrile (ACN), propylene glycol, ethyl acetate, benzyl alcohol, 2-pyrrolidone, benzyl benzoate, and the like. When water is the solvent, the solvate is referred to as a "hydrate."

Pharmacokinetic: As used herein, "pharmacokinetic" refers to any one or more properties of a molecule or compound as it relates to the determination of the fate of substances administered to a living organism. Pharmacokinetics is divided into several areas including the extent and rate of absorption, distribution, metabolism and excretion. This is commonly referred to as ADME where: (A) Absorption is the process of a substance entering the blood circulation; (D) Distribution is the dispersion or dissemination of substances throughout the fluids and tissues of the body; (M) Metabolism (or Biotransformation) is the irreversible transformation of parent compounds into daughter metabolites; and (E) Excretion (or Elimination) refers to the elimination of the substances from the body. In rare cases, some drugs irreversibly accumulate in body tissue.

Phenotype: As used herein, "phenotype" refers to the set of observable characteristics of a subject, cell, tissue, organ and/or organism.

Physicochemical: As used herein, "physicochemical" means of or relating to a physical and/or chemical property.

Preventing: As used herein, the term "preventing" refers to partially or completely delaying onset of an infection, disease, disorder and/or condition; partially or completely delaying onset of one or more symptoms, features, or clinical manifestations of a particular infection, disease, disorder, and/or condition; partially or completely delaying onset of one or more symptoms, features, or manifestations of a particular infection, disease, disorder, and/or condition; partially or completely delaying progression from an infection, a particular disease, disorder and/or condition; and/or decreasing the risk of developing pathology associated with the infection, the disease, disorder, and/or condition.

Prodrug: The present disclosure also includes prodrugs of the compounds described herein. As used herein, "prodrugs" refer to any substance, molecule or entity which is in a form predicate for that substance, molecule or entity to act as a therapeutic upon chemical or physical alteration. Prodrugs may by covalently bonded or sequestered in some way and which release or are converted into the active drug moiety prior to, upon or after administered to a mammalian subject. Prodrugs can be prepared by modifying functional groups present in the compounds in such a way that the modifications are cleaved, either in routine manipulation or in vivo, to the parent compounds. Prodrugs include compounds wherein hydroxyl, amino, sulfhydryl, or carboxyl groups are bonded to any group that, when administered to a mammalian subject, cleaves to form a free hydroxyl, amino, sulfhydryl, or carboxyl group respectively. Preparation and use of prodrugs is discussed in T. Higuchi and V. Stella, "Prodrugs as Novel Delivery Systems," Vol. 14 of the A.C.S. Symposium Series, and in *Bioreversible Carriers in Drug Design*, ed. Edward B. Roche, American Pharmaceutical Association and Pergamon Press, 1987, both of which are hereby incorporated by reference in their entirety.

Proliferate: As used herein, the term "proliferate" means to grow, expand or increase or cause to grow, expand or increase rapidly. "Proliferative" means having the ability to proliferate. "Anti-proliferative" means having properties counter to or inapposite to proliferative properties.

Protein cleavage site: As used herein, "protein cleavage site" refers to a site where controlled cleavage of the amino acid chain can be accomplished by chemical, enzymatic or photochemical means.

Protein cleavage signal: As used herein "protein cleavage signal" refers to at least one amino acid that flags or marks a polypeptide for cleavage.

Progression: As used herein, the term "progression" (e.g., cancer progression) means the advancement or worsening of or toward a disease or condition.

Protein of interest: As used herein, the terms "proteins of interest" or "desired proteins" include those provided herein and fragments, mutants, variants, and alterations thereof.

Proximal: As used herein, the term "proximal" means situated nearer to the center or to a point or region of interest.

Pseudouridine: As used herein, pseudouridine refers to the C-glycoside isomer of the nucleoside uridine. A "pseudouridine analog" is any modification, variant, isoform or derivative of pseudouridine. For example, pseudouridine analogs include but are not limited to 1-carboxymethyl-pseudouridine, 1-propynyl-pseudouridine, 1-taurinomethyl-pseudouridine, 1-taurinomethyl-4-thio-pseudouridine, 1-methyl-pseudouridine (m$^1\psi$), 1-methyl-4-thio-pseudouridine (m$^1$s$^4\psi$), 4-thio-1-methyl-pseudouridine, 3-methyl-pseudouridine (m$^3\psi$), 2-thio-1-methyl-pseudouridine, 1-methyl-1-deaza-pseudouridine, 2-thio-1-methyl-1-deaza-pseudouridine, dihydropseudouridine, 2-thio-dihydropseudouridine, 2-methoxyuridine, 2-methoxy-4-thio-uridine, 4-methoxy-pseudouridine, 4-methoxy-2-thio-pseudouridine, N1-methyl-pseudouridine, 1-methyl-3-(3-amino-3-carboxypropyl)pseudouridine (acp$^3$ $\psi$), and 2'-O-methyl-pseudouridine ($\psi$m).

Purified: As used herein, "purify," "purified," "purification" means to make substantially pure or clear from unwanted components, material defilement, admixture or imperfection.

Regression: As used herein, the term "regression" or "degree of regression" refers to the reversal, either phenotypically or genotypically, of a cancer progression. Slowing or stopping cancer progression may be considered regression.

Reducing the effect: As used herein, the phrase "reducing the effect" when referring to symptoms, means reducing, eliminating or alleviating the symptom in the subject. It does not necessarily mean that the symptom will, in fact, be completely eliminated, reduced or alleviated.

Sample: As used herein, the term "sample" or "biological sample" refers to a subset of its tissues, cells or component parts (e.g. body fluids, including but not limited to blood, mucus, lymphatic fluid, synovial fluid, cerebrospinal fluid, saliva, amniotic fluid, amniotic cord blood, urine, vaginal fluid and semen). A sample further may include a homogenate, lysate or extract prepared from a whole organism or a subset of its tissues, cells or component parts, or a fraction or portion thereof, including but not limited to, for example, plasma, serum, spinal fluid, lymph fluid, the external sections of the skin, respiratory, intestinal, and genitourinary tracts, tears, saliva, milk, blood cells, tumors, organs. A sample further refers to a medium, such as a nutrient broth or gel, which may contain cellular components, such as proteins or nucleic acid molecule.

Side effect: As used herein, the phrase "side effect" refers to a secondary effect of treatment.

Signal Peptide Sequences: As used herein, the phrase "signal peptide sequences" refers to a sequence which can direct the transport or localization of a protein.

Signal-sensor polynucleotide: As used herein, "signal-sensor polynucleotides" are nucleic acid transcripts which encode one or more oncology-related polypeptides of interest that, when translated, delivers a "signal" to the cell (cancer or noncancerous) which results in the therapeutic benefit to the organism of either being detrimental to the cancer cell or beneficial to normal cells or both detrimental to cancer cells and advantageous to normal cells. The signal-sensor polynucleotides may optionally further comprise a sequence (translatable or not) which "senses" the microenvironment of the polynucleotide and alters (a) the function or phenotypic outcome associated with the peptide or protein which is translated, (b) the expression level of the signal-sensor polynucleotide, and/or both.

Single unit dose: As used herein, a "single unit dose" is a dose of any therapeutic administered in one dose/at one time/single route/single point of contact, i.e., single administration event.

Similarity: As used herein, the term "similarity" refers to the overall relatedness between polymeric molecules, e.g. between polynucleotide molecules (e.g. DNA molecules and/or RNA molecules) and/or between polypeptide molecules. Calculation of percent similarity of polymeric molecules to one another can be performed in the same manner as a calculation of percent identity, except that calculation of percent similarity takes into account conservative substitutions as is understood in the art.

Skin: The term "skin" is the thin layer of tissue forming the natural outer covering of the body of a subject and includes the epidermis and the dermis. The dermis is the thick layer of living tissue below the epidermis which is the surface epithelium of the skin.

Split dose: As used herein, a "split dose" is the division of single unit dose or total daily dose into two or more doses.

Stable: As used herein "stable" refers to a compound that is sufficiently robust to survive isolation to a useful degree of purity from a reaction mixture, and preferably capable of formulation into an efficacious therapeutic agent.

Stabilized: As used herein, the term "stabilize", "stabilized," "stabilized region" means to make or become stable.

Subject: As used herein, the term "subject" or "patient" refers to any organism to which a composition in accordance with the invention may be administered, e.g., for experimental, diagnostic, prophylactic, and/or therapeutic purposes. Typical subjects include animals (e.g., mammals such as mice, rats, rabbits, non-human primates, and humans) and/or plants.

Substantially: As used herein, the term "substantially" refers to the qualitative condition of exhibiting total or near-total extent or degree of a characteristic or property of interest. One of ordinary skill in the biological arts will understand that biological and chemical phenomena rarely, if ever, go to completion and/or proceed to completeness or achieve or avoid an absolute result. The term "substantially" is therefore used herein to capture the potential lack of completeness inherent in many biological and chemical phenomena.

Substantially equal: As used herein as it relates to time differences between doses, the term means plus/minus 2%.

Substantially simultaneously: As used herein and as it relates to plurality of doses, the term means within 2 seconds.

Suffering from: An individual who is "suffering from" a disease, disorder, and/or condition has been diagnosed with or displays one or more symptoms of a disease, disorder, and/or condition.

Susceptible to: An individual who is "susceptible to" a disease, disorder, and/or condition has not been diagnosed with and/or may not exhibit symptoms of the disease, disorder, and/or condition but harbors a propensity to develop a disease or its symptoms. In some embodiments, an individual who is susceptible to a disease, disorder, and/or condition (for example, cancer) may be characterized by one or more of the following: (1) a genetic mutation associated with development of the disease, disorder, and/or condition; (2) a genetic polymorphism associated with development of the disease, disorder, and/or condition; (3) increased and/or decreased expression and/or activity of a protein and/or nucleic acid associated with the disease, disorder, and/or condition; (4) habits and/or lifestyles associated with development of the disease, disorder, and/or condition; (5) a family history of the disease, disorder, and/or condition; and (6) exposure to and/or infection with a microbe associated with development of the disease, disorder, and/or condition. In some embodiments, an individual who is susceptible to a disease, disorder, and/or condition will develop the disease, disorder, and/or condition. In some embodiments, an individual who is susceptible to a disease, disorder, and/or condition will not develop the disease, disorder, and/or condition.

Symptom: As used herein, the term "symptom" is a signal of a disease, disorder and/or condition. For example, symptoms may be felt or noticed by the subject who has them but may not be easily accessed by looking at a subject's outward appearance or behaviors. Examples of symptoms include, but are not limited to, weakness, aches and pains, fever, fatigue, weight loss, blood clots, increased blood calcium levels, low white blood cell count, short of breath, dizziness, headaches, hyperpigmentation, jaundice, erthema, pruritis, excessive hair growth, change in bowel habits, change in bladder function, long-lasting sores, white patches inside the mouth, white spots on the tongue, unusual bleeding or discharge, thickening or lump on parts of the body, indigestion, trouble swallowing, changes in warts or moles, change in new skin and nagging cough or hoarseness.

Synthetic: The term "synthetic" means produced, prepared, and/or manufactured by the hand of man. Synthesis of polynucleotides or polypeptides or other molecules of the present invention may be chemical or enzymatic.

Targeted Cells: As used herein, "targeted cells" refers to any one or more cells of interest. The cells may be found in vitro, in vivo, in situ or in the tissue or organ of an organism. The organism may be an animal, preferably a mammal, more preferably a human and most preferably a patient.

Therapeutic Agent: The term "therapeutic agent" refers to any agent that, when administered to a subject, has a therapeutic, diagnostic, and/or prophylactic effect and/or elicits a desired biological and/or pharmacological effect.

Therapeutically effective amount: As used herein, the term "therapeutically effective amount" means an amount of an agent to be delivered (e.g., nucleic acid, drug, therapeutic agent, diagnostic agent, prophylactic agent, etc.) that is sufficient, when administered to a subject suffering from or susceptible to an infection, disease, disorder, and/or condition, to treat, improve symptoms of, diagnose, prevent, and/or delay the onset of the infection, disease, disorder, and/or condition.

Therapeutically effective outcome: As used herein, the term "therapeutically effective outcome" means an outcome that is sufficient in a subject suffering from or susceptible to an infection, disease, disorder, and/or condition, to treat, improve symptoms of, diagnose, prevent, and/or delay the onset of the infection, disease, disorder, and/or condition.

Total daily dose: As used herein, a "total daily dose" is an amount given or prescribed in 24 hr period. It may be administered as a single unit dose.

Transcription factor: As used herein, the term "transcription factor" refers to a DNA-binding protein that regulates transcription of DNA into RNA, for example, by activation or repression of transcription. Some transcription factors effect regulation of transcription alone, while others act in concert with other proteins. Some transcription factor can both activate and repress transcription under certain conditions. In general, transcription factors bind a specific target sequence or sequences highly similar to a specific consensus sequence in a regulatory region of a target gene. Transcription factors may regulate transcription of a target gene alone or in a complex with other molecules.

Treating: As used herein, the term "treating" refers to partially or completely alleviating, ameliorating, improving, relieving, delaying onset of, inhibiting progression of, reducing severity of, and/or reducing incidence of one or more symptoms or features of a particular infection, disease, disorder, and/or condition. For example, "treating" cancer may refer to inhibiting survival, growth, and/or spread of a tumor. Treatment may be administered to a subject who does not exhibit signs of a disease, disorder, and/or condition and/or to a subject who exhibits only early signs of a disease, disorder, and/or condition for the purpose of decreasing the risk of developing pathology associated with the disease, disorder, and/or condition.

Tumor: As used herein, a "tumor" is an abnormal growth of tissue, whether benign or malignant.

Tumor growth: As used herein, the term "tumor growth" or "tumor metastases" means an increased mass or volume of the tumor or expansion of the tumor distribution.

Unmodified: As used herein, "unmodified" refers to any substance, compound or molecule prior to being changed in any way. Unmodified may, but does not always, refer to the wild type or native form of a biomolecule. Molecules may undergo a series of modifications whereby each modified molecule may serve as the "unmodified" starting molecule for a subsequent modification.

EQUIVALENTS AND SCOPE

Those skilled in the art will recognize, or be able to ascertain using no more than routine experimentation, many equivalents to the specific embodiments in accordance with the invention described herein. The scope of the present invention is not intended to be limited to the above Description, but rather is as set forth in the appended claims.

In the claims, articles such as "a," "an," and "the" may mean one or more than one unless indicated to the contrary or otherwise evident from the context. Claims or descriptions that include "or" between one or more members of a group are considered satisfied if one, more than one, or all of the group members are present in, employed in, or otherwise relevant to a given product or process unless indicated to the contrary or otherwise evident from the context. The invention includes embodiments in which exactly one member of the group is present in, employed in, or otherwise relevant to a given product or process. The invention includes embodiments in which more than one, or all of the group members are present in, employed in, or otherwise relevant to a given product or process.

It is also noted that the term "comprising" is intended to be open and permits but does not require the inclusion of additional elements or steps. When the term "comprising" is used herein, the term "consisting of" is thus also encompassed and disclosed.

Where ranges are given, endpoints are included. Furthermore, it is to be understood that unless otherwise indicated or otherwise evident from the context and understanding of one of ordinary skill in the art, values that are expressed as ranges can assume any specific value or subrange within the stated ranges in different embodiments of the invention, to the tenth of the unit of the lower limit of the range, unless the context clearly dictates otherwise.

In addition, it is to be understood that any particular embodiment of the present invention that falls within the prior art may be explicitly excluded from any one or more of the claims. Since such embodiments are deemed to be known to one of ordinary skill in the art, they may be excluded even if the exclusion is not set forth explicitly herein. Any particular embodiment of the compositions of the invention (e.g., any nucleic acid or protein encoded thereby; any method of production; any method of use; etc.) can be excluded from any one or more claims, for any reason, whether or not related to the existence of prior art.

All cited sources, for example, references, publications, databases, database entries, and art cited herein, are incorporated into this application by reference, even if not expressly stated in the citation. In case of conflicting statements of a cited source and the instant application, the statement in the instant application shall control.

Section and table headings are not intended to be limiting.

EXAMPLES

Example 1. Signal-Sensor Polynucleotide Production

Modified signal-sensor mRNAs (mmRNA) according to the invention may be made using standard laboratory methods and materials. The open reading frame (ORF) of the gene of interest may be flanked by a 5' untranslated region (UTR) which may contain a strong Kozak translational initiation signal and/or an alpha-globin 3' UTR which may include an oligo(dT) sequence for templated addition of a poly-A tail. The modified mRNAs may be modified to reduce the cellular innate immune response. The modifications to reduce the cellular response may include pseudouridine ($\psi$) and 5-methyl-cytidine (5meC, 5mc or $m^5C$). (See, Kariko K et al. Immunity 23:165-75 (2005), Kariko K et al. Mol Ther 16:1833-40 (2008), Anderson B R et al. NAR (2010); herein incorporated by reference).

The ORF may also include various upstream or downstream additions (such as, but not limited to, β-globin, tags, etc.) may be ordered from an optimization service such as, but not limited to, DNA2.0 (Menlo Park, Calif.) and may contain multiple cloning sites which may have XbaI recognition. Upon receipt of the construct, it may be reconstituted and transformed into chemically competent *E. coli*.

For the present invention, NEB DH5-alpha Competent *E. coli* may be used. Transformations are performed according to NEB instructions using 100 ng of plasmid. The protocol is as follows:

Thaw a tube of NEB 5-alpha Competent *E. coli* cells on ice for 10 minutes.

Add 1-5 μl containing 1 pg-100 ng of plasmid DNA to the cell mixture. Carefully flick the tube 4-5 times to mix cells and DNA. Do not vortex.

Place the mixture on ice for 30 minutes. Do not mix.

Heat shock at 42° C. for exactly 30 seconds. Do not mix.

Place on ice for 5 minutes. Do not mix.

Pipette 950 μl of room temperature SOC into the mixture.

Place at 37° C. for 60 minutes. Shake vigorously (250 rpm) or rotate.

Warm selection plates to 37° C.

Mix the cells thoroughly by flicking the tube and inverting.

Spread 50-100 μl of each dilution onto a selection plate and incubate overnight at 37° C. Alternatively, incubate at 30° C. for 24-36 hours or 25° C. for 48 hours.

A single colony is then used to inoculate 5 ml of LB growth media using the appropriate antibiotic and then allowed to grow (250 RPM, 37° C.) for 5 hours. This is then used to inoculate a 200 ml culture medium and allowed to grow overnight under the same conditions.

To isolate the plasmid (up to 850 μg), a maxi prep is performed using the Invitrogen PURELINK™ HiPure Maxiprep Kit (Carlsbad, Calif.), following the manufacturer's instructions.

In order to generate cDNA for In Vitro Transcription (IVT), the plasmid is first linearized using a restriction enzyme such as XbaI. A typical restriction digest with XbaI will comprise the following: Plasmid 1.0 μg; 10× Buffer 1.0 μl; XbaI 1.5 μl; dH$_2$O up to 10 μl; incubated at 37° C. for 1 hr. If performing at lab scale (<5 μg), the reaction is cleaned up using Invitrogen's PURELINK™ PCR Micro Kit (Carlsbad, Calif.) per manufacturer's instructions. Larger scale purifications may need to be done with a product that has a larger load capacity such as Invitrogen's standard PURELINK™ PCR Kit (Carlsbad, Calif.). Following the cleanup, the linearized vector is quantified using the NanoDrop and analyzed to confirm linearization using agarose gel electrophoresis.

As a non-limiting example, G-CSF may represent the polypeptide of interest. Sequences used in the steps outlined in Examples 1-5 are shown in Table 12. It should be noted that the start codon (ATG) has been underlined in each sequence of Table 12.

TABLE 12

G-CSF Sequences

| SEQ ID NO | Description |
|---|---|
| 6592 | cDNA sequence:<br>ATGGCTGGACCTGCCACCCAGAGCCCCATGAAGCTGATGGCCCTGCAGCT<br>GCTGCTGTGGCACAGTGCACTCTGGACAGTGCAGGAAGCCACCCCCTGG<br>GCCCTGCCAGCTCCCTGCCCCAGAGCTTCCTGCTCAAGTGCTTAGAGCAA<br>GTGAGGAAGATCCAGGGCGATGGCGCAGCGCTCCAGGAGAAGCTGTGTG<br>CCACCTACAAGCTGTGCCACCCCGAGGAGCTGGTGCTGCTCGGACACTCT<br>CTGGGCATCCCCTGGGCTCCCCTGAGCAGCTGCCCCAGCCAGGCCCTGCA<br>GCTGGCAGGCTGCTTGAGCCAACTCCATAGCGGCCTTTTCCTCTACCAGG<br>GGCTCCTGCAGGCCCTGGAAGGGATCTCCCCCGAGTTGGGTCCCACCTTG<br>GACACACTGCAGCTGGACGTCGCCGACTTTGCCACCACCATCTGGCAGCA<br>GATGGAAGAACTGGGAATGGCCCCTGCCCTGCAGCCCACCCAGGGTGCC<br>ATGCCGGCCTTCGCCTCTGCTTTCCAGCGCCGGGCAGGAGGGGTCCTGGT<br>TGCCTCCCATCTGCAGAGCTTCCTGGAGGTGTCGTACCGCGTTCTACGCC<br>ACCTTGCCCAGCCCTGA |
| 6593 | cDNA having T7 polymerase site, AfeI and Xba restriction site:<br>TAATACGACTCACTATA<br>GGGAAATAAGAGAGAAAAGAAGAGTAAGAAGAAATATAAGAGCCACC<br>ATGGCTGGACCTGCCACCCAGAGCCCCATGAAGCTGATGGCCCTGCAGCT<br>GCTGCTGTGGCACAGTGCACTCTGGACAGTGCAGGAAGCCACCCCCTGG<br>GCCCTGCCAGCTCCCTGCCCCAGAGCTTCCTGCTCAAGTGCTTAGAGCAA<br>GTGAGGAAGATCCAGGGCGATGGCGCAGCGCTCCAGGAGAAGCTGTGTG<br>CCACCTACAAGCTGTGCCACCCCGAGGAGCTGGTGCTGCTCGGACACTCT<br>CTGGGCATCCCCTGGGCTCCCCTGAGCAGCTGCCCCAGCCAGGCCCTGCA<br>GCTGGCAGGCTGCTTGAGCCAACTCCATAGCGGCCTTTTCCTCTACCAGG<br>GGCTCCTGCAGGCCCTGGAAGGGATCTCCCCCGAGTTGGGTCCCACCTTG<br>GACACACTGCAGCTGGACGTCGCCGACTTTGCCACCACCATCTGGCAGCA<br>GATGGAAGAACTGGGAATGGCCCCTGCCCTGCAGCCCACCCAGGGTGCC<br>ATGCCGGCCTTCGCCTCTGCTTTCCAGCGCCGGGCAGGAGGGGTCCTGGT<br>TGCCTCCCATCTGCAGAGCTTCCTGGAGGTGTCGTACCGCGTTCTACGCC<br>ACCTTGCCCAGCCCTGA<br>AGCGCTGCCTTCTGCGGGGCTTGCCTTCTGGCCATGCCCTTCTTCTCTCCC<br>TTGCACCTGTACCTCTTGGTCTTTGAATAAAGCCTGAGTAGGAAGGCGGC<br>CGCTCGAGCATGCATCTAGA |
| 6594 | Optimized sequence; containing T7 polymerase site, AfeI and Xba restriction site<br>TAATACGACTCACTATA<br>GGGAAATAAGAGAGAAAAGAAGAGTAAGAAGAAATATAAGAGCCACC |

TABLE 12-continued

G-CSF Sequences

| SEQ ID NO | Description |
|---|---|
|  | ATGGCCGGTCCCGCGACCCAAAGCCCCATGAAACTTATGGCCCTGCAGTT |
|  | GCTGCTTTGGCACTCGGCCCTCTGGACAGTCCAAGAAGCGACTCCTCTCG |
|  | GACCTGCCTCATCGTTGCCGCAGTCATTCCTTTTGAAGTGTCTGGAGCAG |
|  | GTGCGAAAGATTCAGGGCGATGGAGCCGCACTCCAAGAGAAGCTCTGCG |
|  | CGACATACAAACTTTGCCATCCCGAGGAGCTCGTACTGCTCGGGCACAGC |
|  | TTGGGGATTCCCTGGGCTCCTCTCTCGTCCTGTCCGTCGCAGGCTTTGCAG |
|  | TTGGCAGGGTGCCTTTCCCAGCTCCACTCCGGTTTGTTCTTGTATCAGGGA |
|  | CTGCTGCAAGCCCTTGAGGGAATCTCGCCAGAATTGGGCCCGACGCTGGA |
|  | CACGTTGCAGCTCGACGTGGCGGATTTCGCAACAACCATCTGGCAGCAGA |
|  | TGGAGGAACTGGGGATGGCACCCGCGCTGCAGCCCACGCAGGGGCAAT |
|  | GCCGGCCTTTGCGTCCGCGTTTCAGCGCAGGGCGGGTGGAGTCCTCGTAG |
|  | CGAGCCACCTTCAATCATTTTTGGAAGTCTCGTACCGGGTGCTGAGACAT |
|  | CTTGCGCAGCCGTGA |
|  | AGCGCTGCCTTCTGCGGGGCTTGCCTTCTGGCCATGCCCTTCTTCTCTCCC |
|  | TTGCACCTGTACCTCTTGGTCTTTGAATAAAGCCTGAGTAGGAAGGCGGC |
|  | CGCTCGAGCATGCATCTAGA |
| 6595 | mRNA sequence (transcribed) |
|  | GGGAAAUAAGAGAGAAAAGAAGAGUAAGAAGAAAUAUAAGAGCCACC |
|  | AUGGCCGGUCCCGCGACCCAAAGCCCCAUGAAACUUAUGGCCCUGCAG |
|  | UUGCUGCUUUGGCACUCGGCCCUCUGGACAGUCCAAGAAGCGACUCCU |
|  | CUCGGACCUGCCUCAUCGUUGCCGCAGUCAUUCCUUUUGAAGUGUCUG |
|  | GAGCAGGUGCGAAAGAUUCAGGGCGAUGGAGCCGCACUCCAAGAGAAG |
|  | CUCUGCGCGACAUACAAACUUUGCCAUCCCGAGGAGCUCGUACUGCUC |
|  | GGGCACAGCUUGGGGAUUCCCUGGGCUCCUCUCUCGUCCUGUCCGUCG |
|  | CAGGCUUUGCAGUUGGCAGGGUGCCUUUCCCAGCUCCACUCCGGUUUG |
|  | UUCUUGUAUCAGGGACUGCUGCAAGCCCUUGAGGGAAUCUCGCCAGAA |
|  | UUGGGCCCGACGCUGGACACGUUGCAGCUCGACGUGGCGGAUUUCGCA |
|  | ACAACCAUCUGGCAGCAGAUGGAGGAACUGGGGAUGGCACCCGCGCUG |
|  | CAGCCCACGCAGGGGGCAAUGCCGGCCUUUGCGUCCGCGUUUCAGCGC |
|  | AGGGCGGGUGGAGUCCUCGUAGCGAGCCACCUUCAAUCAUUUUUGGAA |
|  | GUCUCGUACCGGGUGCUGAGACAUCUUGCGCAGCCGUGA |
|  | AGCGCUGCCUUCUGCGGGGCUUGCCUUCUGGCCAUGCCCUUCUUCUCUC |
|  | CCUUGCACCUGUACCUCUUGGUCUUUGAAUAAAGCCUGAGUAGGAAG |

Example 2: PCR for cDNA Production

PCR procedures for the preparation of cDNA are performed using 2×KAPA HIF1™ HotStart ReadyMix by Kapa Biosystems (Woburn, Mass.). This system includes 2×KAPA ReadyMix 12.5 µl; Forward Primer (10 uM) 0.75 µl; Reverse Primer (10 uM) 0.75 µl; Template cDNA 100 ng; and dH$_2$O diluted to 25.0 µl. The reaction conditions are at 95° C. for 5 min. and 25 cycles of 98° C. for 20 sec, then 58° C. for 15 sec, then 72° C. for 45 sec, then 72° C. for 5 min. then 4° C. to termination.

The reverse primer of the instant invention incorporates a poly-T$_{120}$ for a poly-A$_{120}$ in the mRNA. Other reverse primers with longer or shorter poly(T) tracts can be used to adjust the length of the poly(A) tail in the mRNA.

The reaction is cleaned up using Invitrogen's PURE-LINK™ PCR Micro Kit (Carlsbad, Calif.) per manufacturer's instructions (up to 5 µg). Larger reactions will require a cleanup using a product with a larger capacity. Following the cleanup, the cDNA is quantified using the NanoDrop and analyzed by agarose gel electrophoresis to confirm the cDNA is the expected size. The cDNA is then submitted for sequencing analysis before proceeding to the in vitro transcription reaction.

Example 3. In Vitro Transcription (IVT)

The in vitro transcription reaction generates mRNA containing modified nucleotides or modified RNA. The input nucleotide triphosphate (NTP) mix is made in-house using natural and un-natural NTPs.

A typical in vitro transcription reaction includes the following:

| | |
|---|---|
| Template cDNA | 1.0 µg |
| 10× transcription buffer (400 mM Tris-HCl pH 8.0, 190 mM MgCl$_2$, 50 mM DTT, 10 mM Spermidine) | 2.0 µl |
| Custom NTPs (25 mM each) | 7.2 µl |
| RNase Inhibitor | 20 U |
| T7 RNA polymerase | 3000 U |
| dH$_2$O | Up to 20.0 µl. and Incubation at 37° C. for 3 hr-5 hrs. |

The crude IVT mix may be stored at 4° C. overnight for cleanup the next day. 1 U of RNase-free DNase is then used to digest the original template. After 15 minutes of incubation at 37° C., the mRNA is purified using Ambion's MEGACLEAR™ Kit (Austin, Tex.) following the manufacturer's instructions. This kit can purify up to 500 µg of RNA. Following the cleanup, the RNA is quantified using the NanoDrop and analyzed by agarose gel electrophoresis to confirm the RNA is the proper size and that no degradation of the RNA has occurred.

Example 4. Enzymatic Capping of mRNA

Capping of the mRNA is performed as follows where the mixture includes: IVT RNA 60 µg-180 µg and dH$_2$O up to 72 µl. The mixture is incubated at 65° C. for 5 minutes to denature RNA, and then is transferred immediately to ice.

The protocol then involves the mixing of 10× Capping Buffer (0.5 M Tris-HCl (pH 8.0), 60 mM KCl, 12.5 mM MgCl$_2$) (10.0 µl); 20 mM GTP (5.0 µl); 20 mM S-Adenosyl Methionine (2.5 µl); RNase Inhibitor (100 U); 2'-O-Methyltransferase (400 U); Vaccinia capping enzyme (Guanylyl transferase) (40 U); dH$_2$O (Up to 28 µl); and incubation at 37° C. for 30 minutes for 60 µg RNA or up to 2 hours for 180 µg of RNA.

The mRNA is then purified using Ambion's MEGA-CLEAR™ Kit (Austin, Tex.) following the manufacturer's instructions. Following the cleanup, the RNA is quantified using the NANODROP™ (ThermoFisher, Waltham, Mass.) and analyzed by agarose gel electrophoresis to confirm the RNA is the proper size and that no degradation of the RNA has occurred. The RNA product may also be sequenced by running a reverse-transcription-PCR to generate the cDNA for sequencing.

Example 5. PolyA Tailing Reaction

Without a poly-T in the cDNA, a poly-A tailing reaction must be performed before cleaning the final product. This is done by mixing Capped IVT RNA (100 µl); RNase Inhibitor (20 U); 10× Tailing Buffer (0.5 M Tris-HCl (pH 8.0), 2.5 M NaCl, 100 mM MgCl$_2$)(12.0 µl); 20 mM ATP (6.0 µl); Poly-A Polymerase (20 U); dH$_2$O up to 123.5 µl and incubation at 37° C. for 30 min. If the poly-A tail is already in the transcript, then the tailing reaction may be skipped and proceed directly to cleanup with Ambion's MEGA-CLEAR™ kit (Austin, Tex.) (up to 500 µs). Poly-A Polymerase is preferably a recombinant enzyme expressed in yeast.

For studies performed and described herein, the poly-A tail is encoded in the IVT template to comprise 160 nucleotides in length. However, it should be understood that the processivity or integrity of the polyA tailing reaction may not always result in exactly 160 nucleotides. Hence polyA tails of approximately 160 nucleotides, e.g, about 150-165, 155, 156, 157, 158, 159, 160, 161, 162, 163, 164 or 165 are within the scope of the invention.

Example 6. Natural 5' Caps and 5' Cap Analogues

5'-capping of modified RNA may be completed concomitantly during the in vitro-transcription reaction using the following chemical RNA cap analogs to generate the 5'-guanosine cap structure according to manufacturer protocols: 3'-O-Me-m7G(5')ppp(5') G [the ARCA cap]; G(5) ppp(5')A; G(5')ppp(5')G; m7G(5')ppp(5')A; m7G(5')ppp (5')G (New England BioLabs, Ipswich, Mass.). 5'-capping of modified RNA may be completed post-transcriptionally using a Vaccinia Virus Capping Enzyme to generate the "Cap 0" structure: m7G(5')ppp(5')G (New England Bio-Labs, Ipswich, Mass.). Cap 1 structure may be generated using both Vaccinia Virus Capping Enzyme and a 2'-O methyl-transferase to generate: m7G(5')ppp(5')G-2'-O-methyl. Cap 2 structure may be generated from the Cap 1 structure followed by the 2'-O-methylation of the 5'-antepenultimate nucleotide using a 2'-O methyl-transferase. Cap 3 structure may be generated from the Cap 2 structure followed by the 2'-O-methylation of the 5'-preantepenultimate nucleotide using a 2'-O methyl-transferase. Enzymes are preferably derived from a recombinant source.

When transfected into mammalian cells, the modified mRNAs have a stability of between 12-18 hours or more than 18 hours, e.g., 24, 36, 48, 60, 72 or greater than 72 hours.

Example 7. Capping

A. Protein Expression Assay

Synthetic mRNAs encoding human G-CSF (cDNA shown in SEQ ID NO: 6567; mRNA sequence fully modified with 5-methylcytidine at each cytidine and pseudouridine replacement at each uridine site shown in SEQ ID NO: 6570 with a polyA tail approximately 160 nucleotides in length not shown in sequence) containing the ARCA (3' O-Me-m7G(5)ppp(5')G) cap analog or the Cap1 structure can be transfected into human primary keratinocytes at equal concentrations. 6, 12, 24 and 36 hours post-transfection the amount of G-CSF secreted into the culture medium can be assayed by ELISA. Synthetic mRNAs that secrete higher levels of G-CSF into the medium would correspond to a synthetic mRNA with a higher translationally-competent Cap structure.

B. Purity Analysis Synthesis

Synthetic mRNAs encoding human G-CSF (cDNA shown in SEQ ID NO: 6567; mRNA sequence fully modified with 5-methylcytidine at each cytidine and pseudouridine replacement at each uridine site shown in SEQ ID NO: 6570 with a polyA tail approximately 160 nucleotides in length not shown in sequence) containing the ARCA cap analog or the Cap1 structure crude synthesis products can be compared for purity using denaturing Agarose-Urea gel electrophoresis or HPLC analysis. Synthetic mRNAs with a single, consolidated band by electrophoresis correspond to the higher purity product compared to a synthetic mRNA with multiple bands or streaking bands. Synthetic mRNAs with a single HPLC peak would also correspond to a higher purity product. The capping reaction with a higher efficiency would provide a more pure mRNA population.

C. Cytokine Analysis

Synthetic mRNAs encoding human G-CSF (cDNA shown in SEQ ID NO: 6567; mRNA sequence fully modified with 5-methylcytidine at each cytidine and pseudouridine replacement at each uridine site shown in SEQ ID NO: 6570 with a polyA tail approximately 160 nucleotides in length not shown in sequence) containing the ARCA cap analog or the Cap 1 structure can be transfected into human primary keratinocytes at multiple concentrations. 6, 12, 24 and 36 hours post-transfection the amount of pro-inflammatory cytokines such as TNF-alpha and IFN-beta secreted into the culture medium can be assayed by ELISA. Synthetic mRNAs that secrete higher levels of pro-inflammatory cytokines into the medium would correspond to a synthetic mRNA containing an immune-activating cap structure.

D. Capping Reaction Efficiency

Synthetic mRNAs encoding human G-CSF (cDNA shown in SEQ ID NO: 6567; mRNA sequence fully modified with 5-methylcytidine at each cytidine and pseudouridine replacement at each uridine site shown in SEQ ID NO: 6570 with a polyA tail approximately 160 nucleotides in length not shown in sequence) containing the ARCA cap analog or the Cap 1 structure can be analyzed for capping reaction efficiency by LC-MS after capped mRNA nuclease treatment. Nuclease treatment of capped mRNAs would yield a mixture of free nucleotides and the capped 5'-5-triphosphate cap structure detectable by LC-MS. The amount of capped product on the LC-MS spectra can be expressed as a percent of total mRNA from the reaction and would correspond to capping reaction efficiency. The cap structure with higher capping reaction efficiency would have a higher amount of capped product by LC-MS.

Example 8. Agarose Gel Electrophoresis of Modified RNA or RT PCR Products

Individual modified RNAs (200-400 ng in a 20 µl volume) or reverse transcribed PCR products (200-400 ng) are loaded

Example 9. Nanodrop Modified RNA Quantification and UV Spectral Data

Modified RNAs in TE buffer (1 µl) are used for Nanodrop UV absorbance readings to quantitate the yield of each modified RNA from an in vitro transcription reaction.

Example 10. Formulation of Signal-Sensor Polynucleotides

Signal-sensor polynucleotides may be formulated for in vitro and in vivo experiments according to the methods taught in International Application PCT/US12/069610 filed Dec. 14, 2012, the contents of which are incorporated herein by reference in their entirety.

Example 11. Assays and Methods of Detection or Analysis of Signal-Sensor Polynucleotides Signal-sensor polynucleotides may be investigated using the methods described in co-pending International Patent application No. PCT/US2013/030070 filed Mar. 9, 2013 and U.S. Patent Application No. 61/681,742 filed Aug. 10, 2012 (MNC2), the contents of which are incorporated herein by reference in their entirety.

Example 12. Cell Lines for the Study of Signal-Sensor Polynucleotides

Signal-sensor polynucleotides may be investigated in any number of cancer or normal cell lines. Cell lines useful in the present invention include those from ATCC (Manassas, Va.) and are listed in Table 13.

TABLE 13

Cell lines

| ATCC Number | Hybridoma or Cell line Description | Name |
|---|---|---|
| CCL-171 | Homo sapiens (human) Source: Organ: lung Disease: normal Cell Type: fibroblast | MRC-5 |
| CCL-185 | Homo sapiens (human) Source: Organ: lung Disease: carcinoma | A549 |
| CCL-248 | Homo sapiens (human) Source: Organ: colon Disease: colorectal carcinoma Derived from metastatic site: lung | T84 |
| CCL-256 | Homo sapiens (human) Source: Organ: lung Disease: adenocarcinoma; non-small cell lung cancer Derived from metastatic site: pleural effusion | NCI-H2126 [H2126] |
| CCL-257 | Homo sapiens (human) Source: Organ: lung Disease: carcinoma; classic small cell lung cancer | NCI-H1688 [H1688] |
| CCL-75 | Homo sapiens (human) Source: Organ: lung Disease: normal Cell Type: fibroblast | WI-38 |
| CCL-75.1 | Homo sapiens (human) Source: Organ: lung Cell Type: fibroblastSV40 transformed | WI-38 VA-13 subline 2RA |
| CCL-95.1 | Homo sapiens (human) Source: Organ: lung Cell Type: SV40 transformed | WI-26 VA4 |
| CRL-10741 | Homo sapiens (human) Source: Organ: liver Disease: hepatocellular carcinoma | C3A [HepG2/C3A, derivative of Hep G2 (ATCC HB-8065)] |
| CRL-11233 | Homo sapiens (human) Source: Organ: liver Tissue: left lobe Cell Type: epithelialimmortalized with SV40 large T antigen | THLE-3 |
| CRL-11351 | Homo sapiens (human) Source: Organ: lung Disease: carcinoma; small cell lung cancer; multidrug resistant Cell Type: epithelial | H69AR |
| CRL-1848 | Homo sapiens (human) Source: Organ: lung Disease: mucoepidermoid pulmonary carcinoma | NCI-H292 [H292] |
| CRL-1918 | Homo sapiens (human) Source: Organ: pancreas Disease: ductal adenocarcinoma; cystic fibrosis Derived from metastatic site: liver metastasis | CFPAC-1 |
| CRL-1973 | Homo sapiens (human) Source: Organ: testis Disease: malignant pluripotent embryonal carcinoma Derived from metastatic site: lung | NTERA-2 cl.D1 [NT2/D1] |
| CRL-2049 | Homo sapiens (human) Source: Organ: lung Disease: carcinoma; small cell lung cancer | DMS 79 |
| CRL-2062 | Homo sapiens (human) Source: Organ: lung Disease: carcinoma; small cell lung cancer | DMS 53 |
| CRL-2064 | Homo sapiens (human) Source: Organ: lung Disease: carcinoma; small cell lung cancer Derived from metastatic site: liver | DMS 153 |
| CRL-2066 | Homo sapiens (human) Source: Organ: lung Disease: carcinoma; small cell lung cancer | DMS 114 |

TABLE 13-continued

| | Cell lines | |
|---|---|---|
| ATCC Number | Hybridoma or Cell line Description | Name |
| CRL-2081 | *Homo sapiens* (human) Source: Disease: biphasic mesothelioma<br>Derived from metastatic site: lung | MSTO-211H |
| CRL-2170 | *Homo sapiens* (human) Source: Organ: lung<br>Disease: alveolar cell carcinoma | SW 1573 [SW-1573, SW1573] |
| CRL-2177 | *Homo sapiens* (human) Source: Organ: lung<br>Disease: carcinoma; small cell lung cancer | SW 1271 [SW-1271, SW1271] |
| CRL-2195 | *Homo sapiens* (human) Source: Organ: lung<br>Disease: carcinoma; small cell lung cancer<br>Cell Type: large cell, variant; | SHP-77 |
| CRL-2233 | *Homo sapiens* (human) Source: Organ: liver<br>Disease: hepatocellular carcinoma | SNU-398 |
| CRL-2234 | *Homo sapiens* (human) Source: Organ: liver<br>Tumor Stage: grade II-III/IV<br>Disease: hepatocellular carcinoma | SNU-449 |
| CRL-2235 | *Homo sapiens* (human) Source: Organ: liver<br>Tumor Stage: grade III/IV<br>Disease: hepatocellular carcinoma | SNU-182 |
| CRL-2236 | *Homo sapiens* (human) Source: Organ: liver<br>Tumor Stage: grade II-IV/V<br>Disease: hepatocellular carcinoma | SNU-475 |
| CRL-2237 | *Homo sapiens* (human) Source: Organ: liver<br>Tumor Stage: grade IV/V<br>Disease: pleomorphic hepatocellular carcinoma | SNU-387 |
| CRL-2238 | *Homo sapiens* (human) Source: Organ: liver<br>Tumor Stage: grade III/IV<br>Disease: pleomorphic hepatocellular carcinoma | SNU-423 |
| CRL-2503 | *Homo sapiens* (human) Source: Organ: lung<br>Tissue: bronchus<br>Disease: normal | NL20 |
| CRL-2504 | *Homo sapiens* (human) Source: Organ: lung<br>Tissue: bronchus<br>Disease: normal | NL20-TA [NL20T-A] |
| CRL-2706 | *Homo sapiens* (human) Source: Organ: liver<br>Tissue: left lobe<br>Cell Type: epithelialSV40 transformed | THLE-2 |
| CRL-2741 | *Homo sapiens* (human) Source: Organ: lung<br>Tissue: bronchus<br>Cell Type: epithelialHPV-16 E6/E7 transformed | HBE135-E6E7 |
| CRL-2868 | *Homo sapiens* (human) Source: Organ: lung<br>Disease: adenocarcinoma<br>Cell Type: epithelial | HCC827 |
| CRL-2871 | *Homo sapiens* (human) Source: Organ: lung<br>Disease: adenocarcinoma<br>Derived from metastatic site: pleural effusion<br>Cell Type: epithelial | HCC4006 |
| CRL-5800 | *Homo sapiens* (human) Source: Organ: lung<br>Disease: adenocarcinoma; non-small cell lung cancer | NCI-H23 [H23] |
| CRL-5803 | *Homo sapiens* (human) Source: Organ: lung<br>Disease: carcinoma; non-small cell lung cancer<br>Derived from metastatic site: lymph node | NCI-H1299 |
| CRL-5804 | *Homo sapiens* (human) Source: Organ: lung<br>Disease: carcinoma; classic small cell lung cancer<br>Derived from metastatic site: pleural effusion | NCI-H187 [H187] |
| CRL-5807 | *Homo sapiens* (human) Source: Organ: lung<br>Tissue: bronchiole; alveolus<br>Disease: bronchioalveolar carcinoma; non-small cell lung cancer | NCI-H358 [H-358, H358] |
| CRL-5808 | *Homo sapiens* (human) Source: Organ: lung<br>Tumor Stage: stage E<br>Disease: carcinoma; classic small cell lung cancer<br>Derived from metastatic site: pleural effusion | NCI-H378 [H378] |
| CRL-5810 | *Homo sapiens* (human) Source: Organ: lung<br>Tumor Stage: stage 2<br>Disease: adenocarcinoma; non-small cell lung cancer | NCI-H522 [H522] |
| CRL-5811 | *Homo sapiens* (human) Source: Organ: lung<br>Tumor Stage: stage E<br>Disease: carcinoma; variant small cell lung cancer<br>Derived from metastatic site: bone marrow | NCI-H526 [H526] |
| CRL-5815 | *Homo sapiens* (human) Source: Organ: lung<br>Tissue: bronchus<br>Disease: carcinoid | NCI-H727 [H727] |
| CRL-5816 | *Homo sapiens* (human) Source: Organ: lung<br>Tumor Stage: stage 2<br>Disease: carcinoma; non-small cell lung cancer | NCI-H810 [H810] |

TABLE 13-continued

| | Cell lines | |
|---|---|---|
| ATCC Number | Hybridoma or Cell line Description | Name |
| CRL-5817 | *Homo sapiens* (human) Source: Organ: lung Tumor Stage: stage E Disease: carcinoma; classic small cell lung cancer Derived from metastatic site: lymph node | NCI-H889 [H889] |
| CRL-5818 | *Homo sapiens* (human) Source: Organ: lung Disease: carcinoma; non-small cell lung cancer Derived from metastatic site: lymph node | NCI-H1155 [H1155] |
| CRL-5819 | *Homo sapiens* (human) Source: Organ: lung Disease: papillary adenocarcinoma Derived from metastatic site: lymph node | NCI-H1404 [H1404] |
| CRL-5822 | *Homo sapiens* (human) Source: Organ: stomach Disease: gastric carcinoma Derived from metastatic site: liver | NCI-N87 [N87] |
| CRL-5823 | *Homo sapiens* (human) Source: Organ: lung Tumor Stage: stage E Disease: carcinoma; variant small cell lung cancer Derived from metastatic site: pleural effusion | NCI-H196 [H196] |
| CRL-5824 | *Homo sapiens* (human) Source: Organ: lung Tumor Stage: stage E Disease: carcinoma; small cell lung cancer Derived from metastatic site: bone marrow | NCI-H211 [H211] |
| CRL-5825 | *Homo sapiens* (human) Source: Organ: lung Tumor Stage: stage E Disease: carcinoma; classic small cell lung cancer Derived from metastatic site: pleural effusion | NCI-H220 [H220] |
| CRL-5828 | *Homo sapiens* (human) Source: Organ: lung Tumor Stage: stage E Disease: carcinoma; classic small cell lung cancer Derived from metastatic site: brain | NCI-H250 [H250] |
| CRL-5831 | *Homo sapiens* (human) Source: Organ: lung Tumor Stage: stage L Disease: carcinoma; variant small cell lung cancer Derived from metastatic site: lymph node | NCI-H524 [H524] |
| CRL-5834 | *Homo sapiens* (human) Source: Organ: lung Tumor Stage: stage 3A Disease: adenosquamous carcinoma; non-small cell lung cancer Derived from metastatic site: pleural effusion | NCI-H647 [H647] |
| CRL-5835 | *Homo sapiens* (human) Source: Organ: lung Disease: bronchioalveolar carcinoma; non-small cell lung cancer Derived from metastatic site: lymph node | NCI-H650 [H650] |
| CRL-5836 | *Homo sapiens* (human) Source: Organ: lung Tumor Stage: stage E Disease: carcinoma; classic small cell lung cancer Derived from metastatic site: bone marrow | NCI-H711 [H711] |
| CRL-5837 | *Homo sapiens* (human) Source: Organ: lung Tumor Stage: stage E Disease: carcinoma; classic small cell lung cancer Derived from metastatic site: bone marrow | NCI-H719 [H719] |
| CRL-5840 | *Homo sapiens* (human) Source: Organ: lung Tumor Stage: stage E Disease: carcinoma; classic small cell lung cancer Derived from metastatic site: lymph node | NCI-H740 [H740] |
| CRL-5841 | *Homo sapiens* (human) Source: Organ: lung Tumor Stage: stage E Disease: carcinoma; classic small cell lung cancer Derived from metastatic site: lymph node | NCI-H748 [H748] |
| CRL-5842 | *Homo sapiens* (human) Source: Organ: lung Tumor Stage: stage E Disease: carcinoma; classic small cell lung cancer Derived from metastatic site: soft tissue | NCI-H774 [H774] |
| CRL-5844 | *Homo sapiens* (human) Source: Organ: lung Tumor stage: 3B Disease: adenocarcinoma; non-small cell lung cancer Derived from metastatic site: lymph node | NCI-H838 [H838] |
| CRL-5845 | *Homo sapiens* (human) Source: Organ: lung Tumor Stage: stage L Disease: carcinoma; variant small cell lung cancer Derived from metastatic site: lymph node | NCI-H841 [H841] |
| CRL-5846 | *Homo sapiens* (human) Source: Organ: lung Tumor Stage: stage L Disease: carcinoma; classic small cell lung cancer Derived from metastatic site: pleural effusion | NCI-H847 [H847] |

TABLE 13-continued

Cell lines

| ATCC Number | Hybridoma or Cell line Description | Name |
|---|---|---|
| CRL-5849 | *Homo sapiens* (human) Source: Organ: lung<br>Tumor Stage: stage L<br>Disease: carcinoma; classic small cell lung cancer<br>Derived from metastatic site: pleural effusion | NCI-H865 [H865] |
| CRL-5850 | *Homo sapiens* (human) Source: Organ: lung<br>Tumor Stage: stage 4<br>Disease: adenocarcinoma; non-small cell lung cancer<br>Derived from metastatic site: lymph node | NCI-H920 [H920] |
| CRL-5853 | *Homo sapiens* (human) Source: Organ: lung<br>Disease: carcinoma; small cell lung cancer<br>Derived from metastatic site: pleural effusion | NCI-H1048 [H1048] |
| CRL-5855 | *Homo sapiens* (human) Source: Organ: lung<br>Tumor Stage: stage E<br>Disease: carcinoma; classic small cell lung cancer<br>Derived from metastatic site: bone marrow | NCI-H1092 [H1092] |
| CRL-5856 | *Homo sapiens* (human) Source: Organ: lung<br>Tumor Stage: stage E<br>Disease: carcinoma; classic small cell lung cancer<br>Derived from metastatic site: lymph node | NCI-H1105 [H1105] |
| CRL-5858 | *Homo sapiens* (human) Source: Organ: lung<br>Tumor Stage: stage L<br>Disease: carcinoma; small cell lung cancer<br>Derived from metastatic site: lymph node | NCI-H1184 [H1184] |
| CRL-5859 | *Homo sapiens* (human) Source: Organ: lung<br>Tumor Stage: stage E<br>Disease: carcinoma; small cell lung cancer<br>Derived from metastatic site: bone marrow | NCI-H1238 [H1238] |
| CRL-5864 | *Homo sapiens* (human) Source: Organ: lung<br>Disease: carcinoma; small cell lung cancer<br>Derived from metastatic site: cervix | NCI-H1341 [H1341] |
| CRL-5867 | *Homo sapiens* (human) Source: Organ: lung<br>Tumor Stage: stage 3A<br>Disease: carcinoma; non-small cell lung cancer<br>Derived from metastatic site: lymph node | NCI-H1385 [H1385] |
| CRL-5869 | *Homo sapiens* (human) Source: Organ: lung<br>Tumor Stage: stage E<br>Disease: carcinoma; classic small cell lung cancer | NCI-H1417 [H1417] |
| CRL-5870 | *Homo sapiens* (human) Source: Organ: lung<br>Disease: adenocarcinoma; non-small cell lung cancer | NCI-H1435 [H1435] |
| CRL-5871 | *Homo sapiens* (human) Source: Organ: lung<br>Tumor Stage: stage E<br>Disease: carcinoma; classic small cell lung cancer<br>Derived from metastatic site: lymph node | NCI-H1436 [H1436] |
| CRL-5872 | *Homo sapiens* (human) Source: Organ: lung<br>Tumor Stage: stage 1<br>Disease: adenocarcinoma; non-small cell lung cancer<br>Derived from metastatic site: pleural effusion | NCI-H1437 [H1437] |
| CRL-5874 | *Homo sapiens* (human) Source: Organ: lung<br>Tumor Stage: stage E<br>Disease: carcinoma; small cell lung cancer<br>Derived from metastatic site: pleural effusion | NCI-H1522 [H1522] |
| CRL-5875 | *Homo sapiens* (human) Source: Organ: lung<br>Disease: adenocarcinoma; non-small cell lung cancer | NCI-H1563 [H1563] |
| CRL-5876 | *Homo sapiens* (human) Source: Organ: lung<br>Disease: adenocarcinoma; non-small cell lung cancer<br>Derived from metastatic site: lymph node | NCI-H1568 [H1568] |
| CRL-5877 | *Homo sapiens* (human) Source: Organ: lung<br>Tumor Stage: stage 4<br>Disease: adenocarcinoma<br>Derived from metastatic site: soft tissue | NCI-H1573 [H1573] |
| CRL-5878 | *Homo sapiens* (human) Source: Organ: lung<br>Tumor Stage: stage 4<br>Disease: non-small cell lung cancer<br>Cell Type: large cell; | NCI-H1581 [H1581] |
| CRL-5879 | *Homo sapiens* (human) Source: Tumor Stage: stage E<br>Disease: carcinoma; small cell lung cancer<br>Derived from metastatic site: bone marrow | NCI-H1618 [H1618] |
| CRL-5881 | *Homo sapiens* (human) Source: Organ: lung<br>Tumor Stage: stage 3B<br>Disease: adenocarcinoma; non-small cell lung cancer<br>Derived from metastatic site: lymph node | NCI-H1623 [H1623] |
| CRL-5883 | *Homo sapiens* (human) Source: Organ: lung<br>Tumor Stage: stage 3B<br>Disease: adenocarcinoma; bronchoalveolar carcinoma<br>Derived from metastatic site: pleural effusion | NCI-H1650 [H-1650, H1650] |

TABLE 13-continued

Cell lines

| ATCC Number | Hybridoma or Cell line Description | Name |
|---|---|---|
| CRL-5884 | *Homo sapiens* (human) Source: Organ: lung<br>Disease: adenocarcinoma; non-small cell lung cancer | NCI-H1651<br>[H1651] |
| CRL-5885 | *Homo sapiens* (human) Source: Organ: lung<br>Disease: adenocarcinoma; bronchoalveolar carcinoma<br>Derived from metastatic site: pleural effusion | NCI-H1666 [H-1666, H1666] |
| CRL-5886 | *Homo sapiens* (human) Source: Organ: lung<br>Tumor Stage: stage L<br>Disease: carcinoma; classic small cell lung cancer | NCI-H1672<br>[H1672] |
| CRL-5887 | *Homo sapiens* (human) Source: Organ: lung<br>Tumor Stage: stage 3B<br>Disease: adenocarcinoma; non-small cell lung cancer<br>Derived from metastatic site: lymph node | NCI-H1693<br>[H1693] |
| CRL-5888 | *Homo sapiens* (human) Source: Organ: lung<br>Tumor Stage: stage E<br>Disease: carcinoma; classic small cell lung cancer<br>Derived from metastatic site: ascites | NCI-H1694<br>[H1694] |
| CRL-5889 | *Homo sapiens* (human) Source: Organ: lung<br>Tumor Stage: stage 1<br>Disease: non-small cell lung cancer<br>Cell Type: squamous cell; | NCI-H1703<br>[H1703] |
| CRL-5891 | *Homo sapiens* (human) Source: Organ: lung<br>Disease: adenocarcinoma; non-small cell lung cancer | NCI-H1734 [H-1734, H1734] |
| CRL-5892 | *Homo sapiens* (human) Source: Organ: lung<br>Tumor Stage: stage 4<br>Disease: adenocarcinoma; non-small cell lung cancer<br>Derived from metastatic site: liver | NCI-H1755<br>[H1755] |
| CRL-5892 | *Homo sapiens* (human) Source: Organ: lung<br>Tumor Stage: stage 4<br>Disease: adenocarcinoma; non-small cell lung cancer<br>Derived from metastatic site: liver | NCI-H1755<br>[H1755] |
| CRL-5893 | *Homo sapiens* (human) Source: Organ: lung<br>Tumor Stage: stage 4<br>Disease: carcinoma; non-small cell lung cancer<br>Derived from metastatic site: lymph node<br>Cell Type: neuroendocrine; | NCI-H1770<br>[H1770] |
| CRL-5896 | *Homo sapiens* (human) Source: Organ: lung<br>Disease: adenocarcinoma; non-small cell lung cancer | NCI-H1793<br>[H1793] |
| CRL-5898 | *Homo sapiens* (human) Source: Organ: lung<br>Tumor Stage: stage L<br>Disease: carcinoma; classic small cell lung cancer | NCI-H1836<br>[H1836] |
| CRL-5899 | *Homo sapiens* (human) Source: Organ: lung<br>Disease: adenocarcinoma; non-small cell lung cancer | NCI-H1838<br>[H1838] |
| CRL-5900 | *Homo sapiens* (human) Source: Organ: lung<br>Tumor Stage: stage 4<br>Disease: non-small cell lung cancer<br>Derived from metastatic site: pleural effusion<br>Cell Type: squamous cell; | NCI-H1869<br>[H1869] |
| CRL-5902 | *Homo sapiens* (human) Source: Organ: lung<br>Tumor Stage: stage E<br>Disease: carcinoma; classic small cell lung cancer<br>Derived from metastatic site: lymph node | NCI-H1876<br>[H1876] |
| CRL-5903 | *Homo sapiens* (human) Source: Organ: lung<br>Tumor Stage: stage E<br>Disease: carcinoma; small cell lung cancer<br>Derived from metastatic site: bone marrow | NCI-H1882<br>[H1882] |
| CRL-5904 | *Homo sapiens* (human) Source: Organ: lung<br>Tumor Stage: stage 4<br>Disease: poorly differentiated carcinoma; non-small cell lung cancer<br>Derived from metastatic site: brain<br>Cell Type: large cell; | NCI-H1915<br>[H1915] |
| CRL-5906 | *Homo sapiens* (human) Source: Organ: lung<br>Tumor Stage: stage L<br>Disease: carcinoma; classic small cell lung cancer<br>Derived from metastatic site: lymph node | NCI-H1930<br>[H1930] |
| CRL-5907 | *Homo sapiens* (human) Source: Organ: lung<br>Tumor Stage: stage 3B<br>Disease: adenocarcinoma; non-small cell lung cancer<br>Derived from metastatic site: soft tissue | NCI-H1944<br>[H1944] |
| CRL-5908 | *Homo sapiens* (human) Source: Organ: lung<br>Disease: adenocarcinoma; non-small cell lung cancer | NCI-H1975 [H-1975, H1975] |
| CRL-5909 | *Homo sapiens* (human) Source: Organ: lung<br>Tumor Stage: stage 3A<br>Disease: adenocarcinoma; non-small cell lung cancer<br>Derived from metastatic site: lymph node | NCI-H1993<br>[H1993] |

TABLE 13-continued

| Cell lines | | |
|---|---|---|
| ATCC Number | Hybridoma or Cell line Description | Name |
| CRL-5912 | *Homo sapiens* (human) Source: Organ: lung<br>Tumor Stage: stage 3A<br>Disease: adenocarcinoma; non-small cell lung cancer<br>Derived from metastatic site: lymph node | NCI-H2023<br>[H2023] |
| CRL-5913 | *Homo sapiens* (human) Source: Organ: lung<br>Tumor Stage: stage E<br>Disease: carcinoma; small cell lung cancer<br>Derived from metastatic site: lymph node | NCI-H2029<br>[H2029] |
| CRL-5914 | *Homo sapiens* (human) Source: Organ: lung<br>Disease: adenocarcinoma; non-small cell lung cancer<br>Derived from metastatic site: lymph node | NCI-H2030<br>[H2030] |
| CRL-5917 | *Homo sapiens* (human) Source: Organ: lung<br>Tumor Stage: stage 1<br>Disease: mixed; small cell lung cancer; adenocarcinoma; squamous cell carcinoma | NCI-H2066<br>[H2066] |
| CRL-5918 | *Homo sapiens* (human) Source: Organ: lung<br>Tumor Stage: stage 3A<br>Disease: adenocarcinoma; non-small cell lung cancer | NCI-H2073<br>[H2073] |
| CRL-5920 | *Homo sapiens* (human) Source: Organ: lung<br>Tumor Stage: stage E<br>Disease: carcinoma; classic small cell lung cancer<br>Derived from metastatic site: pleural effusion | NCI-H2081<br>[H2081] |
| CRL-5921 | *Homo sapiens* (human) Source: Organ: lung<br>Disease: adenocarcinoma; non-small cell lung cancer | NCI-H2085<br>[H2085] |
| CRL-5922 | *Homo sapiens* (human) Source: Organ: lung<br>Tumor Stage: stage 1<br>Disease: adenocarcinoma; non-small cell lung cancer<br>Derived from metastatic site: lymph node | NCI-H2087<br>[H2087] |
| CRL-5923 | *Homo sapiens* (human) Source: Organ: lung<br>Tissue: neuroendocrine<br>Tumor Stage: stage 4<br>Disease: non-small cell lung cancer<br>Derived from metastatic site: lymph node | NCI-H2106<br>[H2106] |
| CRL-5924 | *Homo sapiens* (human) Source: Organ: lung<br>Disease: non-small cell lung cancer<br>Derived from metastatic site: pleural effusion | NCI-H2110<br>[H2110] |
| CRL-5926 | *Homo sapiens* (human) Source: Organ: lung<br>Disease: non-small cell lung cancer | NCI-H2135<br>[H2135] |
| CRL-5927 | *Homo sapiens* (human) Source: Organ: lung<br>Tumor Stage: stage E<br>Disease: carcinoma; small cell lung cancer<br>Derived from metastatic site: lymph node | NCI-H2141<br>[H2141] |
| CRL-5929 | *Homo sapiens* (human) Source: Organ: lung<br>Tumor Stage: stage E<br>Disease: carcinoma; small cell lung cancer<br>Derived from metastatic site: pleural effusion | NCI-H2171<br>[H2171] |
| CRL-5930 | *Homo sapiens* (human) Source: Organ: lung<br>Disease: non-small cell lung cancer | NCI-H2172<br>[H2172] |
| CRL-5931 | *Homo sapiens* (human) Source: Organ: lung<br>Tumor Stage: stage E<br>Disease: carcinoma; small cell lung cancer<br>Derived from metastatic site: bone marrow | NCI-H2195<br>[H2195] |
| CRL-5932 | *Homo sapiens* (human) Source: Organ: lung<br>Tumor Stage: stage E<br>Disease: carcinoma; small cell lung cancer<br>Derived from metastatic site: bone marrow | NCI-H2196<br>[H2196] |
| CRL-5933 | *Homo sapiens* (human) Source: Organ: lung<br>Tumor Stage: stage E<br>Disease: carcinoma; small cell lung cancer<br>Derived from metastatic site: lymph node | NCI-H2198<br>[H2198] |
| CRL-5934 | *Homo sapiens* (human) Source: Organ: lung<br>Tumor Stage: stage E<br>Disease: carcinoma; small cell lung cancer | NCI-H2227<br>[H2227] |
| CRL-5935 | *Homo sapiens* (human) Source: Organ: lung<br>Disease: adenocarcinoma; non-small cell lung cancer | NCI-H2228<br>[H2228] |
| CRL-5938 | *Homo sapiens* (human) Source: Organ: lung<br>Tumor Stage: stage 1<br>Disease: mixed; small cell lung cancer; adenocarcinoma; squamous cell carcinoma | NCI-H2286<br>[H2286] |
| CRL-5939 | *Homo sapiens* (human) Source: Organ: lung<br>Disease: adenocarcinoma; non-small cell lung cancer<br>Derived from metastatic site: lymph node | NCI-H2291<br>[H2291] |

TABLE 13-continued

| ATCC Number | Hybridoma or Cell line Description | Name |
|---|---|---|
| CRL-5940 | *Homo sapiens* (human) Source: Organ: lung<br>Tumor Stage: stage L<br>Disease: carcinoma; small cell lung cancer<br>Derived from metastatic site: lymph node | NCI-H2330 [H2330] |
| CRL-5941 | *Homo sapiens* (human) Source: Organ: lung<br>Tumor Stage: stage 3A<br>Disease: adenocarcinoma; non-small cell lung cancer | NCI-H2342 [H2342] |
| CRL-5942 | *Homo sapiens* (human) Source: Organ: lung<br>Tumor Stage: stage 1<br>Disease: adenocarcinoma; non-small cell lung cancer | NCI-H2347 [H2347] |
| CRL-5944 | *Homo sapiens* (human) Source: Organ: lung<br>Tumor Stage: stage 4<br>Disease: adenocarcinoma; non-small cell lung cancer<br>Derived from metastatic site: ascites | NCI-H2405 [H2405] |
| CRL-5945 | *Homo sapiens* (human) Source: Organ: lung<br>Disease: non-small cell lung cancer | NCI-H2444 [H2444] |
| CRL-5975 | *Homo sapiens* (human) Source: Organ: lung<br>Disease: carcinoid | UMC-11 |
| CRL-5976 | *Homo sapiens* (human) Source: Organ: lung<br>Tumor Stage: stage E<br>Disease: carcinoma; small cell lung cancer<br>Derived from metastatic site: lymph node | NCI-H64 [H64] |
| CRL-5978 | *Homo sapiens* (human) Source: Organ: lung<br>Tumor Stage: stage E<br>Disease: carcinoma; small cell lung cancer<br>Derived from metastatic site: liver | NCI-H735 [H735] |
| CRL-5978 | *Homo sapiens* (human) Source: Organ: lung<br>Tumor Stage: stage E<br>Disease: carcinoma; small cell lung cancer<br>Derived from metastatic site: liver | NCI-H735 [H735] |
| CRL-5982 | *Homo sapiens* (human) Source: Organ: lung<br>Tumor Stage: stage L<br>Disease: carcinoma; small cell lung cancer | NCI-H1963 [H1963] |
| CRL-5983 | *Homo sapiens* (human) Source: Organ: lung<br>Tumor Stage: stage E<br>Disease: carcinoma; small cell lung cancer<br>Derived from metastatic site: bone marrow | NCI-H2107 [H2107] |
| CRL-5984 | *Homo sapiens* (human) Source: Organ: lung<br>Tumor Stage: stage E<br>Disease: carcinoma; small cell lung cancer<br>Derived from metastatic site: bone marrow | NCI-H2108 [H2108] |
| CRL-5985 | *Homo sapiens* (human) Source: Organ: lung<br>Tumor Stage: stage 4<br>Disease: adenocarcinoma; non-small cell lung cancer<br>Derived from metastatic site: pleural effusion | NCI-H2122 [H2122] |
| CRL-7343 | *Homo sapiens* (human) Source: Organ: lung<br>Disease: cancer | Hs 573.T |
| CRL-7344 | *Homo sapiens* (human) Source: Organ: lung | Hs 573.Lu |
| CRL-8024 | *Homo sapiens* (human) Source: Organ: liver<br>Disease: hepatoma<br>Cell Type: Alexander cells; | PLC/PRF/5 |
| CRL-9609 | *Homo sapiens* (human) Source: Organ: lung<br>Tissue: bronchus<br>Disease: normal<br>Cell Type: epithelialvirus transformed | BEAS-2B |
| HB-8065 | *Homo sapiens* (human) Source: Organ: liver<br>Disease: hepatocellular carcinoma | Hep G2 |
| HTB-105 | *Homo sapiens* (human) Source: Organ: testes<br>Disease: embryonal carcinoma, malignant<br>Derived from metastatic site: lung | Tera-1 |
| HTB-106 | *Homo sapiens* (human) Source: Disease: malignant embryonal carcinoma<br>Derived from metastatic site: lung | Tera-2 |
| HTB-119 | *Homo sapiens* (human) Source: Organ: lung<br>Disease: carcinoma; small cell lung cancer | NCI-H69 [H69] |
| HTB-120 | *Homo sapiens* (human) Source: Organ: lung<br>Disease: carcinoma; small cell lung cancer<br>Derived from metastatic site: pleural effusion | NCI-H128 [H128] |
| HTB-168 | *Homo sapiens* (human) Source: Organ: lung<br>Tissue: bronchus<br>Disease: bronchogenic carcinoma | ChaGo-K-1 |
| HTB-171 | *Homo sapiens* (human) Source: Organ: lung<br>Disease: carcinoma; small cell lung cancer<br>Derived from metastatic site: pleural effusion | NCI-H446 [H446] |

TABLE 13-continued

Cell lines

| ATCC Number | Hybridoma or Cell line Description | Name |
|---|---|---|
| HTB-172 | *Homo sapiens* (human) Source: Organ: lung<br>Disease: carcinoma; small cell lung cancer<br>Derived from metastatic site: bone marrow | NCI-H209 [H209] |
| HTB-173 | *Homo sapiens* (human) Source: Organ: lung<br>Disease: carcinoma; small cell lung cancer<br>Derived from metastatic site: bone marrow | NCI-H146 [H146] |
| HTB-174 | *Homo sapiens* (human) Source: Organ: lung<br>Disease: papillary adenocarcinoma | NCI-H441 [H441] |
| HTB-175 | *Homo sapiens* (human) Source: Organ: lung<br>Disease: carcinoma; small cell lung cancer<br>Derived from metastatic site: pleural effusion | NCI-H82 [H82] |
| HTB-177 | *Homo sapiens* (human) Source: Organ: lung<br>Disease: carcinoma; large cell lung cancer<br>Derived from metastatic site: pleural effusion | NCI-H460 [H460] |
| HTB-178 | *Homo sapiens* (human) Source: Organ: lung<br>Disease: adenosquamous carcinoma | NCI-H596 [H596] |
| HTB-179 | *Homo sapiens* (human) Source: Organ: lung<br>Disease: adenocarcinoma<br>Derived from metastatic site: pleural effusion | NCI-H676B [H676B] |
| HTB-180 | *Homo sapiens* (human) Source: Organ: lung<br>Disease: carcinoma; small cell lung cancer<br>Derived from metastatic site: bone marrow | NCI-H345 [H345] |
| HTB-181 | *Homo sapiens* (human) Source: Organ: lung<br>Disease: papillary adenocarcinoma<br>Derived from metastatic site: lymph node | NCI-H820 [H820] |
| HTB-182 | *Homo sapiens* (human) Source: Organ: lung<br>Disease: squamous cell carcinoma | NCI-H520 [H520] |
| HTB-183 | *Homo sapiens* (human) Source: Organ: lung<br>Disease: carcinoma; large cell lung cancer<br>Derived from metastatic site: lymph node | NCI-H661 [H661] |
| HTB-184 | *Homo sapiens* (human) Source: Organ: lung<br>Disease: carcinoma; small cell lung cancer; extrapulmonary origin<br>Derived from metastatic site: adrenal gland | NCI-H510A [H510A, NCI-H510] |
| HTB-52 | *Homo sapiens* (human) Source: Organ: liver<br>Tissue: ascites<br>Disease: adenocarcinoma | SK-HEP-1 |
| HTB-53 | *Homo sapiens* (human) Source: Organ: lung<br>Disease: carcinoma | A-427 |
| HTB-54 | *Homo sapiens* (human) Source: Organ: lung<br>Tumor Stage: grade III<br>Disease: epidermoid carcinoma<br>Derived from metastatic site: pleura | Calu-1 |
| HTB-55 | *Homo sapiens* (human) Source: Organ: lung<br>Disease: adenocarcinoma<br>Derived from metastatic site: pleural effusion | Calu-3 |
| HTB-56 | *Homo sapiens* (human) Source: Organ: unknown, probably lung<br>Disease: anaplastic carcinoma | Calu-6 |
| HTB-57 | *Homo sapiens* (human) Source: Organ: lung<br>Disease: adenocarcinoma | SK-LU-1 |
| HTB-58 | *Homo sapiens* (human) Source: Organ: lung<br>Disease: squamous cell carcinoma<br>Derived from metastatic site: pleural effusion | SK-MES-1 |
| HTB-59 | *Homo sapiens* (human) Source: Organ: lung<br>Tumor Stage: grade IV<br>Disease: squamous cell carcinoma | SW 900 [SW-900, SW900] |
| HTB-64 | *Homo sapiens* (human) Source: Disease: malignant melanoma<br>Derived from metastatic site: lung | Malme-3M |
| HTB-79 | *Homo sapiens* (human) Source: Organ: pancreas<br>Disease: adenocarcinoma<br>Derived from metastatic site: liver | Capan-1 |

Example 13. Animal Models for the Study of Signal-Sensor Polynucleotides

Various animal models are available for the study of the signal-sensor polynucleotides of the present invention. These include, among others, models for lung and liver cancers.

The lung cancer model of Fukazawa et al (Anticancer Research, 2010; 30: 4193-4200) is employed in studies of signal-sensor polynucleotides. Briefly, a congenic mouse is created by crossing a ubiquitously expressing dominant negative Myc (Omomyc) mouse with a KRAS mutation-positive lung cancer model mouse. In the presence of Omomyc, lung tumors caused by the expression of mutated KRAS regresses in the congenic mouse, indicating that Omomyc caused tumor cell death of KRAS mutation-positive lung cancer.

Human lung cancer xenografts are also prepared by the method of Fukazawa. Briefly, human lung cancer xenografts are established in 4-week-old female BALB/C nude mice (Charles River Laboratories Japan, Kanagawa, Japan) by subcutaneous inoculation of 4×106 A549 cells into the dorsal flank. The mice are randomly assigned into six groups (n=6/group). After the tumors reach a diameter of about 0.5 cm (approximately 6 days after tumor inoculations), each group of mice are injected with 100 µl solution containing PBS, 5×1010 vp of control or signal-sensor polynucleotide into the dorsal flank tumor for the selected dosing regimen. Animals are then observed closely and survival studies or other analyses are performed.

The LSL-KRAS$^{G12D}$: TRE Omomyc:CMV rtTA triple transgenic model involves the use of an adenovirus expressing Cre recombinase which is administered via inhalation to induce oncogene expression via excision of the floxed STOP codon, and ubiquitous Omomyc expression is controlled via doxycycline. The model is reported in Soucek et al. (Nature, 1-5 (2008)). The mice of Soucek may be crossed with the LSLKRAS$^{G12D}$ single transgenic mice (Jackson Laboratories) and may be used for inhalation delivered or otherwise lung-delivered studies of signal-sensor polynucleotides expressing MYC inhibitor D or other oncology related polypeptide.

Mouse-in-mouse models may also be employed. Such models are akin to the p53−/−:c-Myc overexpressing HCC model of Zender (Cell. 2006 Jun. 30; 125(7): 1253-1267).

Design of such models involve starting with the WT or tumor suppressor deleted (such as p53−/−) 129 Sv/Ev Mm ES cell clone; introduction of liver activated protein (LAP) promoter directed tetracycline transactivator (tTA) and tetO-luciferase for liver specific imaging; freezing the resulting LAP-tTA: tetO-luciferase clones to be used for c-Myc as well as other liver relevant programs oncogene; adding tetO driven oncogene, e.g. tetOcMyc; Freeze resulting LAP-tTA: tetO-luciferase: tetO-MYC clones; injecting resulting ES clones into C57Bl/6 blastocytes and implant in pseudo pregnant mothers whereby the resulting chimeric animals are the tumor model upon removal of doxycycline (i.e. Tet-Off). The model will ideally evince inducible nodules of c-Myc-driven, luciferase-expressing HCC surrounded by normal hepatocytes.

Orthotopic HCC models using the HEP3B cell lines in mice may also be used (Crown Bio).

Nongermline genetically engineered mouse model (NGEMM) platform is a platform that could also be utilized for exploring signal-sensor polynucleotides.

Example 14. Inhibition of HIF1-Alpha: SHARP1 and CITED4

Hypoxia-inducible factors (HIFs) control cellular adaptation to oxygen deprivation. Cancer cells engage HIFs to sustain their growth in adverse conditions, thus promoting a cellular reprograming that includes metabolism, proliferation, survival and mobility. HIFs overexpression in human cancer biopsies correlates with high metastasis and mortality.

Hifs regulate genes related to metabolism such as GLUT1, GLUT3, ALDOA, ENOL, GAPDH, HK1, HK2, PFKL, PGK1, PKM2, LDHA, proliferation such as IGF-2, TGFA, VEGFA, survival such as TERT, NANOG, OCT4 and cell migration-invasion such as ZEB1, ZEB2, SNAI2, MMP14, MMP9, AMF, MET, PTHrP. (Keith, et al Nat Rev Cancer 2012; 12:9-22).

To investigate the destabilization of cancer, one or more signal-sensor polynucleotides may be administered to the cancer cell. The selection of the sequence, dose or administrative route is optionally informed by diagnostic evaluation of the cell, tumor, tissue or organism including, but not limited to, expression profiling of the cancer, metabolic evaluation (hypoxic, acidotic), apoptotic vs. survival profiling, cell cycle vs. senescent profiling, immune sensitivities, and/or evaluation of stromal factors.

In one arm of the study signal-sensor polynucleotides encoding either or both oncology related polypeptides, CITED4 and SHARP1 are administered where administration of either or both results in the inhibition of the transcriptome of HIF-1 alpha in cancer cells. Suppression of HIF1-alpha gene regulated expression occurs upon administration with higher suppression when both polynucleotides are administered together. Reporter constructs such as luciferase under HIF1-alpha are used in the manner similar to the methods disclosed in van de Sluis et al, (J Clin Invest. 2010; 120(6):2119-2130). It is known that both CITED4 and SHARP1 expression results in decreased HIF1-alpha and concomitant reduction in HIF1-alpha regulated gene expression. Evaluation of cell death and/or proliferation is also performed.

Additional experiments involve the use a cancer cell line where CITED4 and SHARP1 are themselves down regulated either under hypoxic conditions. Therefore a positive result demonstrates that specifically targeting the metabolic profile (in this case hypoxic-adaptations of CITED4 and SHAPR1) with replacement of native proteins via signal-sensor polynucleotides can directly impact the transcriptome and survival advantage of cancer cells with this profile. Further, the data would show that the relative impact of signal-sensor polynucleotide vs. vehicle under hypoxic conditions was more significant for cancer cells than for normal cells. (i.e., the cancer cells have a disproportionate survival advantage based on their CITED4+SHARP1 down regulation) that makes them more sensitive to the replacement of this protein then a normal cell is to overproduction of it. It is understood that a cancer cell will likely be experiencing hypoxic conditions and that a normal cell under normoxic conditions might be able to tolerate CITED4 and SHARP1 over expression because the normal cell is not dependent on HIF1alpha transcriptome for survival advantage.

In vivo experiments are performed according to the design of the in vitro experiments where the animal model is one evincing metastasis in the cancer setting because HIF-1 alpha appears to confer the largest portion of its advantage in metastasis. Animals are administered the signal-sensor polynucleotide compared to no treatment or a control polynucleotide. Animal cells, tissues and/or organs are then evaluated for alterations in gene expression profiles or transcriptome levels.

Example 15. Alteration of Signal-Sensor Polynucleotide Trafficking: NLS and NES

Two nuclear export signals (NES) which may be incorporated into the Signal-sensor polynucleotides of the present invention include those reported by Muller, et al (Traffic, 2009, 10: 514-527) and are associated with signaling via the gene COMMD1. These are NES1, PVAIIELEL (SEQ ID NO 6596) and NES2, VNQILKTLSE (SEQ ID NO 6597).

Nuclear localization signals may also be used. One such sequence is PKKKRKV (SEQ ID NO: 6598).

Cell lines or mice are administered one or more signal-sensor polynucleotides having a NLS or NES encoded therein. Upon administration the polynucleotide is trafficked to an alternate location, e.g., into the nucleus using the NLS. The oncology related polypeptide having the NLS would be trafficked to the nucleus where it would deliver either a survival or death signal to the nuclear microenvironment. Polypeptides which may be localized to the nucleus include those with altered binding properties for DNA which will function to alter the expression profile of the cell in a therapeutically beneficial manner for the cell, tissue or organism.

In one experiment, the signal-sensor polynucleotide encodes a COMMD1 mut1/mut2+NLS (e.g., both NES signals disrupted plus a NLS added) following the methods of Muller et al, (Traffic 2009; 10: 514-527) and van de Sluis et al, (J Clin Invest. 2010; 120 (6):2119-2130). The signal sequence may encode an oncology related polypeptide or a scrambled sequence which is not translatable. The signal sequence encoded would interact with HIF1-alpha to alter the transcriptome of the cancer cells.

The experiment is repeated under normal and hypoxic conditions.

Once identified the HIF1-alpha dependent signal-sensor polynucleotide is tested in cancer cell lines clonal survival or a marker of apoptosis is measured and compared to control or mock treated cells.

Example 16. Signal-Sensor Polynucleotides in the Treatment of Hepatocellular Carcinoma (HCC): Disruption of Cancer Cell Transcriptome Using the animal models outlined in Example 13, animals are treated with signal-sensor polynucleotide for MYC inhibitor D vs. negative control (untranslatable mRNA for MYC inhibitor D) vs. vehicle. For the KRas model addition of the existing transduced OmoMyc model may also be utilized. Animals are then evaluated for gene expression, tumor status or for any of the hallmarks associated with cancer phenotypes or genotypes.

Example 17. Cytoprotective Signal-Sensor Polynucleotides

Deliver one or multiple mRNA therapeutics resulting in a protein (native or non-native, intracellular or extracellular) that confers a cytoprotective advantage to normal cells in the setting of cancer therapeutics (both mRNA and non-mRNA)

Example 18. miRNA Binding Sites (BS) Useful as Sensor Sequences in Signal-Sensor Polynucleotides miRNA-binding sites are used in the 3'UTR of mRNA therapeutics to direct cytotoxic or cytoprotective mRNA therapeutics to specific cells (normal and/or cancerous).

A strong apoptotic signal (i.e., AIFsh—Apoptosis Inducing Factor short isoform, constitutively active (C.A.) caspase 6 (also known as Rev-caspase-6)—is a component of HSV1-tk—herpes simplex virus 1-thymidine kinase) is encoded as the oncology-related polypeptide or "signal" and is encoded along with a series of 3'UTR miR binding sites, such as that for mir-122a, that would make the signal-sensor polynucleotide relatively much more stable in cancerous cells than in normal cells.

Experiments comparing cancer vs. normal hepatic cell lines where the cancer cell lines have a specific miR signature are performed in vitro. SNU449 or HEP3B (human derived HCC cell lines) are used because both have been shown to have "undetectable miR-122a", whereas normal hepatocytes should have very high miR-122a levels.

A. AIFsh Encoded Polypeptide Study

First a cancer cell is selected which is sensitive to AIFsh signal-sensor polynucleotide (i.e., it results in apoptosis).

Three miR-122a binding sites are encoded into the 3'UTR of an mRNA sequence for AIFsh and the study arms include 2 cell lines (normal hepatocyte, SNU449 or HEP3B)×5 treatments (vehicle alone, signal-sensor polynucleotide untranslatable, signal-sensor polynucleotide AIFsh (no miR BS in 3'UTR), 3'UTR[miR122a BS×3]-signal-sensor polynucleotide untranslatable, 3'UTR[miR122a BS×3]-signal-sensor polynucleotide AIFsh).

The expected result would be significant apoptosis in the face of signal-sensor polynucleotide AIFsh in both normal and cancer (HEP3B or SNU449) cell lines in the absence of any 3'UTR-miR122a BS. However, a significant difference in the relative apoptosis of normal vs. cancer cell lines in the face of 3'UTR [miR122a BS×3]-signal-sensor polynucleotide AIFsh.

Reversibility of the effect is shown with the co-administration of miR122a to the cancer cell line (e.g., through some transduction of the miR122a activity back into the cancer cell line).

B. C.A. Caspase 6 Encoded Polypeptide Study

First a cancer cell is selected which is sensitive to C.A. caspase 6 signal-sensor polynucleotide (i.e., it results in apoptosis).

Three miR-122a binding sites are encoded into the 3'UTR of an mRNA sequence for C.A. caspase 6 and the study arms include 2 cell lines (normal hepatocyte, SNU449 or HEP3B)×5 treatments (vehicle alone, signal-sensor polynucleotide untranslatable, signal-sensor polynucleotide C.A. caspase 6 (no miR BS in 3'UTR), 3'UTR[miR122a BS×3]-signal-sensor polynucleotide untranslatable, 3'UTR [miR122a BS×3]-signal-sensor polynucleotide C.A. caspase 6).

The expected result would be significant apoptosis in the face of signal-sensor polynucleotide C.A. caspase 6 in both normal and cancer (HEP3B or SNU449) cell lines in the absence of any 3'UTR-miR122a BS. However, a significant difference in the relative apoptosis of normal vs. cancer cell lines in the face of 3'UTR [miR122a BS×3]-signal-sensor polynucleotide C.A. caspase 6.

C. HSV1-Tk Encoded Polypeptide Study

First a cancer cell is selected which is sensitive to HSV1-tk signal-sensor polynucleotide (i.e., it results in apoptosis).

Three miR-122a binding sites are encoded into the 3'UTR of an mRNA sequence for HSV1-tk and the study arms include 2 cell lines (normal hepatocyte, SNU449 or HEP3B)×5 treatments (vehicle alone, signal-sensor polynucleotide untranslatable, signal-sensor polynucleotide HSV1-tk (no miR BS in 3'UTR), 3'UTR[miR122a BS×3]- signal-sensor polynucleotide untranslatable, 3'UTR [miR122a BS×3]-signal-sensor polynucleotide HSV1-tk).

The expected result would be significant apoptosis in the face of signal-sensor polynucleotide HSV1-tk in both normal and cancer (HEP3B or SNU449) cell lines in the absence of any 3'UTR-miR122a BS. However, a significant difference in the relative apoptosis of normal vs. cancer cell lines in the face of 3'UTR [miR122a BS×3]-signal-sensor polynucleotide HSV1-tk.

Reversibility of the effect is shown with the co-administration of miR122a to the cancer cell line (e.g., through some transduction of the miR122a activity back into the cancer cell line).

D. In Vivo Study of Signal-Sensor Polynucleotides

In vivo animal studies are performed for AIFsh, C.A. caspase 6 and HSV1-tk using any of the models disclosed herein or a commercially available orthotopic HCC model.

Example 19. Expression of Modified Nucleic Acid with microRNA Binding Site

Human embryonic kidney epithelial cells (HEK293A) and primary human hepatocytes (Hepatocytes) were seeded at a density of 200,000 per well in 500 ul cell culture medium (InVitro GRO medium from Celsis, Chicago, Ill.). G-CSF mRNA having an alpha-globin 3'UTR (G-CSF alpha) (mRNA sequence is shown in SEQ ID NO: 6599; polyA tail of approximately 160 nucleotides not shown in sequence; 5'Cap, Cap1; fully modified with 5-methylcytidine and pseudouridine) G-CSF mRNA having an alpha-globin 3'UTR and a miR-122 binding site (G-CSF miR-122) (mRNA sequence is shown in SEQ ID NO: 6600; polyA tail of approximately 160 nucleotides not shown in sequence; 5'Cap, Cap1; fully modified with 5-methylcytidine and pseudouridine) or G-CSF mRNA having an alpha-globin 3'UTR with four miR-122 binding sites with the seed deleted (G-CSF no seed) (mRNA sequence is shown in SEQ ID NO: 6601; polyA tail of approximately 160 nucleotides not shown in sequence; 5'Cap, Cap1; fully modified with 5-methylcytidine and pseudouridine) was tested at a concentration of 250 ng per well in 24 well plates. The expression of G-CSF was measured by ELISA and the results are shown in Table 14.

TABLE 14 miR-122 Binding Sites

| | HEK293A Protein Expression (ng/mL) | Hepatocytes Protein Expression (ng/mL) |
| --- | --- | --- |
| G-CSF alpha | 99.85 | 8.18 |
| G-CSF miR-122 | 87.67 | 0 |
| G-CSF no seed | 200.2 | 8.05 |

Since HEK293 cells do not express miR-122 there was no down-regulation of G-CSF protein from the sequence containing miR-122. Whereas, the human hepatocytes express high levels of miR-122 and there was a drastic down-regulation of G-CSF protein observed when the G-CSF sequence contained the miR-122 target sequence. Consequently, the mRNA functioned as an auxotrophic mRNA.

Example 20. MYC Inhibitor D Study in Cell Lines

Cell lines of liver and lung cancer, such as those described herein, are transfected with MYC inhibitor D modified mRNA in saline or formulated as described herein or in International Application No PCT/US2012/69610, herein incorporated by reference in its entirety. To evaluate the selectivity and/or the effects of therapy with MYC inhibitor D modified mRNA, normal hepatocytes are also transfected with the MYC inhibitor D modified mRNA.

Example 21. Formulation of Signal-Sensor Polynucleotides

Signal-sensor polynucleotides are formulated in lipid nanoparticles as described herein, known in the art, and/or as described in International Application No PCT/US2012/69610, herein incorporated by reference in its entirety. For tumor delivery, the lipid nanoparticle formulations are adapted for efficient delivery prior to in vitro or in vivo administration. For targeted delivery and/or to reduce toxicity the signal-senor polynucleotides include at least one miR binding site.

The lipid nanoparticle formulations are administered by methods known in the art or described herein (e.g., intravenous, intramuscular and/or intranasal) to liver and lung cancer models (e.g., those described herein and subcutaneous human xenografts in mice, orthotopic human xenografts in mice and transgenic/genetically engineered mouse models).

Example 22. Delivery of Signal-Sensor Polynucleotides to Mammals

Signal-sensor polynucleotides are formulated for in vivo delivery in a lung and/or liver cancer model (e.g., those described herein). The signal-sensor polynucleotides are formulated in lipid nanoparticles as described herein, known in the art and/or described in International Application No PCT/US2012/69610, herein incorporated by reference in its entirety.

The lung and/or liver cancer models are analyzed for protein expression, apoptosis, toxicity, efficacy through tumor volume, liver enzyme levels and effect on tumor tissue to evaluate the effect of administration of the formulated signal-sensor polynucleotides on the lung and/or liver cancer models. Assays are used to evaluate protein expression of the signal-sensor polynucleotides. Apoptosis, toxicity, efficacy through tumor volume, liver enzyme levels and tumor tissue are evaluate using common methods known in the art.

Example 23. Dose Response

Nanoparticle formulations of 98N12-5 (NPA-005) and DLin-KC2-DMA (NPA-003) were tested at varying concentrations to determine the MFI of FL4 or mCherry (mRNA sequence shown in SEQ ID NO: 6602; polyA tail of approximately 160 nucleotides not shown in sequence; 5' cap, Cap1; fully modified with 5-methylcytidine and pseudouridine) over a range of doses. The formulations tested are outlined in Table 15. To determine the optimal concentration of nanoparticle formulations of 98N12-5, varying concentrations of formulated modified RNA (100 ng, 10 ng, 1.0 ng, 0.1 ng and 0.01 ng per well) were tested in a 24-well plate of HEK293.

Human embryonic kidney epithelial (HEK293) (LGC standards GmbH, Wesel, Germany) were seeded on 96-well plates (Greiner Bio-one GmbH, Frickenhausen, Germany) and plates were precoated with collagen type1. HEK293 were seeded at a density of 30,000 cells per well in 100 μl cell culture medium. The cell culture medium was DMEM, 10% FCS, adding 2 mM L-Glutamine, 1 mM Sodiumpyruvate and 1× non-essential amino acids (Biochrom AG, Berlin, Germany) and 1.2 mg/ml Sodiumbicarbonate (Sigma-Aldrich, Munich, Germany). Formulations containing mCherry mRNA were added in quadruplicates directly after seeding the cells and incubated.

Cells were harvested by transferring the culture media supernatants to a 96-well Pro-Bind U-bottom plate (Beckton Dickinson GmbH, Heidelberg, Germany). Cells were trypsinized with ½ volume Trypsin/EDTA (Biochrom AG, Berlin, Germany), pooled with respective supernatants and fixed by adding one volume PBS/2% FCS (both Biochrom AG, Berlin, Germany)/0.5% formaldehyde (Merck, Darmstadt, Germany). Samples then were submitted to a flow cytometer measurement with a 532 nm excitation laser and the 610/20 filter for PE-Texas Red in a LSRII cytometer (Beckton Dickinson GmbH, Heidelberg, Germany). The mean fluorescence intensity (MFI) of all events were analyzed and the results of the FL4 MFI of each dose are shown in Table 16. Likewise, to determine the optimal concentration of nanoparticle formulations of DLin-KC2-DMA, varying concentrations of formulated modified RNA (250 ng 100 ng, 10 ng, 1.0 ng, 0.1 ng and 0.01 ng per well) were tested in a 24-well plate of HEK293, and the results of the FL4 MFI of each dose are shown in Table 17. Nanoparticle formulations of DLin-KC2-DMA were also tested at varying concentrations of formulated modified RNA (250 ng, 100 ng and 30 ng per well) in a 24 well plate of HEK293, and the results of the FL4 MFI of each dose are shown in Table 18. A dose of 1 ng/well for 98N12-5 and a dose of 10 ng/well for DLin-KC2-DMA were found to resemble the FL4 MFI of the background.

To determine how close the concentrations resembled the background, we utilized a flow cytometer with optimized filter sets for detection of mCherry expression, and were able to obtain results with increased sensitivity relative to background levels. Doses of 25 ng/well, 0.25 ng/well, 0.025 ng/well and 0.0025 ng/well were analyzed for 98N12-5 (NPA-005) and DLin-KC2-DMA (NPA-003) to determine the MFI of mCherry. As shown in Table 19, the concentration of 0.025 ng/well and lesser concentrations are similar to the background MFI level of mCherry which is about 386.125.

TABLE 15

Formulations

| Formulation # | NPA-003 | NPA-005 |
| --- | --- | --- |
| Lipid | DLin-KC2-DMA | 98N12-5 |
| Lipid/RNA wt/wt | 20 | 15 |
| Mean size | 114 nm PDI: 0.08 | 106 nm PDI: 0.12 |

TABLE 16

HEK293, NPA-005, 24-well, n = 4

| Formulation | FL4 MFI |
| --- | --- |
| Untreated control | 0.246 |
| NPA-005 100 ng | 2.2175 |
| NPA-005 10 ng | 0.651 |
| NPA-005 1.0 ng | 0.28425 |

TABLE 16-continued

HEK293, NPA-005, 24-well, n = 4

| Formulation | FL4 MFI |
| --- | --- |
| NPA-005 0.1 ng | 0.27675 |
| NPA-005 0.01 ng | 0.2865 |

TABLE 17

HEK293, NPA-003, 24-well, n = 4

| Formulation | FL4 MFI |
| --- | --- |
| Untreated control | 0.3225 |
| NPA-003 250 ng | 2.9575 |
| NPA-003 100 ng | 1.255 |
| NPA-003 10 ng | 0.40025 |
| NPA-003 1 ng | 0.33025 |
| NPA-003 0.1 ng | 0.34625 |
| NPA-003 0.01 ng | 0.3475 |

TABLE 18

HEK293, NPA-003, 24-well, n = 4

| Formulation | FL4 MFI |
| --- | --- |
| Untreated control | 0.27425 |
| NPA-003 250 ng | 5.6075 |
| NPA-003 100 ng | 3.7825 |
| NPA-003 30 ng | 1.5525 |

TABLE 19

Concentration and MFI

| | MFI mCherry | |
| --- | --- | --- |
| Formulation | NPA-003 | NPA-005 |
| 25 ng/well | 11963.25 | 12256.75 |
| 0.25 ng/well | 1349.75 | 2572.75 |
| 0.025 ng/well | 459.50 | 534.75 |
| 0.0025 ng/well | 310.75 | 471.75 |

Example 24. LNP Formulations

Formulations of DLin-DMA, DLin-K-DMA, DLin-KC2-DMA, 98N12-5, C12-200 and DLin-MC3-DMA were incubated at a concentration of 60 ng/well or 62.5 ng/well in a plate of HEK293 and 62.5 ng/well in a plate of HepG2 cells for 24 hours to determine the MFI of mCherry (mRNA sequence shown in SEQ ID NO: 6602; polyA tail of approximately 160 nucleotides not shown in sequence; 5' cap, Cap1; fully modified with 5-methylcytidine and pseudouridine) for each formulation.

Human embryonic kidney epithelial (HEK293) and hepatocellular carcinoma epithelial (HepG2) cells (LGC standards GmbH, Wesel, Germany) were seeded on 96-well plates (Greiner Bio-one GmbH, Frickenhausen, Germany) and plates for HEK293 cells were precoated with collagen type1. HEK293 were seeded at a density of 30,000 and HepG2 were seeded at a density of 35,000 cells per well in 100 µl cell culture medium. For HEK293 the cell culture medium was DMEM, 10% FCS, adding 2 mM L-Glutamine, 1 mM Sodiumpyruvate and 1× non-essential amino acids (Biochrom AG, Berlin, Germany) and 1.2 mg/ml Sodiumbicarbonate (Sigma-Aldrich, Munich, Germany) and for HepG2 the culture medium was MEM (Gibco Life Technologies, Darmstadt, Germany), 10% FCS adding 2 mM L-Glutamine, 1 mM Sodiumpyruvate and 1× non-essential amino acids (Biochrom AG, Berlin, Germany. Formulations containing mCherry mRNA (mRNA sequence shown in SEQ ID NO: 6602; polyA tail of approximately 160 nucleotides not shown in sequence; 5' cap, Cap1); were added in quadruplicates directly after seeding the cells and incubated. The mCherry cDNA with the T7 promoter, 5' untranslated region (UTR) and 3' UTR used in in vitro transcription (IVT) is given in SEQ ID NO: 6603. The mCherry mRNA was modified with 5meC at each cytidine and pseudouridine replacement at each uridine site.

Cells were harvested by transferring the culture media supernatants to a 96-well Pro-Bind U-bottom plate (Beckton Dickinson GmbH, Heidelberg, Germany). Cells were trypsinized with ½ volume Trypsin/EDTA (Biochrom AG, Berlin, Germany), pooled with respective supernatants and fixed by adding one volume PBS/2% FCS (both Biochrom AG, Berlin, Germany)/0.5% formaldehyde (Merck, Darmstadt, Germany). Samples then were submitted to a flow cytometer measurement with a 532 nm excitation laser and the 610/20 filter for PE-Texas Red in a LSRII cytometer (Beckton Dickinson GmbH, Heidelberg, Germany). The mean fluorescence intensity (MFI) of all events was determined.

The formulations tested are outlined in Table 20 below. As shown in Table 21 for the 60 ng/well and Tables 22, 23, 24 and 25 for the 62.5 ng/well, the formulation of NPA-003 and NPA-018 have the highest mCherry MFI and the formulations of NPA-008, NPA-010 and NPA-013 are most the similar to the background sample mCherry MFI value.

TABLE 20

| Formulation # | Lipid | Lipid/RNA wt/wt | Mean size (nm) |
|---|---|---|---|
| NPA-001 | DLin-KC2-DMA | 10 | 155 nm PDI: 0.08 |
| NPA-002 | DLin-KC2-DMA | 15 | 140 nm PDI: 0.11 |
| NPA-002-2 | DLin-KC2-DMA | 15 | 105 nm PDI: 0.04 |
| NPA-003 | DLin-KC2-DMA | 20 | 114 nm PDI: 0.08 |
| NPA-003-2 | DLin-KC2-DMA | 20 | 95 nm PDI: 0.02 |
| NPA-005 | 98N12-5 | 15 | 127 nm PDI: 0.12 |
| NPA-006 | 98N12-5 | 20 | 126 nm PDI: 0.08 |
| NPA-007 | DLin-DMA | 15 | 148 nm PDI: 0.09 |
| NPA-008 | DLin-K-DMA | 15 | 121 nm PDI: 0.08 |
| NPA-009 | C12-200 | 15 | 138 nm PDI: 0.15 |
| NPA-010 | DLin-MC3-DMA | 15 | 126 nm PDI: 0.09 |
| NPA-012 | DLin-DMA | 20 | 86 nm PDI: 0.08 |
| NPA-013 | DLin-K-DMA | 20 | 104 nm PDI: 0.03 |
| NPA-014 | C12-200 | 20 | 101 nm PDI: 0.06 |
| NPA-015 | DLin-MC3-DMA | 20 | 109 nm PDI: 0.07 |

TABLE 21

HEK293, 96-well, 60 ng Modified RNA/well

| Formulation | MFI mCherry |
|---|---|
| Untreated | 871.81 |
| NPA-001 | 6407.25 |
| NPA-002 | 14995 |
| NPA-003 | 29499.5 |
| NPA-005 | 3762 |
| NPA-006 | 2676 |
| NPA-007 | 9905.5 |
| NPA-008 | 1648.75 |
| NPA-009 | 2348.25 |
| NPA-010 | 4426.75 |
| NPA-012 | 11466 |
| NPA-013 | 2098.25 |
| NPA-014 | 3194.25 |
| NPA-015 | 14524 |

TABLE 22

HEK293, 62.5 ng/well

| Formulation | MFI mCherry |
|---|---|
| Untreated | 871.81 |
| NPA-001 | 6407.25 |
| NPA-002 | 14995 |
| NPA-003 | 29499.5 |
| NPA-005 | 3762 |
| NPA-006 | 2676 |
| NPA-007 | 9905.5 |
| NPA-008 | 1648.75 |
| NPA-009 | 2348.25 |
| NPA-010 | 4426.75 |
| NPA-012 | 11466 |
| NPA-013 | 2098.25 |
| NPA-014 | 3194.25 |
| NPA-015 | 14524 |

TABLE 23

HEK293, 62.5 ng/well

| Formulation | MFI mCherry |
|---|---|
| Untreated | 295 |
| NPA-007 | 3504 |
| NPA-012 | 8286 |
| NPA-017 | 6128 |
| NPA-003-2 | 17528 |
| NPA-018 | 34142 |
| NPA-010 | 1095 |
| NPA-015 | 5859 |
| NPA-019 | 3229 |

TABLE 24

HepG2, 62.5 ng/well

| Formulation | MFI mCherry |
|---|---|
| Untreated | 649.94 |
| NPA-001 | 6006.25 |
| NPA-002 | 8705 |
| NPA-002-2 | 15860.25 |
| NPA-003 | 15059.25 |
| NPA-003-2 | 28881 |
| NPA-005 | 1676 |
| NPA-006 | 1473 |
| NPA-007 | 15678 |
| NPA-008 | 2976.25 |
| NPA-009 | 961.75 |

TABLE 24-continued

HepG2, 62.5 ng/well

| Formulation | MFI mCherry |
|---|---|
| NPA-010 | 3301.75 |
| NPA-012 | 18333.25 |
| NPA-013 | 5853 |
| NPA-014 | 2257 |
| NPA-015 | 16225.75 |

TABLE 25

HepG2, 62.5 ng/well

| Formulation | MFI mCherry |
|---|---|
| Untreated control | 656 |
| NPA-007 | 16798 |
| NPA-012 | 21993 |
| NPA-017 | 20377 |
| NPA-003-2 | 35651 |
| NPA-018 | 40154 |
| NPA-010 | 2496 |
| NPA-015 | 19741 |
| NPA-019 | 16373 |

Example 25. LNP In Vivo Studies mCherry mRNA (SEQ ID NO: 6604; polyA tail of approximately 160 nucleotides not shown in sequence; 5' cap, Cap1; fully modified with 5-methylcytidine and pseudouridine) was formulated as a lipid nanoparticle (LNP) using the syringe pump method. The LNP was formulated at a 20:1 weight ratio of total lipid to modified mRNA with a final lipid molar ratio of 50:10:38.5:1.5 (DLin-KC2-DMA: DSPC: Cholesterol: PEG-c-DOMG). The mCherry formulation, listed in Table 26, was characterized by particle size, zeta potential, and encapsulation.

TABLE 26 mCherry Formulation

| Formulation # | NPA-003-5 |
|---|---|
| Modified mRNA | mCherry |
| Mean size | 105 nm |
|  | PDI: 0.09 |
| Zeta at pH 7.4 | 1.8 mV |
| Encaps. (RiboGr) | 100% |

The LNP formulation was administered to mice (n=5) intravenously at a modified mRNA dose of 100 ug. Mice were sacrificed at 24 hrs after dosing. The liver and spleen from the mice administered with mCherry modified mRNA formulations were analyzed by immunohistochemistry (IHC), western blot, or fluorescence-activated cell sorting (FACS).

Histology of the liver showed uniform mCherry expression throughout the section, while untreated animals did not express mCherry. Western blots were also used to confirm mCherry expression in the treated animals, whereas mCherry was not detected in the untreated animals. Tubulin was used as a control marker and was detected in both treated and untreated mice, indicating that normal protein expression in hepatocytes was unaffected.

FACS and IHC were also performed on the spleens of mCherry and untreated mice. All leukocyte cell populations were negative for mCherry expression by FACS analysis. By IHC, there were also no observable differences in the spleen in the spleen between mCherry treated and untreated mice.

Example 26. Titration of the Binding Affinity Between Two Cofactors

Experiments are conducted in order to titrate the binding affinity between two cofactors. As used herein, the term "titrate" refers to a method whereby one or more factors are introduced systematically (such as at increasing levels or wherein the one or more factors are systematically modified) to a solution, scenario or series thereof in order to assess a property of interest. In this embodiment, the property of interest is the binding affinity between two cofactors. In one embodiment, constructs encoding the two cofactors are obtained and/or synthesized and a series of mutant constructs are prepared and/or synthesized. Mutant constructs encode cofactor mutants that may include truncated mutants (mutant proteins lacking one or more amino acids from either the N- or C-terminal domains), mutants with regional deletions [proteins wherein internal regions (comprising one or more amino acids) of the protein are absent], mutants with single amino acid substitutions (wherein a normally expressed amino acid is replaced with an alternative amino acid), mutants with one or more additional amino acids added internally or at either terminus, mutants with regional substitutions [proteins wherein internal regions (comprising one or more amino acids) of the protein are substituted with alternative regions (comprising one or more amino acids) and/or combinations of any of these. Mutant constructs are mutated randomly or subjected to targeted mutation based on existing knowledge of the molecular interactions necessary for binding between the two cofactors being investigated.

In some embodiments, a series of mutant proteins are designed such that the mutations follow a progressive pattern along the polypeptide chain. Such series may allow for a better understanding of a particular aspect or feature of the interaction between cofactors. A mutant series may include, for example, the production of a series of mutants, each with a single amino acid substitution, wherein each mutant has a different amino acid along it's polypeptide sequence mutated (e.g. alanine is substituted, thereby eliminating the influence of an amino acid side chain at each position). In another example, a series of mutants are designed such that the mutants in the series comprise truncations of increasing size. In another example, amino acids capable of being post-translationally modified (e.g. phosphorylated, acetylated, ubiquitinated, glycosylated, etc.) in a similar manner may be mutated along the polypeptide sequence in a series of mutants.

For titration experiments with mutant cofactors, a baseline affinity between the two cofactors is established by combining both cofactors under conditions favorable for binding and the binding affinity between the cofactors is assayed. Binding affinity may be assessed using any of a variety of methods known in the art. Such methods may include, but are not limited to Western blot analysis, immunoprecipitation, enzyme-linked immunosorbent assay (ELISA), fluorescence resonance energy transfer (FRET), fluorescence recovery after photobleaching (FRAP), fluorescence polarization technologies and/or surface plasmon resonance (SPR) based technologies. For titration, according to one method, a mutant series of one or both cofactors are combined with the two unmutated cofactors (to allow for binding competition between the wild type and mutated proteins). Changes in affinity between the two cofactors in the presence of increasing concentrations of different mutants are assessed and compared and/or plotted against the specific mutations present in the series of mutants that are competing for binding. Alternatively, mutant cofactors in a series are individually combined with a corresponding unmutated binding partner and assessed for binding affinity. Increasing concentrations of the wild type cofactor (corresponding to the mutant cofactor) are introduced and changes in binding between the mutant cofactors and the corresponding unmutated binding partner are assessed. Comparisons are made between the resulting binding curves and the binding curves of other mutants tested.

In some embodiments, titration of the binding affinity between two cofactors is assessed in the presence or absence of increasing concentrations of a third factor. Such a third factor may be an inhibitor or activator of binding between the two cofactors. A series of mutants, as described above, may be generated for a third factor and such a series may be used in titration experiments to assess the effect of mutations on binding between the two cofactors.

Information obtained from titration experiments may be used to design modified mRNA molecules to encode factors that modulate the interaction between cofactors.

In some embodiments, titration experiments are carried out wherein the binding affinity between HIF1 subunits (HIF1-alpha, HIF2-alpha and ARNT) and/or mutated HIF1 subunits and/or other proteins that interact with HIF1 is assessed. Titration experiments may utilize mutant series generated using constructs for one or more of HIF1-alpha, HIF2-alpha, ARNT and/or a third interacting factor. In some embodiments, a mutant series is generated for HIF1-alpha. HIF1-alpha and HIF2-alpha are hydroxylated by HIF hydroxylase enzymes under normal levels of oxygen in the cell, facilitating degradation and/or blocking transcriptional activity. Hydroxylation decreases as oxygen levels drop, allowing HIF1-alpha and/or HIF2-alpha to associate with their cofactor, ARNT leading to elevated expression of genes comprising HIF-response elements (HREs) (Keith, B. et al., HIF1α and HIF2α: sibling rivalry in hypoxic tumour growth and progression. Nat Rev Cancer. 2011 Dec. 15; 12(1):9-22).

In one embodiment, HIF1-alpha mutant series are generated wherein mutations in the series progressively eliminate one or more hydroxylation sites along the polypeptide chain (including, but not limited to proline 402, proline 564 and/or asparagine 803), thereby modulating stability and/or transcriptional activity in mutant versions of HIF1-alpha. In another embodiment, an alternative cofactor, HIF2-alpha is used to generate a mutant series. Such a mutant series may progressively eliminate one or more hydroxylation sites along the polypeptide chain (including, but not limited to proline 405, proline 531 and/or asparagine 847), thereby modulating stability and/or transcriptional activity in mutant versions of HIF2-alpha. In another embodiment, HIF1-alpha and/or HIF2-alpha mutant series are generated that progressively mutate regions necessary for interaction with ARNT, thereby creating mutants with altered abilities to bind ARNT and modulate HIF-dependent gene expression. In another embodiment, ARNT mutant series are generated that progressively mutate regions necessary for interactions with other HIF subunits, thereby creating mutants with altered abilities to bind HIF subunits and modulate HIF-dependent gene expression.

In some embodiments, mutant series are generated for Von Hippel-Landau tumor suppressor protein (pVHL). This protein binds hydroxylated HIF1-alpha and HIF2-alpha, facilitating their ubiquitination and degradation. In one embodiment, mutant series are generated that progressively mutate regions necessary for interaction with HIF1 subunits, thereby creating mutants with altered abilities to bind HIF1 subunits and modulate HIF-dependent gene expression.

Shown in Table 27 and 28 are the transcript sequences and polypeptide sequences (respectively) for protein targets for use in titration experiments. The name and description of the gene encoding the polypeptide of interest are accompanied by the ENSEMBL Transcript ID (ENST) and transcript sequence (Table 27) or the ENSEMBL Protein ID (ENSP) and peptide sequence (Table 28). In some embodiments of the present invention, modified mRNAs may be designed to encode factors that modulate the affinity between HIF subunits and/or HIF-dependent gene expression. Such modified mRNAs may be designed using knowledge gained from titration experiments.

TABLE 27

Transcript sequences for additional targets for titration experiments

| Target | Target Description | ENST ID | Transcript Sequence | SEQ ID NO |
|---|---|---|---|---|
| HIF2-alpha | hypoxia inducible factor 2, alpha subunit; endothelial PAS domain protein 1 | 263734 | GCTTTACACTCGCGAGCGGACCGCCACACGG GTCCGGTGCCCGCTGCGCTTCCGCCCCAGCGC TCCTGAGGCGGCCGTACAATCCTCGGCAGTGT CCTGAGACTGTATGGTCAGCTCAGCCCGGCCT CCGACTCCTTCCGACTCCCAGCATTCGAGCCA CTTTTTTTTTCTTTGAAAACTCAGAAAAGTG ACTCCTTTTCCAGGGAAAAAGGAACTTGGGTT CCCTTCTCTCCGTCCTCTTTTCGGGTCTGACAG CCTCCACCCACTCCTTCCCCGGACCCCGCCTC CGCGCGCAGGTTCCTCCCAGTCACCTTTCTCC ACCCCCGCCCCCGCACCTAGCCCGCCGCGCG CCACCTTCCACCTGACTGCGCGGGGCGCTCGG GACCTGCGCGCACCTCGGACCTTCACCACCCG CCCGGGCCGCGGGGAGCGGACGAGGGCCACA GCCCCCCACCCGCCAGGGAGCCCAGGTGCTC GGCGTCTGAACGTCTCAAAGGGCCACAGCGA CAATGACAGCTGACAAGGAGAAGAAAAGGA GTAGCTCGGAGAGGAGGAAGGAGAAGTCCCG GGATGCTGCGCGGTGCCGGCGGAGCAAGGAG ACGGAGGTGTTCTATGAGCTGGCCCATGAGC | 6605 |

TABLE 27-continued

Transcript sequences for additional targets for titration experiments

| Target | Target Description | ENST ID | Transcript Sequence | SEQ ID NO |
|---|---|---|---|---|
| | | | TGCCTCTGCCCCACAGTGTGAGCTCCCATCTG GACAAGGCCTCCATCATGCGACTGGCAATCA GCTTCCTGCGAACACACAAGCTCCTCTCCTCA GTTTGCTCTGAAAACGAGTCCGAAGCCGAAG CTGACCAGCAGATGGACAACTTGTACCTGAA AGCCTTGGAGGGTTTCATTGCCGTGGTGACCC AAGATGGCGACATGATCTTTCTGTCAGAAAA CATCAGCAAGTTCATGGGACTTACACAGGTG GAGCTAACAGGACATAGTATCTTTGACTTCAC TCATCCCTGCGACCATGAGGAGATTCGTGAG AACCTGAGTCTCAAAAATGGCTCTGGTTTTGG GAAAAAAAGCAAAGACATGTCCACAGAGCG GGACTTCTTCATGAGGATGAAGTGCACGGTC ACCAACAGAGGCCGTACTGTCAACCTCAAGT CAGCCACCTGGAAGGTCTTGCACTGCACGGG CCAGGTGAAAGTCTACAACAACTGCCCTCCTC ACAATAGTCTGTGTGGCTACAAGGAGCCCCT GCTGTCCTGCCTCATCATCATGTGTGAACCAA TCCAGCACCCATCCCACATGGACATCCCCCTG GATAGCAAGACCTTCCTGAGCCGCCACAGCA TGGACATGAAGTTCACCTACTGTGATGACAG AATCACAGAACTGATTGGTTACCACCCTGAG GAGCTGCTTGGCCGCTCAGCCTATGAATTCTA CCATGCGCTAGACTCCGAGAACATGACCAAG AGTCACCAGAACTTGTGCACCAAGGGTCAGG TAGTAAGTGGCCAGTACCGGATGCTCGCAAA GCATGGGGCTACGTGTGGCTGGAGACCCAG GGGACGGTCATCTACAACCCTCGCAACCTGC AGCCCCAGTGCATCATGTGTGTCAACTACGTC CTGAGTGAGATTGAGAAGAATGACGTGGTGT TCTCCATGGACCAGACTGAATCCCTGTTCAAG CCCCACCTGATGGCCATGAACAGCATCTTTGA TAGCAGTGGCAAGGGGGCTGTGTCTGAGAAG AGTAACTTCCTATTCACCAAGCTAAAGGAGG AGCCCGAGGAGCTGGCCCAGCTGGCTCCCAC CCCAGGAGACGCCATCATCTCTCTGGATTTCG GGAATCAGAACTTCGAGGAGTCCTCAGCCTA TGGCAAGGCCATCCTGCCCCCGAGCCAGCCA TGGGCCACGGAGTTGAGGAGCCACAGCACCC AGAGCGAGGCTGGGAGCCTGCCTGCCTTCAC CGTGCCCCAGGCAGCTGCCCCGGGCAGCACC ACCCCCAGTGCCACCAGCAGCAGCAGCAGCT GCTCCACGCCCAATAGCCCTGAAGACTATTAC ACATCTTTGGATAACGACCTGAAGATTGAAG TGATTGAGAAGCTCTTCGCCATGGACACAGA GGCCAAGGACCAATGCAGTACCCAGACGGAT TTCAATGAGCTGGACTTGGAGACACTGGCAC CCTATATCCCCATGGACGGGGAAGACTTCCA GCTAAGCCCCATCTGCCCCGAGGAGCGGCTC TTGGCGGAGAACCCACAGTCCACCCCCCAGC ACTGCTTCAGTGCCATGACAAACATCTTCCAG CCACTGGCCCCTGTAGCCCCGCACAGTCCCTT CCTCCTGGACAAGTTTCAGCAGCAGCTGGAG AGCAAGAAGACAGAGCCCGAGCACCGGCCCA TGTCCTCCATCTTCTTTGATGCCGGAAGCAAA GCATCCCTGCCACCGTGCTGTGGCCAGGCCA GCACCCCTCTCTCTTCCATGGGGGGCAGATCC AATACCCAGTGGCCCCCAGATCCACCATTAC ATTTTGGGCCCACAAAGTGGGCCGTCGGGGA TCAGCGCACAGAGTTCTTGGGAGCAGCGCCG TTGGGGCCCCCTGTCTCTCCACCCCATGTCTC CACCTTCAAGACAAGGTCTGCAAAGGGTTTT GGGGCTCGAGGCCCAGACGTGCTGAGTCCGG CCATGGTAGCCCTCTCCAACAAGCTGAAGCT GAAGCGACAGCTGGAGTATGAAGAGCAAGCC TTCCAGGACCTGAGCGGGGGGGACCCACCTG GTGGCAGCACCTCACATTTGATGTGGAAACG GATGAAGAACCTCAGGGGTGGGAGCTGCCCT TTGATGCCGGACAAGCCACTGAGCGCAAATG TACCCAATGATAAGTTCACCCAAAACCCCAT GAGGGGCCTGGGCCATCCCCTGAGACATCTG CCGCTGCCACAGCCTCCATCTGCCATCAGTCC CGGGGAGAACAGCAAGAGCAGGTTCCCCCCA | |

TABLE 27-continued

Transcript sequences for additional targets for titration experiments

| Target | Target Description | ENST ID | Transcript Sequence | SEQ ID NO |
|---|---|---|---|---|
| | | | CAGTGCTACGCCACCCAGTACCAGGACTACA | |
| | | | GCCTGTCGTCAGCCCACAAGGTGTCAGGCAT | |
| | | | GGCAAGCCGGCTGCTCGGGCCCTCATTTGAGT | |
| | | | CCTACCTGCTGCCCGAACTGACCAGATATGAC | |
| | | | TGTGAGGTGAACGTGCCCGTGCTGGGAAGCT | |
| | | | CCACGCTCCTGCAAGGAGGGGACCTCCTCAG | |
| | | | AGCCCTGGACCAGGCCACCTGAGCCAGGCCT | |
| | | | TCTACCTGGGCAGCACCTCTGCCGACGCCGTC | |
| | | | CCACCAGCTTCACTCTCTCCGTCTGTTTTTGCA | |
| | | | ACTAGGTATTTCTAACGCCAGCACACTATTTA | |
| | | | CAAGATGGACTTACCTGGCAGACTTGCCCAG | |
| | | | GTCACCAAGCAGTGGCCTTTTTCTGAGATGCT | |
| | | | CACTTTATTATCCCTATTTTTAAAGTACACAA | |
| | | | TTGTTTTACCTGTTCTGAAATGTTCTTAAATTT | |
| | | | TGTAGGATTTTTTTCCTCCCCACCTTCAATGA | |
| | | | CTTCTAATTTATATTATCCATAGGTTTCTCTCC | |
| | | | CTCCTTCTCCTTCTCACACACAACTGTCCATA | |
| | | | CTAACAAGTTTGGTGCATGTCTGTTCTTCTGT | |
| | | | AGGGAGAAGCTTTAGCTTCATTTTACTAAAAA | |
| | | | GATTCCTCGTTATTGTTGTTGCCAAAGAGAAA | |
| | | | CAAAAATGATTTTGCTTTCCAAGCTTGGTTTG | |
| | | | TGGCGTCTCCCTCGCAGAGCCCTTCTCGTTTC | |
| | | | TTTTTTAAACTAATCACCATATTGTAAATTTC | |
| | | | AGGGTTTTTTTTTTTTGTTTAAGCTGACTCTT | |
| | | | TGCTCTAATTTTGGAAAAAAAGAAATGTGAA | |
| | | | GGGTCAACTCCAACGTATGTGGTTATCTGTGA | |
| | | | AAGTTGCACAGCGTGGCTTTTCCTAAACTGGT | |
| | | | GTTTTTCCCCCGCATTTGGTGGATTTTTTATTA | |
| | | | TTATTCAAAAACATAACTGAGTTTTTTAAAAG | |
| | | | AGGAGAAAATTTATATCTGGGTTAAGTGTTTA | |
| | | | TCATATATATGGGTACTTTGTAATATCTAAAA | |
| | | | ACTTAGAAACGGAAATGGAATCCTGCTCACA | |
| | | | AAATCACTTTAAGATCTTTTCGAAGCTGTTAA | |
| | | | TTTTTCTTAGTGTTGTGGACACTGCAGACTTG | |
| | | | TCCAGTGCTCCCACGGCCTGTACGGACACTGT | |
| | | | GGAAGGCCTCCCTCTGTCGGCTTTTTGCCATC | |
| | | | TGTGATATGCCATAGGTGTGACAATCCGAGC | |
| | | | AGTGGAGTCATTCAGCGGGAGCACTGCGCGC | |
| | | | TATCCCCTCACATTCTCTATGTACTATGTATGT | |
| | | | ATGTATTATTATTATTGCTGCCAAGAGGGTCT | |
| | | | GATGGCACGTTGTGGGGTCGGGGGGTGGGGC | |
| | | | GGGGAAGTGCTCTAACTTTTCTTAAGGTTTTG | |
| | | | TTGCTAGCCCTTCAAGTGCACTGAGCTATGTG | |
| | | | ACTCGGATGGTCTTTCACACGGCACATTTGGA | |
| | | | CATTTCCAGAACTACCATGAGATGGTTTAGAC | |
| | | | GGGAATTCATGCAAATGAGGGGTCAAAAATG | |
| | | | GTATAGTGACCCCGTCCACGTCCTCCAAGCTC | |
| | | | ACGACCTTGGAGCCCCGTGGAGCTGGACTGA | |
| | | | GGAGGAGGCTGCACAGCGGGAGAGCAGCTG | |
| | | | GTCCAGACCAGCCCTGCAGCCCCCACTCAGC | |
| | | | CGGCAGCCAGATGGCCCCGCAAGGCCTCCAG | |
| | | | GGATGGCCCCTAGCCACAGGCCCTGGCTGAG | |
| | | | GTCTCTGGGTCGGTCAGTGACATGTAGGTAG | |
| | | | GAAGCACTGAAAATAGTGTTCCCAGAGCACT | |
| | | | TTGCAACTCCCTGGGTAAGAGGGACGACACC | |
| | | | TCTGGTTTTCAATACCAATTACATGGAACTTT | |
| | | | TTCTGTAATGGGTACAATGAAGAAGTTTCTAA | |
| | | | AAACACACACAAAGCACATTGGGCCAACTAT | |
| | | | TTAGTAAGCCCGGATAGACTTATTGCCAAAA | |
| | | | ACAAAAAATAGCTTTCAAAAGAAATTTAAGT | |
| | | | TCTATGAGAAATTCCTTAGTCATGGTGTTGCG | |
| | | | TAAATCATATTTTAGCTGCACGGCATTACCCC | |
| | | | ACACAGGGTGGCAGAACTTGAAGGGTTACTG | |
| | | | ACGTGTAAATGCTGGTATTTGATTTCCTGTGT | |
| | | | GTGTTGCCCTGGCATTAAGGGCATTTTACCCT | |
| | | | TGCAGTTTTACTAAAACACTGAAAAATATTCC | |
| | | | AAGCTTCATATTAACCCTACCTGTCAACGTAA | |
| | | | CGATTTCATGAACGTTATTATATTGTCGAATT | |
| | | | CCTACTGACAACATTATAACTGTATGGGAGCT | |
| | | | TAACTTTATAAGGAAATGTATTTTGACACTGG | |
| | | | TATCTTATTAAAGTATTCTGATCCTA | |

TABLE 27-continued

Transcript sequences for additional targets for titration experiments

| Target | Target Description | ENST ID | Transcript Sequence | SEQ ID NO |
|---|---|---|---|---|
| pVHL | von Hippel-Lindau tumor suppressor | 256474 | TGAGTGTTTATGTTTGTAGTTTTAATTGCTCTG AAGTAAATATCTGATTTTCCAATTTCCACCAG AGTGCTCTGCACATAGTAGGTCTAATTATTTT TCCCTCTTTACTAATCACCCATGCCTTGTAAG AATTCAGTTAGTTGACTTTTTGTACTTTATAA GCGTGATGATTGGGTGTTCCCGTGTGAGATGC GCCACCCTCGAACCTTGTTACGACGTCGGCAC ATTGCGCGTCTGACATGAAGAAAAAAAAAAT TCAGTTAGTCCACCAGGCACAGTGGCTAAGG CCTGTAATCCCTGCACTTTGAGAGGCCAAGGC AGGAGGATCACTTGAACCCAGGAGTTCGAGA CCAGCCTAGGCAACATAGCGAGACTCCGTTT CAAACAACAAATAAAAATAATTAGTCGGGCA TGGTGGTGCGCGCCTACAGTACCAACTACTCG GGAGGCTGAGGCGAGACGATCGCTTGAGCCA GGGAGGTCAAGGCTGCAGTGAGCCAAGCTCG CGCCACTGCACTCCAGCCCGGGCGACAGAGT GAGACCCTGTCTCAAAAAAAAAAAAAACACC AAACCTTAGAGGGGCGAAAAAAAATTTTATA GTGGAAATACAGTAACGAGTTGGCCTAGCCT CGCCTCCGTTACAACGGCCTACGGTGCTGGA GGATCCTTCTGCGCACGCGCACAGCCTCCGGC CGGCTATTTCCGCGAGCGCGTTCCATCCTCTA CCGAGCGCGCGCGAAGACTACGGAGGTCGAC TCGGGAGCGCGCACGCAGCTCCGCCCCGCGT CCGACCCGCGGATCCCGCGGCGTCCGGCCCG GGTGGTCTGGATCGCGGAGGGAATGCCCCGG AGGGCGGAGAACTGGGACGAGGCCGAGGTA GGCGCGGAGGAGGCAGGCGTCGAAGAGTAC GGCCCTGAAGAAGACGGCGGGGAGGAGTCG GGCGCCGAGGAGTCCGGCCCGGAAGAGTCCG GCCCGGAGGAACTGGGCGCCGAGGAGGAGAT GGAGGCCGGGCGGCCGCGGCCCGTGCTGCGC TCGGTGAACTCGCGCGAGCCCTCCCAGGTCAT CTTCTGCAATCGCAGTCCGCGCGTCGTGCTGC CCGTATGGCTCAACTTCGACGGCGAGCCGCA GCCCTACCCAACGCTGCCGCCTGGCACGGGC CGCCGCATCCACAGCTACCGAGGTCACCTTTG GCTCTTCAGAGATGCAGGGACACACGATGGG CTTCTGGTTAACCAAACTGAATTATTTGTGCC ATCTCTCAATGTTGACGGACAGCCTATTTTTG CCAATATCACACTGCCAGTGTATACTCTGAAA GAGCGATGCCTCCAGGTTGTCCGGAGCCTAG TCAAGCCTGAGAATTACAGGAGACTGGACAT CGTCAGGTCGCTCTACGAAGATCTGGAAGAC CACCCAAATGTGCAGAAAGACCTGGAGCGGC TGACACAGGAGCGCATTGCACATCAACGGAT GGGAGATTGAAGATTTCTGTTGAAACTTACAC TGTTTCATCTCAGCTTTTGATGGTACTGATGA GTCTTGATCTAGATACAGGACTGGTTCCTTCC TTAGTTTCAAAGTGTCTCATTCTCAGAGTAAA ATAGGCACCATTGCTTAAAAGAAAGTTAACT GACTTCACTAGGCATTGTGATGTTTAGGGGCA AACATCACAAATGTAATTTAATGCCTGCCCA TTAGAGAAGTATTTATCAGGAGAAGGTGGTG GCATTTTTGCTTCCTAGTAAGTCAGGACAGCT TGTATGTAAGGAGGTTTGTATAAGTAATTCAG TGGGAATTGCAGCATATCGTTTAATTTTAAGA AGGCATTGGCATCTGCTTTTAATGGATGTATA ATACATCCATTCTACATCCGTAGCGGTTGGTG ACTTGTCTGCCTCCTGCTTTGGGAAGACTGAG GCATCCGTGAGGCAGGGACAAGTCTTTCTCCT CTTTGAGACCCCAGTGCCTGCACATCATGAGC CTTCAGTCAGGGTTTGTCAGAGGAACAAACC AGGGGACACTTTGTTAGAAAGTGCTTAGAGG TTCTGCCTCTATTTTTGTTGGGGGGTGGGAGA GGGGACCTTAAAATGTGTACAGTGAACAAAT GTCTTAAAGGGAATCATTTTTGTAGGAAGCAT TTTTTATAATTTTCTAAGTCGTGCACTTTCTCG GTCCACTCTTGTTGAAGTGCTGTTTTATTACT GTTTCTAAACTAGGATTGACATTCTACAGTTG TGATAATAGCATTTTTGTAACTTGCCATCCGC ACAGAAAATACGAGAAATCTGCATGTTTGA | 6606 |

TABLE 27-continued

Transcript sequences for additional targets
for titration experiments

| Target | Target Description | ENST ID | Transcript Sequence | SEQ ID NO |
|---|---|---|---|---|
| | | | TTATAGTATTAATGGACAAATAAGTTTTTGCT AAATGTGAGTATTTCTGTTCCTTTTTGTAAAT ATGTGACATTCCTGATTGATTTGGGTTTTTTG TTGTTGTTGTTTTGTTTTGTTTTGTTTTTTGAG ATGGAGTCTCACTCTTGTCACCCAGGCTGGAG TGCAGTGGCGCCATCTCGGCTCACTGCAACCT CTGCCTCCTGGGTTCACGTAATCCTCCTGAGT AGCTGGGATTACAGGCGCCTGCCACCACGCT GGCCAATTTTTGTACTTTTAGTAGAGACAGTG TTTCGTCATGTTGGCCAGGCTGGTTTCAAACT CCTGACCTCAGGTGATCCGCCCACCTCAGCCT CCCAAAATGGTGGGATTACAGGTGTGTGGGC CACCGTGCCTGGCTGATTCAGCATTTTTTATC AGGCAGGACCAGGTGGCACTTCCACCTCCAG CCTCTGGTCCTACCAATGGATTCATGGAGTAG CCTGGACTGTTTCATAGTTTTCTAAATGTACA AATTCTTATAGGCTAGACTTAGATTCATTAAC TCAAATTCAATGCTTCTATCAGACTCAGTTTT TTGTAACTAATAGATTTTTTTTTCCACTTTTGT TCTACTCCTTCCCTAATAGCTTTTTAAAAAAA TCTCCCCAGTAGAGAAACATTTGGAAAAGAC AGAAAACTAAAAAGGAAGAAAAAAGATCCC TATTAGATACACTTCTTAAATACAATCACATT AACATTTTGAGCTATTTCCTTCCAGCCTTTTTA GGGCAGATTTTGGTTGGTTTTTACATAGTTGA GATTGTACTGTTCATACAGTTTTATACCCTTTT TCATTTAACTTTATAACTTAAATATTGCTCTAT GTTAGTATAAGCTTTTCACAAACATTAGTATA GTCTCCCTTTTATAATTAATGTTTGTGGGTATT TCTTGGCATGCATCTTTAATTCCTTATCCTAGC CTTTGGGCACAATTCCTGTGCTCAAAAATGAG AGTGACGGCTGGCATGGTGGCTCCCGCCTGT AATCCCAGTACTTTGGAAAGCCAAGGTAAGA GGATTGCTTGAGCCCAGAACTTCAAGATGAG CCTGGGCTCATAGTGAGAACCCATCTATACA AAAAATTTTTAAAAATTAGCATGGCGGCACA CATCTGTAATCCTAGCTACTTGGCAGGCTGAG GTGAGAAGATCATTGGAGTTTAGGAATTGGA GGCTGCAGTGAGCCATGAGTATGCCACTGCA CTCCAGCCTGGGGACAGAGCAAGACCCTGC CTCAAAAAAAAAAAAAAAAAAAAATCAGG CCGGGCATGGTGGCTCACGCCTGTAATCCCA GCACTTTGGGAGGTCGAGGTGGGCAGATCAC CTGAGGTCAGGAGTTCGAGACCAGCCTGGCC AACATGGTAAAACCCCATTTCTACTAAAAAA TACAAGAAT | |
| pVHL | von Hippel-Lindau tumor suppressor | 345392 | CCCGCGTCCGACCCGCGGATCCCGCGGCGTC CGGCCCGGGTGGTCTGGATCGCGGAGGGAAT GCCCCGGAGGGCGGAGAACTGGGACGAGGCC GAGGTAGGCGCGGAGGAGGCAGGCGTCGAA GAGTACGGCCCTGAAGAAGACGGCGGGGAG GAGTCGGGCGCCGAGGAGTCCGGCCCGGAAG AGTCCGGCCCGGAGGAACTGGGCGCCGAGGA GGAGATGGAGGCCGGGCGGCCGCGGCCCGTG CTGCGCTCGGTGAACTCGCGCGAGCCCTCCCA GGTCATCTTCTGCAATCGCAGTCCGCGCGTCG TGCTGCCCGTATGGCTCAACTTCGACGGCGAG CCGCAGCCCTACCCAACGCTGCCGCCTGGCA CGGGCCGCCGCATCCACAGCTACCGAGTGTA TACTCTGAAAGAGCGATGCCTCCAGGTTGTCC GGAGCCTAGTCAAGCCTGAGAATTACAGGAG ACTGGACATCGTCAGGTCGCTCTACGAAGAT CTGGAAGACCACCCAAATGTGCAGAAAGACC TGGAGCGGCTGACACAGGAGCGCATTGCACA TCAACGGATGGGAGATTGAAGATTTCTGTTG AAACTTACACTGTTTCATCTCAGCTTTTGATG GTACTGATGAGTCTTGATCTAGATACAGGACT GGTTCCTTCCTTAGTTTCAAAGTGTCTCATTCT CAGAGTAAAATAGGCACCATTGCTTAAAAGA AAGTTAACTGACTTCACTAGGCATTGTGATGT TTAGGGGCAAACATCACAAAAATGTAATTTAA TGCCTGCCCATTAGAGAAGTATTTATCAGGAG | 6607 |

TABLE 27-continued

Transcript sequences for additional targets for titration experiments

| Target | Target Description | ENST ID | Transcript Sequence | SEQ ID NO |
|---|---|---|---|---|
| | | | AAGGTGGTGGCATTTTTGCTTCCTAGTAAGTC<br>AGGACAGCTTGTATGTAAGGAGGTTTGTATA<br>AGTAATTCAGTGGGAATTGCAGCATATCGTTT<br>AATTTTAAGAAGGCATTGGCATCTGCTTTTAA<br>TGGATGTATAATACATCCATTCTACATCCGTA<br>GCGGTTGGTGACTTGTCTGCCTCCTGCTTTGG<br>GAAGACTGAGGCATCCGTGAGGCAGGGACAA<br>GTCTTTCTCCTCTTTGAGACCCCAGTGCCTGC<br>ACATCATGAGCCTTCAGTCAGGGTTTGTCAGA<br>GGAACAAACCAGGGGACACTTTGTTAGAAAG<br>TGCTTAGAGGTTCTGCCTCTATTTTTGTTGGG<br>GGGTGGGAGAGGGGACCTTAAAATGTGTACA<br>GTGAACAAATGTCTTAAAGGGAATCATTTTTG<br>TAGGAAGCATTTTTTATAATTTTCTAAGTCGT<br>GCACTTTCTCGGTCCACTCTTGTTGAAGTGCT<br>GTTTTATTACTGTTTCTAAACTAGGATTGACA<br>TTCTACAGTTGTGATAATAGCATTTTTGTAAC<br>TTGCCATCCGCACAGAAAATACGAGAAAATC<br>TGCATGTTTGATTATAGTATTAATGGACAAAT<br>AAGTTTTTGCTAAATGTGAGTATTTCTGTTCC<br>TTTTTGTAAATATGTGACATTCCTGATTGATTT<br>GGGTTTTTTTGTTGTTGTTGTTTTGTTTTGTTTT<br>GTTTTTTTGAGATGGAGTCTCACTCTTGTCAC<br>CCAGGCTGGAGTGCAGTGGCGCCATCTCGGC<br>TCACTGCAACCTCTGCCTCCTGGGTTCACGTA<br>ATCCTCCTGAGTAGCTGGGATTACAGGCGCCT<br>GCCACCACGCTGGCCAATTTTTGTACTTTTAG<br>TAGAGACAGTGTTTCGTCATGTTGGCCAGGCT<br>GGTTTCAAACTCCTGACCTCAGGTGATCCGCC<br>CACCTCAGCCTCCCAAAATGGTGGGATTACA<br>GGTGTGTGGGCCACCGTGCCTGGCTGATTCAG<br>CATTTTTTATCAGGCAGGACCAGGTGGCACTT<br>CCACCTCCAGCCTCTGGTCCTACCAATGGATT<br>CATGGAGTAGCCTGGACTGTTTCATAGTTTTC<br>TAAATGTACAAATTCTTATAGGCTAGACTTAG<br>ATTCATTAACTCAAATTCAATGCTTCTATCAG<br>ACTCAGTTTTTTGTAACTAATAGATTTTTTTT<br>CCACTTTTGTTCTACTCCTTCCCTAATAGCTTT<br>TTAAAAAAATCTCCCCAGTAGAGAAACATTT<br>GGAAAAGACAGAAAACTAAAAAGGAAGAAA<br>AAAGATCCCTATTAGATACACTTCTTAAATAC<br>AATCACATTAACATTTTGAGCTATTTCCTTCC<br>AGCCTTTTTAGGGCAGATTTTGGTTGGTTTTT<br>ACATAGTTGAGATTGTACTGTTCATACAGTTT<br>TATACCCTTTTTCATTTAACTTTATAACTTAAA<br>TATTGCTCTATGTTAGTATAAGCTTTTCACAA<br>ACATTAGTATAGTCTCCCTTTTATAATTAATG<br>TTTGTGGGTATTTCTTGGCATGCATCTTTAATT<br>CCTTATCCTAGCCTTTGGGCACAATTCCTGTG<br>CTCAAAAATGAGAGTGACGGCTGGCATGGTG<br>GCTCCCGCCTGTAATCCCAGTACTTTGGAAAG<br>CCAAGGTAAGAGGATTGCTTGAGCCCAGAAC<br>TTCAAGATGAGCCTGGGCTCATAGTGAGAAC<br>CCATCTATACAAAAAATTTTTAAAAATTAGCA<br>TGGCGGCACACATCTGTAATCCTAGCTACTTG<br>GCAGGCTGAGGTGAGAAGATCATTGGAGTTT<br>AGGAATTGGAGGCTGCAGTGAGCCATGAGTA<br>TGCCACTGCACTCCAGCCTGGGGGACAGAGC<br>AAGACCCTGCCTCAAAAAAAAAAAAAAAA<br>AAAAA | |
| pVHL | von Hippel-Lindau tumor suppressor | 450183 | GGATCCCGCGGCGTCCGGCCCGGGTGGTCTG<br>GATCGCGGAGGGAATGCCCCGGAGGGCGGAG<br>AACTGGGACGAGGCCGAGGTAGGCGCGGAG<br>GAGGCAGGCGTCGAAGAGTACGGCCCTGAAG<br>AAGACAGCTACCGAGGTCACCTTTGGCTCTTC<br>AGAGATGCAGGGACACACGATGGGCTTCTGG<br>TTAACCAAACTGAATTATTTGTGCCATCTCTC<br>AATGTTGACGGACAGCCTATTTTTGCCAATAT<br>CACACTGCCAGTGTATACTCTGAAAGAGCGA<br>TGCCTCCAGGTTGTCCGGAGCCTAGTCAAGCC<br>TGAGAATTACAGGAGACTGGACATCGTCAGG<br>TCGCTCTACGAAGATCTGGAAGACCACCCAA | 6608 |

TABLE 27-continued

Transcript sequences for additional targets for titration experiments

| Target | Target Description | ENST ID | Transcript Sequence | SEQ ID NO |
|---|---|---|---|---|
| | | | ATGTGCAGAAAGACCTGGAGCGGCTGACACA GGAGCGCATTGCACATCAACGGATGGGAGAT TGAAGATTTCTGTTGAAACTTACACTGTTTCA TCTCAGCTTTTGATGGTACTGATGAGTCTTGA TCTAGATACAGGACTGGTTCCTTCCTTAGTTT CAAAGTGTCTCATTCTCAGAGTAAAATAGGC ACCATTGCTTAAAAGAAAGTTAACTGACTTCA CTAGGCATTGTGATGTTAGGGGCAAACATC ACAAAATGTAATTTAATGCCTGCCCATTAGAG AAGTATTTATCAGGAGAAGGTGGTGGCATTTT TGCTTCCTAGTAAGTCAGGACAGCTTGTATGT AAGGAGGTTTGTATAAGTAATTCAGTGGGAA TTGCAGCATATCGTTTAATTTTAAGAAGGCAT TGGCATCTGCTTTTAATGGATGTATAATACAT CCATTCTACATCCGTAGCGGTTGGTGACTTGT CTGCCTCCTGCTTTGGGAAGACTGAGGCATCC GTGAGGCAGGGACAAGTCTTTCTCCTCTTTGA GACCCCAGTGCCTGCACATCATGAGCCTTCAG TCAGGGTTTGTCAGAGGAACAAACCAGGGGA CACTTTGTTAGAAAGTGCTTAGAGGTTCTGCC TCTATTTTTGTTGGGGGGTGGGAGAGGGGAC CTTAAAATGTGTACAGTGAACAAATGTCTTAA AGGGAATCATTTTTGTAGGAAGCATTTTTTAT AATTTTCTAAGTCGTGCACTTTCTCGGTCCAC TCTTGTT | |
| HIF1-alpha | hypoxia inducible factor 1, alpha subunit (basic helix-loop-helix transcription factor) | 557538 | ATTTGAAAACTTGGCAACCTTGGATTGGATGG ATTCATATTTCTTAGTATAGAAGTTCTTGATA TAACTGAAAAATTAAGTTAAACACTTAATAA GTGGTGGTTACTCAGCACTTTTAGATGCTGTT TATAATAGATGACCTTTTCTAACTAATTTACA GTTTTTTGAAAGATAACTGAGAGGTTGAGGG ACGGAGATTTTCTTCAAGCAATTTTTTTTTTCA TTTTAAATGAGCTCCCAATGTCGGAGTTTGGA AAACAAATTTGTCTTTTTAAAAGAAGGTCTAG GAAACTCAAAACCTGAAGAATTGGAAGAAAT CAGAATAGAAAATGGTAGGATAAGTTCTGAA CGTCGAAAAGAAAAGTCTCGAGATGCAGCCA GATCTCGGCGAAGTAAAGAATCTGAAGTTTTT TATGAGCTTGCTCATCAGTTGCCACTTCCACA TAATGTGAGTTCGCATCTTGATAAGGCCTCTG TGATGAGGCTTACCATCAGCTATTTGCGTGTG AGGAAACTTCTGGATGCTGGTGATTTGGATAT TGAAGATGACATGAAAGCACAGATGAATTGC TTTTATTTGAAAGCCTTGGATGGTTTTGTTAT GGTTCTCACAGATGATGGTGACATGATTTACA TTTCTGATAATGTGAACAAATACATGGGATTA ACTCAGTTTGAACTAACTGGACACAGTGTGTT TGATTTTACTCATCCATGTGACCATGAGGAAA TGAGAGAAATGCTTACACACAGAAATGGCCT TGTGAAAAAGGGTAAAGAACAAAACACACA GCGAAGCTTTTTTCTCAGAATGAAGTGTACCC TAACTAGCCGAGGAAGAACTATGAACATAAA GTCTGCAACATGGAAGGTATTGCACTGCACA GGCCACATTCACGTATATGATACCAACAGTA ACCAACCTCAGTGTGGGTATAAGAAACCACC TATGACCTGCTTGGTGCTGATTTGTGAACCCA TTCCTCACCCATCAAATATTGAAATTCCTTTA GATAGCAAGACTTTCCTCAGTCGACACAGCCT GGATATGAAATTTTCTTATTGTGATGAAAGAA TTACCGAATTGATGGGATATGAGCCAGAAGA ACTTTTAGGCCGCTCAATTTATGAATATTATC ATGCTTTGGACTCTGATCATCTGACCAAAACT CATCATGATATGTTTACTAAAGGACAAGTCAC CACAGGACAGTACAGGATGCTTGCCAAAAGA GGTGGATATGTCTGGGTTGAAACTCAAGCAA CTGTCATATATAACACCAAGAATTCTCAACCA CAGTGCATTGTATGTGTGAATTACGTTGTGAG TGGTATTATTCAGCACGACTTGATTTTCTCCC TTCAACAAACAGAATGTGTCCTTAAACCGGTT GAATCTTCAGATATGAAAATGACTCAGCTATT CACCAAAGTTGAATCAGAAGATACAAGTAGC CTCTTTGACAAACTTAAGAAGGAACCTGATG | 6609 |

TABLE 27-continued

Transcript sequences for additional targets for titration experiments

| Target | Target Description | ENST ID | Transcript Sequence | SEQ ID NO |
|---|---|---|---|---|
| | | | CTTTAACTTTGCTGGCCCCAGCCGCTGGAGAC ACAATCATATCTTTAGATTTTGGCAGCAACGA CACAGAAACTGATGACCAGCAACTTGAGGAA GTACCATTATATAATGATGTAATGCTCCCCTC ACCCAACGAAAAATTACAGAATATAAATTTG GCAATGTCTCCATTACCCACCGCTGAAACGCC AAAGCCACTTCGAAGTAGTGCTGACCCTGCA CTCAATCAAGAAGTTGCATTAAAATTAGAAC CAAATCCAGAGTCACTGGAACTTTCTTTTACC ATGCCCCAGATTCAGGATCAGACACCTAGTC CTTCCGATGGAAGCACTAGACAAAGTTCACC TGAGCCTAATAGTCCCAGTGAATATTGTTTTT ATGTGGATAGTGATATGGTCAATGAATTCAA GTTGGAATTGGTAGAAAAACTTTTTGCTGAAG ACACAGAAGCAAAGAACCCATTTTCTACTCA GGACACAGATTTAGACTTGGAGATGTTAGCT CCCTATATCCCAATGGATGATGACTTCCAGTT ACGTTCCTTCGATCAGTTGTCACCATTAGAAA GCAGTTCCGCAAGCCCTGAAAGCGCAAGTCC TCAAAGCACAGTTACAGTATTCCAGCAGACT CAAATACAAGAACCTACTGCTAATGCCACCA CTACCACTGCCACCACTGATGAATTAAAAAC AGTGACAAAAGACCGTATGGAAGACATTAAA ATATTGATTGCATCTCCATCTCCTACCCACAT ACATAAAGAAACTACTAGTGCCACATCATCA CCATATAGAGATACTCAAAGTCGGACAGCCT CACCAAACAGAGCAGGAAAAGGAGTCATAG AACAGACAGAAAAATCTCATCCAAGAAGCCC TAACGTGTTATCTGTCGCTTTGAGTCAAAGAA CTACAGTTCCTGAGGAAGAACTAAATCCAAA GATACTAGCTTTGCAGAATGCTCAGAGAAAG CGAAAAATGGAACATGATGGTTCACTTTTTCA AGCAGTAGGAATTGGAACATTATTACAGCAG CCAGACGATCATGCAGCTACTACATCACTTTC TTGGAAACGTGTAAAAGGATGCAAATCTAGT GAACAGAATGGAATGGAGCAAAAGACAATTA TTTTAATACCCTCTGATTTAGCATGTAGACTG CTGGGGCAATCAATGGATGAAAGTGGATTAC CACAGCTGACCAGTTATGATTGTGAAGTTAAT GCTCCTATACAAGGCAGCAGAAACCTACTGC AGGGTGAAGAATTACTCAGAGCTTTGGATCA AGTTAACTGAGCTTTTTCTTAATTTCATTCCTT TTTTTGGACACTGGTGGCTCATTACCTAAAGC AGTCTATTTATATTTTCTACATCTAATTTTAGA AGCCTGGCTACAATACTGCACAAACTTGGTTA GTTCAATTTTGATCCCCTTTCTACTTAATTTAC ATTAATGCTCTTTTTTAGTATGTTCTTTAATGC TGGATCACAGACAGCTCATTTTCTCAGTTTTT TGGTATTTAAACCATTGCATTGCAGTAGCATC ATTTTAAAAAATGCACCTTTTTATTTATTTATT TTTGGCTAGGGAGTTTATCCCTTTTTCGAATT ATTTTTAAGAAGATGCCAATATAATTTTTGTA AGAAGGCAGTAACCTTTCATCATGATCATAG GCAGTTGAAAAATTTTTACACCTTTTTTTTCA CATTTTACATAAATAATAATGCTTTGCCAGCA GTACGTGGTAGCCACAATTGCACAATATATTT TCTTAAAAAATACCAGCAGTTACTCATGGAAT ATATTCTGCGTTTATAAAACTAGTTTTTAAGA AGAAATTTTTTTGGCCTATGAAATTGTTAAA CCTGGAACATGACATTGTTAATCATATAATAA TGATTCTTAAATGCTGTATGGTTTATTATTTA AATGGGTAAAGCCATTTACATAATATAGAAA GATATGCATATATCTAGAAGG | |
| HIF1-alpha | hypoxia inducible factor 1, alpha subunit (basic helix-loop-helix transcription factor) | 394997 | GACAGGAGGATCACCCTCTTCGTCGCTTCGGC CAGTGTGTCGGGCTGGGCCCTGACAAGCCAC CTGAGGAGAGGCTCGGAGCCGGGCCCGGACC CCGGCGATTGCCGCCCGCTTCTCTCTAGTCTC ACGAGGGGTTTCCCGCCTCGCACCCCCACCTC TGGACTTGCCTTTCCTTCTCTTCTCCGCGTGTG GAGGGAGCCAGCGCTTAGGCCGGAGCGAGCC TGGGGGCCGCCCGCCGTGAAGACATCGCGGG GACCGATTCACCATGGAGGGCGCCGGCGGCG | 6610 |

TABLE 27-continued

Transcript sequences for additional targets for titration experiments

| Target | Target Description | ENST ID | Transcript Sequence | SEQ ID NO |
|---|---|---|---|---|
| | | | CGAACGACAAGAAAAATAGGATAAGTTCTGA ACGTCGAAAAGAAAAGTCTCGAGATGCAGCC AGATCTCGGCGAAGTAAAGAATCTGAAGTTT TTTATGAGCTTGCTCATCAGTTGCCACTTCCA CATAATGTGAGTTCGCATCTTGATAAGGCCTC TGTGATGAGGCTTACCATCAGCTATTTGCGTG TGAGGAAACTTCTGGATGCTGGTGATTTGGAT ATTGAAGATGACATGAAAGCACAGATGAATT GCTTTTATTTGAAAGCCTTGGATGGTTTTGTT ATGGTTCTCACAGATGATGGTGACATGATTTA CATTTCTGATAATGTGAACAAATACATGGGAT TAACTCAGTTTGAACTAACTGGACACAGTGTG TTTGATTTTACTCATCCATGTGACCATGAGGA AATGAGAGAAATGCTTACACACAGAAATGGC CTTGTGAAAAGGGTAAAGAACAAAACACAC AGCGAAGCTTTTTTCTCAGAATGAAGTGTACC CTAACTAGCCGAGGAAGAACTATGAACATAA AGTCTGCAACATGGAAGGTATTGCACTGCAC AGGCCACATTCACGTATATGATACCAACAGT AACCAACCTCAGTGTGGGTATAAGAAACCAC CTATGACCTGCTTGGTGCTGATTTGTGAACCC ATTCCTCACCCATCAAATATTGAAATTCCTTT AGATAGCAAGACTTTCCTCAGTCGACACAGC CTGGATATGAAATTTTCTTATTGTGATGAAAG AATTACCGAATTGATGGGATATGAGCCAGAA GAACTTTTAGGCCGCTCAATTTATGAATATTA TCATGCTTTGGACTCTGATCATCTGACCAAAA CTCATCATGATATGTTTACTAAAGGACAAGTC ACCACAGGACAGTACAGGATGCTTGCCAAAA GAGGTGGATATGTCTGGGTTGAAACTCAAGC AACTGTCATATATAACACCAAGAATTCTCAAC CACAGTGCATTGTATGTGTGAATTACGTTGTG AGTGGTATTATTCAGCACGACTTGATTTTCTC CCTTCAACAAACAGAATGTGTCCTTAAACCG GTTGAATCTTCAGATATGAAAATGACTCAGCT ATTCACCAAAGTTGAATCAGAAGATACAAGT AGCCTCTTTGACAAACTTAAGAAGGAACCTG ATGCTTTAACTTTGCTGGCCCCAGCCGCTGGA GACACAATCATATCTTTAGATTTTGGCAGCAA CGACACAGAAACTGATGACCAGCAACTTGAG GAAGTACCATTATATAATGATGTAATGCTCCC CTCACCCAACGAAAAATTACAGAATATAAAT TTGGCAATGTCTCCATTACCCACCGCTGAAAC GCCAAAGCCACTTCGAAGTAGTGCTGACCCT GCACTCAATCAAGAAGTTGCATTAAAATTAG AACCAAATCCAGAGTCACTGGAACTTTCTTTT ACCATGCCCCAGATTCAGGATCAGACACCTA GTCCTTCCGATGGAAGCACTAGACAAAGTTC ACCTGAGCCTAATAGTCCCAGTGAATATTGTT TTTATGTGGATAGTGATATGGTCAATGAATTC AAGTTGGAATTGGTAGAAAAACTTTTTGCTGA AGACACAGAAGCAAAGAACCCATTTTCTACT CAGGACACAGATTTAGACTTGGAGATGTTAG CTCCCTATATCCCAATGGATGATGACTTCCAG TTACGTTCCTTCGATCAGTTGTCACCATTAGA AAGCAGTTCCGCAAGCCCTGAAAGCGCAAGT CCTCAAAGCACAGTTACAGTATTCCAGCAGA CTCAAATACAAGAACCTACTGCTAATGCCAC CACTACCACTGCCACCACTGATGAATTAAAA ACAGTGACAAAAGACCGTATGGAAGACATTA AAATATTGATTGCATCTCCATCTCCTACCCAC ATACATAAAGAAACTACTAGTGCCACATCAT CACCATATAGAGATACTCAAAGTCGGACAGC CTCACCAAACAGAGCAGGAAAAGGAGTCATA GAACAGACAGAAAAATCTCATCCAAGAAGCC CTAACGTGTTATCTGTCGCTTTGAGTCAAAGA ACTACAGTTCCTGAGGAAGAACTAAATCCAA AGATACTAGCTTTGCAGAATGCTCAGAGAAA GCGAAAAATGGAACATGATGGTTCACTTTTTC AAGCAGTAGGAATTGGAACATTATTACAGCA GCCAGACGATCATGCAGCTACTACATCACTTT CTTGGAAACGTGTAAAAGGATGCAAATCTAG TGAACAGAATGGAATGGAGCAAAAGACAATT | |

TABLE 27-continued

Transcript sequences for additional targets for titration experiments

| Target | Target Description | ENST ID | Transcript Sequence | SEQ ID NO |
|---|---|---|---|---|
| | | | ATTTTAATACCCTCTGATTTAGCATGTAGACT GCTGGGGCAATCAATGGATGAAAGTGGATTA CCACAGCTGACCAGTTATGATTGTGAAGTTAA TGCTCCTATACAAGGCAGCAGAAACCTACTG CAGGGTGAAGAATTACTCAGAGCTTTGGATC AAGTTAACTGAGCTTTTTCTTAATTTCATTCCT TTTTTTGGACACTGGTGGCTCATTACCTAAAG CAGTCTATTTATATTTTCTACATCTAATTTTAG AAGCCTGGCTACAATACTGCACAAACTTGGTT AGTTCAATTTTGATCCCCTTTCTACTTAATTTA CATTAATGCTCTTTTTTAGTATGTTCTTTAATG CTGGATCACAGACAGCTCATTTTCTCAGTTTT TTGGTATTTAAACCATTGCATTGCAGTAGCAT CATTTTAAAAAATGCACCTTTTTATTTATTTAT TTTTGGCTAGGGAGTTTATCCCTTTTTCGAATT ATTTTTAAGAAGATGCCAATATAATTTTTGTA AGAAGGCAGTAACCTTTCATCATGATCATAG GCAGTTGAAAAATTTTTACACCTTTTTTTTCA CATTTTACATAAATAATAATGCTTTGCCAGCA GTACGTGGTAGCCACAATTGCACAATATATTT TCTTAAAAAATACCAGCAGTTACTCATGGAAT ATATTCTGCGTTTATAAAACTAGTTTTTAAGA AGAAATTTTTTTTGGCCTATGAAATTGTTAAA CCTGGAACATGACATTGTTAATCATATAATAA TGATTCTTAAATGCTGTATGGTTTATTATTTA AATGGGTAAAGCCATTTACATAATATAGAAA GATATGCATATATCTAGAAGGTATGTGGCATT TATTTGGATAAAATTCTCAATTCAGAGAAATC ATCTGATGTTTCTATAGTCACTTTGCCAGCTC AAAAGAAAACAATACCCTATGTAGTTGTGGA AGTTTATGCTAATATTGTGTAACTGATATTAA ACCTAAATGTTCTGCCTACCCTGTTGGTATAA AGATATTTTGAGCAGACTGTAAACAAGAAAA AAAAAATCATGCATTCTTAGCAAAATTGCCTA GTATGTTAATTTGCTCAAAATACAATGTTTGA TTTTATGCACTTTGTCGCTATTAACATCCTTTT TTTCATGTAGATTTCAATAATTGAGTAATTTT AGAAGCATTATTTTAGGAATATATAGTTGTCA CAGTAAATATCTTGTTTTTTCTATGTACATTGT ACAAATTTTTCATTCCTTTTGCTCTTTGTGGTT GGATCTAACACTAACTGTATTGTTTTGTTACA TCAAATAAACATCTTCTGTGGACCAGG | |

TABLE 28

Peptide sequences for additional targets for titration experiments

| Target | Target Description | ENSP ID | Protein Sequence | SEQ ID NO |
|---|---|---|---|---|
| HIF2-alpha | hypoxia inducible factor 2, alpha subunit; endothelial PAS domain protein 1 | 263734 | MTADKEKKRSSSERRKEKSRDAARCRRSKETE VFYELAHELPLPHSVSSHLDKASIMRLAISFLRT HKLLSSVCSENESEAEADQQMDNLYLKALEGFI AVVTQDGDMIFLSENISKFMGLTQVELTGHSIF DFTHPCDHEEIRENLSLKNGSGFGKKSKDMSTE RDFFMRMKCTVTNRGRTVNLKSATWKVLHCT GQVKVYNNCPPHNSLCGYKEPLLSCLIIMCEPIQ HPSHMDIPLDSKTFLSRHSMDMKFTYCDDRITE LIGYHPEELLGRSAYEFYHALDSENMTKSHQNL CTKGQVVSGQYRMLAKHGGYVWLETQGTVIY NPRNLQPQCIMCVNYVLSEIEKNDVVFSMDQTE SLFKPHLMAMNSIFDSSGKGAVSEKSNFLFTKL KEEPEELAQLAPTPGDAIISLDFGNQNFEESSAY GKAILPPSQPWATELRSHSTQSEAGSLPAFTVPQ AAAPGSTTPSATSSSSSCSTPNSPEDYYTSLDND LKIEVIEKLFAMDTEAKDQCSTQTDFNELDLET LAPYIPMDGEDFQLSPICPEERLLAENPQSTPQH CFSAMTNIFQPLAPVAPHSPFLLDKFQQQLESKK TEPEHRPMSSIFFDAGSKASLPPCCGQASTPLSS | 6611 |

TABLE 28-continued

Peptide sequences for additional targets for titration experiments

| Target | Target Description | ENSP ID | Protein Sequence | SEQ ID NO |
|---|---|---|---|---|
| | | | MGGRSNTQWPPDPPLHFGPTKWAVGDQRTEFL GAAPLGPPVSPPHVSTFKTRSAKGFGARGPDVL SPAMVALSNKLKLKRQLEYEEQAFQDLSGGDP PGGSTSHLMWKRMKNLRGGSCPLMPDKPLSAN VPNDKFTQNPMRGLGHPLRHLPLPQPPSAISPGE NSKSRFPPQCYATQYQDYSLSSAHKVSGMASR LLGPSFESYLLPELTRYDCEVNVPVLGSSTLLQG GDLLRALDQAT | |
| pVHL | von Hippel-Lindau tumor suppressor | 256474 | MPRRAENWDEAEVGAEEAGVEEYGPEEDGGE ESGAEESGPEESGPEELGAEEEMEAGRPRPVLRS VNSREPSQVIFCNRSPRVVLPVWLNFDGEPQPY PTLPPGTGRRIHSYRGHLWLFRDAGTHDGLLVN QTELFVPSLNVDGQPIFANITLPVYTLKERCLQV VRSLVKPENYRRLDIVRSLYEDLEDHPNVQKDL ERLTQERIAHQRMGD | 6612 |
| pVHL | von Hippel-Lindau tumor suppressor | 344757 | MPRRAENWDEAEVGAEEAGVEEYGPEEDGGE ESGAEESGPEESGPEELGAEEEMEAGRPRPVLRS VNSREPSQVIFCNRSPRVVLPVWLNFDGEPQPY PTLPPGTGRRIHSYRVYTLKERCLQVVRSLVKP ENYRRLDIVRSLYEDLEDHPNVQKDLERLTQER IAHQRMGD | 6613 |
| pVHL | von Hippel-Lindau tumor suppressor | 395399 | MPRRAENWDEAEVGAEEAGVEEYGPEEDSYR GHLWLFRDAGTHDGLLVNQTELFVPSLNVDGQ PIFANITLPVYTLKERCLQVVRSLVKPENYRRLD IVRSLYEDLEDHPNVQKDLERLTQERIAHQRMGD | 6614 |
| HIF1-alpha | hypoxia inducible factor 1, alpha subunit (basic helix-loop-helix transcription factor) | 451696 | MRLTISYLRVRKLLDAGDLDIEDDMKAQMNCF YLKALDGFVMVLTDDGDMIYISDNVNKYMGL TQFELTGHSVFDFTHPCDHEEMREMLTHRNGL VKKGKEQNTQRSFFLRMKCTLTSRGRTMNIKS ATWKVLHCTGHIHVYDTNSNQPQCGYKKPPMT CLVLICEPIPHPSNIEIPLDSKTFLSRHSLDMKFSY CDERITELMGYEPEELLGRSIYEYYHALDSDHL TKTHHDMFTKGQVTTGQYRMLAKRGGYVWV ETQATVIYNTKNSQPQCIVCVNYVVSGIIQHDLI FSLQQTECVLKPVESSDMKMTQLFTKVESEDTS SLFDKLKKEPDALTLLAPAAGDTIISLDFGSNDT ETDDQQLEEVPLYNDVMLPSPNEKLQNINLAM SPLPTAETPKPLRSSADPALNQEVALKLEPNPES LELSFTMPQIQDQTPSPDGSTRQSSPEPNSPSEY CFYVDSDMVNEFKLELVEKLFAEDTEAKNPFST QDTDLDLEMLAPYIPMDDDFQLRSFDQLSPLES SSASPESASPQSTVTVFQQTQIQEPTANATTTTA TTDELKTVTKDRMEDIKILIASPSPTHIHKETTSA TSSPYRDTQSRTASPNRAGKGVIEQTEKSHPRSP NVLSVALSQRTTVPEEELNPKILALQNAQRKRK MEHDGSLFQAVGIGTLLQQPDDHAATTSLSWK RVKGCKSSEQNGMEQKTIILIPSDLACRLLGQS MDESGLPQLTSYDCEVNAPIQGSRNLLQGEELL RALDQVN | 6615 |
| HIF1-alpha | hypoxia inducible factor 1, alpha subunit (basic helix-loop-helix transcription factor) | 378446 | MEGAGGANDKKNRISSERRKEKSRDAARSRRS KESEVFYELAHQLPLPHNVSSHLDKASVMRLTI SYLRVRKLLDAGDLDIEDDMKAQMNCFYLKAL DGFVMVLTDDGDMIYISDNVNKYMGLTQFELT GHSVFDFTHPCDHEEMREMLTHRNGLVKKGKE QNTQRSFFLRMKCTLTSRGRTMNIKSATWKVL HCTGHIHVYDTNSNQPQCGYKKPPMTCLVLICE PIPHPSNIEIPLDSKTFLSRHSLDMKFSYCDERITE LMGYEPEELLGRSIYEYYHALDSDHLTKTHHD MFTKGQVTTGQYRMLAKRGGYVWVETQATVI YNTKNSQPQCIVCVNYVVSGIIQHDLIFSLQQTE CVLKPVESSDMKMTQLFTKVESEDTSSLFDKLK KEPDALTLLAPAAGDTIISLDFGSNDTETDDQQL EEVPLYNDVMLPSPNEKLQNINLAMSPLPTAET PKPLRSSADPALNQEVALKLEPNPESLELSFTMP QIQDQTPSPDGSTRQSSPEPNSPSEYCFYVDSD MVNEFKLELVEKLFAEDTEAKNPFSTQDTDLDL EMLAPYIPMDDDFQLRSFDQLSPLESSSASPESA SPQSTVTVFQQTQIQEPTANATTTTATTDELKTV TKDRMEDIKILIASPSPTHIHKETTSATSSPYRDT | 6616 |

TABLE 28-continued

Peptide sequences for additional targets for titration experiments

| Target Target Description | ENSP ID | Protein Sequence | SEQ ID NO |
|---|---|---|---|
| | | QSRTASPNRAGKGVIEQTEKSHPRSPNVLSVAL SQRTTVPEEELNPKILALQNAQRKRKMEHDGSL FQAVGIGTLLQQPDDHAATTSLSWKRVKGCKS SEQNGMEQKTIILIPSDLACRLLGQSMDESGLPQ LTSYDCEVNAPIQGSRNLLQGEELLRALDQVN | |

Materials for Examples 27-33

Table 29 describes the modified mRNA sequences described in Examples 27-33.

TABLE 29

| Target | mRNA Sequence (polyA tail and 5'cap not shown in sequence) | SEQ ID NO |
|---|---|---|
| Apoptosis-inducing factor short (AIFsh) | GGGAAAUAAGAGAGAAAAGAAGAGUAAGAAGAAAUAUAAGAGCC ACCAUGGAAAAAGUCAGACGAGAGGGGGUUAAGGUGAUGCCCAA UGCUAUUGUGCAAUCCGUUGGAGUCAGCAGUGGCAAGUUACUUA UCAAGCUGAAAGACGGCAGGAAGGUAGAAACUGACCACAUAGUG GCAGCUGUGGGCCUGGAGCCCAAUGUUGAGUUGGCCAAGACUGG UGGCCUGGAAAUAGACUCAGAUUUUGGUGGCUUCCGGGUAAAUG CAGAGCUACAAGCACGCUCUAACAUCUGGGUGGCAGGAGAUGCU GCAUGCUUCUACGAUAUAAAGUUGGGAAGGAGGCGGGUAGAGCA CCAUGAUCACGCUGUUGUGAGUGGAAGAUUGGCUGGAGAAAAUA UGACUGGAGCUGCUAAGCCGUACUGGCAUCAGUCAAUGUUCUGG AGUGAUUUGGGCCCCGAUGUUGGCUAUGAAGCUAUUGGUCUUGU GGACAGUAGUUUGCCCACAGUUGGUGUUUUUGCAAAAGCAACUG CACAAGACAACCCCAAAUCUGCCACAGAGCAGUCAGGAACUGGUA UCCGAUCAGAGAGUGAGACAGAGUCCGAGGCCUCAGAAAUUACU AUUCCUCCCAGCACCCCGGCAGUUCCACAGGCUCCCGUCCAGGGG GAGGACUACGGCAAAGGUGUCAUCUUCUACCUCAGGGACAAAGU GGUCGUGGGGAUUGUGCUAUGGAACAUCUUUAACCGAAUGCCAA UAGCAAGGAAGAUCAUUAAGGACGGUGAGCAGCAUGAAGAUCUC AAUGAAGUAGCCAAACUAUUCAACAUUCAUGAAGACUGAUAAUA GGCUGGAGCCUCGGUGGCCAUGCUUCUUGCCCCUUGGGCCUCCCC CCAGCCCCUCCUCCCCUUCCUGCACCCGUACCCCCGUGGUCUUUG AAUAAAGUCUGAGUGGGCGGC | 6617 |
| Siah E3 ubiquitin protein ligase 1 (SIAH1) | GGGAAAUAAGAGAGAAAAGAAGAGUAAGAAGAAAUAUAAGAGCC ACCAUGAGCCGUCAGACUGCUACAGCAUUACCUACCGGUACCUCG AAGUGUCCACCAUCCCAGAGGGUGCCUGCCCUGACUGGCACAACU GCAUCCAACAAUGACUUGGCGAGUCUUUUGAGUGUCCAGUCUG CUUUGACUAUGUGUUACCGCCAUUCUUCAAUGUCAGAGUGGCC AUCUUGUUUGUAGCAACUGUCGCCCAAAGCUCACAUGUUGUCCA ACUUGCCGGGGCCCUUUGGGAUCCAUUCGCAACUUGGCUAUGGA GAAAGUGGCUAAUUCAGUACUUUUCCCCUGUAAAUAUGCGUCUU CUGGAUGUGAAAUAACUCUGCCACACACAGAAAAAGCAGACCAU GAAGAGCUCUGUGAGUUUAGGCCUUAUUCCUGUCCGUGCCCUGG UGCUUCCUGUAAAUGGCAAGGCUCUCUGGAUGCUGUAAUGCCCC AUCUGAUGCAUCAGCAUAAGUCCAUUACAACCCUACAGGGAGAG GAUAUAGUUUUUCUUGCUACAGACAUUAAUCUUCCUGGUGCUGU UGACUGGGUGAUGAUGCAGUCCUGUUUUGGCUUUCACUUCAUGU UAGUCUUAGAGAAACAGGAAAAAUACGAUGGUCACCAGCAGUUC UUCGCAAUCGUACAGCUGAUAGGAACACGCAAGCAAGCUGAAAA UUUUGCUUACCGACUUGAGCUAAAUGGUCAUAGGCGACGAUUGA CUUGGGAAGCGACUCCUCGAUCUAUUCAUGAAGGAAUUGCAACA GCCAUUAUGAAUAGCGACUGUCUAGUCUUUGACACCAGCAUUGC ACAGCUUUUUGCAGAAAAUGGCAAUUUAGGCAUCAAUGUAACUA UUUCCAUGUGUUGAUAAUAGGCUGGAGCCUCGGUGGCCAUGCUU CUUGCCCCUUGGGCCUCCCCCCAGCCCCUCCUCCCCUUCCUGCACC CGUACCCCCGUGGUCUUUGAAUAAAGUCUGAGUGGGCGGC | 6618 |
| Constitutively active (C.A. caspase 3 (also known as reverse caspase 3 | GGGAAAUAAGAGAGAAAAGAAGAGUAAGAAGAAAUAUAAGAGCC ACCAUGAUUGAGACAGACAGUGGUGUUGAUGAUGACAUGGCGUG UCAUAAAAAUACCAGUGGAGGCCGACUUCUUGUAUGCAUACUCCA CAGCACCUGGUUAUUAUUCUUGGCGAAAUUCAAAGGAUGGCUCC UGGUUCAUCCAGUCGCUUUGUGCCAUGCUGAAACAGUAUGCCGA CAAGCUUGAAUUUAUGCACAUUCUUACCCGGGUUAACCGAAAGG UGGCAACAGAAUUUGAGUCCUUUUCCUUUGACGCUACUUUUCAU GCAAAGAAACAGAUUCCAUGUAUUGUUUCCAUGCUCACAAAGGA | 6619 |

TABLE 29-continued

| Target | mRNA Sequence (polyA tail and 5'cap not shown in sequence) | SEQ ID NO |
|---|---|---|
| (Rev-Caspase 3)) | ACUCUAUUUUAUCACGAUGAAGUUGAUGGGGGAUCCCCCAUGG<br>AGAACACUGAAAACUCAGUGGAUUCAAAAUCCAUUAAAAAUUUG<br>GAACCAAAGAUCAUACAUGGAAGCGAAUCAAUGGACUCUGGAAU<br>AUCCCUGGACAACAGUUAUAAAAUGGAUUAUCCUGAGAUGGGUU<br>UAUGUAUAAUAAUUAAUAAUAAGAAUUUUCAUAAGAGCACUGGA<br>AUGACAUCUCGGUCUGGUACAGAUGUCGAUGCAGCAAACCUCAG<br>GGAAACAUUCAGAAACUUGAAAUAUGAAGUCAGGAAUAAAAAUG<br>AUCUUACACGUGAAGAAAUUGUGGAAUUGAUGCGUGAUGUUUCU<br>AAAGAAGAUCACAGCAAAAGGAGCAGUUUUGUUUGUGUGCUUCU<br>GAGCCAUGGUGAAGAAGGAAUAAUUUUUGGAACAAAUGGACCUG<br>UUGACCUGAAAAAAAUAACAAACUUUUUCAGAGGGGAUCGUUGU<br>AGAAGUCUAACUGGAAAACCCAAACUUUUCAUUAUUCAGGCCUG<br>CCGUGGUACAGAACUGGACUGUGGCAUUGAGACAGACUGAUAAU<br>AGGCUGGAGCCUCGGUGGCCAUGCUUCUUGCCCCUUGGGCCUCCC<br>CCCAGCCCCUCCUCCCCUUCCUGCACCCGUACCCCCGUGGUCUUU<br>GAAUAAAGUCUGAGUGGGCGGC | |
| Granulysin | GGGAAAUAAGAGAGAAAAGAAGAGUAAGAAGAAAUAUAAGAGCC<br>ACCAUGGCAACUUGGGCCCUGCUGCUUCUUGCAGCCAUGUUGCUC<br>GGAAAUCCUGGUCUGGUGUUUUCGCGCCUUUCACCGGAGUACUA<br>CGAUCUCGCUCGCGCACAUCUGCGCGACGAGGAGAAGUCGUGCCC<br>AUGUCUCGCACAAGAAGGGCCACAGGGUGACCUUUUGACCAAGA<br>CGCAAGAACUUGGCAGGGACUACCGAACCUGUCUGACCAUCGUGC<br>AAAAGCUGAAGAAAAUGGUCGAUAAACCUACCCAAAGAAGCGUG<br>UCCAACGCAGCGACUCGGGUGUGCCGGACUGGCAGAUCCAGAUG<br>GCGGGAUGUGUGUAGAAACUUCAUGAGAAGGUACCAGAGCCGUG<br>UUACUCAGGGACUGGUCGCGGGAGAAACUGCCCAACAGAUUUGC<br>GAAGAUCUGCGACUCUGUAUUCCUUCAACCGGACCCCUUUGAUA<br>AUAGGCUGGAGCCUCGGUGGCCAUGCUUCUUGCCCCUUGGGCCUC<br>CCCCCAGCCCCUCCUCCCCUUCCUGCACCCGUACCCCCGUGGUCUU<br>UGAAUAAAGUCUGAGUGGGCGGC | 6620 |
| MYC inhibitor D | GGGAAAUAAGAGAGAAAAGAAGAGUAAGAAGAAAUAUAAGAGCC<br>ACCAUGACCGAAGAAAACGUCAAGAGAAGAACCCAUAAUGUCCU<br>CGAGCGCCAGCGGCGCAAUGAGCUCAAGCGCAGCUUCUUUGCACU<br>CAGGGACCAAAUUCCAGAGUUGGAGAACAACGAAAAGGCCCCGA<br>AGGUGGUGAUCCUUAAGAAGGCGACUGCCUACAUCCUGUCGGUG<br>CAGGCUGAGACUCAAAAGCUGAUCUCCGAAAUCGAUCUGCUCCG<br>GAAACAGAACGAACAACUGAAACACAAACUGGAACAGCUGCGGA<br>AUUCAUGCUGAUAAUAGGCUGGAGCCUCGGUGGCCAUGCUUCUU<br>GCCCCUUGGGCCUCCCCCCAGCCCCUCCUCCCCUUCCUGCACCCGU<br>ACCCCCGUGGUCUUUGAAUAAAGUCUGAGUGGGCGGC | 6621 |

Example 27. Detection of Apoptosis-Inducing Factor Short Protein: Western Blot

CD1 mice (Harlan Laboratories, South Easton, Mass.) were administered intravenously lipolexed apoptosis-inducing factor short (AIFsh) modified mRNA (mRNA sequence shown in Table 29; polyA tail of approximately 140 nucleotides not shown in sequence; 5' cap, Cap1) fully modified with 5-methylcytidine and pseudouridine (5mC/pU), fully modified with 5-methylcytidine and 1-methylpseudouridine (5mC/1 mpU), 25% of uridine modified with 2-thiouridine and 25% of cytidine modified with 5-methylcytidine (s2U and 5mC), fully modified with pseudouridine (pU) or fully modified with 1-methylpseudouridine (1mpU). The mice were administered a dose of 2 ug of mRNA complexed with 2 ul Lipofectamine 2000 (LifeTechnologies, Grand Island, N.Y.) in 100 ul sterile basal DMEM medium (w/o additives, LifeTechnologies, Grand Island, N.Y.).

After 6 hours, the animals were sacrificed and serum & spleen are taken. Spleens were transferred to 6-well plates and kept on ice in presence of 1 ml PBS. One spleen was cut with a scalpel several times and with a rubber cell scraper splenocytes were squeezed out until the PBS turns turbid due to cell release.

Leaving fibrous components behind, the cells were transferred to a 100 um cell strainer (BD Biosciences, San Jose, Calif.) sitting on a 12-well cell culture plate. By gravity the cells passed through the cell strainer and were collected beneath in the 12-well culture dish. 1 ml of PBS was transferred with the free-floating splenocytes to an Eppendorf tube and spun for 5 min at 2000 rpm. The PBS was discarded and the cell pellet combined with 500 ul fresh PBS. The splenocytes were resuspended by brief vortexing for 5 mins at 2000 rpm. The PBS was discarded and 1 ml BD Pharmlyse was added to the cell pellet. The splenocytes were resuspended by brief vortexing. The cells were incubated at room temperature for 3 minutes and then spun at 200 rpm for 5 minutes. The cells were washed twice with 500 ul PBS and spun as described above. The cells were resuspended with 500 ul of PBS and spun as described.

250 ul of splenocytes were combined with 1× Pharmlyse buffer and vortexed briefly or resuspended with a pipet and then spun for 2 minutes at 2000 rpm.

In one tube, resuspend cell pellet in 500 ul RIPA buffer with protease inhibitor cocktail for mammalian cells (BostonBioproducts, Ashland, Mass.) and freeze lysate or continue with BCA assay immediately. In a second tube, add 250 ul FACS staining kit fixation solution (4% formaldehyde; R and D Systems, Minneapolis, Minn.) and then incubate for 10 minutes at room temperature. The cells were washed twice with 500 ul PBS and spun as described above. The cell pellet was resuspended in 500 PBS and stored at 4° C.

Protein lysates were loaded on NuPage SDS-PAGE system (chambers and power supply) with 1.5 mm ready-to-use Bis-Tris gels and 4-12% acrylamide gradient with MOPS-buffer as running aid (all Life Technologies, Grand Island, N.Y.). Each lysate sample was prepared to 40 ul final volume. This sample contained 25 ug protein lysate in variable volume, RIPA buffer to make up volume to 26 ul, 4 ul of 10× reducing agent and 10 ul 4×SDS loading buffer (both from Life Technologies, Grand Island, N.Y.). Samples were heated at 95° C. for 5 min and loaded on the gel. Standard settings were chosen by the manufacturer, 200V, 120 mA and max. 25 W. Run time was 60 min, but no longer than running dye reaching the lower end of the gel.

After the run was terminated, the plastic case was cracked and the encased gel transferred to a ready-to-use nitrocellulose membrane kit and power supply (iBLOT; LifeTechnologies, Grand Island, N.Y.). Using default settings, the protein lysate was transferred by high Ampere electricity from the gel to the membrane.

After the transfer, the membranes were incubated in 5% BSA in 1×TBS for 15 minutes then in 5% BSA in 1×TBS+0.1% Tween for another 15 minutes. Primary antibodies (AIFsh rabbit polyclonal antibody; Abcam, Cambridge, Mass.) against AIFsh proteins were applied in 3 ml of 5% BSA in 1×TBS solution at a 1:500 to 1:2000 dilution for 3 hours at room temperature and gentle agitation on an orbital shaker. Membranes are washed 3 times with 1×TBS/0.1% Tween, 5 minutes each time with gentle agitation. The secondary antibody (Goat anti-rabbit HRP conjugate; Abeam, Cambridge, Mass.) was conjugated to horse radish peroxidase and binds to the primary antibody antibodies. The secondary antibody was diluted of 1:1000 to 1:5000 in 5% BSA in 1×TBS and incubated for 3 hrs at RT.

At the end of incubation time, the membranes were washed 3 times with 1×TBS/0.1% Tween, 5 minutes each time with gentle agitation. The membranes were developed in 5 ml Pierce WestPico Chemiluminescent Substrate (Thermo Fisher, Rockford, Ill.) as directed.

Figure 3A:
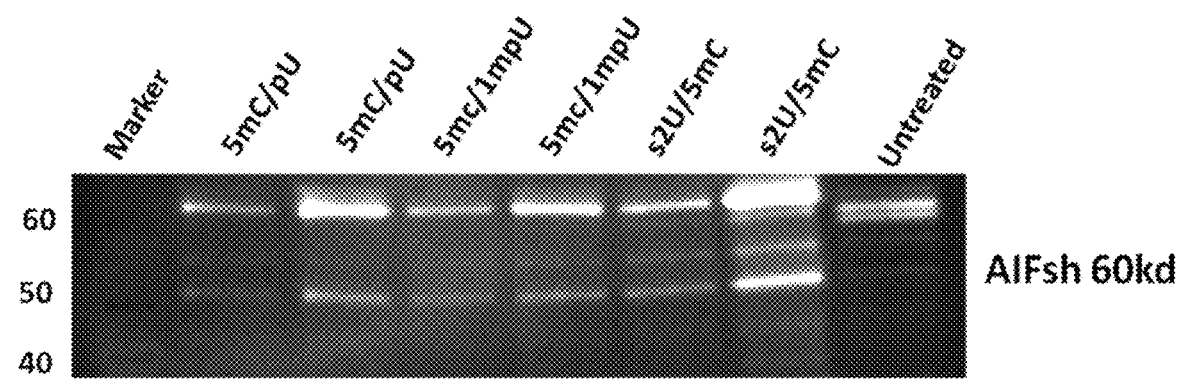
FIGS. 3A and 3B are gel profiles of Apoptosis-Inducing Factor short (AIFsh) protein from AIFsh modified mRNA in mammals.
Figure 3B:
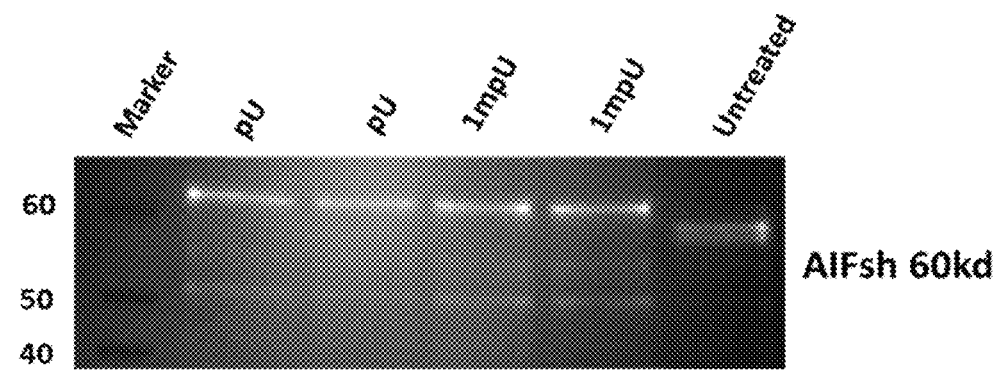

As shown in FIGS. 3A and 3B the Western Blot detected protein around the expected size of 60 kd for each of the 2 samples evaluated for each chemistry.

Example 28. Detection of Siah E3 Ubiquitin Protein Ligase 1 Protein: Western Blot CD1 mice (Harlan Laboratories, South Easton, Mass.) were administered intravenously lipolexed siah E3 ubiquitin protein ligase 1 (SIAH1) modified mRNA (mRNA sequence shown in SEQ ID NO. 6618 (Table 29); polyA tail of approximately 140 nucleotides not shown in sequence; 5' cap, Cap 1) fully modified with 5-methylcytidine and pseudouridine (5mC/pU), fully modified with 5-methylcytidine and 1-methylpseudouridine (5mC/1mpU), 25% of uridine modified with 2-thiouridine and 25% of cytidine modified with 5-methylcytidine (s2U and 5mC), fully modified with pseudouridine (pU) or fully modified with 1-methylpseudouridine (1mpU). The mice were administered a dose of 2 ug of mRNA complexed with 2 ul Lipofectamine 2000 (LifeTechnologies, Grand Island, N.Y.) in 100 ul sterile basal DMEM medium (w/o additives, LifeTechnologies, Grand Island, N.Y.).

After 6 hours, the animals were sacrificed and serum & spleen are taken. Spleens transferred to 6-well plates and kept on ice in presence of 1 ml PBS. One spleen was cut with a scalpel several times and with a rubber cell scraper splenocytes were squeezed out until the PBS turns turbid due to cell release.

Leaving fibrous components behind, the cells were transferred to a 100 um cell strainer (BD Biosciences, San Jose, Calif.) sitting on a 12-well cell culture plate. By gravity the cells passed through the cell strainer and were collected beneath in the 12-well culture dish. 1 ml of PBS was transferred with the free-floating splenocytes to an Eppendorf tube and spun for 5 min at 2000 rpm. The PBS was discarded and the cell pellet combined with 500 ul fresh PBS. The splenocytes were resuspended by brief vortexing for 5 mins at 2000 rpm. The PBS was discarded and 1 ml BD Pharmlyse was added to the cell pellet. The splenocytes were resuspended by brief vortexing. The cells were incubated at room temperature for 3 minutes and then spun at 200 rpm for 5 minutes. The cells were washed twice with 500 ul PBS and spun as described above. The cells were resuspended with 500 ul of PBS and spun as described.

250 ul of splenocytes were combined with 1× Pharmlyse buffer and vortexed briefly or resuspended with a pipet and then spun for 2 minutes at 2000 rpm.

In one tube, resuspend cell pellet in 500 ul RIPA buffer with protease inhibitor cocktail for mammalian cells (BostonBioproducts, Ashland, Mass.) and freeze lysate or continue with BCA assay immediately. In a second tube, add 250 ul FACS staining kit fixation solution (4% formaldehyde; R and D Systems, Minneapolis, Minn.) and then incubate for 10 minutes at room temperature. The cells were washed twice with 500 ul PBS and spun as described above. The cell pellet was resuspended in 500 PBS and stored at 4° C.

Protein lysates were loaded on NuPage SDS-PAGE system (chambers and power supply) with 1.5 mm ready-to-use Bis-Tris gels and 4-12% acrylamide gradient with MOPS-buffer as running aid (all Life Technologies, Grand Island, N.Y.). Each lysate sample was prepared to 40 ul final volume. This sample contained 25 ug protein lysate in variable volume, RIPA buffer to make up volume to 26 ul, 4 ul of 10× reducing agent and 10 ul 4×SDS loading buffer (both from Life Technologies, Grand Island, N.Y.). Samples were heated at 95° C. for 5 min and loaded on the gel. Standard settings were chosen by the manufacturer, 200V, 120 mA and max. 25 W. Run time was 60 min, but no longer than running dye reaching the lower end of the gel.

After the run was terminated, the plastic case was cracked and the encased gel transferred to a ready-to-use nitrocellulose membrane kit and power supply (iBLOT; LifeTechnologies, Grand Island, N.Y.). Using default settings, the protein lysate was transferred by high Ampere electricity from the gel to the membrane.

After the transfer, the membranes were incubated in 5% BSA in 1×TBS for 15 minutes then in 5% BSA in 1×TBS+0.1% Tween for another 15 minutes. Primary antibodies (SIAH1 rabbit polyclonal antibody; Abcam, Cambridge, Mass.) against SIAH1 proteins were applied in 3 ml of 5% BSA in 1×TBS solution at a 1:500 to 1:2000 dilution for 3 hours at room temperature and gentle agitation on an orbital shaker. Membranes are washed 3 times with 1×TBS/0.1% Tween, 5 minutes each time with gentle agitation. The secondary antibody (Goat anti-rabbit HRP conjugate; Abcam, Cambridge, Mass.) was conjugated to horse radish peroxidase and binds to the primary antibody antibodies. The secondary antibody was diluted of 1:1000 to 1:5000 in 5% BSA in 1×TBS and incubated for 3 hrs at RT.

At the end of incubation time, the membranes were washed 3 times with 1×TBS/0.1% Tween, 5 minutes each time with gentle agitation. The membranes were developed in 5 ml Pierce WestPico Chemiluminescent Substrate (Thermo Fisher, Rockford, Ill.) as directed.

Figure 4A:
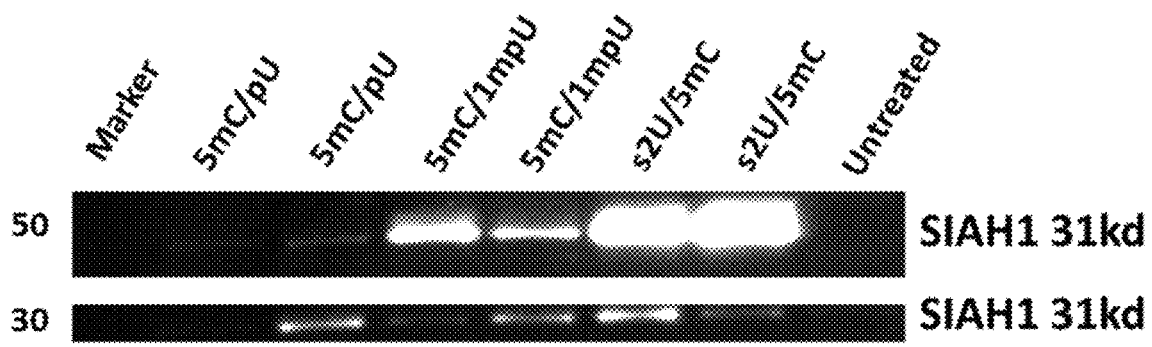
FIGS. 4A and 4B are gel profiles of Siah E3 ubiquitin protein ligase 1 (SIAH1) protein from SIAH1 modified mRNA in mammals.
Figure 4B:
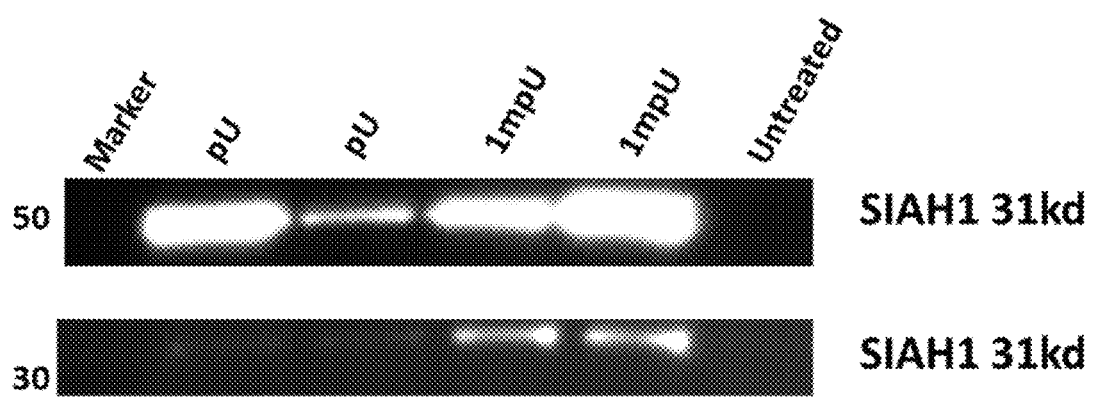

As shown in FIGS. 4A and 4B the Western Blot detected protein around the expected size of 31 kd for each of the 2 samples evaluated for each chemistry.

Example 29. Detection of Reverse Caspase 3 Protein: Western Blot

CD1 mice (Harlan Laboratories, South Easton, Mass.) were administered intravenously lipolexed constitutively active (C.A.) caspase 3 (also known as Reverse-Caspase 3 or Rev-Caspase 3) modified mRNA (mRNA sequence shown in SEQ ID NO. 6619 (Table 29); polyA tail of approximately 140 nucleotides not shown in sequence; 5' cap, Cap1) fully modified with 5-methylcytidine and pseudouridine (5mC/pU), fully modified with 5-methylcytidine and 1-methylpseudouridine (5mC/1mpU), 25% of uridine modified with 2-thiouridine and 25% of cytidine modified with 5-methylcytidine (s2U and 5mC), fully modified with pseudouridine (pU) or fully modified with 1-methylpseudouridine (1mpU). The mice were administered a dose of 2 ug of mRNA complexed with 2 ul Lipofectamine 2000 (LifeTechnologies, Grand Island, N.Y.) in 100 ul sterile basal DMEM medium (w/o additives, LifeTechnologies, Grand Island, N.Y.).

After 6 hours, the animals were sacrificed and serum & spleen are taken. Spleens were transferred to 6-well plates and kept on ice in presence of 1 ml PBS. One spleen was cut with a scalpel several times and with a rubber cell scraper splenocytes were squeezed out until the PBS turns turbid due to cell release.

Leaving fibrous components behind, the cells were transferred to a 100 um cell strainer (BD Biosciences, San Jose, Calif.) sitting on a 12-well cell culture plate. By gravity the cells passed through the cell strainer and were collected beneath in the 12-well culture dish. 1 ml of PBS was transferred with the free-floating splenocytes to an Eppendorf tube and spun for 5 min at 2000 rpm. The PBS was discarded and the cell pellet combined with 500 ul fresh PBS. The splenocytes were resuspended by brief vortexing for 5 mins at 2000 rpm. The PBS was discarded and 1 ml BD Pharmlyse was added to the cell pellet. The splenocytes were resuspended by brief vortexing. The cells were incubated at room temperature for 3 minutes and then spun at 200 rpm for 5 minutes. The cells were washed twice with 500 ul PBS and spun as described above. The cells were resuspended with 500 ul of PBS and spun as described.

250 ul of splenocytes were combined with 1× Pharmlyse buffer and vortexed briefly or resuspended with a pipet and then spun for 2 minutes at 2000 rpm.

In one tube, resuspend cell pellet in 500 ul RIPA buffer with protease inhibitor cocktail for mammalian cells (BostonBioproducts, Ashland, Mass.) and freeze lysate or continue with BCA assay immediately. In a second tube, add 250 ul FACS staining kit fixation solution (4% formaldehyde; R and D Systems, Minneapolis, Minn.) and then incubate for 10 minutes at room temperature. The cells were washed twice with 500 ul PBS and spun as described above. The cell pellet was resuspended in 500 PBS and stored at 4° C.

Protein lysates were loaded on NuPage SDS-PAGE system (chambers and power supply) with 1.5 mm ready-to-use Bis-Tris gels and 4-12% acrylamide gradient with MOPS-buffer as running aid (all Life Technologies, Grand Island, N.Y.). Each lysate sample was prepared to 40 ul final volume. This sample contained 25 ug protein lysate in variable volume, RIPA buffer to make up volume to 26 ul, 4 ul of 10× reducing agent and 10 ul 4×SDS loading buffer (both from Life Technologies, Grand Island, N.Y.). Samples were heated at 95° C. for 5 min and loaded on the gel. Standard settings were chosen by the manufacturer, 200V, 120 mA and max. 25 W. Run time was 60 min, but no longer than running dye reaching the lower end of the gel.

After the run was terminated, the plastic case was cracked and the encased gel transferred to a ready-to-use nitrocellulose membrane kit and power supply (iBLOT; LifeTechnologies, Grand Island, N.Y.). Using default settings, the protein lysate was transferred by high Ampere electricity from the gel to the membrane.

After the transfer, the membranes were incubated in 5% BSA in 1×TBS for 15 minutes then in 5% BSA in 1×TBS+ 0.1% Tween for another 15 minutes. Primary antibodies (Caspase 3 rabbit polyclonal antibody; Abcam, Cambridge, Mass.) against target proteins were applied in 3 ml of 5% BSA in 1×TBS solution at a 1:500 to 1:2000 dilution for 3 hours at room temperature and gentle agitation on an orbital shaker. Membranes are washed 3 times with 1×TBS/0.1% Tween, 5 minutes each time with gentle agitation. The secondary antibody (Goat anti-rabbit HRP conjugate; Abcam, Cambridge, Mass.) was conjugated to horse radish peroxidase and binds to the primary antibody antibodies. The secondary antibody was diluted of 1:1000 to 1:5000 in 5% BSA in 1×TBS and incubated for 3 hrs at RT.

At the end of incubation time, the membranes were washed 3 times with 1×TBS/0.1% Tween, 5 minutes each time with gentle agitation. The membranes were developed in 5 ml Pierce WestPico Chemiluminescent Substrate (Thermo Fisher, Rockford, Ill.) as directed.

Figure 5A:
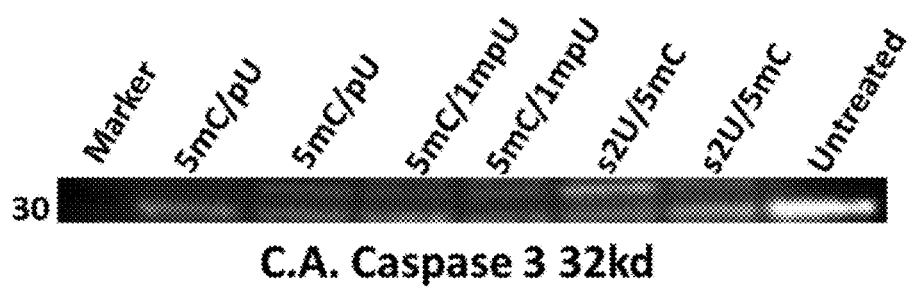
FIGS. 5A and 5B are gel profiles of constitutively active (C.A.) caspase 3 (also known as reverse caspase 3 (Rev-Caspase 3)) protein from C.A. caspase 3 modified mRNA in mammals.
Figure 5B:
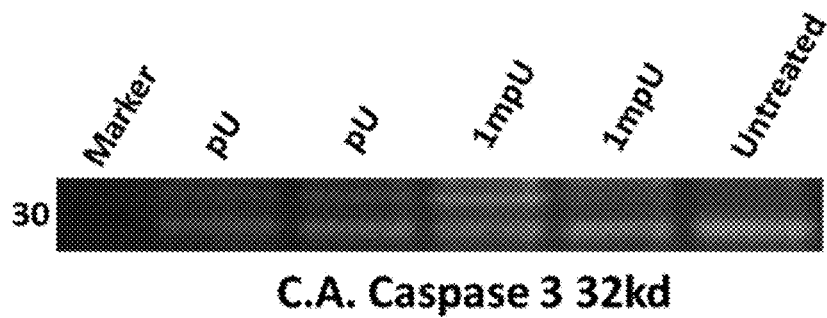

As shown in FIGS. 5A and 5B the Western Blot detected protein around the expected size of 32 kd for each of the 2 samples evaluated for each chemistry.

Example 30. Detection of Granulysin Protein: Western Blot

CD1 mice (Harlan Laboratories, South Easton, Mass.) were administered intravenously lipolexed granulysin mRNA (mRNA sequence shown in SEQ ID NO. 6620 (Table 29); polyA tail of approximately 140 nucleotides not shown in sequence; 5' cap, Cap1) fully modified with 5-methylcytidine and pseudouridine (5mC/pU), fully modified with 5-methylcytidine and 1-methylpseudouridine (5mC/1mpU), 25% of uridine modified with 2-thiouridine and 25% of cytidine modified with 5-methylcytidine (s2U and 5mC), fully modified with pseudouridine (pU) or fully modified with 1-methylpseudouridine (1mpU). The mice were administered a dose of 2 ug of mRNA complexed with 2 ul Lipofectamine 2000 (LifeTechnologies, Grand Island, N.Y.) in 100 ul sterile basal DMEM medium (w/o additives, LifeTechnologies, Grand Island, N.Y.).

After 6 hours, the animals were sacrificed and serum & spleen are taken. Spleens were transferred to 6-well plates and kept on ice in presence of 1 ml PBS. One spleen was cut with a scalpel several times and with a rubber cell scraper splenocytes were squeezed out until the PBS turns turbid due to cell release.

Leaving fibrous components behind, the cells were transferred to a 100 um cell strainer (BD Biosciences, San Jose, Calif.) sitting on a 12-well cell culture plate. By gravity the cells passed through the cell strainer and were collected beneath in the 12-well culture dish. 1 ml of PBS was transferred with the free-floating splenocytes to an Eppendorf tube and spun for 5 min at 2000 rpm. The PBS was discarded and the cell pellet combined with 500 ul fresh PBS. The splenocytes were resuspended by brief vortexing for 5 mins at 2000 rpm. The PBS was discarded and 1 ml BD Pharmlyse was added to the cell pellet. The splenocytes were resuspended by brief vortexing. The cells were incubated at room temperature for 3 minutes and then spun at 200 rpm for 5 minutes. The cells were washed twice with 500 ul PBS and spun as described above. The cells were resuspended with 500 ul of PBS and spun as described.

250 ul of splenocytes were combined with 1× Pharmlyse buffer and vortexed briefly or resuspended with a pipet and then spun for 2 minutes at 2000 rpm.

In one tube, resuspend cell pellet in 500 ul RIPA buffer with protease inhibitor cocktail for mammalian cells (BostonBioproducts, Ashland, Mass.) and freeze lysate or continue with BCA assay immediately. In a second tube, add 250 ul FACS staining kit fixation solution (4% formaldehyde; R and D Systems, Minneapolis, Minn.) and then incubate for 10 minutes at room temperature. The cells were washed twice with 500 ul PBS and spun as described above. The cell pellet was resuspended in 500 PBS and stored at 4° C.

Protein lysates were loaded on NuPage SDS-PAGE system (chambers and power supply) with 1.5 mm ready-to-use Bis-Tris gels and 4-12% acrylamide gradient with MOPS-buffer as running aid (all Life Technologies, Grand Island, N.Y.). Each lysate sample was prepared to 40 ul final volume. This sample contained 25 ug protein lysate in variable volume, RIPA buffer to make up volume to 26 ul, 4 ul of 10× reducing agent and 10 ul 4×SDS loading buffer (both from Life Technologies, Grand Island, N.Y.). Samples were heated at 95° C. for 5 min and loaded on the gel. Standard settings were chosen by the manufacturer, 200V, 120 mA and max. 25 W. Run time was 60 min, but no longer than running dye reaching the lower end of the gel.

After the run was terminated, the plastic case was cracked and the encased gel transferred to a ready-to-use nitrocellulose membrane kit and power supply (iBLOT; LifeTechnologies, Grand Island, N.Y.). Using default settings, the protein lysate was transferred by high Ampere electricity from the gel to the membrane.

After the transfer, the membranes were incubated in 5% BSA in 1×TBS for 15 minutes then in 5% BSA in 1×TBS+ 0.1% Tween for another 15 minutes. Primary antibodies (Granulysin mouse monoclonal antibody; Abcam, Cambridge, Mass.) against granulysin proteins were applied in 3 ml of 5% BSA in 1×TBS solution at a 1:500 to 1:2000 dilution for 3 hours at room temperature and gentle agitation on an orbital shaker. Membranes are washed 3 times with 1×TBS/0.1% Tween, 5 minutes each time with gentle agitation. The secondary antibody (Donkey anti-mouse HRP conjugate; Abcam, Cambridge, Mass.) was conjugated to horse radish peroxidase and binds to the primary antibody antibodies. The secondary antibody was diluted of 1:1000 to 1:5000 in 5% BSA in 1×TBS and incubated for 3 hrs at RT.

At the end of incubation time, the membranes were washed 3 times with 1×TBS/0.1% Tween, 5 minutes each time with gentle agitation. The membranes were developed in 5 ml Pierce WestPico Chemiluminescent Substrate (Thermo Fisher, Rockford, Ill.) as directed.

Figure 6A:
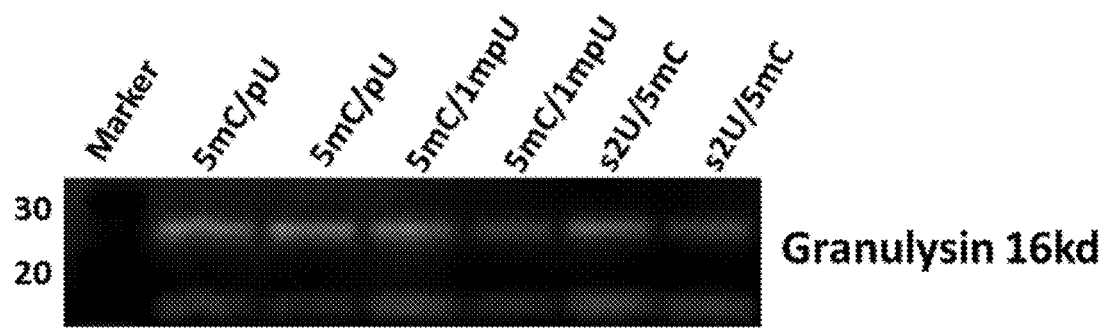
FIGS. 6A and 6B are gel profiles of Granulysin protein from granulysin modified mRNA in mammals.
Figure 6B:
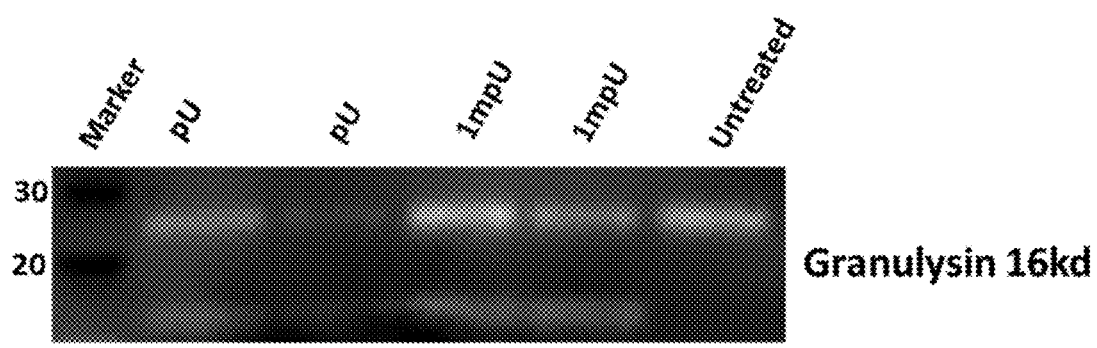

As shown in FIGS. 6A and 6B the Western Blot detected protein around the expected size of 16 kd for each of the 2 samples evaluated for each chemistry.

Example 31. Confirmation of Peptide Identity

Proteins can be evaluated using liquid chromatography-mass spectrometry in tandem with mass spectrometry (LC-MS/MS) with quantitative LC-multiple reaction monitoring (MRM) in order to confirm the identity of the peptide.

The identity of any protein target described herein can be evaluated using the liquid chromatography-mass spectrometry in tandem with mass spectrometry (LC-MS/MS) with quantitative LC-multiple reaction monitoring (MRM) Assay (Biognosys AG, Schlieren Switzerland). HeLa cell lysates containing protein expressed from modified mRNA are evaluated using LC-MS/MS with quantitative LC-MRM Assay (Biognosys, Schlieren Switzerland) in order to confirm the identity of the peptides in the cell lysates. The identified peptide fragments are compared against known proteins including isoforms using methods known and/or described in the art.

A. Sample Preparation

Protein in each sample in lysis buffer is reduced by incubation for 1 hour at 37° C. with 5 mM tris(2-carboxyethyl)phosphine (TCEP). Alkylation is carried out using 10 mM iodoacetamide for 30 minutes in the dark at room temperature. Proteins are digested to peptides using trypsin (sequence grade, Promega Corporation, Madison, Wis.) at a protease: protein ratio of 1:50. Digestion is carried out overnight at 37° C. (total digestion time is 12 hours). Peptides are cleaned up for mass spectrometric analysis using C18 spin columns (The Nest Group, Southborough, Mass.) according to the manufacturer's instructions. Peptides are dried down to complete dryness and resuspended in LC solvent A (1% acetonitrile, 0.1% formic acid (FA)). All solvents are HPLC-grade from SIGMA-ALDRICH® (St. Louis, Mo.) and all chemicals, where not stated otherwise, are obtained from SIGMA-ALDRICH® (St. Louis, Mo.).

B. LC-MS/MS and LC-MRM

Peptides are injected to a packed C18 column (Magic AQ, 3 um particle size, 200 Å pore size, Michrom Bioresources, Inc (Auburn, Calif.); 11 cm column length, 75 um inner diameter, New Objective (Woburn, Mass.)) on a Proxeon Easy nLC nano-liquid chromatography system for all mass spectrometric analysis. LC solvents are A: 1% acetonitrile in water with 0.1% FA; B: 3% water in acetonitrile with 0.1% FA. The LC gradient for shotgun analysis is 5-35% solvent B in 120 minutes followed by 35-100% solvent B in 2 minutes and 100% solvent B for 8 minutes (total gradient length is 130 minutes). LC-MS/MS shotgun runs for peptide discovery are carried out on a Thermo Scientific (Thermo Fisher Scientific) (Billerica, Mass.) Q Exactive mass spectrometer equipped with a standard nano-electrospray source. The LC gradient for LC-MRM is 5-35% solvent B in 30 minutes followed by 35-100% solvent B in 2 minutes and 100% solvent B for 8 minutes (total gradient length is 40 minutes). The Thermo Scientific (Thermo Fisher Scientific) (Billerica, Mass.) TSQ Vantage triple quadrupole mass spectrometer is equipped with a standard nano-electrospray source. In unscheduled MRM mode for recalibration it is operated at a dwell time of 20 ms per transition. For relative quantification of the peptides across samples, the TSQ Vantage is operated in scheduled MRM mode with an acquisition window length of 4 minutes. The LC eluent is electrosprayed at 1.9 kV and MRM analysis is performed using a Q1 peak width of 0.7 Da. Collision energies are calculated for the TSQ Vantage by a linear regression according to the vendor's specifications.

C. Assay Design, Data Processing and Analysis

For the generation of LC-MRM assays, the 12 most intense fragment ions from LC-MS/MS analysis are measured in scheduled LC-MRM mode and data were processed using MQUEST® (Cluetec, Karlsruhe, Germany), the scoring part of mProphet (Reiter et al, mProphet: Automated data processing and statistical validation for large-scale SRM experiments, Nature Methods, 2011 (8), 430-435; the contents of which are herein incorporated by reference). Assays were validated manually, exact fragment intensities are determined and iRTs (indexed retention times) are assigned relative to Biognosys's iRT-peptides (Esther et al. Using iRT, a normalized retention time for more targeted measurement of peptides, Proteomics, 2012 (12), 1111-1121; the contents of which are herein incorporated by reference).

For the relative quantification of the peptides across the sample series the 8 most intense transitions of each assay are measured across the sample series. Data analysis is carried out using SpectroDive™ (Biognosys, Schlieren Switzerland). Total peak areas are compared for the selected peptides and a false discover rate of 0.05 is applied. Peptides with a Qvalue below 0.05 are excluded and considered not detected in the respective sample.

Example 32. Confirmation and of Peptide Identity from Chemically Modified mRNA Cell lysates containing protein produced from siah E3 ubiquitin protein ligase 1 (SIAH1) modified mRNA (mRNA sequence shown in SEQ ID NO. 6618 (Table 29); polyA tail of approximately 140 nucleotides not shown in sequence; 5' cap, Cap1), MYC inhibitor D (a unique dominant-negative 90 amino acid protein comprised of the human c-Myc) modified mRNA (mRNA sequence shown in SEQ ID NO. 6621 (Table 29); polyA tail of approximately 140 nucleotides not shown in sequence; 5' cap, Cap1), fully modified with 5-methylcytidine and pseudouridine (5mC and pU), fully modified with 5-methylcytidine and 1-methylpseudouridine (5mC and 1 mpU), modified where 25% of uridine modified with 2-thiouridine and 25% of cytidine modified with 5-methylcytidine (s2U and 5mC), fully modified with pseudouridine (pU), or fully modified with 1-methylpseudouridine (1mpU) were evaluated using the LC-MS/MS with quantitative LC-MRM as described in Example 31. Peptide fragments identified for the evaluated proteins are shown in Table 30.

TABLE 30

Proteins and Peptide Fragment Sequences

| Peptide Fragment SEQ ID NO | 5mC and pU | 5mC and 1mpU | s2U and 5mC | pU | 1mpU |
|---|---|---|---|---|---|
| SIAH1 | | | | | |
| GPLGSIR 6622 | YES | — | YES | — | YES |
| MYC INHIBITOR D | | | | | |
| ATAYILSVQAETQK 6623 | YES | YES | YES | YES | YES |
| KATAYILSVQAETQK 6624 | YES | YES | YES | YES | YES |
| LISEIDLLRK 6625 | YES | YES | YES | YES | YES |

Example 33. Confirmation and of Peptide Identity from 1-Methylpseudouridine Modified mRNA Cell lysates containing protein produced from granulysin mRNA (mRNA sequence shown in Table 29; polyA tail of approximately 140 nucleotides not shown in sequence; 5' cap, Cap1) fully modified with 1-methylpseudouridine (1mpU) were evaluated using the LC-MS/MS with quantitative LC-MRM as described in Example 31. Peptide fragments identified for the evaluated proteins are shown in Table 31. In Table 31, "Uniprot ID" refers to the protein identifier from the UniProt database when the peptide fragment sequences were blasted against all review proteins in the database.

TABLE 31

Proteins and Peptide Fragment Sequences

| Peptide Fragment SEQ ID NO | Uniprot ID |
|---|---|
| GRANULYSIN | |
| SCPCLAQEGPQGDLLTK 6626 | P22749 |

Example 34. Signal-Sensor Polynucleotides in the Treatment of Cancer (HCC): Disruption of Cancer Cell Transcriptome Using Dominant Negative STAT3 and Akt mRNA Using the animal models outlined in Example 13, animals are treated with signal-sensor polynucleotide encoding for a dominant negative STAT3 molecule or a dominant negative Akt molecule whose expression has been shown to interfere with PI-3 kinase induced oncogenic transformation, including in glioblastoma cells (Vogt and Hart, Cancer Discov, 2011 1:481-486; herein included by reference in its entirety). Animals are injected with mRNA encoding dominant negative STAT3 mRNA vs dominant negative Akt mRNA vs negative control mRNA (non-translated version of the same mRNA containing multiple stop codons) vs vehicle using an appropriate route of delivery and formulation. Animals are then evaluated for gene expression, tumor status or for any of the hallmarks associated with cancer phenotypes or genotypes. Other examples of dominant negative approaches for cancer are outlined and could similarly be used with modified mRNA (Moss and Lemoine Chapter 15 RNA Interference and Dominant Negative Approaches in Viral Therapy of Cancer Harrington et al., eds. Wiley & Sons; herein incorporated by reference in its entirety).

Example 35. Signal-Sensor Polynucleotides in the Treatment of Cancer (HCC): Disruption of Cancer Cell Transcriptome Using Dominant Negative hTERT mRNA Using the animal models outlined in Example 13, animals are treated with signal-sensor polynucleotide encoding for a dominant negative hTERT whose expression has been shown to interfere with telomerase activity and lead to apoptosis of cancer cells (Agrawal et al. 2012 Recent Pat Anticancer Drug Discov 7:102-117, Samy et al. 2012 Mol Cancer Ther 11:2384-2393, Nguyen et al. 2009 Cell Cycle. 8:3227-3233; all herein included by reference in their entirety). Telomerase, a specialised RNA-directed DNA polymerase extends and stabilises the telomeres at the ends of the eukaryotic chromosomes. The progressive loss of telomeres results in limited number of cell divisions and has been linked to the mechanism of human cellular ageing. Tumour cells marked by indefinite proliferation have stable telomere length maintained by telomerase. The differential expression of the telomerase enzyme in normal and cancer cells have led to the evolution of tumour specific anti-telomerase approaches which inhibit the telomerase enzyme activity so as to destabilise and shorten the telomeres leading to senescence in cancer cells. One such approach is to use modified mRNA to express a dominant negative hTERT. As such animals are injected with mRNA encoding dominant negative hTERT mRNA vs negative control mRNA (non-translated version of the same mRNA containing multiple stop codons) vs vehicle using an appropriate route of delivery and formulation. Animals are then evaluated for gene expression, tumor status or for any of the hallmarks associated with cancer phenotypes or genotypes. Other examples of dominant negative approaches for cancer are outlined and could similarly be used with modified mRNA (Moss and Lemoine Chapter 15 RNA Interference and Dominant Negative Approaches in Viral Therapy of Cancer Harrington et al., eds. Wiley & Sons; herein incorporated by reference in its entirety).

Example 36. Signal-Sensor Polynucleotides in the Treatment of Cancer (HCC): Disruption of Cancer Cell Transcriptome Using Dominant Negative Survivin mRNA Using the animal models outlined in Example 13, animals are treated with signal-sensor polynucleotide encoding for a dominant negative survivin (C84A and others) whose expression has been shown to lead to apoptosis of cancer cells (Cheung et al. 2010 Cancer Cell Int. 10:36; herein included by reference in its entirety). Survivin is a member of the inhibitor-of-apoptosis (IAP) family which is widely expressed by many different cancers. Overexpression of survivin is associated with drug resistance in cancer cells, and reduced patient survival after chemotherapy and radiotherapy. Agents that antagonize the function of survivin hold promise for treating many forms of cancer. One such approach is to use modified mRNA to express a dominant negative survivin (C84A mutation is one described example). As such animals are injected with mRNA encoding dominant negative survivin mRNA vs negative control mRNA (non-translated version of the same mRNA containing multiple stop codons) vs vehicle using an appropriate route of delivery and formulation. Animals are then evaluated for gene expression, tumor status or for any of the hallmarks associated with cancer phenotypes or genotypes. Other examples of dominant negative approaches for cancer are outlined and could similarly be used with modified mRNA (Moss and Lemoine Chapter 15_RNA Interference and Dominant Negative Approaches in Viral Therapy of Cancer Harrington et al., eds. Wiley & Sons; herein incorporated by reference in its entirety).

Example 37. Expression of Modified Nucleic Acid with microRNA Binding Site

Human embryonic kidney epithelial cells (HEK293A), or antigen presenting cells or cell lines with highly expressed mir-142/146, such as monocyte-derived dendritic cells (MDDC) or PBMC, are seeded at a density of 200,000 per well in 500 ul cell culture medium (InVitro GRO medium from Celsis, Chicago, Ill.). G-CSF mRNA (mRNA sequence is shown in SEQ ID NO: 6595; polyA tail of at least 140 nucleotides not shown in sequence; 5'Cap, Cap1) G-CSF mRNA having a miR-142-5p binding site (G-CSF miR-142-5p) (cDNA sequence is shown in SEQ ID NO:6627; mRNA sequence is shown in SEQ ID NO: 6628, polyA tail of at least 140 nucleotides not shown in sequence; 5'Cap, Cap1), G-CSF mRNA having a seed sequence from miR-142-5p binding site (G-CSF miR-142-5p-seed) (cDNA sequence is shown in SEQ ID NO. 6629; mRNA sequence is shown in SEQ ID NO: 6630; polyA tail of at least 140 nucleotides not shown in sequence; 5'Cap, Cap1) G-CSF mRNA having a miR-142-5p binding site without the seed sequence (G-CSF miR-142-5p-seedless) (cDNA sequence is shown in SEQ ID NO: 6631, mRNA sequence is shown in SEQ ID NO: 6632; polyA tail of at least 140 nucleotides not shown in sequence; 5'Cap, Cap1) G-CSF mRNA having a miR-142-3p binding site (G-CSF miR-142-3p) (cDNA sequence is shown in SEQ ID NO: 6633, mRNA sequence is shown in SEQ ID NO: 6634; polyA tail of at least 140 nucleotides not shown in sequence; 5'Cap, Cap1; G-CSF mRNA having a seed sequence from miR-142-3p binding site (G-CSF miR-142-3p-seed) (cDNA sequence is shown in SEQ ID NO: 6635, mRNA sequence is shown in SEQ ID NO: 6636; polyA tail of at least 140 nucleotides not shown in sequence; 5'Cap, Cap1) G-CSF mRNA having a miR-142-3p binding site without the seed sequence (G-CSF miR-142-3p-seedless) (cDNA sequence is shown in SEQ ID NO: 6637; mRNA sequence is shown in SEQ ID NO: 6638; polyA tail of at least 140 nucleotides not shown in sequence; 5'Cap, Cap1) G-CSF mRNA having a miR-146a binding site (G-CSF miR-146a) (cDNA sequence is shown in SEQ ID NO. 6639, mRNA sequence is shown in SEQ ID NO: 6640; polyA tail of at least 140 nucleotides not shown in sequence; 5'Cap, Cap1) G-CSF mRNA having a seed sequence from miR-146a binding site (G-CSF miR-146a-seed) (cDNA sequence is shown in SEQ ID NO. 6641, mRNA sequence is shown in SEQ ID NO:6642; polyA tail at least 140 nucleotides not shown in sequence; 5'Cap, Cap1) or G-CSF mRNA having a miR-146a binding site without the seed sequence (G-CSF miR-146a-seedless) (cDNA sequence is shown in SEQ ID NO. 6643, mRNA sequence is shown in SEQ ID NO: 6644; polyA tail at least nucleotides not shown in sequence; 5'Cap, Cap1) are tested at a concentration of 250 ng per well in 24 well plates. The mRNA sequences are evaluated with various chemical modifications described herein and/or known in the art including, fully modified with 5-methylcytidine and pseudouridine, fully modified with 5-methylcytidine and 1-methylpseudouridine, fully modified with pseudouridine, fully modified with 1-methylpseudouridine and where 25% of the uridine residues are modified with 2-thiouridine and 25% of the cytidine residues are modified with 5-methylcytidine. The expression of G-CSF in each sample is measured by ELISA.

Shown in Table 32 are the DNA and mRNA G-CSF sequences with the miR binding sites described above. In the table, the start codon of each sequence is underlined.

TABLE 32

G-CSF constructs with miR binding sites

| SEQ ID NO. | Description | SEQ |
|---|---|---|
| 6627 | DNA sequence having the T7 polymerase site and restriction sites: G-CSF miR-142-5p | TAATACGACTCACTATA GGGAAATAAGAGAGAAAAGAAGAGTAAGAAGAAATATAAGAGCC ACC<u>ATG</u>GCCGGTCCCGCGACCCAAAGCCCCATGAAACTTATGGCC CTGCAGTTGCTGCTTTGGCACTCGGCCCTCTGGACAGTCCAAGAAG CGACTCCTCTCGGACCTGCCTCATCGTTGCCGCAGTCATTCCTTTTG AAGTGTCTGGAGCAGGTGCGAAAGATTCAGGGCGATGGAGCCGCA CTCCAAGAGAAGCTCTGCGCGACATACAAACTTTGCCATCCCGAG GAGCTCGTACTGCTCGGGCACAGCTTGGGGATTCCCTGGGCTCCTC TCTCGTCCTGTCCGTCGCAGGCTTTGCAGTTGGCAGGGTGCCTTTC CCAGCTCCACTCCGGTTTGTTCTTGTATCAGGGACTGCTGCAAGCC CTTGAGGGAATCTCGCCAGAATTGGGCCCGACGCTGGACACGTTG CAGCTCGACGTGGCGGATTTCGCAACAACCATCTGGCAGCAGATG GAGGAACTGGGGATGGCACCCGCTGCAGCCCACGCAGGGGGC AATGCCGGCCTTTGCGTCCGCGTTTCAGCGCAGGGCGGGTGGAGT CCTCGTAGCGAGCCACCTTCAATCATTTTTGGAAGTCTCGTACCGG GTGCTGAGACATCTTGCGCAGCCGTGATAATAGGCTGCCTTCTGCG GGGCTTGCCTTCTGGCCATGCCCTTCTTCTCTCCCTTGCACCTGTAC CTCTAGTAGTGCTTTCTACTTTATGTGGTCTTTGAATAAAGCCTGA GTAGGAAGGCGGCCGCTCGAGCATGCATCTAGA |
| 6628 | mRNA sequence: G-CSF miR-142-5p | GGGAAAUAAGAGAGAAAAGAAGAGUAAGAAGAAAUAUAAGAGC CACC<u>AUG</u>GCCGGUCCCGCGACCCAAAGCCCCAUGAAACUUAUGG CCCUGCAGUUGCUGCUUUGGCACUCGGCCCUCUGGACAGUCCAA GAAGCGACUCCUCUCGGACCUGCCUCAUCGUUGCCGCAGUCAUU CCUUUUGAAGUGUCUGGAGCAGGUGCGAAAGAUUCAGGGCGAU GGAGCCGCACUCCAAGAGAAGCUCUGCGCGACAUACAAACUUUG CCAUCCCGAGGAGCUCGUACUGCUCGGGCACAGCUUGGGGAUUC CCUGGGCUCCUCUCUCGUCCUGUCCGUCGCAGGCUUUGCAGUUG GCAGGGUGCCUUUCCCAGCUCCACUCCGGUUUGUUCUUGUAUCA GGGACUGCUGCAAGCCCUUGAGGGAAUCUCGCCAGAAUUGGGCC CGACGCUGGACACGUUGCAGCUCGACGUGGCGGAUUUCGCAACA ACCAUCUGGCAGCAGAUGGAGGAACUGGGGAUGGCACCCGCGCU GCAGCCCACGCAGGGGGCAAUGCCGGCCUUUGCGUCCGCGUUUC AGCGCAGGGCGGGUGGAGUCCUCGUAGCGAGCCACCUUCAAUCA UUUUUGGAAGUCUCGUACCGGGUGCUGAGACAUCUUGCGCAGCC GUGAUAAUAGGCUGCCUUCUGCGGGGCUUGCCUUCUGGCCAUGC CCUUCUUCUCUCCCUUGCACCUGUACCUCUAGUAGUGCUUUCUA CUUUAUGUGGUCUUUGAAUAAAGCCUGAGUAGGAAGG |
| 6629 | DNA sequence having the T7 polymerase site and restriction sites: G-CSF miR-142-5p-seed | TAATACGACTCACTATA GGGAAATAAGAGAGAAAAGAAGAGTAAGAAGAAATATAAGAGCC ACC<u>ATG</u>GCCGGTCCCGCGACCCAAAGCCCCATGAAACTTATGGCC CTGCAGTTGCTGCTTTGGCACTCGGCCCTCTGGACAGTCCAAGAAG CGACTCCTCTCGGACCTGCCTCATCGTTGCCGCAGTCATTCCTTTTG AAGTGTCTGGAGCAGGTGCGAAAGATTCAGGGCGATGGAGCCGCA CTCCAAGAGAAGCTCTGCGCGACATACAAACTTTGCCATCCCGAG GAGCTCGTACTGCTCGGGCACAGCTTGGGGATTCCCTGGGCTCCTC TCTCGTCCTGTCCGTCGCAGGCTTTGCAGTTGGCAGGGTGCCTTTC CCAGCTCCACTCCGGTTTGTTCTTGTATCAGGGACTGCTGCAAGCC CTTGAGGGAATCTCGCCAGAATTGGGCCCGACGCTGGACACGTTG CAGCTCGACGTGGCGGATTTCGCAACAACCATCTGGCAGCAGATG GAGGAACTGGGGATGGCACCCGCTGCAGCCCACGCAGGGGGC AATGCCGGCCTTTGCGTCCGCGTTTCAGCGCAGGGCGGGTGGAGT CCTCGTAGCGAGCCACCTTCAATCATTTTTGGAAGTCTCGTACCGG GTGCTGAGACATCTTGCGCAGCCGTGATAATAGGCTGCCTTCTGCG GGGCTTGCCTTCTGGCCATGCCCTTCTTCTCTCCCTTGCACCTGTAC CTCTACTTTATTGGTCTTTGAATAAAGCCTGAGTAGGAAGGCGGC CGCTCGAGCATGCATCTAGA |
| 6630 | mRNA sequence: G-CSF miR-142-5p-seed | GGGAAAUAAGAGAGAAAAGAAGAGUAAGAAGAAAUAUAAGAGC CACC <u>AUG</u>GCCGGUCCCGCGACCCAAAGCCCCAUGAAACUUAUGGCCCU GCAGUUGCUGCUUUGGCACUCGCCCUCUGGACAGUCCAAGAAG CGACUCCUCUCGGACCUGCCUCAUCGUUGCCGCAGUCAUUCCUU UUGAAGUGUCUGGAGCAGGUGCGAAAGAUUCAGGGCGAUGGAG CCGCACUCCAAGAGAAGCUCUGCGCGACAUACAAACUUUGCCAU CCCGAGGAGCUCGUACUGCUCGGGCACAGCUUGGGGAUUCCCUG GGCUCCUCUCUCGUCCUGUCCGUCGCAGGCUUUGCAGUUGGCAG GGUGCCUUUCCCAGCUCCACUCCGGUUUGUUCUUGUAUCAGGGA CUGCUGCAAGCCCUUGAGGGAAUCUCGCCAGAAUUGGGCCCGAC GCUGGACACGUUGCAGCUCGACGUGGCGGAUUUCGCAACAACCA UCUGGCAGCAGAUGGAGGAACUGGGGAUGGCACCCGCGCUGCAG CCCACGCAGGGGGCAAUGCCGGCCUUUGCGUCCGCGUUUCAGCG CAGGGCGGGUGGAGUCCUCGUAGCGAGCCACCUUCAAUCAUUUU |

TABLE 32-continued

G-CSF constructs with miR binding sites

| SEQ ID NO. | Description | SEQ |
|---|---|---|
| | | UGGAAGUCUCGUACCGGGUGCUGAGACAUCUUGCGCAGCCG UGAUAAUAGGCUGCCUUCUGCGGGGCUUGCCUUCUGGCCAUGCC CUUCUUCUCUCCCUUGCACCUGUACCUCUACUUUAUUGGUCUUU GAAUAAAGCCUGAGUAGGAAG |
| 6631 | DNA sequence having the T7 polymerase site and restriction sites: G-CSF miR-142-5p-seedless | TAATACGACTCACTATA GGGAAATAAGAGAGAAAAGAAGAGTAAGAAGAAATATAAGAGCC ACC<u>ATG</u>GCCGGTCCCGCGACCCAAAGCCCCATGAAACTTATGGCC CTGCAGTTGCTGCTTTGGCACTCGGCCCTCTGGACAGTCCAAGAAG CGACTCCTCTCGGACCTGCCTCATCGTTGCCGCAGTCATTCCTTTTG AAGTGTCTGGAGCAGGTGCGAAAGATTCAGGGCGATGGAGCCGCA CTCCAAGAGAAGCTCTGCGCGACATACAAACTTTGCCATCCCGAG GAGCTCGTACTGCTCGGGCACAGCTTGGGGATTCCCTGGGCTCCTC TCTCGTCCTGTCCGTCGCAGGCTTTGCAGTTGGCAGGGTGCCTTTC CCAGCTCCACTCCGGTTTGTTCTTGTATCAGGGACTGCTGCAAGCC CTTGAGGGAATCTCGCCAGAATTGGGCCCGACGCTGGACACGTTG CAGCTCGACGTGGCGGATTTCGCAACAACCATCTGGCAGCAGATG GAGGAACTGGGGATGGCACCCGCGCTGCAGCCCACGCAGGGGGC AATGCCGGCCTTTGCGTCCGCGTTTCAGCGCAGGGCGGGTGGAGT CCTCGTAGCGAGCCACCTTCAATCATTTTTGGAAGTCTCGTACCGG GTGCTGAGACATCTTGCGCAGCCGTGATAATAGGCTGCCTTCTGCG GGGCTTGCCTTCTGGCCATGCCCTTCTTCTCTCCCTTGCACCTGTAC CTCTAGTAGTGCTTTCTGTGGTCTTTGAATAAAGCCTGAGTAGGAA GGCGGCCGCTCGAGCATGCATCTAGA |
| 6632 | mRNA sequence: G-CSF miR-142-5p-seedless | GGGAAAUAAGAGAGAAAAGAAGAGUAAGAAGAAAUAUAAGAGC CACC <u>AUG</u>GCCGGUCCCGCGACCCAAAGCCCCAUGAAACUUAUGGCCCU GCAGUUGCUGCUUUGGCACUCGGCCCUCUGGACAGUCCAAGAAG CGACUCCUCUCGGACCUGCCUCAUCGUUGCCGCAGUCAUUCCUU UUGAAGUGUCUGGAGCAGGUGCGAAAGAUUCAGGGCGAUGGAG CCGCACUCCAAGAGAAGCUCUGCGCGACAUACAAACUUUGCCAU CCCGAGGAGCUCGUACUGCUCGGGCACAGCUUGGGGAUUCCCUG GGCUCCUCUCUCGUCCUGUCCGUCGCAGGCUUUGCAGUUGGCAG GGUGCCUUUCCCAGCUCCACUCCGGUUUGUUCUUGUAUCAGGGA CUGCUGCAAGCCCUUGAGGGAAUCUCGCCAGAAUUGGGCCCGAC GCUGGACACGUUGCAGCUCGACGUGGCGGAUUUCGCAACAACCA UCUGGCAGCAGAUGGAGGAACUGGGGAUGGCACCCGCGCUGCAG CCCACGCAGGGGGCAAUGCCGGCCUUUGCGUCCGCGUUUCAGCG CAGGGCGGGUGGAGUCCUCGUAGCGAGCCACCUUCAAUCAUUUU UGGAAGUCUCGUACCGGGUGCUGAGACAUCUUGCGCAGCCG UGAUAAUAGGCUGCCUUCUGCGGGGCUUGCCUUCUGGCCAUGCC CUUCUUCUCUCCCUUGCACCUGUACCUCUAGUAGUGCUUUCUGU GGUCUUUGAAUAAAGCCUGAGUAGGAAG |
| 6633 | DNA sequence having the T7 polymerase site and restriction sites: G-CSF miR-142-3p | TAATACGACTCACTATA GGGAAATAAGAGAGAAAAGAAGAGTAAGAAGAAATATAAGAGCC ACC<u>ATG</u>GCCGGTCCCGCGACCCAAAGCCCCATGAAACTTATGGCC CTGCAGTTGCTGCTTTGGCACTCGGCCCTCTGGACAGTCCAAGAAG CGACTCCTCTCGGACCTGCCTCATCGTTGCCGCAGTCATTCCTTTTG AAGTGTCTGGAGCAGGTGCGAAAGATTCAGGGCGATGGAGCCGCA CTCCAAGAGAAGCTCTGCGCGACATACAAACTTTGCCATCCCGAG GAGCTCGTACTGCTCGGGCACAGCTTGGGGATTCCCTGGGCTCCTC TCTCGTCCTGTCCGTCGCAGGCTTTGCAGTTGGCAGGGTGCCTTTC CCAGCTCCACTCCGGTTTGTTCTTGTATCAGGGACTGCTGCAAGCC CTTGAGGGAATCTCGCCAGAATTGGGCCCGACGCTGGACACGTTG CAGCTCGACGTGGCGGATTTCGCAACAACCATCTGGCAGCAGATG GAGGAACTGGGGATGGCACCCGCGCTGCAGCCCACGCAGGGGGC AATGCCGGCCTTTGCGTCCGCGTTTCAGCGCAGGGCGGGTGGAGT CCTCGTAGCGAGCCACCTTCAATCATTTTTGGAAGTCTCGTACCGG GTGCTGAGACATCTTGCGCAGCCGTGATAATAGGCTGCCTTCTGCG GGGCTTGCCTTCTGGCCATGCCCTTCTTCTCTCCCTTGCACCTGTAC CTCTTCCATAAAGTAGGAAACACTACATGGTCTTTGAATAAAGCCT GAGTAGGAAGGCGGCCGCTCGAGCATGCATCTAGA |
| 6634 | mRNA sequence: G-CSF miR-142-3p | GGGAAAUAAGAGAGAAAAGAAGAGUAAGAAGAAAUAUAAGAGC CACC <u>AUG</u>GCCGGUCCCGCGACCCAAAGCCCCAUGAAACUUAUGGCCCU GCAGUUGCUGCUUUGGCACUCGGCCCUCUGGACAGUCCAAGAAG CGACUCCUCUCGGACCUGCCUCAUCGUUGCCGCAGUCAUUCCUU UUGAAGUGUCUGGAGCAGGUGCGAAAGAUUCAGGGCGAUGGAG CCGCACUCCAAGAGAAGCUCUGCGCGACAUACAAACUUUGCCAU CCCGAGGAGCUCGUACUGCUCGGGCACAGCUUGGGGAUUCCCUG GCUCCUCUCUCGUCCUGUCCGUCGCAGGCUUUGCAGUUGGCAG |

TABLE 32-continued

G-CSF constructs with miR binding sites

| SEQ ID NO. | Description | SEQ |
|---|---|---|
| | | GGUGCCUUUCCCAGCUCCACUCCGGUUUGUUCUUGUAUCAGGGA<br>CUGCUGCAAGCCCUUGAGGGAAUCUCGCCAGAAUUGGGCCCGAC<br>GCUGGACACGUUGCAGCUCGACGUGGCGGAUUUCGCAACAACCA<br>UCUGGCAGCAGAUGGAGGAACUGGGGAUGGCACCCGCGCUGCAG<br>CCCACGCAGGGGGCAAUGCCGGCCUUUGCGUCCGCGUUUCAGCG<br>CAGGGCGGGUGGAGUCCUCGUAGCGAGCCACCUUCAAUCAUUUU<br>UGGAAGUCUCGUACCGGGUGCUGAGACAUCUUGCGCAGCCG<br>UGAUAAUAGGCUGCCUUCUGCGGGGCUUGCCUUCUGGCCAUGCC<br>CUUCUUCUCUCCCUUGCACCUGUACCUCUUCCAUAAAGUAGGAA<br>ACACUACAUGGUCUUUGAAUAAAGCCUGAGUAGGAAG |
| 6635 | DNA sequence having the T7 polymerase site and restriction sites: G-CSF miR-142-3p-seed | TAATACGACTCACTATA<br>GGGAAATAAGAGAGAAAAGAAGAGTAAGAAGAAATATAAGAGCC<br>ACC<u>ATG</u>GCCGGTCCCGCGACCCAAAGCCCCATGAAACTTATGGCC<br>CTGCAGTTGCTGCTTTGGCACTCGGCCCTCTGGACAGTCCAAGAAG<br>CGACTCCTCTCGGACCTGCCTCATCGTTGCCGCAGTCATTCCTTTTG<br>AAGTGTCTGGAGCAGGTGCGAAAGATTCAGGGCGATGGAGCCGCA<br>CTCCAAGAGAAGCTCTGCGCGACATACAAACTTTGCCATCCCGAG<br>GAGCTCGTACTGCTCGGGCACAGCTTGGGGATTCCCTGGGCTCCTC<br>TCTCGTCCTGTCCGTCGCAGGCTTTGCAGTTGGCAGGGTGCCTTTC<br>CCAGCTCCACTCCGGTTTGTTCTTGTATCAGGGACTGCTGCAAGCC<br>CTTGAGGGAATCTCGCCAGAATTGGGCCCGACGCTGGACACGTTG<br>CAGCTCGACGTGGCGGATTTCGCAACAACCATCTGGCAGCAGATG<br>GAGGAACTGGGGATGGCACCCGCGCTGCAGCCCACGCAGGGGGC<br>AATGCCGGCCTTTGCGTCCGCGTTTCAGCGCAGGGCGGGTGGAGT<br>CCTCGTAGCGAGCCACCTTCAATCATTTTTGGAAGTCTCGTACCGG<br>GTGCTGAGACATCTTGCGCAGCCGTGATAATAGGCTGCCTTCTGCG<br>GGGCTTGCCTTCTGGCCATGCCCTTCTTCTCTCCCTTGCACCTGTAC<br>CTCTACACTACTGGTCTTTGAATAAAGCCTGAGTAGGAAGGCGGC<br>CGCTCGAGCATGCATCTAGA |
| 6636 | mRNA sequence: G-CSF miR-142-3p-seed | GGGAAAUAAGAGAGAAAAGAAGAGUAAGAAGAAAUAUAAGAGC<br>CACC<br><u>AUG</u>GCCGGUCCCGCGACCCAAAGCCCCAUGAAACUUAUGGCCCU<br>GCAGUUGCUGCUUUGGCACUCGGCCCUCUGGACAGUCCAAGAAG<br>CGACUCCUCUCGGACCUGCCUCAUCGUUGCCGCAGUCAUUCCUU<br>UUGAAGUGUCUGGAGCAGGUGCGAAAGAUUCAGGGCGAUGGAG<br>CCGCACUCCAAGAGAAGCUCUGCGCGACAUACAAACUUUGCCAU<br>CCCGAGGAGCUCGUACUGCUCGGGCACAGCUUGGGGAUUCCCUG<br>GGCUCCUCUCUCGUCCUGUCCGUCGCAGGCUUUGCAGUUGGCAG<br>GGUGCCUUUCCCAGCUCCACUCCGGUUUGUUCUUGUAUCAGGGA<br>CUGCUGCAAGCCCUUGAGGGAAUCUCGCCAGAAUUGGGCCCGAC<br>GCUGGACACGUUGCAGCUCGACGUGGCGGAUUUCGCAACAACCA<br>UCUGGCAGCAGAUGGAGGAACUGGGGAUGGCACCCGCGCUGCAG<br>CCCACGCAGGGGGCAAUGCCGGCCUUUGCGUCCGCGUUUCAGCG<br>CAGGGCGGGUGGAGUCCUCGUAGCGAGCCACCUUCAAUCAUUUU<br>UGGAAGUCUCGUACCGGGUGCUGAGACAUCUUGCGCAGCCG<br>UGAUAAUAGGCUGCCUUCUGCGGGGCUUGCCUUCUGGCCAUGCC<br>CUUCUUCUCUCCCUUGCACCUGUACCUCUACACUACUGGUCUUU<br>GAAUAAAGCCUGAGUAGGAAG |
| 6637 | DNA sequence having the T7 polymerase site and restriction sites: G-CSF miR-142-3p-seedless | TAATACGACTCACTATA<br>GGGAAATAAGAGAGAAAAGAAGAGTAAGAAGAAATATAAGAGCC<br>ACC<u>ATG</u>GCCGGTCCCGCGACCCAAAGCCCCATGAAACTTATGGCC<br>CTGCAGTTGCTGCTTTGGCACTCGGCCCTCTGGACAGTCCAAGAAG<br>CGACTCCTCTCGGACCTGCCTCATCGTTGCCGCAGTCATTCCTTTTG<br>AAGTGTCTGGAGCAGGTGCGAAAGATTCAGGGCGATGGAGCCGCA<br>CTCCAAGAGAAGCTCTGCGCGACATACAAACTTTGCCATCCCGAG<br>GAGCTCGTACTGCTCGGGCACAGCTTGGGGATTCCCTGGGCTCCTC<br>TCTCGTCCTGTCCGTCGCAGGCTTTGCAGTTGGCAGGGTGCCTTTC<br>CCAGCTCCACTCCGGTTTGTTCTTGTATCAGGGACTGCTGCAAGCC<br>CTTGAGGGAATCTCGCCAGAATTGGGCCCGACGCTGGACACGTTG<br>CAGCTCGACGTGGCGGATTTCGCAACAACCATCTGGCAGCAGATG<br>GAGGAACTGGGGATGGCACCCGCGCTGCAGCCCACGCAGGGGGC<br>AATGCCGGCCTTTGCGTCCGCGTTTCAGCGCAGGGCGGGTGGAGT<br>CCTCGTAGCGAGCCACCTTCAATCATTTTTGGAAGTCTCGTACCGG<br>GTGCTGAGACATCTTGCGCAGCCGTGATAATAGGCTGCCTTCTGCG<br>GGGCTTGCCTTCTGGCCATGCCCTTCTTCTCTCCCTTGCACCTGTAC<br>CTCTTCCATAAAGTAGGAAATGGTCTTTGAATAAAGCCTGAGTAG<br>GAAGGCGGCCGCTCGAGCATGCATCTAGA |

TABLE 32-continued

G-CSF constructs with miR binding sites

| SEQ ID NO. | Description | SEQ |
|---|---|---|
| 6638 | mRNA sequence: G-CSF miR-142-3p-seedless | GGGAAAUAAGAGAGAAAAGAAGAGUAAGAAGAAAUAUAAGAGC CACC<u>AUG</u>GCCGGUCCCGCGACCCAAAGCCCCAUGAAACUUAUGG CCCUGCAGUUGCUGCUUUGGCACUCGGCCCUCUGGACAGUCCAA GAAGCGACUCCUCUCGGACCUGCCUCAUCGUUGCCGCAGUCAUU CCUUUUGAAGUGUCUGGAGCAGGUGCGAAAGAUUCAGGGCGAU GGAGCCGCACUCCAAGAGAAGCUCUGCGCGACAUACAAACUUUG CCAUCCCGAGGAGCUCGUACUGCUCGGGCACAGCUUGGGGAUUC CCUGGGCUCCUCUCUCGUCCUGUCCGUCGCAGGCUUUGCAGUUG GCAGGGUGCCUUUCCCAGCUCCACUCCGGUUUGUUCUUGUAUCA GGGACUGCUGCAAGCCCUUGAGGGAAUCUCGCCAGAAUUGGGCC CGACGCUGGACACGUUGCAGCUCGACGUGGCGGAUUUCGCAACA ACCAUCUGGCAGCAGAUGGAGGAACUGGGGAUGGCACCCGCGCU GCAGCCCACGCAGGGGGCAAUGCCGGCCUUUGCGUCCGCGUUUC AGCGCAGGGCGGGUGGAGUCCUCGUAGCGAGCCACCUUCAAUCA UUUUUGGAAGUCUCGUACCGGGUGCUGAGACAUCUUGCGCAGCC GUGAUAAUAGGCUGCCUUCUGCGGGGCUUGCCUUCUGGCCAUGC CUUCUUCUCUCCCUUGCACCUGUACCUCUUCCAUAAAGUAGGA AAUGGUCUUUGAAUAAAGCCUGAGUAGGAAG |
| 6639 | DNA sequence having the T7 polymerase site and restriction sites: G-CSF miR-146a | TAATACGACTCACTATA GGGAAATAAGAGAGAAAAGAAGAGTAAGAAGAAATATAAGAGCC ACC<u>ATG</u>GCCGGTCCCGCGACCCAAAGCCCCATGAAACTTATGGCC CTGCAGTTGCTGCTTTGGCACTCGGCCCTCTGGACAGTCCAAGAAG CGACTCCTCTCGGACCTGCCTCATCGTTGCCGCAGTCATTCCTTTTG AAGTGTCTGGAGCAGGTGCGAAAGATTCAGGGCGATGGAGCCGCA CTCCAAGAGAAGCTCTGCGCGACATACAAACTTTGCCATCCCGAG GAGCTCGTACTGCTCGGGCACAGCTTGGGGATTCCCTGGGCTCCTC TCTCGTCCTGTCCGTCGCAGGCTTTGCAGTTGGCAGGGTGCCTTTC CCAGCTCCACTCCGGTTTGTTCTTGTATCAGGGACTGCTGCAAGCC CTTGAGGGAATCTCGCCAGAATTGGGCCCGACGCTGGACACGTTG CAGCTCGACGTGGCGGATTTCGCAACAACCATCTGGCAGCAGATG GAGGAACTGGGGATGGCACCCGCGCTGCAGCCCACGCAGGGGGC AATGCCGGCCTTTGCGTCCGCGTTTCAGCGCAGGGCGGGTGGAGT CCTCGTAGCGAGCCACCTTCAATCATTTTTGGAAGTCTCGTACCGG GTGCTGAGACATCTTGCGCAGCCGTGATAATAGGCTGCCTTCTGCG GGGCTTGCCTTCTGGCCATGCCCTTCTTCTCTCCCTTGCACCTGTAC CTCTAACCCATGAATTCAGTTCTCATGGTCTTTGAATAAAGCCTG AGTAGGAAGGCGGCCGCTCGAGCATGCATCTAGA |
| 6640 | mRNA sequence: G-CSF miR-146a | GGGAAAUAAGAGAGAAAAGAAGAGUAAGAAGAAAUAUAAGAGC CACC<u>AUG</u>GCCGGUCCCGCGACCCAAAGCCCCAUGAAACUUAUGG CCCUGCAGUUGCUGCUUUGGCACUCGGCCCUCUGGACAGUCCAA GAAGCGACUCCUCUCGGACCUGCCUCAUCGUUGCCGCAGUCAUU CCUUUUGAAGUGUCUGGAGCAGGUGCGAAAGAUUCAGGGCGAU GGAGCCGCACUCCAAGAGAAGCUCUGCGCGACAUACAAACUUUG CCAUCCCGAGGAGCUCGUACUGCUCGGGCACAGCUUGGGGAUUC CCUGGGCUCCUCUCUCGUCCUGUCCGUCGCAGGCUUUGCAGUUG GCAGGGUGCCUUUCCCAGCUCCACUCCGGUUUGUUCUUGUAUCA GGGACUGCUGCAAGCCCUUGAGGGAAUCUCGCCAGAAUUGGGCC CGACGCUGGACACGUUGCAGCUCGACGUGGCGGAUUUCGCAACA ACCAUCUGGCAGCAGAUGGAGGAACUGGGGAUGGCACCCGCGCU GCAGCCCACGCAGGGGGCAAUGCCGGCCUUUGCGUCCGCGUUUC AGCGCAGGGCGGGUGGAGUCCUCGUAGCGAGCCACCUUCAAUCA UUUUUGGAAGUCUCGUACCGGGUGCUGAGACAUCUUGCGCAGCC GUGAUAAUAGGCUGCCUUCUGCGGGGCUUGCCUUCUGGCCAUGC CUUCUUCUCUCCCUUGCACCUGUACCUCUAACCCAUGGAAUUC AGUUCUCAUGGUCUUUGAAUAAAGCCUGAGUAGGAAG |
| 6641 | DNA sequence having the T7 polymerase site and restriction sites: G-CSF-146a-seed | TAATACGACTCACTATA GGGAAATAAGAGAGAAAAGAAGAGTAAGAAGAAATATAAGAGCC ACC<u>ATG</u>GCCGGTCCCGCGACCCAAAGCCCCATGAAACTTATGCC CTGCAGTTGCTGCTTTGGCACTCGGCCCTCTGGACAGTCCAAGAAG CGACTCCTCTCGGACCTGCCTCATCGTTGCCGCAGTCATTCCTTTTG AAGTGTCTGGAGCAGGTGCGAAAGATTCAGGGCGATGGAGCCGCA CTCCAAGAGAAGCTCTGCGCGACATACAAACTTTGCCATCCCGAG GAGCTCGTACTGCTCGGGCACAGCTTGGGGATTCCCTGGGCTCCTC TCTCGTCCTGTCCGTCGCAGGCTTTGCAGTTGGCAGGGTGCCTTTC CCAGCTCCACTCCGGTTTGTTCTTGTATCAGGGACTGCTGCAAGCC CTTGAGGGAATCTCGCCAGAATTGGGCCCGACGCTGGACACGTTG CAGCTCGACGTGGCGGATTTCGCAACAACCATCTGGCAGCAGATG GAGGAACTGGGGATGGCACCCGCGCTGCAGCCCACGCAGGGGGC AATGCCGGCCTTTGCGTCCGCGTTTCAGCGCAGGGCGGGTGGAGT CCTCGTAGCGAGCCACCTTCAATCATTTTTGGAAGTCTCGTACCGG GTGCTGAGACATCTTGCGCAGCCGTGATAATAGGCTGCCTTCTGCG |

TABLE 32-continued

G-CSF constructs with miR binding sites

| SEQ ID NO. | Description | SEQ |
|---|---|---|
| | | GGGCTTGCCTTCTGGCCATGCCCTTCTTCTCTCCCTTGCACCTGTAC CTCTAGTTCTCTGGTCTTTGAATAAAGCCTGAGTAGGAAGGCGGC CGCTCGAGCATGCATCTAGA |
| 6642 | mRNA sequence: G-CSF-146a-seed | GGGAAAUAAGAGAGAAAAGAAGAGUAAGAAGAAAUAUAAGAGC CACCAUGGCCGGUCCCGCGACCCAAAGCCCCAUGAAACUUAUGG CCCUGCAGUUGCUGCUUUGGCACUCGGCCCUCUGGACAGUCCAA GAAGCGACUCCUCUCGGACCUGCCUCAUCGUUGCCGCAGUCAUU CCUUUUGAAGUGUCUGGAGCAGGUGCGAAAGAUUCAGGGCGAU GGAGCCGCACUCCAAGAGAAGCUCUGCGCGACAUACAAACUUUG CCAUCCCGAGGAGCUCGUACUGCUCGGGCACAGCUUGGGGAUUC CCUGGGCUCCUCUCUCGUCCUGUCCGUCGCAGGCUUUGCAGUUG GCAGGGUGCCUUUCCCAGCUCCACUCCGGUUUGUUCUUGUAUCA GGGACUGCUGCAAGCCCUUGAGGGAAUCUCGCCAGAAUUGGGCC CGACGCUGGACACGUUGCAGCUCGACGUGGCGGAUUUCGCAACA ACCAUCUGGCAGCAGAUGGAGGAACUGGGGAUGGCACCCGCGCU GCAGCCCACGCAGGGGGCAAUGCCGGCCUUUGCGUCCGCGUUUC AGCGCAGGGCGGGUGGAGUCCUCGUAGCGAGCCACCUUCAAUCA UUUUUGGAAGUCUCGUACCGGGUGCUGAGACAUCUUGCGCAGCC GUGAUAAUAGGCUGCCUUCUGCGGGGCUUGCCUUCUGGCCAUGC CCUUCUUCUCUCCCUUGCACCUGUACCUCUAGUUCUCUGGUCUU UGAAUAAAGCCUGAGUAGGAAG |
| 6643 | DNA sequence having the T7 polymerase site and restriction sites: G-CSF-146a-seedless | TAATACGACTCACTATA GGGAAATAAGAGAGAAAAGAAGAGTAAGAAGAAATATAAGAGCC ACCATGGCCGGTCCCGCGACCCAAAGCCCCATGAAACTTATGGCC CTGCAGTTGCTGCTTTGGCACTCGGCCCTCTGGACAGTCCAAGAAG CGACTCCTCTCGGACCTGCCTCATCGTTGCCGCAGTCATTCCTTTTG AAGTGTCTGGAGCAGGTGCGAAAGATTCAGGGCGATGGAGCCGCA CTCCAAGAGAAGCTCTGCGCGACATACAAACTTTGCCATCCCGAG GAGCTCGTACTGCTCGGGCACAGCTTGGGGATTCCCTGGGCTCCTC TCTCGTCCTGTCCGTCGCAGGCTTTGCAGTTGGCAGGGTGCCTTTC CCAGCTCCACTCCGGTTTGTTCTTGTATCAGGGACTGCTGCAAGCC CTTGAGGGAATCTCGCCAGAATTGGGCCCGACGCTGGACACGTTG CAGCTCGACGTGGCGGATTTCGCAACAACCATCTGGCAGCAGATG GAGGAACTGGGGATGGCACCCGCGCTGCAGCCCACGCAGGGGGC AATGCCGGCCTTTGCGTCCGCGTTTCAGCGCAGGGCGGGTGGAGT CCTCGTAGCGAGCCACCTTCAATCATTTTTGGAAGTCTCGTACCGG GTGCTGAGACATCTTGCGCAGCCGTGATAATAGGCTGCCTTCTGCG GGGCTTGCCTTCTGGCCATGCCCTTCTTCTCTCCCTTGCACCTGTAC CTCTAACCCATGGAATTCATGGTCTTTGAATAAAGCCTGAGTAGGA AGGCGGCCGCTCGAGCATGCATCTAGA |
| 6644 | mRNA sequence: G-CSF-146a-seedless | GGGAAAUAAGAGAGAAAAGAAGAGUAAGAAGAAAUAUAAGAGC CACCAUGGCCGGUCCCGCGACCCAAAGCCCCAUGAAACUUAUGG CCCUGCAGUUGCUGCUUUGGCACUCGGCCCUCUGGACAGUCCAA GAAGCGACUCCUCUCGGACCUGCCUCAUCGUUGCCGCAGUCAUU CCUUUUGAAGUGUCUGGAGCAGGUGCGAAAGAUUCAGGGCGAU GGAGCCGCACUCCAAGAGAAGCUCUGCGCGACAUACAAACUUUG CCAUCCCGAGGAGCUCGUACUGCUCGGGCACAGCUUGGGGAUUC CCUGGGCUCCUCUCUCGUCCUGUCCGUCGCAGGCUUUGCAGUUG GCAGGGUGCCUUUCCCAGCUCCACUCCGGUUUGUUCUUGUAUCA GGGACUGCUGCAAGCCCUUGAGGGAAUCUCGCCAGAAUUGGGCC CGACGCUGGACACGUUGCAGCUCGACGUGGCGGAUUUCGCAACA ACCAUCUGGCAGCAGAUGGAGGAACUGGGGAUGGCACCCGCGCU GCAGCCCACGCAGGGGGCAAUGCCGGCCUUUGCGUCCGCGUUUC AGCGCAGGGCGGGUGGAGUCCUCGUAGCGAGCCACCUUCAAUCA UUUUUGGAAGUCUCGUACCGGGUGCUGAGACAUCUUGCGCAGCC GUGAUAAUAGGCUGCCUUCUGCGGGGCUUGCCUUCUGGCCAUGC CCUUCUUCUCUCCCUUGCACCUGUACCUCUAACCCAUGGAAUUC AUGGUCUUUGAAUAAAGCCUGAGUAGGAAG |

It is likely that the binding site "seed" sequence is sufficient to induce microRNA binding, the expression of G-CSF should be down-regulated in cells transfected with miR-142-3p, miR-142-3p-seed, miR-142-5p, miR-142-5p-seed, miR-146a or miR-146a-seed. Whereas, the miR-142-3p-seedless, miR-142-5p-seedless, miR-146a-seedless should not change the expression of G-CSF, as compared with cells transfected with G-CSF mRNA without microRNA binding sites.

Example 38. APCs Specific microRNA Binding Sites to Suppress Modified Nucleic Acid Mediated Immune Stimulation The binding sites for microRNAs are used in the 3'UTR of mRNA therapeutics to selectively degrade mRNA therapeutics in the immune cells to subdue unwanted immunogenic reactions caused by mRNA therapeutics delivery.

A signal-sensor polynucleotide comprising a series of 3'UTR miR binding sites which make the signal sensor polynucleotide more unstable in antigen presenting cells (APCs), such as, but not limited to mir-142-5p, mir-142-3p, mir-146a-5p and mir-146a-3p, encodes an oncology-related polypeptide of the present invention. The addition of miR binding sites in the 3'UTR making a signal sensor polynucleotide unstable would subdue modified mRNA mediated immune stimulation.

Experiments comparing the cytokine expression (e.g. TNF-alpha) induced by the signal-sensor polypeptide with APCs specific microRNA signature vs. without such signature is performed in vitro by methods described herein and/or known in the art.

Example 39. In Vitro Expression of mRNAs with miR Binding Sites

Human embryonic kidney epithelial cells (HEK293A), antigen-presenting cells or cell lines with highly expressed mir-142/146, such as monocyte-derived dendritic cells (MDDC) or PBMC, are seeded at a density of 200,000 per well in 500 ul cell culture medium (InVitro GRO medium from Celsis, Chicago, Ill.). Cultured cells are transfected with G-CSF mRNAs with or without microRNA signature, as described in Example 37. The cells are transfected for five consecutive days. The transfection complexes are removed four hours after each round of transfection.

The culture supernatant is assayed for secreted G-CSF (R&D Systems, catalog #DCS50), tumor necrosis factor-alpha (TNF-alpha) and interferon alpha (IFN-alpha by ELISA every day after transfection following manufacturer's protocols. The cells are analyzed for viability using CELL TITER GLO® (Promega, catalog #G7570) 6 hrs and 18 hrs after the first round of transfection and every alternate day following that. At the same time from the harvested cells, total RNA is isolated and treated with DNASE® using the RNAEASY micro kit (catalog #74004) following the manufacturer's protocol. 100 ng of total RNA is used for cDNA synthesis using the High Capacity cDNA Reverse Transcription kit (Applied Biosystems, cat #4368814) following the manufacturer's protocol. The cDNA is then analyzed for the expression of innate immune response genes by quantitative real time PCR using SybrGreen in a Biorad CFX 384 instrument following the manufacturer's protocol.

Example 40. In Vivo Detection of Innate Immune Response Study

To test the signal sensor protein expression and in vivo immune response, female BALB/C mice (n=5) are injected intramuscularly with G-CSF mRNA with or without microRNA signatures as described in Example 37. Blood is collected at 8 hours after dosing. The protein levels of G-CSF, TNF-alpha and IFN-alpha is determined by ELISA.

The difference of cytokine production is seen as measured by mouse TNF-alpha and IFN-alpha level in serum. Injection with G-CSF modified mRNA having miR-142 and miR-146a binding site or binding site seed shows a lower level of cytokine response in vivo.

Example 41. Expression of miR-122 in Primary Hepatocytes

Hepatocyte specific miR-122 level in rat and human primary hepatocytes was measured. Hela Cells and primary rat and human hepatocytes were cultured and RNAs were extracted from cell lysates. The miR-122 level in rat and human primary hepatocytes was compared with that in Hela cells. The miR-122 level is about 6 fold increased in primary human hepatocytes and about 12 fold increased in primary rat hepatocytes, respectively, as compared with that in Hela cells.

Example 42. Expression of Modified Nucleic Acid with Mir-122 Binding Site in Hepatocytes Primary rat and human hepatocytes and Hela cells were seeded at a density of 200,000 per well in 500 ul cell culture medium (InVitro GRO medium from Celsis, Chicago, Ill.). G-CSF mRNA having a miR-122 binding site in the 3'UTR (G-CSF miR-122-1X) (mRNA sequence is shown in SEQ ID NO: 6600; polyA tail of approximately 140 nucleotides not shown in sequence; 5'Cap, Cap1) fully modified with 5-methylcytidine and pseudouridine (5mC/pU), or fully modified with pseudouridine (pU) or G-CSF mRNA with four miR-122 binding sites with the seed deleted (G-CSF no seed) (mRNA sequence is shown in SEQ ID NO: 6601; polyA tail of approximately 140 nucleotides not shown in sequence; 5'Cap, Cap1) fully modified with 5-methylcytidine and pseudouridine (5mC/pU) or fully modified with pseudouridine (pU) was tested at a concentration of 250 ng per well in 24 well plates. The 24 hours after transfection, the expression of G-CSF was measured by ELISA, and the results are shown in Table 33.

TABLE 33

| G-CSF mir122 expression | | | |
|---|---|---|---|
| | Hela cells Protein Expression (ng/mL) | Primary human Hepatocytes Protein Expression (ng/mL) | Primary rat Hepatocytes Protein Expression (ng/mL) |
| G-CSF miR-122 1X (5mC/pU) | 167.34 | 67.60 | 3.40 |
| G-CSF miR-122 1X (pU) | 292.18 | 116.18 | 25.63 |
| G-CSF no seed (5mC/pU) | 194.78 | 129.77 | 8.39 |
| G-CSF no seed (pU) | 335.78 | 462.88 | 84.93 |

Example 43. Expression of Modified Nucleic Acids with Mir-122 Binding Sites in Hepatocytes MicroRNA control gene expression through the translational suppression and/or degradation of target messenger RNA. Mir-122 binding site containing G-CSF mRNA was translationally regulated in hepatocytes.

Primary rat and human hepatocytes and Hela cells were seeded at a density of 200,000 per well in 500 ul cell culture medium (InVitro GRO medium from Celsis, Chicago, Ill.). G-CSF mRNA (G-CSF alpha) (mRNA sequence is shown in SEQ ID NO: 6599; polyA tail of approximately 140 nucleotides not shown in sequence; 5'Cap, Cap1) fully modified with 5-methylcytidine and pseudouridine (5mC/pU), G-CSF mRNA having a miR-122 binding site in the 3'UTR (G-CSF miR-122-1X) (mRNA sequence is shown in SEQ ID NO: 6600; polyA tail of approximately 140 nucleotides not shown in sequence; 5'Cap, Cap 1) fully modified with 5-methylcytidine and pseudouridine (5 mc/pU) or G-CSF mRNA with four miR-122 binding sites with the seed deleted (G-CSF no seed) (mRNA sequence is shown in SEQ ID NO: 6601; polyA tail of approximately 140 nucleotides not shown in sequence; 5'Cap, Cap1) fully modified with 5-methylcytidine and pseudouridine (5mC/pU) was tested at a concentration of 250 ng per well in 24 well plates. 24 hours after transfection, the expression of G-CSF was measured by ELISA. The G-CSF drug (mRNA) levels and protein levels are shown in Table 34.

TABLE 34

G-CSF drug and protein levels

| | Human Hepatocytes | | Rat Hepatocytes | |
|---|---|---|---|---|
| | Drug (mRNA) level (unit normalized to HPRT) | Protein expression (ng/ml) | Drug (mRNA) level (unit normalized to HPRT) | Protein expression (ng/ml) |
| G-CSF alpha (5mC/pU) | 43237.6 | 247.26 | 26615.88 | 784.6 |
| G-CSF miR-122-1X (5mC/pU) | 46340.9 | 74.07 | 20171.07 | 40.628 |
| G-CSF no seed (5mC/pU) | 70239.7 | 298.28 | 23170.47 | 894.06 |

Example 44. Microphysiological Systems

The polynucleotides, primary constructs and/or mmRNA of the present invention are formulated using one of the methods described herein such as in buffer, lipid nanoparticles and PLGA. These formulations are then administered to or contacted with microphysiological systems created from organ chips as described in International Publication Nos. WO2013086502, WO2013086486 and WO2013086505, the contents of each of which are herein incorporated by reference in its entirety.

Example 45. Translation Enhancing Elements (TEEs) in Untranslated Regions

The 5' and/or 3' untranslated regions (UTRs) in the signal-sensor polynucleotides, primary constructs and/or mmRNA described herein may include at least one translation enhancing element (TEE). Such TEE which may be included in the 5'UTR and/or 3'UTR include, but are not limited to, those listed in Table 35, including portion and/or fragments thereof. The TEE sequence may include at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, at least 99% or more than 99% of the TEE sequences disclosed in Table 35 and/or the TEE sequence may include a 5-30 nucleotide fragment, a 5-25 nucleotide fragment, a 5-20 nucleotide fragment, a 5-15 nucleotide fragment, a 5-10 nucleotide fragment of the TEE sequences disclosed in Table 35.

TABLE 35

TEE Sequences

| TEE Identifier | Sequence | SEQ ID NO |
|---|---|---|
| TEE-001 | MSCSGCNGMWA | 6645 |
| TEE-002 | RNSGAGMGRMR | 6646 |
| TEE-003 | RNSGAGMGRMRRR | 6647 |
| TEE-004 | RMSCSGCNGMWR | 6648 |
| TEE-005 | GCGAGAGAA | — |
| TEE-006 | GGGAGCGAA | — |
| TEE-007 | GCGAGAGGA | — |
| TEE-008 | GCGAGCGGA | — |
| TEE-009 | CGGAGCGAA | — |
| TEE-010 | CGGAGCGGA | — |
| TEE-011 | ACGAGAGGA | — |
| TEE-012 | ACGAGCGGA | — |
| TEE-013 | GACGAGAGGA | 6649 |
| TEE-014 | GACGAGAGAA | 6650 |
| TEE-015 | AGCGAGCG | — |
| TEE-016 | AGGAGAGGA | — |
| TEE-017 | GCCGAGAGA | — |
| TEE-018 | CGAGAGGCA | — |
| TEE-019 | GAGAGGAGC | — |

TABLE 35-continued

TEE Sequences

| TEE Identifier | Sequence | SEQ ID NO |
|---|---|---|
| TEE-020 | CGCGGCGGA | — |
| TEE-021 | CGCCGCCGC | — |
| TEE-022 | GCGGCTGAA | — |
| TEE-023 | CCGGCTGAA | — |
| TEE-024 | CGCCGCTGAA | 6651 |
| TEE-025 | CGCCGCGGAA | 6652 |
| TEE-026 | CGCCGCCGAA | 6653 |
| TEE-027 | CCCGCGGAA | — |
| TEE-028 | CCCGCCGAA | — |
| TEE-029 | CCCGCTGAA | — |
| TEE-030 | CCCGGCGGA | — |
| TEE-031 | CGCGGCTGA | — |
| TEE-032 | CGGCTGCTA | — |
| TEE-033 | CCCGGCGGA | — |
| TEE-034 | AGCCGCCGCA | 6654 |
| TEE-035 | ACGCCGCCGA | 6655 |
| TEE-036 | GGCATTCATCGT | 6656 |
| TEE-037 | GCATTAGTATCT | 6657 |
| TEE-038 | TCGGTTATTGTT | 6658 |
| TEE-039 | TCCAATTGGGAA | 6659 |
| TEE-040 | ATCTATTGGCCA | 6660 |
| TEE-041 | TTACTGGGTGTT | 6661 |
| TEE-042 | AGGGTGAAGGTC | 6662 |
| TEE-043 | GGTGGGTGTGTC | 6663 |
| TEE-044 | CGCTTCAATGCT | 6664 |
| TEE-045 | TGCTTCAATGCC | 6665 |
| TEE-046 | TGTGTCTTTGCA | 6666 |
| TEE-047 | CACGGGACAGC | 6667 |
| TEE-048 | AAGCTGTACATG | 6668 |
| TEE-049 | GATGGGGCACA | 6669 |
| TEE-050 | ATATGTGCCCTT | 6670 |
| TEE-051 | TCCTTCTGGGTC | 6671 |
| TEE-052 | GGTGGGTGTGTC | 6672 |
| TEE-053 | GAATGGATGGGG | 6673 |
| TEE-054 | CAXGTGATATTC | 6674 |
| TEE-055 | AGGAGGGTTTGT | 6675 |
| TEE-056 | TGGGCGAGTGGG | 6676 |
| TEE-057 | CGGCTCACCAGT | 6677 |

TABLE 35-continued

TEE Sequences

| TEE Identifier | Sequence | SEQ ID NO |
|---|---|---|
| TEE-058 | GGTTTCXATAAC | 6678 |
| TEE-059 | GGTGGGTGTGTC | 6679 |
| TEE-060 | TTACTGGGTGTT | 6680 |
| TEE-061 | AAGTCTTTGGGT | 6681 |
| TEE-062 | CCGGCGGGU | — |
| TEE-063 | CCGGCGGG | — |
| TEE-064 | CCGGCGG | — |
| TEE-065 | CCGGCG | — |
| TEE-066 | CCGGC | — |
| TEE-067 | CGGCGGGU | — |
| TEE-068 | GGGAGACGGCGGCGGTGGCGGCGCGGGCAGAGCAAG GACGCGGCGGATCCCACTCGCACAGCAGCGCACTCGG TGCCCCGCGCAGGGTCG | 6682 |
| TEE-069 | AAAGAAATGGAATCGAAGAGAATGGAAACAAATGGA ATGGAATTGAATGGAATGGAATTGA ATGGAATGGGAACG | 6683 |
| TEE-070 | AAAGAAATGGAATCGAAGAGAATGGAAACAAATGGA ATGGAATTGAATGGAATGGAATTGA ATGGAATGGGAACG | 6684 |
| TEE-071 | AGACAGTCAGACAATCACAAAGAAACAAGAATGAAA ATGAATGAACAAAACCTTCAAGAAATATGGGATTATG AAGAGGCCAAATGT | 6685 |
| TEE-072 | AAAAGGAAATACAAGACAACAAACACAGAAACACAA CCATCGGGCATCATGAAACCTCGTGAAGATAATCATCA GGGT | 6686 |
| TEE-073 | AGACCCTAATATCACAGTTAAACGAACTAGAGAAGGA AGAGCAAACAAATTCAAAAGCTAGCGGAAAGCAAGA AATAACTAAGACCAG | 6687 |
| TEE-074 | AAAGACTTAAACATAAGACCTAAAACCATAAAAACCA CAGAAGAAAACATAGGCAATGCCATTCAGGACATAGG CATGGGCAAAGACTTC | 6688 |
| TEE-075 | AGCAATAACCAAACAACCTCATTAAAAAGTAGGCAAA GGACATAAACAGACACTTTTCAAAAGAAGACATACAC GTGGCCAACAAACATATG | 6689 |
| TEE-076 | AGAAAGAATCAAGAGGAAATGCAAGAAATCCAAAAC ACTGTAACAGATATGATGAATAATGAGGTATGCACTC ATCAGCAGACTCGACAT | 6690 |
| TEE-077 | GCACTAGTCAGATCAAGACAGAAAGTCAACGAACAAA GAACAGACTTAAACTACACTCTAGA ACAAATGGACCTA | 6691 |
| TEE-078 | AGCAGCCAACAAGCATATGAAATAATGCTCCACAACA CTCATCATCAGAGAAATGCAAATCA AAACCAAAAT | 6692 |
| TEE-079 | AATATACGCAAATCAATAAATGTAATCCAGCATATAA ACAGTACTAAAGACAAAAACCACAT GATTATCTCAATAGATGCAGAAAAGGCC | 6693 |
| TEE-080 | ATGTACACAAATCAATAAATGCAGTCCAGCATATAAA CAGAACCAAACACAAAAACCACATG ATTATCTCAATAGATGCAGAAAAGGCCTTT | 6694 |
| TEE-081 | TATACCACACAAATGCAAAGATTATTAGCAACAATT ATCAACAGCAATATGTCAACAAGTT GACAAACCTAGAGGACATGGAT | 6695 |

TABLE 35-continued

TEE Sequences

| TEE Identifier | Sequence | SEQ ID NO |
|---|---|---|
| TEE-082 | AAACACACAAAGCAACAAAAGAACGAAGCAACAAAA GCATAGATTTATTGAAATGAAAGTA CATTCTACAGAGTGGGGGCAGGCT | 6696 |
| TEE-083 | GAAATCATCATCAAACGGAATCGAATGGAATCATTGA ATGGAATGGAATGGAATCATCATGG AATGGAAACG | 6697 |
| TEE-084 | AACAGAATGGAATCAAATCGAATGAAATGGAATGGAA TAGAAAGGAATGGAATGAAATGGA ATGGAAAGGATTCGAATGGAATGCAATCG | 6698 |
| TEE-085 | TACAAAGAACTCAAACAAATCAGCAAGAACAAAAACA ATCCCAACAAATGTTGGACAAAG ACATGAATAGACAATTCTCGAAAGAAGATGTACAAAT GGCT | 6699 |
| TEE-086 | TGTTGAGAGAAATTAAACAAAGCACAGATAAATGGAA AAACGTGTTCATAGATTGAAAGACT TCATGTTGTATGGTGTC | 6700 |
| TEE-087 | AAACGATTGGACAGGAATGGAATCACCATCGAATGGA AACGAATGGAATCTTCGAATGGAAT TGAATGAAATTATTGAACGGAATCAAATAGAATCATC ATTGAACAGAATCAAATTGGATCAT | 6701 |
| TEE-088 | AACAATAAACAAACTCCAACTAGACACAATAGTCAAA TTGCTGAAAATGAAATATAAAGGAA CAATCTCGATGGTAGCCCAAGGA | 6702 |
| TEE-089 | AAATCAATAAATGTAATTCAGCATATAAACAGAACCA AAGACAAAAACCACATGATTATCTC AATAGATGCAGAAAAGGCCTTT | 6703 |
| TEE-090 | GCTCAAGGAAATAAAATAGGACACAAAGAAATGGAA AAACATTCCATACTCATGGATAGAA AGAATCAATATCATGAAATGGCC | 6704 |
| TEE-091 | AACATACGCAAATCAATAAATGTAATCCAGCATATAA ACAGAACCAAAGACAAAAACCACAT GATTATCTCAATAGATGCAGAAAAGGCC | 6705 |
| TEE-092 | AACAATCACTAGTCCTTAAGTAAGAGACAACACCTTTT GTCACACACAGTTTGTCCTAACTTT ATCTTGGTAATTGGGGAGACC | 6706 |
| TEE-093 | AGAAAACACACAGACAACAAAAAACACAGAACGACA ATGACAAAATGGCCAAGC | 6707 |
| TEE-094 | ACACAACAACCAAGAAACAACCCCATTAAGAAGTGGG AAAAATACATGAATAAACACATCTC AAAAGAAGACAAACAAGTGGCTAAC | 6708 |
| TEE-095 | ACAGCAGAAAACGAACATCAGAAAATCACTCTACATG ATGCTTAAATACAGAGGGCAAGCAA CCCAAGAGAAAACACCACTTCCTAAT | 6709 |
| TEE-096 | GAATAGAACAGAATGGAATCAAATCGAATGAAATGGA ATGGAATAGAAAGGAATGGAATGA AATGGAATGGAAAGGATTCGAATGGAATG | 6710 |
| TEE-097 | TAAGCAGAGAAAATATCAACACGAAAATAATGCAAGG AGAAAAATACAGAACAATCCAAAA TGTGGCC | 6711 |
| TEE-098 | GAACAATCAATGGAAGCAGAAACAAATAAACCAAGGT GTGCATCAAGGAATACATTCACGC ATGATGGCTGTATGAGTAAAATG | 6712 |
| TEE-099 | GATCAATAAATGTAATTCATCATATAAACAGAGAACT AAAGACAAAAACACATGATTATCGC AATACATGCAGAAAAGGCC | 6713 |

TABLE 35-continued

TEE Sequences

| TEE Identifier | Sequence | SEQ ID NO |
|---|---|---|
| TEE-100 | GACAAGAGTTCAGAAAGGAAGACTACACAGAAATACG CATTTTAAAGTCACTGACATGGAGA TGACACTTAAAACCATGAACATGGATGGG | 6714 |
| TEE-101 | AAGCAAAGAAAGAATGAAGCAGCAAAAGAACGAAAG CAGGAATTTATTGAAAACCAAAGTA CACTCCACAGTATGGGAGCGGACCCGAGCA | 6715 |
| TEE-102 | ACCAACATAAGACAAAGAAACATCCAGCAGCTGCCTA TGGCAAAAGATTACAATGTGTCAAA CAAGAGGGCAATG | 6716 |
| TEE-103 | GGACAAATTGCTAGAAATAAACAAATTACCAAAAATG ATTCAAGTAGAGACAGAGAATCAA AATAGAACTACACATAAGTGGGCCAAG | 6717 |
| TEE-104 | AACATAATCCATCAAATAAACAGAACCAAAGACAAAA ACCACATGATTATCTCAATAGATGC AGAAAAGGCCTTC | 6718 |
| TEE-105 | AAAATCAATATGAAAACAAACAAGCAGACAAAGA AAATTGGGCAAAAGGTTTGAGCAGA CACTTCACCAAAGAAGTACAAATGGCAAATCAGCA | 6719 |
| TEE-106 | AACCAAATTAGACAAATTGGAAATCATTACACATAAC AAAAGTAATAAACTGTCAGCCTCAG TAGTATTCATTGTACATAAACTGGCC | 6720 |
| TEE-107 | AAGGAATTTAAGCAAATCAACAAGCAAAACCAAAATA ATCCCATTAAAAAGTGGGTAAAGG ACATGAATACACACTTGTCAATAGAGGACATTCAAGT GGCCAAC | 6721 |
| TEE-108 | TAACCTGATTTGCCATAATCCACGATACGCTTACAACA GTGATATACAAGTTACATGAGAAAC ACAAACATTTTGCAAGGAAACTGTGGCCAGATG | 6722 |
| TEE-109 | AACTAACACAAGAACAGAAAACCAAACATCACATGTT CTCACTCATAAGCGGGAGCTGAACA ATGAGAACACACGGACACAGGGAGAGGAACATG | 6723 |
| TEE-110 | TAAACTGACACAAACACAGACACACAGATACACACAT ACATACAGAAATACACATTCACACA CAGACCTGGTCTTTGGAGCCAGAGATG | 6724 |
| TEE-111 | ATCAACAGACAACAGAAACAAATCCACAAAGCACTTA GTTATTAGAACTGTCATACAGACTG TACAACAACCACATTTACCAT | 6725 |
| TEE-112 | AAATAAGCCAACGGTCATAAATTGCAAAGCCTTTTACA ATCCAAACATGATGGAAACGATAT GCCATTTTGAAGGTGATTTGAAAAGCACATGGTTT | 6726 |
| TEE-113 | AAACAGTTCAAAAATTATTGCAACAAAATGAGAGAGA TGAGTTTATCTTGCAAACTAATGGA TGGTAGCAGTGACAGTGGCAAAACGTGGTTTGATTCT | 6727 |
| TEE-114 | TAAGCAACTTCAGCAAAGTCTCAGGATACAAAATCAA TGTACAAAAATCACAAGCATTCTTA TACACCAACAACAGACAAACAAGAGTGCCAAATCATG | 6728 |
| TEE-115 | AGCAAACAAACAAACAAACAAACAAACTATGACAGG AACAAAACGTCACATATCAACATTA ACAAAGAATGTAAACAGCCTAAATGCTTCACTTAAAA GTTATAGACAGGGGCTGGGCATGGT GGCTCACGCC | 6729 |
| TEE-116 | GGAAATAACAGAGAACACAAACAAATGGGAAAACATT CCATGTTCATGGATAGGAAGAATC AATATTGTGAAAATGGCCATACT | 6730 |
| TEE-117 | AGCAACTTCAGCAAAGTCTCAGGATACAAAATCAATG TACAAAAATCACAAGCATTCTTATA CACCAATAACAGACAAACAGAGAGCC | 6731 |

TABLE 35-continued

TEE Sequences

| TEE Identifier | Sequence | SEQ ID NO |
|---|---|---|
| TEE-118 | AGATAAGAATAAGGCAAACATAGTAATAGGGAGTTCA TGAATAACACACGGAAAGAGAACT TACAGGGCTGTGATCAGGAAACG | 6732 |
| TEE-119 | AGGAAATAAAAGAAGACACAAACAAATGGAAGAACA TTCCATGCTTATGGATAGGGAGAAT CAGTATCGTGAAAATGGCCATACT | 6733 |
| TEE-120 | AACATACGAAAATCAATAAACGTAATCCAGCATATAA ACAGAACCAAAGACAAAAACCACA TGATTATCTCAATAGATGCAGAAAAGGCCTTT | 6734 |
| TEE-121 | AATGGACTCGAATGAAATCATCATCAAACGGAATCGA ATGGAATCATTGAATGGAATGGAAT GGAATCATCATGGAATGGAAACG | 6735 |
| TEE-122 | AAGATTTAAACATAAGACCTAAAACGACAAAAATCCT AGGAGAAAACCTAAGCAATACCATT CAGGACATAGGCATGGGCAAAGACTTCATG | 6736 |
| TEE-123 | TAATGAGAAGACACAGACAACACAAAGAATCACAGAA ACATGACACAGGTGACAAGAACAG GCAAGGACCTGCAGTGCACAGGAGCC | 6737 |
| TEE-124 | TAAACGTTAGACCTAAAACCATAAAAACCCTAGAAGA AAACCTAGGCATTACCATTCAGGAC ATAGGCATGGGCAAGGAC | 6738 |
| TEE-125 | GAATTGAATTGAATGGAATGGAATGCAATGGAATCTA ATGAAACGGAAAGGAAAGGAATGG AATGGAATGGAATG | 6739 |
| TEE-126 | GTAATGGAATGGAATGGAAAGGAATCGAAACGAAAG GAATGGAGACAGATGGAATGGAATG GAACAGAG | 6740 |
| TEE-127 | AGAGAAATGCAAATCAAAACCACAATGGAATACCATC TCACGCCAGTCAGAATGGCAATTAT TAAAAAATCACAACAATTAATGATGGCAAGGCTGTGG | 6741 |
| TEE-128 | AACATACACAAATCAATAAACGTAATCCAGCTTATAA ACAGAACCAAAGACAAAAACCACAT GATTATCTCAATAGATGCGGAAAAGGCC | 6742 |
| TEE-129 | TAAACAGAACCAAAGACAAAAATCACATGATTATCTC AATAGATGCAGAAAAGGCC | 6743 |
| TEE-130 | AATGGAATGCAATCGAATGGAATGGAATCGAACGGAA TGGAATAAAATGGAAGAAAACTGG CAAGAAATGGAATCG | 6744 |
| TEE-131 | AGATAAAAGAACAGCAGCCAAAATGACAAAAGCAA AAAGCAAATCGTGTTAGAGCCAGG TGTGGTGATGTGTGCT | 6745 |
| TEE-132 | AGGAAAGTTTTCAATATGAGAAAGATACAAACCAACA GAATAAGCAAACTGGATAAACAGA AAATACAGAGAGAGCCAAGG | 6746 |
| TEE-133 | GCAATCTCAGGATACAAAATCAATGTGCAAAAATCAC AAGCATTCTCATACACCAATAACAG ACAAACAGAGCCAAATCATG | 6747 |
| TEE-134 | AGCATTCATATCTTGCAGTGTTGGGAAAGAGTGAGAG GTTGTGATGTCAAGAAGGATAGGTC AGAAGTGGAAGGTATGGGGGATTGTGCCTGCTGTCAT GGCT | 6748 |
| TEE-135 | AGCAACTTCAGCAAAGTCTCAGGATACAAAATCAATG TGCAAAAATCACAAGCATTCTTATA CACCAATAACAGACAAACAGAGAGCC | 6749 |
| TEE-136 | AGCAACTTCAGCAAAGTCTCAGGATACAAAATCAATG TGCAAAAATCACAAGCATTCTTATA CACCAACAACAGACAAACAGAGAGCC | 6750 |

TABLE 35-continued

TEE Sequences

| TEE Identifier | Sequence | SEQ ID NO |
|---|---|---|
| TEE-137 | TAAGCCGATAAGCAACTTCAGCAAAGTCTCAGGAGAC AAAATCAATGTGCAAAAAATCACAA GCATTCTTATACACTAATAACAGACAAACAGAGAGCC AAATCATG | 6751 |
| TEE-138 | AACGTGACATACATACAAAAAGTTTTTAGAGCAAGTG AAATTTTAGCTGCTATATGTTAATTG GTGGTAATCCC | 6752 |
| TEE-139 | TACGCAAATCGATAAATGTAATCCAGCATATAAACAG AACCAAAGACAAAAACCACATGATT ATCTCAATAGATGCAGAAAAGGCC | 6753 |
| TEE-140 | GCAATCGAATGGAATGGAATCGAACGGAATGGAATAA AATGGAAGAAAACTGGCAAGAAAT GGAATCG | 6754 |
| TEE-141 | TTGAATCGAATGGAATCGAATGGATTGGAAAGGAATA GAATGGAATGGAATGGAATTGACTC AAATGGAATG | 6755 |
| TEE-142 | TAAAGAAAAACAAACAAACAGAAATCAATGAAAATCC CATTCAAAGGTCAGCAACCTCAAA GACTGAAGGTAGATAAGCCCACAAGGATG | 6756 |
| TEE-143 | GTCATATTTGGGATTTATCATCTGTTTCTATTGTTGTTG TTTTAGTACACACAAAGCCACAATA AATATTCTAGGCT | 6757 |
| TEE-144 | AAAAGTACAGAAGACAACAAAAAATGAGAGAGAGAA AGATAACAGACTATAGCAGCATTGG TGATCAGAGCCACCAG | 6758 |
| TEE-145 | AACCCACAAAGACAACAGAAGAAAAGACAACAGTAG ACAAGGATGTCAACCACATTTTGGA AGAGACAAGTAATCAAACACATGGCA | 6759 |
| TEE-146 | AAAGACCGAAACAACAACAGAAACAGAAACAAACAA CAATAAGAAAAAATGTTAAGCAAAA CAAATGATTGCACAACTTACATGATTACTGAGTGTTCT AATGGT | 6760 |
| TEE-147 | AATCAGTAAACGTAATACAGCATATAAACAGAACCAA AGACAAAAACCACATGATTATCTCA ATAGATGCAGAAAAGGCC | 6761 |
| TEE-148 | AAGCAACTTCAGCAAAGTCTCAGGACACAAAATCAAT ATGCGAAAATCACAAGCATTCCTAT ACACCAATAATAGACAAACAGAGAGCCAAATCATG | 6762 |
| TEE-149 | AGCAACTTCAGCAAAATCTCAGGATACAAAATCAATG TACAAAAATCACAAGCATTCTTATA CACCAACAACAGACAAACAGAGAGCC | 6763 |
| TEE-150 | TAATGCAAACTAAAACGACAATGAGATATCAATACAT AACTACCAGAAAGGCTAACAAAAAA ACAGTCATAACACACCAAAGGCTGATGAGTGAGGATG TGCAG | 6764 |
| TEE-151 | AGCAACTTCAGCAAAGTCTCAGGATACAAAATCGATG TGCAAAAATCACAAGCATTCTTATA CACCAATAACAGGCAAACAGAGAGCC | 6765 |
| TEE-152 | GATATATAAACAAGAAAACAACTAATCACAACTCAAT ATCAAAGTGCAATGATGGTGCAAAA TGCAAGTATGGTGGGGACAGAGAAAGGATGC | 6766 |
| TEE-153 | AAGACAGAACACTGAAACTCAACAGAGAAGTAACAAG AACACCTAAGACAAGGAAGGAGAG GGAAGGCAGGCAG | 6767 |
| TEE-154 | TAAGACACATAGAAAACATAAAGCAAAATGGCAGATG TAAATGCAACCTATCAATCAAAACA TTACGAATGGCTT | 6768 |

TABLE 35-continued

TEE Sequences

| TEE Identifier | Sequence | SEQ ID NO |
|---|---|---|
| TEE-155 | TGAAACAAATGATAATGAAAATACAACATACCAAACA TACGAGATACAGTAAAAGCAGTACT AAGATGCAAGTATATATTGCTACAAGTGCCTAC | 6769 |
| TEE-156 | AATGTAATCCAGCATATAAACAGAGCCAAAGACAAAA ACCACATGATTATCTCAATAGATGC AGAAAAAGCCTTTGACAAAATTCAACAACCCTTCATGC TAAAAACTCTCAATAAATTAGGTAT TGATGGGACG | 6770 |
| TEE-157 | ACAAAATTGATAGACCACTAGCAAGACTAATAAAGAA GAAAAGAGAGAAGAATCATTACCA TTCAGGACATAGGCATGGGCAAGGAC | 6771 |
| TEE-158 | AAGGATTCGAATGGAATGCAATCGAATGGAATGGAAT CGAACGGAATGGAATAAAATGGAA GAAAACTGGCAAGAAATGGAATCG | 6772 |
| TEE-159 | GATCATCAGAGAAACAGAGAAATGCAAATTAAAACCA CAATGAGATACTATCTCCACACAAG TCAGAATGGCTAT | 6773 |
| TEE-160 | ATCAAAAGAAAAGCAACCTAACAAATACGGGAAGAAT ATTTGAATAGACATTTCACAGGAAA AGATATATGAATGGCCAAAAAGCAAATGAAAAG | 6774 |
| TEE-161 | AACAGCAATGACAATGATCAGTAACAACAAGACTTTT AACTTTGAAAAAATCAGGACC | 6775 |
| TEE-162 | AAGAGCCTGAATAGCTAAAGTGATCATAAGCAAAAAG AACAAAGTCGGAAGCATCACATTAC CTGACTTCAAACTATACTCAAAGGCTATG | 6776 |
| TEE-163 | ACTCAGGAAAAATAACGAATCCAACTCACAGGAGAAA GAAGTACAAACCAGAAACCAATTT CAAATTACAAGGACCAGAATACTCATGTTGGCTGGCC AGT | 6777 |
| TEE-164 | TTGACCAGAACACATTACACAATGCTAATCAACTGCAA AGGAGAATATGAACAGAGAGGAGG ACATGGATATTTTGTG | 6778 |
| TEE-165 | AACATATGGAAAAAAACTCAACATCACTGATCATTAG AGAAATGCAAATCAAAACCACAATG AGATACCATCTCACGCCAGTCAGAATGGCG | 6779 |
| TEE-166 | AGCAACTTCAGCAAAGACTCAGGATACAAAATCAATG TGCAAAAATCACAAGCATTCTTATA CACCAATAACAGACAGAGAGCCAAAT | 6780 |
| TEE-167 | TGGGATATGGGTGAAAGAACAAGTTTGCAGAAAAGAT ACAGTGAATTATGGACCATGAGTTC GGGAAAGAAGGGTAGGACTGCG | 6781 |
| TEE-168 | AGCAGTGCAAGAACAACATAACATACAAGTAAACAAA CACATGGGGCCAGGTAATAAAAAG TCAGGCTCAAGAGGTCAG | 6782 |
| TEE-169 | AAGGAAAGTAAAAGGAACTTAACACCTTCAAGAAAA GACAGACAAATAACAAAACAGCAG TTTGATAGAATGAGATATCAGGGGATGGCA | 6783 |
| TEE-170 | GCTAGTTCAACATATGCAAATCAATAAACGTAATCCAT CACATAAACAGAACCAATGACAAA AACCACGATTATCTCAATAGATGCAGAAAAGGCC | 6784 |
| TEE-171 | AACATCACTGATCATTAGAAACACACAAATCAAAACC ACAATAAGATACCATCTAACACCAG TCACAATGGCTATT | 6785 |
| TEE-172 | AGAGCATCCACAAGGCCCAATTCAAAGAATCTGAAAT AATGTATTGTTACTGCAACAGTTGTG AGTACCAGTGGCATCAG | 6786 |

TABLE 35-continued

TEE Sequences

| TEE Identifier | Sequence | SEQ ID NO |
|---|---|---|
| TEE-173 | GGAATAACAACAACAACAACCAAAAGACATATAGAAA ACAAACAGCACGATGGCAGATGTA AAGCCTACC | 6787 |
| TEE-174 | AAACGCAGAAACAAATCAACGAAAGAACGAAGCAAT GAAAGACAAAGCAACAAAAGAATG GAGTAAGAAAGCACACTCCACAAAGTGGAAGCAGGCT GGGACA | 6788 |
| TEE-175 | AGCAACTTCAGCAAAGTCTCAGGATACAAAATCAATG TGCAAAAATCACAAGCATTCCTATA CACCAACAACAGACAAACAGAGAGCC | 6789 |
| TEE-176 | AGCAACTTCAGCAAAGTCTCAGGATACAAAATCAATG GGAAAAAATCACAAGCATTCCTATA CATCAATAACAGACAAACAGAGAGCC | 6790 |
| TEE-177 | ACACATTTCAAGGAAGGAAACAAGAACAGACAGAAAC ACAACATACTTCATGAAACCACATT TTAGCATCCTGGCCGAGTATTCATCA | 6791 |
| TEE-178 | AGCAACTTCAGCAAAGTCTCAGGACACAAAATCAATG TGCAAAAATCACAAGCATTCTTATA CACCAATAACAGACAAACAGAGAGCC | 6792 |
| TEE-179 | TATTTTACCAGATTATTCAAGCAATATATAGACAGCTT AAAGCATACAAGAAGACATGTATAG ATTTACATGCAAACACTGCACCACTTTACATAAGGGAC TTGAGCAC | 6793 |
| TEE-180 | CCCAACTTCAAATTATACTACAAGGCTACAGTAATCAA AAAAGCATAGTACTATTACAAAAA CAGACACACAGGCCAATGGAATACAAT | 6794 |
| TEE-181 | AGAAAGGATTCGAATGGAATGAAAAGAATTGAATGG AATAGAACAGAATGGAATCAAATC GAATGAAATGGAATGGAATAGAAAGGAATGGAATG | 6795 |
| TEE-182 | GTTTACAGTCAAGTGTACAAACAGAATATAAGCAAAC AAAAGAGAACATATACTTACAAACT ATGCTAAGTGCCATGAAGGAAAAG | 6796 |
| TEE-183 | AAGAGTATTGAAGTTGACATATCTAGACTGATCAAGA ACAAAGACAAAAGGTACAGATTATC AAGAAAATGAGCGGGCAAAGCAAGATGGCC | 6797 |
| TEE-184 | AGTAGAATTGCAATTGCAAATTTCACACATATACTCAC ACACAAGTACACACATCCACTTTTA CAACTAAAAAAACTAGCACCCAGGACAGGTGCAGTGG CT | 6798 |
| TEE-185 | TGAATGCTATAGAGCAGTAAAAACAAATAAATGAACT ACATTACAGCTACTTACAACCATAT GAAAGAATATAACCATAACAATGATGAGTGGACAAAA GCTAAGTGTGAAAGAATGCATAGT GCTACAGCAGCCAACATTTACAGC | 6799 |
| TEE-186 | GAATGGAATCAAATAGAATGGAATCGAAACAAATGGA ATGGAATGGAATGGGAGCTGAGAT TGTGTCACTGCAC | 6800 |
| TEE-187 | TAAAAGTGTGCTCAACATCATTGATCATCAGAGAAATG CAAATCAAAACTACAATGAGATAT CATCTCATCCCAGTCAAAGTGGCT | 6801 |
| TEE-188 | TCAGACCATAGCAGATAACATGCACATTAGCAATACG ATTGCCATGACAGAGTGGTTGGTG | 6802 |
| TEE-189 | ACAAACAATCCAATTCGAAAATGGGCAAGATATTTCA CCAAAGACATGAGCTGATATTTCAC | 6803 |
| TEE-190 | AGGAAAAACAACAACAACAACAGGAAAACAACCTCA GTATGAAGACAAGTACATTGATTTAT TCAACATTTACTGATCACTTTTCAGGTGGTAGGCAG | 6804 |

TABLE 35-continued

TEE Sequences

| TEE Identifier | Sequence | SEQ ID NO |
|---|---|---|
| TEE-191 | AACAAAACAAAAACCCAACTCAATAACAAGAAGACAA ACAACCCAATTTAAAATGAGCAAA GAACTTGATAAACATGTCTCCAAAGAAGATACGGCCA AAGAGCAC | 6805 |
| TEE-192 | ATACAACTAAAGCAAATATAAGCAACTAAAGCAACAG TACAACTAAAGCAAAACAGAACAA GACTGCCAGGGCCTAGAAAAGCCAAGAAC | 6806 |
| TEE-193 | AACAACAACAACAACAGGAAAACAACCTCAGTATGAA GACAAGTACATTGATTTATTCAACA TTTACTGATCACTTTTCAGGTGGTAGGCAGACC | 6807 |
| TEE-194 | AGAGAGTATTCATCATGAGGAGTATTACTGGACAAAT AATTCACAAACGAACAAACCAAAGC GATCATCTTTGTACTGGCTGGCTA | 6808 |
| TEE-195 | AGTAAATCACCATAAAGAAGGTAAGAGTTCATTCACA AAAACAACAAACTGAAGAATCAGGC CATAGTA | 6809 |
| TEE-196 | AAAATAGAATGAAAGAGAATCAAATGGAATTGAATCG AATGGAATCGAATGGATTGGAAAG GAATAGAATGGAATGGAATGGAATG | 6810 |
| TEE-197 | AAAAGATGCAAAAGTAGCAAATGCAATGTTAAAACAA GCAAAGAAAGAATCAGGTGGACCA CATAGTGCAGTGCTTCTC | 6811 |
| TEE-198 | TTCACAGCAGCATTACGCACAATAGCCAGAAGGTGGG AACAGACAAAATGCCTTTTGATGGG | 6812 |
| TEE-199 | CCATAACACAATTAAAAACAACCTAAATGTCTAATAG AAGAACACTGTTCAGACCGGGCATG GTGGCTTATACC | 6813 |
| TEE-200 | TGGATTTCAGATATTTAACACAAAATAGTCAAAGCAG ATAAATACTAGCAACTTATTTTTAAT GGGTAACATCATATGTTCGTGCCTT | 6814 |
| TEE-201 | ATCATTGAATGCAATCACATGGAATCATCACAGAATG GAATCGTACGGAATCATCATCGAAT GGAATTGAATGGAATCATCAATTGGACTCGAATGGAA ACATCAAATGGAATCGATTGGAAGT GTCGAATGGACTCG | 6815 |
| TEE-202 | AGAAACAGCCAGAAAACAATTATTACCTACAGCATTA AAACTATTCAAATGACAGCATATTTT TCAGCAGAAATCATGAAGGCCAGAAGGACGTGTCAT | 6816 |
| TEE-203 | AAAATGATCATGAGAAAATTCAGCAACAAAACCATGA AATTGCAAAGATATTACTTTTGGGA TGGAACAGAGCTGGAAGGCAAAGAG | 6817 |
| TEE-204 | AACCACTGCTCAAGGAAATAAGAGAGAACACAAACAA ATGAAAAAACATTCCATGCTCATGG ATAGGAAGAATCAG | 6818 |
| TEE-205 | TACTCTCAGAAGGGAAGCAGATATTCAGCATAAATCA TATTGTTTGTACAAAGAGTCTGGGCA TGGTGAATGACACT | 6819 |
| TEE-206 | TATAGTTGAATGAACACACATACACACACACATGCCA CAAAACAAAAACAAAGTTATCCTCA CACACAGGATAGAAACCAAACCAAATCCCAACACATG GCAAGATGAT | 6820 |
| TEE-207 | GCTCAAAGAAATCAGAAATGACACAAGCAAATGGAAA AACATGCCATGTTCATGAATATGAA GAATCAATATTGTTAAAATGGCCATACTGCTCA | 6821 |
| TEE-208 | GGATACAAAATCAATGTACAAAAATCACAAGCATTCT TATACACCAATAACAGACAAACAGA GAGCC | 6822 |

TABLE 35-continued

TEE Sequences

| TEE Identifier | Sequence | SEQ ID NO |
|---|---|---|
| TEE-209 | AGCAACTTCAGCAAAGTCTCAGGATACAAAATCAATG<br>TACAAAAATCACAAGCATTCTTATA<br>CACCAACAACAGACAAACAGAGAGCC | 6823 |
| TEE-210 | AGGAGAATAGCAGTAGAATGACAAAATTAGATTTTCA<br>CATGAAACTTGATGACAGTGTAGGA<br>AATGGACTGAAAGGACAAGAC | 6824 |
| TEE-211 | AGCAACTTCAGCAAAGTCTCGGGATACAAAATCAATG<br>TGCAAAAATCACAAGCATTCCTATA<br>CACCAATAACAGGCAAACAGAGAGCC | 6825 |
| TEE-212 | AAGTTCAAACATCAGTATTAACCTTGAACATCAATGGC<br>CTACATGCATCACTTAAAACATACA<br>GACAGGCAAATTGGGTTAAGAAAACAAACAAGCAAAC<br>AAAACATGTTCCAAACATTTGTTGG<br>CTAT | 6826 |
| TEE-213 | AAGAAACAATCAAAAGGAAGTGCTAGAAATAAAACAC<br>ACTGTAATAGAAAAGAAGAATGCC<br>TTATGGGCTTATCAATAGACTAGACATGGCCAGG | 6827 |
| TEE-214 | AAAGAAAGACAGAGAACAAACGTAATTCAAGATGACT<br>GATTACATATCCAAGAACATTAGAT<br>GGTCAAAGACTTTAAGAAGGAATACATTCAAAGGCAA<br>AAAGTCACTTACTGATTTTGGTGGA<br>GTTTGCCACATGGAC | 6828 |
| TEE-215 | AGCAACTTCAGCAAAGTTTCAGGATACAAAATCAATG<br>TGCAAAAATCACAAGCATTCTTATA<br>CACCAACAACAGACAAACAGAGAGCC | 6829 |
| TEE-216 | AGAATCAAATGGAATTGAATCGAATGGAATCGAATGG<br>ATTGGAAAGGAATAGAATGGAATG<br>GAATGGAATG | 6830 |
| TEE-217 | AAACAGAACCACAGATATCTGTAAAGGATTACACTAT<br>AGTATTCAACAGAGTATGGAACAGA<br>GTATAGTATTCAACAGAGTATGCAAAGAAACTAAGGC<br>CAGAAAG | 6831 |
| TEE-218 | AAAAAATGTTCAACATCACTAGTCAGCAGAGAAATGC<br>AAATCAAAATCACAATGAGATAACT<br>TCTCACACCAGACAGCATGGC | 6832 |
| TEE-219 | GAATCCATGTTCATAGCACAACAACCAAACAGAAGAA<br>ATCACTGTGAAATAAGAAACAAAGC<br>AAAACACAGATGTCGACACATGGCA | 6833 |
| TEE-220 | AGGATACAAAATCAAAGTGCAAAAATCACAAGCATTC<br>TTATACACCAATAACAGACAAACAG<br>AGAGCC | 6834 |
| TEE-221 | AACAGATTTAAACAAACCAACAAGCAAAAAACGAACA<br>ACTCCATTCAAACATGGACAAAAG<br>ACACGAACAGACACTTTTCAAAGAAGACATACATGTG<br>GCC | 6835 |
| TEE-222 | AAAGACAATATACAAATGGCCAATAAGCACATGAAAA<br>GACGCTCAACATCCTTAGTCGTTAA<br>GGCAATGCAAATCAAAACCACAATG | 6836 |
| TEE-223 | TAAACAACGAGAACACATGAACACAAAGAGGGGAAC<br>AACAGACACCAAGACCTTCTTGAGG<br>GTGGAGGATGGGAGGAGGGAG | 6837 |
| TEE-224 | GGTTCAACTTACAATATTTTGACTTGACAACAGTGCAA<br>AAGCAATACACGATTAGTAGAAAC<br>ACACTTCCAATGCCCATAGGACCATTCTGC | 6838 |
| TEE-225 | AGCAACTTCAGCAAAGTCTCAGGATACAAAATCAATG<br>AGCAAAAATCACAAGCATTCTTACA<br>CACCAATAACAGACAAACAGAGAGCC | 6839 |

TABLE 35-continued

TEE Sequences

| TEE Identifier | Sequence | SEQ ID NO |
|---|---|---|
| TEE-226 | AATCCAGCATATAAACAGAACCAAAGACAAAAACCAC ATGATTATCTCAATAGATGCAGAAA AGGCC | 6840 |
| TEE-227 | TGAAAATACAAATGACCATGCAAGTAATTCCGCAGGG AGAGAGCGGATATGAACAAACAGA AGAAATCAGATGGGATAGTGCTGGCGGGAAGTCA | 6841 |
| TEE-228 | GCAAATGATTATAAGTGCTGTTATAGAAACATTCAAAG ACCAGAAAAGGACCACAATGGCTG ACCAC | 6842 |
| TEE-229 | AGTCAATAACAAGAAGACAAACAACCCAATTACAAAA TGGGATATGAATTTAATAGATGTTA CTCCAAGGAAGATACACAAATGGCCAAC | 6843 |
| TEE-230 | ATGGTTAAAACTCAACAATGAAAACACAAACAGCGCA ATTTAAAAATGGGCAAAATGACAG GCCAGACCCAGTGGCTCATGCG | 6844 |
| TEE-231 | TAACTACTCACAGAACTCAACAAAACACTATACATGC ATTTACCAGTTTATTATAAAGATACA AGTCAGGAACAGCCAAATGGAAGAAATGTAAATGGCA AG | 6845 |
| TEE-232 | AACAGACCATAAATAAACACAGAAGACACACGAGTGT AAAGTCAGTGCCCCGCTGCGAATTA AATCGGGGTGATGTGATGGCGAGTGAGTGGGTAGTT | 6846 |
| TEE-233 | GAATAGAATAGAATGGAATCATCGAATGGAATCGAAT GGAATCATCATGATATGGAATTGAG TGGAATC | 6847 |
| TEE-234 | GGAATCTATAATACAGCTGTTTATAGCCAAGCACTAAA TCATATGATACAGAAAACAAATGC AGATGGTTTGAAGGGTGGG | 6848 |
| TEE-235 | AAGATAGAGTTGAAACAGTGGACAATTAAAGAGTAAT TTGGAAGAATGGTGAAATTACAGCC ATGCTTTGAATCAGGCGGGTTCACTGGC | 6849 |
| TEE-236 | TGAAAGAAGAATGACCATAAGCAAGCAGATGAAAA ACAAAACAGAATTTTTACAGACGTCT TGGACTGATATCTTGGGC | 6850 |
| TEE-237 | AGGAATCTATAATACAGCTGTTTATAGCCAAGCACTAA ATCATATGATACAGAAAACAAATG CAGATGGTTTGAAGGGTGGG | 6851 |
| TEE-238 | AGGAAAAGAAAGAAATAGAAAATGCGAAATGGTAAG AAAAAACAGCATAATAAACATTTGT ATGGTGTTGATGGACAATGCATT | 6852 |
| TEE-239 | TAACAGTACCAAAAAACAGTCATAATCTTCAAGAGCTT AAATTTAGCATGAAAGGAAGACAT TCATCAAAGAATCACACAAAGGAATGTAAAATTAAAT GGAGATTAGTGCCAGGAAAGAGC | 6853 |
| TEE-240 | GCAAAACACAAACAACGCCATAAAAAACTGGGCAAAG GATATGAACAGACATTTTTCAAAAC AAAACATACTTATGGCCAAC | 6854 |
| TEE-241 | AACAAAATTGAACAACATGCAAAGAAACATAAACGAA GCAATGAAAGTGTGCAGATCCACT GAAATGAAAGTGCTGTCCAGAGTGGGAGCCAGCTCGA GA | 6855 |
| TEE-242 | GAATGGAATCAACATCAAACGGAATCAAACGGAATTA TCGAATGGAATCGAAGAGAATCATC GAATGGCCACGAATGGAATCATCTAATGGAATGGAAT GGAATAATCCATGG | 6856 |
| TEE-243 | TACAAGAAAATCACAGTAACATTTATAAAACACAGAA GTGTGAACACACAGCTATTGACCTT GAAAACAGTGAAAGAGGGTCAGCTGTAGAACTAAGAC | 6857 |

TABLE 35-continued

TEE Sequences

| TEE Identifier | Sequence | SEQ ID NO |
|---|---|---|
| | ATAAGCAAAGTTTTTCAATCAAGAA TACATGGGTGGCC | |
| TEE-244 | AAGAATTGGACAAAACACACAAACAAAGCAAGGAAG GAATGAAAGGATTTGTTGAAAATGA AAGTACACTCCACAGTGTGGGAGCAG | 6858 |
| TEE-245 | ACAGTTAACAAAAACCGAACAATCTAATTACGAAATG AACAAAGATATGAACAGACATTTC ACCCGAGAGTATACAGGGGCCAGGCATGGT | 6859 |
| TEE-246 | AAACGCACAAACAAAGCAAGGAAAGAATGAAGCAAC AAAAGCAGAGATTTATTGAAAATGA AAAATACACTCCACAGGGTGGG | 6860 |
| TEE-247 | CACCATGAGTCATTAGGTAAATGCAAATCAAAACCAC AATGAAATACTTCACACCCATGAAG ATGGCTATAATAAAAAAACAGACA | 6861 |
| TEE-248 | AGCAACTTCAGCAAAGTCTCAGGAGACAAAATCAATG TACAAAAATCACAAGCATTCTTATA CACCAATAACAGACAAACAGAGAGCC | 6862 |
| TEE-249 | TGACATGCAAGAAATAAGGAAGTGCAAAAACAAACAA ACAAACAACAACAACAACAACAAC AACAACAACAAAAAACAGTCCCAAAAGGATGGGCAG | 6863 |
| TEE-250 | AGACTTGAAAAGCACAGACAACGAAAGCAAAAATGG ACAAATGGAATCACATCAAGCTAAA AGGTTTTGCATGGCAAAGG | 6864 |
| TEE-251 | GCAAAAGAAACAATCAGTAGAGTAAACAGACAACTCA TAGAATGCAAGAAAATCATCGCAA TCTGTACATCCAACAAAGGGCT | 6865 |
| TEE-252 | ACAAAATCAAACTAACCTCGATAAGAATGCAAGTGAA TCAAAATGAGTTTCAAGGGGTTGTG GCTAGTACACGCTTTCTACAGCTG | 6866 |
| TEE-253 | ACAAACCACTGCTCAAGGAAATAAGGACACAAACAAA TGGAACAACATTCCGTGCTCATGGA TAGGAAGAATCAATATCGTGAAAATGGCCATACT | 6867 |
| TEE-254 | GAACGATTTATCACTGAAAATTAATACTCATGCAAGTA GTAAACGAATGTAATGACCATGAT AAGGAGACGGACGGTGGTGATAGT | 6868 |
| TEE-255 | AGCAGAAGAAATAACTGAAATCAGAGTGAAACTGAAT CAAATTGAGATGCAAAAATACATA CGAAATGGCCAG | 6869 |
| TEE-256 | TGAATAGACACACAGACCAATGGAACAGAATAGAGAA CACAGAATAAATCTGCACACTTATA GCCAGCTGATTTTTGACAAATTTGCCAAG | 6870 |
| TEE-257 | AGCAACTTCAGCAGTCTCAGTATACAAAAACAATGTG CAAAAATCACAAGCATTCCTATATG CCAATAACAGACAAACAGAGAGCC | 6871 |
| TEE-258 | ACCAATCAAGAAAACAATGCAACCCACAGAGAATGGA CAAAAGCAAGGCAGGACAATGGCT | 6872 |
| TEE-259 | GCCACAATTTTGAAACAACCATAATAATGAGAATACA CAAGACAACTCCAATAATGTGGGAA GACAAACTTTGCAATTCACATCATGGC | 6873 |
| TEE-260 | GAAAATGAACAATATGAACAAACAAACAAAATTACTA CCCTTACGAAAGTACGTGCATTCTA GTATGGTGACAAAAAGGAAA | 6874 |
| TEE-261 | TATGCAAATCAATAAACATAATCCATCACATAAACAG AAACAAAGACAAAATGACATGATTA TCTCAATAGATGCAGAAAAGGCC | 6875 |

TABLE 35-continued

TEE Sequences

| TEE Identifier | Sequence | SEQ ID NO |
|---|---|---|
| TEE-262 | CACCCATCTGTAGGACCAGGAAGCCTGATGTGGGAGA GAACAGCAGGCTAAATCCAGGGTTG GTCTCTACAGCAGAGGGAATCACAAGCCTGTTAGCAA GTGAAGAACCAACACTGGCAAGAGT GTGAAGGCC | 6876 |
| TEE-263 | AGGATACAAAATCAATGTACAAAAATCACAAACATTC TTATACACCAACAACAGACAAACAG AGAGCCAAATCATGGGTG | 6877 |
| TEE-264 | AGGAAAATGCAAATCAGAACGACTATAACACACCATC TCAAACTCGTTAGGATGGCTATTAT CAAAAAGTCAAGAGATAACAAATGTGGGCAAGGG | 6878 |
| TEE-265 | GTAACAAAACAGACTCATAGACCAATAGAACAGAATA GAGAATTCAGAAATAAGACTGCACT TCTATGACCATGTGATCTTAGACAAACCT | 6879 |
| TEE-266 | AAAGGAAAACTACAAAACACTGCTGAAAGAAATCATT GACAACACAAACAAATGGAAACAC ATCCCAAGATCATGGGTGGGTGGAATCAAT | 6880 |
| TEE-267 | ACACACATACCAACAGAACATGACAAAAGAACAAAAC CAGCCGCATGCATACTCGATGGAG ACAAAGGTAACACTGCAGAATGGTGAAGGAAGAACAG TCATTTTAATGACAGTGTTGGCT | 6881 |
| TEE-268 | AACTAAGACAACAGATTGATTTACACTACTATTTTCAC ACAGCCAAAAATATCACTATGGCAA TCGTCAAAAGGTCAATTCAAAGATGGGACAGT | 6882 |
| TEE-269 | GATCAGCTTAGAATACAATGGAACAGAACAGATTAGA ACAATGTGATTTTATTAGGGGCCAC AGCACTGTTGACTCAAGTACAAGTTCTGACTCATGTAG AACTAACACTTTT | 6883 |
| TEE-270 | GAATGGAATCAAATCGAATGAAATGGAATGGAATAGA AAGGAATGGAATGAAATGGAATGG AAAGGATTCGAAT | 6884 |
| TEE-271 | AAATGAACAAAACTAGAGGAATGACATTACCTGACTT CAAATTATACTACAGAGCTATAGTA ACCAAAACAGCATGGTACAGGCAT | 6885 |
| TEE-272 | GGACAACATACACAAATCAGTCAAGATACATCATTTC AACAGAATGAAAGACAAAAACCATT TGATCACTTCAATCGATGATGAAAAAGCA | 6886 |
| TEE-273 | AACTTCAGCAAATTCTCAGGATACAAAATCAATGTGCA AAAACCACAAGCATTCCTATACAC CAATAATAGACAGTGAGCCAAAT | 6887 |
| TEE-274 | TATGACTTTCACAAATTACAGAAAAAGACACCCATTTG ACAAGGGAACTGAAGGTGGTGAAG ACATACTGGCAGGCTAC | 6888 |
| TEE-275 | AACAGCAATAGACACAAAGTCAGCACTTACAGTACAA AAACTAATGGCAAAAGCACATGAA GTGGGACAT | 6889 |
| TEE-276 | TGTAACACTGCAAACCATAAAAACCGTAGAAGAAAAC CTAGACAATACTATTCAGGACATAG GCATGGGCAAAGAC | 6890 |
| TEE-277 | GAAGAAGAAAAAACATGGATATACAATGTCAACAGAA ATCAAGGAGAAACGGAATTTCACC AATCAATTTAGTGATCTGGGTT | 6891 |
| TEE-278 | AAAACACACAAACATACATGTGGATGCACATATAAAC ATGCACATACACACACACATAAATG CACAAACACACTTAACACAAGCACACATGCAAACAAA CACATGG | 6892 |

TABLE 35-continued

TEE Sequences

| TEE Identifier | Sequence | SEQ ID NO |
|---|---|---|
| TEE-279 | TAGAAGGAATTTGATACATGCTCAGAAATACAGGCAA AGGAAGTAGGTGCCTGCCAGTGAAC ACAGGGGAACTATGGCTCCTA | 6893 |
| TEE-280 | TGACTAAACAGAGTTGAACAAGAACAAAAAGCAAATT TGCAGAAATGAAATACATACTAATT GAAAGTCCATGGACAGGCTCAACAGATGATATAGATA CAGCTAAAGAGATAATTAGTGAAAT GGATCAG | 6894 |
| TEE-281 | AAGTAATAAGACTGAATTAGTAATACAAAGTGTCTCA ACAAAGAAAATTGCGGGACTGTTCA TGCTCATGGACAGGAAGAATCAATATCATGAAAATGG CC | 6895 |
| TEE-282 | ACAGACAGAGATTTAAAACAATAAACAAGCAGTAAGC AAACACAGATAACAAAATGACATG ATCCAACAAATACTCAGAAGGAGACTTAGAAATGAAT TGAGGGTC | 6896 |
| TEE-283 | AGAAAAAAACAAACAGCCCATTAAAAGGTAGACAAA GGACATGAACACTTTTCAAAAGAAG ACATACATGTGGCCAAACAGCATG | 6897 |
| TEE-284 | AAAAATGACCAGAGCAATAGAATGCATTGACCAGATA AAGACCTTCACGTATGTTGAACTAA AATGTGTGGTGCAGGTG | 6898 |
| TEE-285 | AATCAGTCTAGATCTTAAAGGAACACCAGAGGGAGTA TTTAAATGTGCCCAATAAGCAAGAA TTATGGTGATGTGGAAGTA | 6899 |
| TEE-286 | GAATGGAATGGAAAGGAATCGAAACGAAAGGAATGG AGACAGATGGAATGGAATGGAACAG AGAGCAATGG | 6900 |
| TEE-287 | GGAATGGAATGAACACGAATGTAATGCAACCCAATAG AATGGAATCGAATGGCATGGAATAT AAAGAAATGGAATCGAAGAGAATGGAAACAAATGGA ATGGAATTG | 6901 |
| TEE-288 | AGGACATGAATAGACAATTCTCAAAAGAAGATACACA AGTGGCAAACAAACACATGAAAAA AGACTCAACATTAGTAATGACCATGGAAATGCAAATC | 6902 |
| TEE-289 | TCCAGTCGATCATCATATAGTCAGCACTTATCATACAC CAAGCCGTGTGCAAGGAAAGGGAA TACAACCATGAACATGATAGATGGATGGTT | 6903 |
| TEE-290 | TACAGATAAGAAAATTGAGACTCAAGAGTATTACATA AATTGTTTCAGCTACCACAGCAAAA AATGGTATGGTTGGGAATCAAGCTCAGGG | 6904 |
| TEE-291 | AGCCTATCAAAAAGTGGGCTAAGAATATGAATACACA ATTCTCAAAAGAAGATATACAAATG GGCAACAAACATATGAAAACATACTCAACATCACTAA TGATCAGGGAAATG | 6905 |
| TEE-292 | GAAAATGAACAATATGAACAAACAAACAAAATTACTA CCCTTACGAAAGTACGTGCATTCTA GTATGGTGACAAAAAGGAAAG | 6906 |
| TEE-293 | ACATACGCAAATCAATAAACATAATCCATCACATAAA CAGAACCAAAGACAAAAATCACATG ATTATCTCAATAGATGCAGAAAAGGCCTTCGAC | 6907 |
| TEE-294 | AAGAGTATCAACAGTAAATTACATTAGCAGAAGAATC AACAAACATGAAAATAGAAATTATG GTAGCCAAAGAACAG | 6908 |
| TEE-295 | AATCGAATGGAATCAACATCAAACGGAAAAAAACGGA ATTATCGAATGGAATCGAAGAGAATCATCGAATGGACC | 6909 |

TABLE 35-continued

TEE Sequences

| TEE Identifier | Sequence | SEQ ID NO |
|---|---|---|
| TEE-296 | GAAAGGAATAGAATGGAATGGATCGTTATGGAAAGAC<br>ATCGAATGGGATGGAATTGACTCGAATGGATTGGACT<br>GGAATG<br>GAACGGACTCGAATGGAATGGACTGGAATG | 6910 |
| TEE-297 | TAAGCAATTTCAGCAGTCTCAGGATACAAAATCAATGT<br>GCAAAAATCACAAGCATTCTTATACACCAACAACAGA<br>CAAAC<br>AGAGAGCCAAATCG | 6911 |
| TEE-298 | AACGGAATCAAACGGAATTATCGAATGGAATCGAAGA<br>GAATCATCGAATGGCCACGAATGGAATCATCTAATGG<br>AATGG<br>AATGGAATAATCCATGGACCCGAATG | 6912 |
| TEE-299 | ACATCAAACGGAATCAAACGGAATTATCGAATGGAAT<br>CGAAAAGAATCATCGAACGGACTCGAATGGAATCATC<br>TAATGG<br>AATGGAATGGAAG | 6913 |
| TEE-300 | ATCGAATGGAATCAACATCAAACGGAAAAAAACGGAA<br>TTATCAAATGGAATCGAAGAGAATCATCGAATGGACC | 6914 |
| TEE-301 | GAATAATCATTGAACGGAATCGAATGGAAACATCATC<br>GAATGGAAACGAATGGAATCATCATCGAATGGAAATG<br>AAAGG<br>AGTCATC | 6915 |
| TEE-302 | CATCAAACGGAATCAAACGGAATTATCGAATGGAATC<br>GAAAAGAATCATCGAACGGACTCGAATGGAATCATCT<br>AATGGA<br>ATGGAATGGAAGAATCCATGGACTCGAATG | 6916 |
| TEE-303 | AAACGGAATCAAACGGAATTATCGAATGGAATCGAAG<br>AGAATCATCGAATGGACTCGAATGGAATCATCTAATG<br>GAATGG<br>AATGGAAGAATCCATGG | 6917 |
| TEE-304 | ATACACAAATCAATAAATGTAATCCAGCATATAAACA<br>GAACCAAAGACAAAAACCATATGATTATCTCAATGGA<br>TGCAGA<br>AAAGGCC | 6918 |
| TEE-305 | AATCGAATAGAATCATCGAATGGACTCGAATGGAATC<br>ATCGAATGTAATGATGGAACAGTC | 6919 |
| TEE-306 | TGGAATGGAATCATCGCATAGAATCGAATGGAATTAC<br>CATCGAATGGGATCGAATGGTATCAACATCAAACGCA<br>AAAAAA<br>CGGAATTATCGAATGGAATCGAAGAGAATCTTCGAAC<br>GGACCCG | 6920 |
| TEE-307 | ATGGAATGGAATGGAATGGAATTAAATGGAATGGAAA<br>GGAATGGAATCGAATGGAAAGGAATC | 6921 |
| TEE-308 | GTCGAAATGAATAGAATGCAATCATCATCAAATGGAA<br>TCCAATGGAATCATCATCAAATAGAATCGAATGGAAT<br>CATCAA<br>ATGGAATCGAATGGAGTCATTG | 6922 |
| TEE-309 | TGGAATTATCGAAAGCAAACGAATAGAATCATCGAAT<br>GGACTCGAATGGAATCATCGAATGGAATGGAATGGAA<br>CAG | 6923 |
| TEE-310 | AAAGGAATGGAATGCAATGGAATGCAATGGAATGCAC<br>AGGAATGGAATGGAATGGAATGGAAAGGAATG | 6924 |
| TEE-311 | AATCTAATGGAATCAACATCAAACGGAAAAAAACGGA<br>ATTATCGAATGGAATCGAAGAGAATCATCGAATGGACC | 6925 |
| TEE-312 | TACACAACAAAAGAAATACTCAACACAGTAAACAGAC<br>AACCTTCAGAACAGGAGAAAATATTTGCAAATACATC<br>TAACAA<br>AGGGCTAATATCCAGAATCT | 6926 |

TABLE 35-continued

TEE Sequences

| TEE Identifier | Sequence | SEQ ID NO |
|---|---|---|
| TEE-313 | TGCAATCCTAGTCTCAGATAAAACAGACATTAAACCA ACAAAGATCAAAAGAGACAAAGAAGGCCATTAC | 6927 |
| TEE-314 | GAATCGAATGGAATCAACATCAAACGGAAAAAAACGG AATTATCGAATGGAATCGAAAAGAATCATCGAATGGA CC | 6928 |
| TEE-315 | AATGGAATCGAATGGAATGCAATCCAATGGAATGGAA TGCAATGCAATGGAATGGAATCGAACGGAATGCAGTG GAAGG GAATGG | 6929 |
| TEE-316 | GAACACAGAAAAATTTCAAAGGAATAATCAACAGGGA TTGATAACTAACTGGATTTAGAGAGCCAAGGCAAAGA GAATC AAAGCACAGGGCCTGAGTCGGAG | 6930 |
| TEE-317 | AGTTGAATAGAACCAATCCGAATGAAATGGAATGGAA TGGAACGGAATGGAATTGAATGGAATGGAATGGAATG CAATG GA | 6931 |
| TEE-318 | AACTCGATTGCAATGGAATGTAATGTAATGGAATGGA ATGGAATTAACGCGAATAGAATGGAATGGAATGTAAT GGAACG GAATGGAATG | 6932 |
| TEE-319 | AAGCGGAATAGAATTGAATCATCATTGAATGGAATCG AGTAGAATCATTGAAATCGAATGGAATCATAGAATGG AATCCA AT | 6933 |
| TEE-320 | AATGGAATCGAAAGGAATAGAATGGAATGGATCGTTA TGGAAAGATATCGAATGGAATGGAATTGACTCGAATG GAATG GACTGGAATGGAACG | 6934 |
| TEE-321 | TAACGGAATAATCATCGAACAGAATCAAATGGAATCA TCATTGAATGGAATTGAATGGAATCTTCGAATAGACAT GAATG GACCATCATCG | 6935 |
| TEE-322 | AACGGAATCAAACGGAATTATCGAATGGAATCGAATA GAATCATCGAACGGACTCGAATGGAATCATCTAATGG AATGGA ATGGAAG | 6936 |
| TEE-323 | ATTGGAATGGAACGGAACAGAACGGAATGGAATGGAA TAGAATGGAATGGAATGGAATGGTATGGAATGGAATG GAATG GTACG | 6937 |
| TEE-324 | AATCCACAAAGACAACAGAAGAAAAGACAACAGTAG ACAAGGATGTCAACCACATTTTGGAAGAGACAAGTAA TCAAAC ACATGGCA | 6938 |
| TEE-325 | GAATCGAATGGAATCAACATCAAACGGAAAAAAACGG AATTATCGAATGGAATCGAAAAGAATCATCGAACGGA CTCGA ATGGAATCATCTAATGGAATGGAATGGAAGAATCCAT GG | 6939 |
| TEE-326 | AATGGAATCGAATGGAATCATCATCAAATGGAATCTA ATGGAATCATTGAACGGAATTGGATGGAATCGTCAT | 6940 |
| TEE-327 | CAACATCAAACGGAAAAAAACGGAATTATCGAATGGA ATCGAAGAGAATCATCGAATGGACC | 6941 |
| TEE-328 | CACAACCAAAGCAATGAAAGAAAAGCACAGACTTATT GAAATGAAAGTACACACCACAGAATGGGAGCAGGCTC AAGCA AGC | 6942 |

TABLE 35-continued

TEE Sequences

| TEE Identifier | Sequence | SEQ ID NO |
|---|---|---|
| TEE-329 | ATCAAAGGGAATCAAGCGGAATTATCGAATGGAATCG AAGAGAATCATCGAATGGACTCGAATGGAATCATGTG ATGGA ATGGAATGGAATAATCCACGGACT | 6943 |
| TEE-330 | GGAATCGAATGGAATCAATATCAAACGGAGAAAAACG GAATTATCGAATGGAATCGAAGAGAATCATCGAATGG ACC | 6944 |
| TEE-331 | AGGAATGGACACGAACGGAATGCAATCGAATGGAATG GAATCTAATAGAAAGGAATTGAATGAAATGGACTGG | 6945 |
| TEE-332 | GGAAGGGAATCAAATGCAACAGAATGTAATGGAATGG AATGCAATGGAATGCAATGGAATGGAATGGAATGCAA TGGAA TGG | 6946 |
| TEE-333 | AAATTGGATTGAATCGAATCGAATGGAAAAAATGAAA TCAAATGAAATTGAATGGAATCGAAATGAATGTAAAC AATGG AATCCAATGGAATCCAATGGAATCGAATCAAATGGTTT TGAGTGGCGTAAAATG | 6947 |
| TEE-334 | AATGGAAGGGAATGGAATGGAATCGAATCGAATGGAA CAGAATTCAATGGAATGGAATGGAATGGAATGGAATC GAATG GAATGG | 6948 |
| TEE-335 | GAAAAATCATTGAACGGAATCGAATGGAATCATCATC GGATGGAAACGAATGGAATCATCATCGAATGGAAATG AAAGG AGTCATC | 6949 |
| TEE-336 | GGAATCGAATGGAATCAACATCAAACGGAGAAAAACG GAATTATCGAATGGAATCGAAGAGAATCATCGAATGG ACC | 6950 |
| TEE-337 | AAAGAAATGTCACTGCGTATACACACACACGCACATA CACACACCATGGAATACTACTCAGCTATACAAAGGAA TGAAAT AATCCACAGCCAC | 6951 |
| TEE-338 | GGAATCGAATGGAATCAATATCAAACGGAAAAAAACG GAATTATCGAATGGAATCGAAGAGAATCATCGAATGG ACC | 6952 |
| TEE-339 | TGAACGGAATCGAATGGAATCATCATCGGATGGAAAC GAATGGAATCATCATCGAATGGAAATGAAAGGAGTCA TC | 6953 |
| TEE-340 | GAATAGAACGAAATGGAATGGAATGGAATGGAATGGA AAGGAATGGAATGGAATGGAACG | 6954 |
| TEE-341 | TGGAATTATCGTCGAATAGAATCGAATGGTATCAACAT CAAACGGAAAAAAACGGAATTATCGAATGGAATCGAA GAGA ATCATCGAACGGACTCGAATGGAATCATCTAATGGAA TGGAATGGAATAATCCATGG | 6955 |
| TEE-342 | GACAAAAGAATCATCATCGAATAGAATCAAATGGAA TCTTTGAATGGACTCAAAAGGAATATCGTCAAATGGA ATCAAA AGCCATCATCGAATGGACTGAAATGGAATTATCAAAT GGACTCG | 6956 |
| TEE-343 | AACCAAACCAAGCAAACAAACAAACAGTAAAAACTCA ATAACAACCAACAAACAGGAAATACCAGGTAATTCAG ATTAT CTAGTTATGTGCCATAGT | 6957 |
| TEE-344 | GAATGAATTGAATGCAAACATCGAATGGTCTCGAATG GAATCATCTTCAAATGGAATGGAATGGAATCATCGCAT AGAAT CGAATGGAATTATCAACGAATGGAATCGAATGGAATC ATCATCAGATGGAAATGAATGGAATCGTCAT | 6958 |

TABLE 35-continued

TEE Sequences

| TEE Identifier | Sequence | SEQ ID NO |
|---|---|---|
| TEE-345 | TGGAATGGAATCAAATCGCATGGAATCGAATGGAATA<br>GAAAAGAATCAAACAGAGTGGAATGGAATGGAATGG<br>AATGGA<br>ATCATGCCGAATGGAATG | 6959 |
| TEE-346 | AAATGGAATAATGAAATGGAATCGAACGGAATCATCA<br>TCAAAAGGAACCGAATGAAGTCATTGAATGGAATCAA<br>AGGCA<br>ATCATGGTCGAATGGAATCAAATGGAAACAGCATTGA<br>ATAGAATTGAATGGAGTCATCACATGGAATCG | 6960 |
| TEE-347 | GAATTAACCCGAATAGAATGGAATGGAATGGAATGGA<br>ACAGAACGGAACGGAATGGAATGGAATGGAATGGAAT<br>GGAATG | 6961 |
| TEE-348 | AAGATATACAAGCAGCCAACAAACATACGAAAGAATG<br>CTCAACATCACTAATCCTCAGAGAAATTTAAATCAAAA<br>CCACA<br>ATGAGTTACAATCTCATACCAGTCAGAAT | 6962 |
| TEE-349 | AGATAAGTGGATGAACAGATGGACAGATGGATGGATG<br>GATGGATGGATGGATGGATGCCTGGAAGAAAGAAGAA<br>TGGAT<br>AGTAAGCTGGGTATA | 6963 |
| TEE-350 | AGAATTACAAACCACTGCTCAACAAAATAAAGAGTA<br>CACAAACAAATGGAAGAATATTCCATGCTTATGGATA<br>GGAAGA<br>ATCAATATTGTGAAAATGGCCATACT | 6964 |
| TEE-351 | CATCGAATGGACTCGAATGGAATAATCATTGAACGGA<br>ATCGAAGGGAATCATCATCGGATGGAAACGAATGGAA<br>TCATCA<br>TCGAATGGAAATG | 6965 |
| TEE-352 | AAAGGAATCAAACGGAATTATCGAATGGAATCGAAAA<br>GAATCATCGAACGGACTCGAATGGAATCATCTAATGG<br>AATGG<br>AATGGAAGAATCCATGGACTCGAATG | 6966 |
| TEE-353 | GGATATAAACAAGAAAACAACTAATCACAACTCAATA<br>TCAAAGTGCAATGATGGTGCAAAATGCAAGTATGGTG<br>GGGAC<br>AGAGAAAGGATGC | 6967 |
| TEE-354 | AACATCAAACGGAAAAAAACGGAAATATCGAATGGAA<br>TCGAAGAGAATCATCGAATGGACC | 6968 |
| TEE-355 | TAAAATGGAATCGAATGGAATCAACATCAAATGGAAT<br>CAAATGGAATCATTGAACGGAATTGAATGGAATCGTC<br>AT | 6969 |
| TEE-356 | AATCATCATCGAATGGAATCGAATGGTATCATTGAATG<br>GAATCGAATGGAATCATCATCGAGATGGAAATGAATGG<br>AATCG<br>TCAT | 6970 |
| TEE-357 | CAATGCGTCAAGCTCAGACGTGCCTCACTACGGCAATG<br>CGTCAAGCTCAGGCGTGCCTCACTAT | 6971 |
| TEE-358 | TAAGCTGATAAGCAACTTTAGCAAAGTCTCAGGATAC<br>AAAATCAATGTACAAAAATCACAAGCATTCTTATACAC<br>CAACA<br>ACAGACAGACGGAGAGCCAAA | 6972 |
| TEE-359 | AATCAAAGAATTGAATCGAATGGAATCATCTAATGTA<br>CTCGAATGGAATCACCAT | 6973 |
| TEE-360 | ATGAACACGAATGTAATGCAATCCAATAGAATGGAAT<br>CGAATGGCATGGAATATAAAGAAATGGAATCGAAGAG<br>AATGG<br>AAACAAATGGAATGGAATTGAATGGAATGGAATTG | 6974 |

TABLE 35-continued

TEE Sequences

| TEE Identifier | Sequence | SEQ ID NO |
|---|---|---|
| TEE-361 | ATCAAACGGAATCAAACGGAATTATCGAATGGAATCG<br>AAGAGAATCATCGAACGGACTCGAATGGAATCATCTA<br>ATGGAA<br>TGGGATGG | 6975 |
| TEE-362 | AATGGAAAGGAATCAAATGGAATATAATGGAATGCAA<br>TGGACTCGAATGGAATGGAATGGAATGGACCCAAATG<br>GAATG<br>GAATGGAATGGAATG | 6976 |
| TEE-363 | GGAATACAACGGAATGGAATCGAAAAAAATGGAAAG<br>GAATGAAATGAATGGAATGGAATGGAATGGAATGGAT<br>GGGAA<br>TGGAATGGAATGG | 6977 |
| TEE-364 | GAATCAAGCGGAATTATCGAATGGAATCGAAGAGAAT<br>CATCGAAAGGACTCGAATGGAATCATCTAATGGAATG<br>GAATG<br>GAATAATACACGGACC | 6978 |
| TEE-365 | AAGATAACCTGTGCCCAGGAGAAAAACAATCAATGGC<br>AACAAAAGCAGAAACAACACAAATGATACAATTAGCA<br>GACAG<br>AAACATTGAGATTGCTATT | 6979 |
| TEE-366 | AATGGACTCCAATGGAATAATCATTGAACGGAATCTA<br>ATGGAATCATCATCGGATGGAAATGAGTGGAATCATC<br>ATCGAA<br>TGGAATCG | 6980 |
| TEE-367 | AATCTATAAACGTAATCCATCACATAAACAGGACCAA<br>AGAGAAAAACCGCATGATTATCTCAAGAATGCAGAAA<br>AGGCC | 6981 |
| TEE-368 | TAATTGATTCGAAATTAATGGAATTGAATGGAATGCAA<br>TCAAATGGAATGGAATGTAATGCAATGGAATGTAATA<br>GAATG<br>GAAAGCAATGGAATG | 6982 |
| TEE-369 | AAAGGAATGGACTTGAACAAAATGAAATCGAACGATA<br>GGAATCGTACAGAACGGAAAGAAATGGAACGGAATG<br>GAATG | 6983 |
| TEE-370 | TGAGCAGGGAACAATGCGGATAAATTTCACAAATACA<br>ATGTTGAGCAAAAGAAAGACACAAAAGAATACACACA<br>TACAC<br>ACCATATGGGCTAGG | 6984 |
| TEE-371 | AATGGAATCGAACGGAATCATCATCAAACGGAACCGA<br>ATGGAATCATTGAATGGAATCAAAGGCAATCATGGTC<br>GAATG | 6985 |
| TEE-372 | AATGGAATGGAATGTACAAGAAAGGAATGGAATGAAA<br>CCGAATGGAATGGAATGGACGCAAAATGAATGGAATG<br>GAAGT<br>CAATGG | 6986 |
| TEE-373 | AACGGAAAAAAACGGAATTATCGAATGGAATCGAAGA<br>GAATCATCGAATGGACC | 6987 |
| TEE-374 | GGAATAATCATTGAACGGAATCGAATGGAATCATCAT<br>CGGATGGAAACGAATGGAATCATCATCGAATGGAAAT<br>GAAAG<br>GAGTCATC | 6988 |
| TEE-375 | GGAACGAAATCGAATGGAACGGAATAGAATAGACTCG<br>AATGTAATGGATTGCTATGTAATTGATTCGAATGGAAT<br>GGAAT<br>CG | 6989 |
| TEE-376 | TGAAAGGAATAGACTGGAACAAAATGAAATCGAATGG<br>TAGGAATCATACAGAACAGAAAGAAATGGAACGGAAT<br>GGAATG | 6990 |

TABLE 35-continued

TEE Sequences

| TEE Identifier | Sequence | SEQ ID NO |
|---|---|---|
| TEE-377 | AACCCGAATAGAATGGAATGGAATGGAATGGAACGGA<br>ACGGAATGGAATGGAATGGATTGGAATGGAATGGAATG | 6991 |
| TEE-378 | AAAGAGAATCAAATGGAATTGAATCGAATGGAATCGA<br>ATGGATTGGAAAGGAATAGAATGGAATGGAATGGAAT<br>GGAAT<br>GGAATGGAATG | 6992 |
| TEE-379 | AATGGAATCATCAGTAATGGAATGGAAAGGAATGGAA<br>AGGACTGGAATGGAATGGAATGGAATGGAATGG | 6993 |
| TEE-380 | GGAACAAAATGAAATCGAACGGTAGGAATCGTACAGA<br>ACGGAAAGAAATGGAACGGAATGGAATGCACTCAAAT<br>GGAAA<br>GGAGTCCAATGGAATCGAAAGGAATAGAATGGAATGG | 6994 |
| TEE-381 | AGAATGAGATCAAGCAGTATAATAAAGGAAGAAGTAG<br>CAAAATTACAACAGAGCAGTGAAATGGATATGCTTTCT<br>GGCA<br>ATAATTGTGAAAGGTCTGGTAATGAGAAAGTAGCAAC<br>AGCTAGTGGCTGCCAC | 6995 |
| TEE-382 | AACAAATGGAATCAACATCGAATGGAATCGAATGGAA<br>ACACCATCGAATTGAAACGAATGGAATTATCATGAAA<br>TTGAAA<br>TGGATGGACTCATCATCG | 6996 |
| TEE-383 | TAACATGCAGCATGCACACACGAATACACAACACACA<br>AACATGTATGCACGCACACGTGAATACACAACACACA<br>CAAACA<br>TGCATGCATGCATACATGAATACACAGCACACAAATA<br>TCCAGCAT | 6997 |
| TEE-384 | GAATGGAATCAACATCAAACGGAAAAAAAACGGAATT<br>ATCGAATGGAATCGAATAGAATCATCGAATGGACC | 6998 |
| TEE-385 | AATCGAATGAAATGGAGTCAAAAGGAATGGAATCGAA<br>TGGCAAGAAATCGAATGTAATGGAATCGCAAGGAATT<br>GATGT<br>GAACGGAACGGAATGGAAT | 6999 |
| TEE-386 | AATGGAATTGAACGGAAACATCAGCGAATGGAATCGA<br>AAGGAATCATCATGGAATAGATTCGAATGGAATGGAA<br>AGGAA<br>TGGAATGGAATG | 7000 |
| TEE-387 | ATGGAATCAACATCAAACAGAATCAAACGGAATTATC<br>GAATGGAATCGAAGACAATCATCGAATGGACTCGAAT<br>GGAATC<br>ATCTAATGGAATGGAATGGAAGAATCCATGGTCTCGA<br>ATGCAATCATCATCG | 7001 |
| TEE-388 | GAATAATCATTGAACGGAATCGAATGGAATCATCTTCG<br>GATGGAAACGAATGGAATCATCATCGAATGGAAATGA<br>AAGGA<br>GTCATC | 7002 |
| TEE-389 | AATGGACTCGAATGGAATAATCATTGAACGGAATCGA<br>ATGGAATCATCATCGGATGGAAATGAGTGGAATCATC<br>ATCGAA<br>TGGAATCG | 7003 |
| TEE-390 | AAATGAAATCGAACGGTAGGAATCGTACAGAACGGAA<br>AGAAATGGAACGGAATGGAATGCAATCGAATGGAAAG<br>GAGTC<br>CAATGGAAGGGAATCGAAT | 7004 |
| TEE-391 | TACCAAACATTTAAAGAACAAATATCAATCCTACGCA<br>AACCATTCTGAAACACAGAGATGGAGGATATACAGCG<br>AAACTC<br>ATTCTACATGGCC | 7005 |

TABLE 35-continued

TEE Sequences

| TEE Identifier | Sequence | SEQ ID NO |
|---|---|---|
| TEE-392 | TATTGGAATGGAATGGAATGGAGTCGAATGGAACGGA<br>ATGCACTCGAATGGAAGGCAATGCAATGGAATGCACT<br>CAACA<br>GGAATAGAATGGAATGGAATGGAATGG | 7006 |
| TEE-393 | GGAATTTAATAGAATGTACCCGAATGGAACGGAATGG<br>AATGGAATTGTATGGCATGGAATGGAA | 7007 |
| TEE-394 | GCAATCCAATAGAATGGAATCGAATGGCATGGAATAT<br>AAAGAAATGGAATCGAAGAGAATGGAGACAAATGGA<br>ATGGAA<br>TTGAATGGAATGGAATTG | 7008 |
| TEE-395 | AATGGAATCGAATGGAATCATCATCAAATGGAATCTA<br>ATGGAATCATTGAACGGAATTAAATGGAATCGTCATC<br>GAATGA<br>ATTCAATGCAATCAACGAATGGTCTCGAATGGAACCAC | 7009 |
| TEE-396 | AATTGCAAAAGAAACACACATATACACATATAAAACT<br>CAAGAAAGACAAAACTAACCTATGGTGATAGAAATCA<br>GAAAA<br>GTACAGTACATTGGTTGTCTTGGTGGG | 7010 |
| TEE-397 | TGACATCATTATTATCAAGAAACATTCTTACCACTGTT<br>ACCAACTTCCCAACACAGACTATGGAGAGAGAGATAA<br>GACAGA<br>ATAGCATT | 7011 |
| TEE-398 | AAAGAATTGAATTGAATAGAATCACCAATGAATTGAA<br>TCGAATGGAATCGTCATCGAATGGAATCGAAGGGAAT<br>CATTGG<br>ATGGGCTCA | 7012 |
| TEE-399 | ATCATCGAATGGAATCGAATGGAATCAATATCAAACG<br>GAAAAAAACGGAATTATCGAATGGAATCGAATAGAAT<br>CATCGA<br>ATGGACC | 7013 |
| TEE-400 | GAATGAAATCGTATAGAATCATCGAATGCAACTGAAT<br>GGAATCATTAAATGGACTTGAAAGGAATTATTATGGA<br>ATGGAA<br>TTG | 7014 |
| TEE-401 | TAAGCAACTTCAGCAAAGTCTCAGGATACAAAATCAA<br>TGTGCAAAAATCTCAAGCATTCTTATACACGAACAACA<br>GACAA<br>ACAGAGAGCT | 7015 |
| TEE-402 | ACTCAAAAGGAATTGATTCGAATGGAATAGAATGGCA<br>AGGAATAGTATTGAATTGAATGGAATGGAATGGACCC<br>AAATG | 7016 |
| TEE-403 | GAATGGAATTTAAAGGAATAGAATGGAAGGAATCGGA<br>TGGAATGGAATGGAATAGAATGGAGTCGAATGGAATA<br>GAATC<br>GAATGGAATGGCATTG | 7017 |
| TEE-404 | TGAGAAAATGATGGAAAAGAGGAATAAAACGAAACA<br>AAACCACAGGAACACAGGTGCATGTGAATGTGCACAG<br>ACAAA<br>GATACAGGGCGGACTGGGAAGGAAGTTTCTGCACCAG<br>AATTTGGGG | 7018 |
| TEE-405 | AACAAAAAATGAGTCAAGCCTTAAATAAAATCAGAGC<br>CAAAAAAGAAGACATTACATCTGATAAGACAAAAATT<br>CAAAG<br>GACCATC | 7019 |
| TEE-406 | AACCCAGTGGAATTGAATTGAATGGAATTGAATGGAA<br>TGGAAAGAATCAATCCGAGTCGAATGGAATGGTATGG<br>AATGGA<br>ATGGCATGGAATCAAC | 7020 |
| TEE-407 | ATCAACATCAAACGGAAAAAAAACGGAATTATCGAAT<br>GGAATCGAAGAGAATCATCGAATGGACC | 7021 |

TABLE 35-continued

TEE Sequences

| TEE Identifier | Sequence | SEQ ID NO |
|---|---|---|
| TEE-408 | AAGGAATGGAATGGTACGGAATAGAATGGAATGGAAC GAATTGTAATGGAATGGAATTTAATGGAACGGAATGG AATGG AATGGAATCAACG | 7022 |
| TEE-409 | AACGGAATGGAAAGCAATTTAATCAAATGCAATACAG TGGAATTGAAGGGAATGGAATGGAATGGC | 7023 |
| TEE-410 | AATCGAATGGAACGGAATAGAATAGACTCGAATGTAA TGGATTGCTATGTAATTGATTCGAATGGAATGGAATCG AATGG AATGCAATCCAATGGAATGGAATGCAATGCAATGGAA TGGAATCGAACGGAATGCAGTGGAAGGGAATGG | 7024 |
| TEE-411 | TAGCAACATTTTAGTAACATGATAGAAACAAAACAGC AACATAGCAATGCAATAGTAACACAACAGCAACATCA TAACAT GGCAGCA | 7025 |
| TEE-412 | AATGGAATCGAAGAGAATGGAAACAAATGGAATGGA ATTGAATGGAATGGAATTGAATGGAATGGGAAGGAAT GGAGTG | 7026 |
| TEE-413 | AGCAAACAAGTGAATAAACAAGCAAACAAGTGAACA AGCAAACAAGTGAATAAACAAGCAAACAAGTGAACA AGCAAA CAAGTGAATAAACAAGCAAACAAGTGAACAAGGAAA CAAGTGAATAAACAAAGGCTCT | 7027 |
| TEE-414 | AATGGAATCAACACGAGTGCAATTGAATGGAATCGAA TGGAATGGAATGGAATGGAATGAATTCAACCCGAATG GAATG GAAAGGAATGGAATC | 7028 |
| TEE-415 | GAATCGAATGGAATCAACATCAAACGGAAAAAAACGG AATTATCGAATGGAATCGAAGAGAATCATCGAATGGA CC | 7029 |
| TEE-416 | AACACGAATGTAATGCAATCCAATAGAATGGAATCGA ATGGCATGGAATATAAAGAAATGGAATCGAAGAGAAT GGAAA CAAACGGAATGGAATTGAATGGAATGGAATTGAATGG AATGGGAACGAATGGAGTGAAATTG | 7030 |
| TEE-417 | GAATGGAACGGAATAGAACAGACTCGAATGTAATGGA TTGCTATGTAATTGATTCGAATGGAATGGAATCGAATG GAATG CAATCCAATGGAATGGAATGCAATGCAATGGAATGGA ATCGAATGGAATGCAGTGGAAGGGAATGG | 7031 |
| TEE-418 | GAATCGAATGGAATCAATATCAAACGGAAAAAAACGG AATTATCGAATGGAATCGAAGAGAATCATCGAATGGA CC | 7032 |
| TEE-419 | ATAAACATCAAACGGAATCAAACGGAATTATCGAATG GAATCGAAGAGAATAATCGAATGGACTCAAATGGAGT CATCTA ATGGAATGGTATGGAAGAATCCATGGACTCCAACGCA ATCATCAGCGAATGGAATC | 7033 |
| TEE-420 | AAAAGAAAAGACAAAAGACACCAATTGCCAATACTGA AATGAAAAAACAGGTAATAACTATTGATCCCATGGAC ATTAA AATGATGTTGAAGGAACACCAC | 7034 |
| TEE-421 | AATGTCAAGTGGAATCGAGTGGAATCATCGAAAGAAA TCGAATGGAATCGAAGGGAATCATTGGATGGGCTCAA AT | 7035 |
| TEE-422 | ATCATCGAATGGAATAGAATGGTATCAACATCAAACG GAGAAAAACGGAATTATCGAATGGAATCGAAGAGAAT CTTCGA ACGGACC | 7036 |

TABLE 35-continued

TEE Sequences

| TEE Identifier | Sequence | SEQ ID NO |
|---|---|---|
| TEE-423 | GAATGGAATCATCGCATAGAATCGGATGGAATTATCA TCGAATGGAATCGAATGGTATCAACATCAAACGGAAA AAAACG GAATTATCGAATGGAATCGAATTGAATCATCGAACGG ACCCG | 7037 |
| TEE-424 | AATGGACTCGAATGGAATAATCATTGAACGGAATCGA ATGGAATCATCATCGGATGGAAATGAATGGAATAATC CATGGA CTCGAATGCAATCATCATCGAATGGAATCGAATGGAA TCATCGAATGGACTCG | 7038 |
| TEE-425 | AATGCAATCATCAACTGGCTTCGAATGGAATCATCAAG AATGGAATCGAATGGAATCATCGAATGGACTC | 7039 |
| TEE-426 | AAGAGACCAATAAGGAATAAGTAAGCAACAAGAGGA AGGAGAAAGGGCAAGAGAGATGACCAGAGTT | 7040 |
| TEE-427 | TGGAATCATCATAAAATGGAATCGAATGGAATCAACA TCAAATGGAATCAAATGGAATCATTGAACGGAATTGA ATGGAA TCGTCAT | 7041 |
| TEE-428 | GGAATCATCGCATAGAATCGAATGGAATTATCATCGA ATGGAATCGAATGGAATCAACATCAAACGAAAAAAAA CCGGA ATTATCGAATGGAATCGAAGAGAATCATCGAACGGACC | 7042 |
| TEE-429 | AAATCATCATCGAATGGGATCGAATGGTATCCTTGAAT GGAATCGAATGGAATCATCATCAGATGGAAATGAATG GAATC GTCAT | 7043 |
| TEE-430 | GGAATGTAATAGAACGGAAAGCAATGGAATGGAACGC ACTGGATTCGAGTGCAATGGAATCTATTGGAATGGAAT CGAAT GGAATGGTTTGGCATGGAATGGAC | 7044 |
| TEE-431 | AAACAATGGAAGATAATGGAAAGATATCGAATGGAAT AGAATGGAATGGAATGGACTCAAATGGAATGGACTTT AATGG AATGG | 7045 |
| TEE-432 | GGAACGAAATCGAATGGAACGGAATAGAATAGACTCG AATGTAATGGATTGCTATGTAATTGATTCGAATGGAAT GGAAT CGAATGGAATGCAATCCAATGGAATGGAATGCAATGC AATGAATGGAATGGAATGGAATGGAATGGAA | 7046 |
| TEE-433 | AAACCGAATGGAATGGAATGGACGCAAAATGAATGGA ATGGAAGTCAATGGACTCGAAATGAATGGAATGGAAT GGAAT GGAATG | 7047 |
| TEE-434 | GGAATCGAATGGAATCAACATCAAACGGAAAAAAACA GAATTATCGTATGGAATCGAATAGAATCATCGAATGG ACC | 7048 |
| TEE-435 | CAACCCGAGTGGAATAAAATGGAATGGAATGGAATGA ATGGAATGGATCGGAATGGAATCCAATGGAATCAAC TGGAA TGGAATGGAATGGAATG | 7049 |
| TEE-436 | TATCATCGAATGGAATCGAATGGAATCAACATCAAAC GGAAAAAAACGGAATTATCGAATGGAATCGAAGAGAA TCATC GAATGGACC | 7050 |
| TEE-437 | CGGAATAATCATTGAACGGAATCGAATGGAATCATCA TCGGATGGAAACGAATGGAATCATCATCGAATGGAAA TGAAAG GAGTCATC | 7051 |

TABLE 35-continued

TEE Sequences

| TEE Identifier | Sequence | SEQ ID NO |
|---|---|---|
| TEE-438 | CAACACACAGAGATTAAAACAAACAAACAAACAATCC AGCCCTGACATTTATGAGTTTACAGACTGGTGGAGAGG CAGAG AAG | 7052 |
| TEE-439 | CACTACAAACCACGCTCAAGGCAATAAAAGAACACAA ACAAATGGAAAAACATTCCATGCTCATGGATGGG | 7053 |
| TEE-440 | AATCGAATGGAATTAACATCAAACGGAAAAAAACGGA ATTATCGAATGGAATCGAAGAGAATCATCGAATGGACC | 7054 |
| TEE-441 | TGGAAAAGAATCAAATTGAATGGCATCGAACGGAATG GGATGGAATGGAATAGACCCAGATGTAATGGACTCGA ATGGA ATG | 7055 |
| TEE-442 | GACTAATATTCAGAATATACAAGGAACTCAAACAACT CAACAGTAGAAAAAAAAACCTGAATAGACATTTCTCA AAAGAA GACATACAAATGGCC | 7056 |
| TEE-443 | GGTCCATTCGATGATTCTCTTCGATTCCATTCGATAATT CCGTTTTTTCCCGTTTGATGTTGATTCC | 7057 |
| TEE-444 | GGAACGAAATCGAATGGAACGGAATAGAATAGACTCG AATGTAATGGATTGCTATGTAATTGATTCGAATGGAAT GGAAT CGAATGGAATGCAATCCAATGGAATGGAATGCAATGC AATGAATGGAATGGAATGGAATGGAATGGA | 7058 |
| TEE-445 | AGCAACTTCAGTAAAGTGTCAGGATACAAAATCAATG TGCAAAAATCACAAGCATTCTTATACATCAATAACAGA CAAAC AGAGAGCCAAA | 7059 |
| TEE-446 | GAATAATCATTGAACGGAATCGAATGGAATCATCATC GGATGGAAACGAATGGAATCATCATCGAATGGAAATG AAAGG AGTCATC | 7060 |
| TEE-447 | TAATCATCTTCGAATTGAAAACAAAGCAATCATTAAAT GTACTCTAACGGAATCATCGAATGGACC | 7061 |
| TEE-448 | GGAATCGAATGGAATCAACATCAAACGGAAAAAAACG GAATTATCGAATGGAATCGAAGAGAATCATCGAATGG ACC | 7062 |
| TEE-449 | AGAGAAAAGATGATCATGTAACCATTGAAAAGACAAT GTACAAAACTAATACTAATCACACAGGACCAGAAAGC AATTTA GACCAT | 7063 |
| TEE-450 | AATGGAATCGAATGGAATCAACATCAAACGGAAAAAA CGGAATTATCGAATGGAATCAAAGAGAATCATCGAAT GGACC | 7064 |
| TEE-451 | AATGGAATTATCATCGAATGGAATCGAATGGAATCAA CATCAAACGGAAAAAAACGGAATTATCGAATGGAATC GAAGA GAATCATCGAATGGACC | 7065 |
| TEE-452 | GTCAACACAGGACCAACATAGGACCAACACAGGGTCA ACACAGGACCAACATAGGACCAACACAGGGTCAACAC AAGAC CAACATGGGACCAACACAGGGTCAACATAGGACCAAC ATGGGACCAACACAGGGTCAACACAGGACCAAC | 7066 |
| TEE-453 | GAATCAACTCGATTGCAATCGAATGGAATGGAATGGT ATTAACAGAATAGAATGGAATGGAATGGAATGGAACG GAACG | 7067 |
| TEE-454 | ACTCGAATGCAATCAACATCAAACGGAATCAAACGGA ATTATCGAATGGAATCGAAGAGAATCATCGAACGGAC TCGAAT GGAATCATCTAATGGAATGGAATGG | 7068 |

TABLE 35-continued

TEE Sequences

| TEE Identifier | Sequence | SEQ ID NO |
|---|---|---|
| TEE-455 | AATGGAATGGAATAATCGACGGACCCGAATGCAATCA TCATCGTACAGAATCGAATGGAATCATCGAATGGACT GGAATG GAATGG | 7069 |
| TEE-456 | AATACAAACCACTGCTCAACGAAATAAAAGAGGATAC AAACAAATGGAAGAACATTCTATGCTCATGGGTAGGA TGAATT CATATCGTGAAAATGGCCATACTGCC | 7070 |
| TEE-457 | AAACACGCAAACACACACACAAGCACACTACCACACA AGCGGACACACATGCAAACACGCGAACACACACACAT ATACA CACAAGCACATTACAAAACACAAGCAAACACCAGCAG ACACACAAACACACAAACATACATGG | 7071 |
| TEE-458 | AATCGAACGGAATCAACATCAAACGGAAAAAAAACGG AATTATCGAATGGAATCGAAGAGAATCATCGAATGGA CC | 7072 |
| TEE-459 | TAATTGATTCGAATGGAATGGAATAGAATGGAATTGA ATGGAATGGACCATAATGGATTGGACTTTAATAGAAA GGGCATG | 7073 |
| TEE-460 | AGCAACTTCAGCAAAGTCTCAGGATACAAAATCAATG TACAAAAGTCACAAGCATTCTTATACACCAACAAAAG ACAAAC AGAGAGCC | 7074 |
| TEE-461 | ACATCAAACGGAAAAAAAAAACAAAACGGAATTATCG AATGGAATCGAAGAGAATCATCGAATGGACC | 7075 |
| TEE-462 | GAAATTCCAATTAAAATGAAATCGACTTATCTTAACAA ATATAGCAATGCTGACAACACTTCTCCGGATATGGGTA CTGCT | 7076 |
| TEE-463 | ACATCTCACTTTTAGTAATGAACAGATCATTCAGACAG AAAATTAGCAAAGAAACATCAGAGTTAAACTACACTC TAAAC CAAATGGACCTA | 7077 |
| TEE-464 | GAAGAAAGCATTCATTCAAGACATCTAACTCGTTGATA TAATGCATACAGTTCAAAATGATTACACTATCATTACA TCTAG GGCTTTC | 7078 |
| TEE-465 | ACACACACATTCAAAGCAGCAATATTTACAACAGCCA AAAGGTGGAAACAATTGAGCAATTG | 7079 |
| TEE-466 | ATCATCGAATAGAATCGAATGGTATCAACACCAAACG GAAAAAAACGGAATTATCGAATGGAATCGAAGAGAAT CTTCGA ACGGACC | 7080 |
| TEE-467 | ATCAACATCAAACGGAAAAAACGGAATTATCGAATGG AATCGAAGAGAATCATCGAACGGACC | 7081 |
| TEE-468 | AATCGAAGGAATGTCATCGAATGGAATGGACTCAAA TGGAATAGAATCGGATGGAATGGCATCGAATGGAATG GAATG GAATTGGATGGAC | 7082 |
| TEE-469 | AACATGAACAGTGGAACAATCAGTGAACCAATACAAG GGTTAAATAAGCTAGCAATTAAAAGCTGTATCACTGGT CTAAA GATAGAAGATCAAGTAGAAAATCAGCGCAAGAGGAA AGATATACGAAAACTAATGGCC | 7083 |
| TEE-470 | CGAATGGAATCATTATGGAATGGAATGAAATGGAATA ATCAAATGGAATTGAATGGAATCATCGAATGGAATCG AACAAA ATCCTCTTTGAATGGAATAAGATGGAATCACCAAATGG AATTG | 7084 |

TABLE 35-continued

TEE Sequences

| TEE Identifier | Sequence | SEQ ID NO |
| --- | --- | --- |
| TEE-471 | AAGGGAATTGAATAGAATGAATCCGAATGGAATGGAA<br>TGGAATGGAATGGAATGGAATGGAATGGAATGGAATG<br>GAATG | 7085 |
| TEE-472 | GAATGGAATCGAATCAAATTAAATCAAATGGAATGCA<br>ATAGAAGGGAATACAATGGAATAGAATGGAATGGAAT<br>GGAAT<br>GGACT | 7086 |
| TEE-473 | AAACGGAATCAAACGGAATTATCGAATGGAATCGAAG<br>AGAATCATCGAACGGACTCGAATGGAATCATCTAATG<br>GAATG<br>GAATGGAAGAATCCATGGACT | 7087 |
| TEE-474 | ATGGAATCAACATCAAACGGAAAAAAAAACGGAATTA<br>TCGAATGGAATCGAAGAGAATCATCGAATGGACCAGA<br>ATGGA<br>ATCATCTAATGGAATGGAATGG | 7088 |
| TEE-475 | AATGGAATCATCATCGAATGGAATCGAATGGAATCAT<br>GGAATGGAATCAAATGGAATCAAATGGAATCGAATGG<br>AATGG<br>AATGGAATG | 7089 |
| TEE-476 | AACGGAATCAAACGGAATTACCGAATGGAATCGAATA<br>GAATCATCGAACGGACTCGAATGGAATCATCTAATGG<br>AATGGA<br>ATGGAAG | 7090 |
| TEE-477 | AAACGGAATCAAACGGAATTATCGAATGGAATCGAAA<br>AGAATCATCGAACGGACTCGAATGGAATCATCTAATG<br>GAATG<br>GAATGGAAGAATCCATGG | 7091 |
| TEE-478 | GAATGATACGGAATACAATGGAATGGAACGAAATGAA<br>ATGGAATGGAATGGAATGGAATGGAATGGAATGG | 7092 |
| TEE-479 | ACAGCAAGAGAGAAATAAAACGACAAGAAAACTACA<br>AAATGCCTATCAATAGTTACTTTAAATATCAGTGGACC<br>AAATCA<br>GTGAAACAAAAGACACAGAGTGGC | 7093 |
| TEE-480 | AATGGACTCGAATGGATTAATCATTGAACGGAATCGA<br>ATGGAATCATCATCGGATGGTAATGAATGGAATCATC<br>ATCGAA<br>TGGAATCGG | 7094 |
| TEE-481 | GAATGGAATCGAAAGGAATGTCATCGAATGGAATGGA<br>ATGGAACGGAATGGAATCGAATGGAATGGACTCGAAT<br>GGAAT<br>AGAATCGAATGCAATGGCATCG | 7095 |
| TEE-482 | ATCGAATGGAATCAACATCAGACGGAAAAAAACGGAA<br>TTATCAAATGGAATCGAAGAGAATCATCGAATGGACC | 7096 |
| TEE-483 | AGCAACTTCAGCAAAGTCTCAGGATACAAAATCAATG<br>TGCAAAAATCAAAAGCATTCTTATGCACCAATAACAG<br>ACACAG<br>AGCCAAAT | 7097 |
| TEE-484 | AATGGAATGGAACGCAATTGAATGGAATGGAATGGAA<br>CGGAATCAACCTGAGTCAAATGGAATGGAATGGAATG<br>GAATG | 7098 |
| TEE-485 | GGAACGAAATCGAATGGAACGGAATAGAATAGACTCG<br>AATGTCATGGATTGCTATGTAATTGATTGGAATGGAAT<br>GGAAT<br>CG | 7099 |
| TEE-486 | TAGCAGGAAACAGCAAACTCAAATTAAGTAATTTCAA<br>GAGCGTATCATCAATGAACTATTTTCAAAGATGTGGGC<br>AAGAT | 7100 |

TABLE 35-continued

TEE Sequences

| TEE Identifier | Sequence | SEQ ID NO |
|---|---|---|
| TEE-487 | GAATTGAAAGGAATGTATTGGAATAAAATGGAATCGA<br>ATAGGTTGAAATACCATAGGTTCGAATTGAATGGAAT<br>GGGAGG<br>GACACCAATGGAATTG | 7101 |
| TEE-488 | AAGCAACTTCAGCAAAGTCTCGGGATACAAAATCAAT<br>GTGCAAAAATCACAAGCATTCTTATACACCACTAACAG<br>ACAAA<br>TGGAGAGTC | 7102 |
| TEE-489 | GAATGGAATCAACATCAAACGGAAAAAAACGGAATTA<br>TCGAATGGAATCGAAGAGAATCATCGAATGGACCAGA<br>ATGGA<br>ATCATCTAATGGAATGGAATGGAATAATCCATGG | 7103 |
| TEE-490 | AAAAGCAATTGGACTGATTTTAAATATACGTGGCAAC<br>AAGGATAAACTGCTAATGATGGGTTTGCAAATACAGA<br>TCG | 7104 |
| TEE-491 | AATGGAATCAACATCGAACGGAAAAAAACGGAATTAT<br>CGAATGGAATCGAAGAGAATCATCGAATGGACC | 7105 |
| TEE-492 | AAACGGAATTATCAAATGGAATCGAAGAGAATCATCG<br>AACGGACTCGAATGGAATCATCTAATGGAATGGAATG<br>GAAG | 7106 |
| TEE-493 | TGCAAGATAACACATTTTAGTTGACACCATTGAAAACA<br>GTTTTAACCAAGAATATTAGAACCAATGAAGCAGAGA<br>AATCA<br>AAAGGGTGGATGGAACTGCCAAAGGATG | 7107 |
| TEE-494 | TAGAACAGAATTGAATGGAATGGCATCAAATGGAATG<br>GAAACGAAAGGAATGGAATTGAATGGACTCAAATGTT<br>ATGGA<br>ATCAAAGGGAATGGACTC | 7108 |
| TEE-495 | AAGAGAATCATCGAATGGAATCGAATGGAATCAACAT<br>CAAACGGAAAAAAACGGAATTATCGAATGGAATCGAA<br>GAGAA<br>TCATCGAATGGACC | 7109 |
| TEE-496 | ATCAACATCAAACGGAAAAAAACGGAATTATCGAATG<br>GAATCGAAGAGAATCATCGAATGGACC | 7110 |
| TEE-497 | GAATCAACATCAAACGGAAAAAAACCGAATTATCGAA<br>TGGAATCGAAGAGAATCATCGAATGGACC | 7111 |
| TEE-498 | ATCAACATCAAACGGAATCAAACGGAATTATCGAATG<br>GAATCGAAGAGAATCATCAAATGGACTCGAATGGAAT<br>CATCTA<br>ATGGAATGGAATGGAAGAATCCATGG | 7112 |
| TEE-499 | ATCGAATGGAATCATTGAATGGAAAGGAATGGAATCA<br>TCATGGAATGGAAACGAATGGAATCACTGAATGGACT<br>CGAATG<br>GGATCATCA | 7113 |
| TEE-500 | ATTCAGCCTTTAAAAAAGAAGACAGTCCTGTCATTTG<br>TGACAATATGAATGAAACAGACATCACATTAAATGAA<br>ATGAG<br>CCAGGCGCAG | 7114 |
| TEE-501 | GAATGAAATGAAATCAAATGGAATGTACATGAATGGA<br>ATAGAAAAGAATGCATCTTTCTCGAACGGAAGTGCATT<br>GAATG<br>GAAAGGAATCTACTGGAATGGATTCGAATGGAATGGA<br>ATGGGATGGAATGGTATGG | 7115 |
| TEE-502 | AACATCAAACGGAATCAAACGGAATTATCGAATGGAA<br>TCGAAGAGAATCATCGAACGGACTCGAATGGAATCAT<br>CTAATG<br>GAATGGAATGGAAGAATCCATGGACTCGAATGCAATC<br>ATCATCGAATGAAATCGAATGGAATCATCGAATGGAC<br>TCG | 7116 |

TABLE 35-continued

TEE Sequences

| TEE Identifier | Sequence | SEQ ID NO |
|---|---|---|
| TEE-503 | ATGGAATTCAATGGAATGGACATGAATGGAATGGACT TCAATGGAATGGTATCAAATGGAATGGAATTCAGT | 7117 |
| TEE-504 | AATGGAAAGGAATCGAATGGAAGGGAATGAAATTGAA TCAACAGGAATGGAAGGGAATAGAATAGACGGCAATG GAAT GGACTCG | 7118 |
| TEE-505 | AGCAACTTCAGCAAAGTATCAGGATACAAAATCAATG TACAAAAATCCCAAGCATTCTTATACACCAACAACAG ACAAAC AGAGAGCC | 7119 |
| TEE-506 | AGCAACTTCAGCAAAGTCTCAGGATACAAAATCGATG TGCAAAAATCACAAGCATTCTTATACACCAACAACAG ATAAAC AGAGAGCC | 7120 |
| TEE-507 | AACGGAAAAAAAACGGAATTATCGAATGGAATCGAAG AGAATCATCGAATGGACCAGAATGGAATCATCTAATG GAATG GAATGGAATAATCCATGGACTCGAATG | 7121 |
| TEE-508 | GGAATCAAACGGAATTATCGAATGGAATCGAAGAGAA TCATAGAACGGACTCAAATGGAATCATCTAATGGAAT GGAAT GGGAGAATCCATGGACTCGAATG | 7122 |
| TEE-509 | AATGGAATCAATATCAAACGGAAAAAAACGGAATTAT CGAATGGAATCGAAGAGAATCATCGAATGGACC | 7123 |
| TEE-510 | AACGGAATCAAACGGAATTATCGAATGGAATCGAAAA GAATCATCGAACGGACTCGAATGGAATCATCTAATGG AATGG AATGGAAGAATCCATGG | 7124 |
| TEE-511 | AAACGGAATTATCGAATGGAATCAAAGAGAATCATCG AATGGCCACGAATGGAATCATATAATGGAATGGAATG GAATA ATCCATGGACC | 7125 |
| TEE-512 | AATGGAATCGAATGGATTGATATCAAATGGAATGGAA TGGAAGGGAATGGAATGGAATGGAATTGAACCAAATG TAATG GATTTG | 7126 |
| TEE-513 | TAAAAGACGGAACAGATAGAAAGCAGAAAGGAAAGG TGAATTGCATTACCACTATTCATACTGCCACACACATG ACATTA GGCCAAGTC | 7127 |
| TEE-514 | AATGGAATCGAATGGAACAATCAAATGGACTCCAATG GAGTCATCTAATGGAATCGAGTGGAATCATCGAATGG ACTCG | 7128 |
| TEE-515 | TAACACATAAACAAACACAGAGACAAAATCTCCGAGA TGTTAATCTGCTCCAGCAATACAGAACAATTTCTATTA CCAAC AGAATGCTTAATTTTTCTGCCT | 7129 |
| TEE-516 | GGAATCGAATGGAATCAACATCAAACGGAAAAAAACG GAATTATCGAATGGAATCAAAGAGAATCATCGAATGG ACC | 7130 |
| TEE-517 | AGAATGGAAAGGAATCGAAACGAAAGGAATGGAGAC AGATGGAATGGAATG | 7131 |
| TEE-518 | GAATCATCATAAAATGGAATCGAATGGAATCAACATC AAATGGAATCAAATGGTCTCGAATGGAATCATCTTCAA ATGGA ATGGAATGG | 7132 |
| TEE-519 | AACAACAATGACAAACAAACAACAACGACAAAGACAT TTATTTGGTTCACAAATCTCCAGGGTGTACAAGAAGCA TGGTG | 7133 |

TABLE 35-continued

TEE Sequences

| TEE Identifier | Sequence | SEQ ID NO |
|---|---|---|
| | CCAGCATCTGCTCAGCTTCTGATGAGGGCTCTGGGAAG CTTTTACTC | |
| TEE-520 | AACGGACTCGAACGGAATATAATGGAATGGAATGGAT TCGAAAGGAATGGAATGGAATGGACAGGAAAAGAATT GAATG GGATTGGAATGGAATCG | 7134 |
| TEE-521 | AACATCAAACGAAATCAAACGGAATTATCAAATTGAA TCGAAGAGAATCATCGAATTGCCACGAATGCAATCAT CTAATG GTATGGAATGGAATAATCCATGGACCCAGATG | 7135 |
| TEE-522 | AGAAATTAACAGCAAAAGAAGGATGCAGTGCAACTCA GGACAACACATACAATTCAAGCAACAAATGTATAGTG GCTGG GCACCAAGGATACAG | 7136 |
| TEE-523 | GCAATAAAATCGACTCAGATAGAGAAGAATGCAATGG AATGGAATGGAATGGAATGGAATGGGATGGAATGGTA TGGAA TGG | 7137 |
| TEE-524 | AATGGACTCGAATGAAATCATCATCAAACGGAATCGA ATGGAATCATTGAATGGAAAGGATGGGATCATCATGG AATGGA AACGAATGGAATCACTG | 7138 |
| TEE-525 | CCACATAAAACAAAACTACAAGACAATGATAAAGTTC ACAACATTAACACAATCAGTAATGGAAAAGCCTAGTC AATGGC AG | 7139 |
| TEE-526 | TGGAATGGAATGGAATGGAATCAAATCGCATGGTAAT GAATCAAATGGAATCAAATCGAATGGAAATAATGGAA TCGAA GGGAAACGAATGGAATCGAATTGCACTGATTCTACTG ACTTCGAGGAAAATGAAATGAAATGCGGTGAAGTGGA ATGG | 7140 |
| TEE-527 | GAATGTTATGAAATCAACTCGAACGGAATGCAATAGA ATGGAATGGAATGGAATGGAATGGAATGGAATGG | 7141 |
| TEE-528 | AATGGAATCATTGAATGGAATGGAATGGAATCATCAA AGAAAGGAATCGAAGGGAATCATCGAATGGAATCAAA CGGAA TCATCGAATGGAATGGAATGGAATG | 7142 |
| TEE-529 | GGAATCAACATCAAACGGAAAAAAAACGGAATTATCG AATGGAATCGAAGAGAATCATCGAATGGACC | 7143 |
| TEE-530 | GGAATAATCATCATCAAACAGAACCAAATGGAATCAT TGAATGGAATCAAAGGCAATCATGGTCGAATG | 7144 |
| TEE-531 | GCATAGAATCGAATGGAATTATCATTGAATGGAATCG AATGGAATCAACATCAAACGGAAAAAAACGGAATTAT CGAATG GAATCGAAGAGAATCATCGAATGGACCC | 7145 |
| TEE-532 | AATGGAATCGAAGAGAATCATCGAACGGACTCGAATG GAATCATCTAATGGAATGGAATGGAATAATCCATGGA CCCGAA TG | 7146 |
| TEE-533 | AAATGAATCGAATGGAATTGAATGGAATCAAATAGAA CAAATGGAATCGAAATGAATCAAATGGAATCGAATCG AATGG AATTGAATGGCATGGAATTG | 7147 |
| TEE-534 | AGTTAATCCGAATAGAATGGAATGGAATGCAATGGAA CGGAATGGAACGAATGGAATGGAATGGAATGGAATG GAATG | 7148 |

TABLE 35-continued

TEE Sequences

| TEE Identifier | Sequence | SEQ ID NO |
|---|---|---|
| TEE-535 | ATCACAATCACACAACACATTGCACATGCATAACATGC ACTCACAATACACACAACACATACACAACACACAT GCAAT ACAACACAAAACGCAACACAACATATACACAACACAC AGCACACACATGCC | 7149 |
| TEE-536 | AAAGACTTAAACGTTAGACCTAAAACCATAAAAACCC TAGAGGAAAACCTAGGCATTACCATTCAGGACTTAGG CATGGG CAAGGAC | 7150 |
| TEE-537 | AAAGTCCAAAGATGAACAAAATATCCAGAAGGAAAAC AAATGCACTTGGGGAGTGGGAAAGAAAACCAAGACTG AGCAA TGCGTCAAGCTCAGACGTGCCTCACTACG | 7151 |
| TEE-538 | AAACGGAATCAAACGGAATTATCGAATGGAGTCGAAA AGAATCATCGAACGGACTCGAATGGAATCATCTAATG GAATG GAATGGAAGAATCCATGG | 7152 |
| TEE-539 | AATTGATTCGAAATTAATGGAATTGAATGGAATGCAAT CAAATGGAATGGAATGTAATGCAATGGAATGTAATAG AATGG AAAGCAATGGAATG | 7153 |
| TEE-540 | TACAGAACACATGACTCAACAACAGCAGAAAGCATAT TCTTTTCAAATGCACATGAAACATTATCATGATGGACC AAAT | 7154 |
| TEE-541 | GGAACAAAATGAAATCGAACGGTAGGAATCATACAGA ACAGAAAGAAATGGAACGGAATGGAATG | 7155 |
| TEE-542 | AACGGAAAAAACGGAATTATCGAATGGAATCGAAGAG AATCATCGAATGGAATCGAATGGAGTCATCG | 7156 |
| TEE-543 | AATCGAACGGAATCAACATCAAACGGAAAAAAACGGA ATTATCGAATGGAATCGAAGAGAATCATCGAATGGACC | 7157 |
| TEE-544 | AGAATGGAATGCAATAGAATGGAATGCAATGGAATGG AGTCATCCGTAATGGAATGGAAAGGAATGCAATGGAA TGGAA TGGAATGG | 7158 |
| TEE-545 | ATGGAATCAACATCAAACGAATCAAACGGAATTATC GAATGGAATCGAAGAGAATCATCGAACGGATTCGAAT GGAATC ATCTAATGGAATGGAATGGAAGAATCCATGGACTCGA ATGCAATCATCAGCGAATGGAATCGAATGGAATCATC GAATGG ACTCG | 7159 |
| TEE-546 | GGAATAAAACGGACTCAATAGTAATGGATTGCAATGT AATTGATTCGATTTCGAATGGAATCGCATGGAATGTAA TGGAA TGGAATGGAATGGAAGGC | 7160 |
| TEE-547 | AATGGAATCAACATCAAACGGAAAAAAACGGAATTAT CGTATGGAATCGAAAAGAATTATCGAATGGACC | 7161 |
| TEE-548 | TCAAACGGAAAAAAACGGAATTATCGAATGGAATCGA AGAGAATCATCGAATGGACC | 7162 |
| TEE-549 | ACATCAAACGGAATCAAACGGAATTATCGAATGGAAT CGAAAAGAATCATCGAACGGACTCGAATGGAATCATC TAATGG AATGGAATGGAAGAATCCATGGACTCGAATG | 7163 |
| TEE-550 | TGGAATCGAATGGAATCAACATCAAACGGAAAAAAAC GGAATTATCGAATGGAATCGAAGAGAATCATCGAATG GACC | 7164 |
| TEE-551 | AATGGAATCGAATGCAATCATCGAACGGAATCGAATG GCATCACCGAATGGAATGGAATGGAATGGAATGGAAT GG | 7165 |

TABLE 35-continued

TEE Sequences

| TEE Identifier | Sequence | SEQ ID NO |
| --- | --- | --- |
| TEE-552 | AGAATTGATTGAATCCAAGTGGAATTGAATGGAATGG<br>AATGGATTAGAAAGGAATGGAATGGATTGGAATGGAT<br>TGGAAT<br>GGAAAGG | 7166 |
| TEE-553 | AACTGCATCAACTAACAGGCAAAATAACCAGCTAATA<br>TCATAATGACAGGATTAAATTCACAAATGACAATATTA<br>ACCGT<br>AAATGTAAATGGGCTA | 7167 |
| TEE-554 | GTAAACAAACAATCAAGCAAGTAAGAACAGAAATAAC<br>AGCATTTGGCTTTTGAGTTAATGACAAGAACACTCGGC<br>ATGGG<br>AGCCTGGGTGAGCAAATCACAGATCTTC | 7168 |
| TEE-555 | AAAGGAATGGACTGGAACAAAATGAAATCGAACGGTA<br>GGAATCGTACAGAACGGACAGAAATGGAACGGCATGG<br>AATGC<br>ACTCG | 7169 |
| TEE-556 | GAATCAACCCGAGCGGAAAGGAATGGAATGGAATGGA<br>ATCAACACGAATGGAATGGAACGGAATGGAATGGGAT<br>GGGAT<br>GAAATGGAATGG | 7170 |
| TEE-557 | AAGAAATGGAATCGAAGAGAATGGAAACAAACGGAA<br>TGGAATTGAATGGAATGGAATTGAATGGAATGGGA | 7171 |
| TEE-558 | GACATGCAAACACAACACACAGCACACATGGAACATG<br>CATCAGACATGCAAACACAACACACATACCACACATG<br>GCATAT<br>GCATCAGACGTGCCTCACTAC | 7172 |
| TEE-559 | AAAGGAATGCACTCGAATGGAATGGACTTGAATGGAA<br>TGTCTCCGAATGGAACAGACTCGTATGAAATGGAATC<br>GAATGG<br>AATGGAATCAAATGGAATTGATTTGAGTGAAATGGAA<br>TCAAATGGAATGGCAACG | 7173 |
| TEE-560 | GGAACAAAATGAAATCGAACGGTAGGAATCGTACAGA<br>ACGGAAAGAAATGGAACGGAATGGAATGCACTCGAAT<br>GGAAA<br>GGAGTCCAAT | 7174 |
| TEE-561 | AAATTGATTGAAATCATCATAAAATGGAATCGAAGGG<br>AATCAACATCAAATGGAATCAAATGGAATCATTGAAC<br>GGAATT<br>GAATGGAATCGTCAT | 7175 |
| TEE-562 | AGAATGGAAAGCAATAGAATGGAACGCACTGGATTCG<br>AGTGCAATGGAATCAATTGGAATGGAATCGAATGGAA<br>TGGAT<br>TGGCA | 7176 |
| TEE-563 | AACACCAAACGGAAAAAAACGGAATTATCGAATGGAA<br>TCGAAGAGAATCTTCGAACGGACCCGAATGGGATCAT<br>CTAAT<br>GGAATGGAATGGAATAATCCATGG | 7177 |
| TEE-564 | AATGGAGACTAATGTAATAGAATCAAATGGAATGGCA<br>TCGAATGGAATGGACTGGAATGGAATGTGCATGAATG<br>GAATGG<br>AATCGAATGGATTG | 7178 |
| TEE-565 | AAATCGAATGGAACGCAATAGAATAGACTCGAATGTA<br>ATGGATTGCTATGTAATTGATTCGAATGGAATGGAATC<br>GACTG<br>GAATGCAATCCAATGGAATGGAATGCAATGCAATGGA<br>ATGGAATCGAACGGAATGCAGTGGAAGGGAATGG | 7179 |
| TEE-566 | AATCAACAAGGAACTGAAACAAGTAAACAAGAAAAC<br>AAATAACACCATAAAACATGGGCAAAGGACATAAACA<br>GACATT<br>TTTCAAAAAGACATACAAATGGCCGAG | 7180 |

TABLE 35-continued

TEE Sequences

| TEE Identifier | Sequence | SEQ ID NO |
|---|---|---|
| TEE-567 | AATGGAATCAACATCAAACGGAAAAAAACGGAATTAT CGAATGGAATCGAAGAGAATCATCGAATGGACCCAGG CTGGT CTTGAACTCC | 7181 |
| TEE-568 | ATTGAATGGGCTAGAATGGAATCATCTTTGAACGGAAT CAAAGGGAATCATCATCGAATGGAATCGAATGGAAAT GTCAA CG | 7182 |
| TEE-569 | AATGGACTCGAATGGAATCAACATCAAATGGAATCAA GCGGAATTATCGAATGAAATCGAAGAGAATCATCGAA TGGACT CGAAAGGAATCATCTAATGGAATGGAATGGAATAATC CATGGACTCGAATGCAATCATCATCG | 7183 |
| TEE-570 | AAACGGAAAAAAACGGAATTATTGAATGGAATCGAAG AGAATCTTCGAACGGACCCGAATGGAATCATCTAATG GAATG GAATGGAATAATCCATGG | 7184 |
| TEE-571 | ACTCGAGTGGAATTGACTGTAACAAAATGGAAAGTAA CGGATTGGAATCGAATGGAACGGAATGGAATGGAATG GACAT | 7185 |
| TEE-572 | TACAAACTTTAAAAAATGATCAACAGATACACAGTTA GCAAGAAAGAATTGAGGGCAAAGAATATGCCAGACAA ACTCA AGAGGAAGATGATGGTAGAGATAGGTCACATTGGAGT GTCA | 7186 |
| TEE-573 | AAATCAACAACAAACGGAAAAAAAAGGAATTATCGAA TGGAATCAAAGAGAATCATCGAATGGACC | 7187 |
| TEE-574 | AACGGAATCAAACGGAATTATCGAATGGAATCGAAAA GAATCATCGAACGGACTCGAATGGAATCATCTAATGT AATGGA ATGGAAGAATCCATGGACTCGAATG | 7188 |
| TEE-575 | AACGGAAAAAAACGGAATTATCGAATGGAATCGAAGA GAATCATCGAATGGACCAGAATGGAATCATCTAATGG AATGG AATGGAATAATCCATGGACTCGAATG | 7189 |
| TEE-576 | CAACATCAAACGGAAAAAAACGGAATTATGGAATGGA ATCGAAGAGAATCATCGAATGGACCCGAATGGAATCA TCTGA AATATAATAGACTCGAAAGGAATG | 7190 |
| TEE-577 | ATGGAATCGAATGGAATGGACTGGAATGGAATGGATT CGAATGGAATCGAATGGAACAATATGGAATGGTACCA AATG | 7191 |
| TEE-578 | GAATGGAATCAACATCAAACGGAAAAAAACGGAATTA TCGAATGGAATCGAAGAGAATCATCGAATGGACC | 7192 |
| TEE-579 | AAATGGACTCGAATGGAATCATCATAGAATGGAATCG AATGCAATGGAATGGAATCTTCCGGAATGGAATGGAA TGGAATGGAATGGAG | 7193 |
| TEE-580 | GAATCATCATAAAATGGAATCGAATGGAATCAACATC AAATGGAATCAAATGGAATCATTGAACGGAATTGAAT GGAATCGTCAT | 7194 |
| TEE-581 | ATCGAATGGAATCAACATCAAACGGAAAAAAACGGAA TTATCGAATGGAATCGAAGAGAATCATCGAATGGACC | 7195 |
| TEE-582 | AGCAACTTCAGCAAAGTCTCAGGATACAAAATCAATG TACAAAAATCACAAGCATTCTTATACACCAATAACAG ACAAACAGAGAGCCAAAA | 7196 |
| TEE-583 | AGAAACAGAAAACAGTCAAACCAATGGGCAATCCATA TCAGATGCAGTATTATGAACAGAAGTGTAAAGAATGC ACCAGGCACAATGGC | 7197 |

TABLE 35-continued

TEE Sequences

| TEE Identifier | Sequence | SEQ ID NO |
|---|---|---|
| TEE-584 | GATTGGAACGAAATCGAATGGAACGGAATAGAATAGA CTCGAATGTAATGGATTGCTATGTAATTGATTCGAATG GAATGGAATCGAATGGAATGCAATCCAATGGAATGGA ATGCAATGCAATGGAATGG | 7198 |
| TEE-585 | ATGGAATGGAATAATCAACGTACTCGAATGCAATCAT CATCGTATAGAATCGAATGGAATCATCGAATGGACTC GAATGGAATAATCATTGAACGGAGTCGAATGGAATCA TCATCGGATGGAAAC | 7199 |
| TEE-586 | AAAGAAATCGAATGGAATCAGTGTCGAATGGAATGGA ATGGAATCGAAGAATTGAATTGAGTAGAATCGAAGGG AATCATTGGATGGGCTCAAAT | 7200 |
| TEE-587 | AGAAAAGATAACTCGATTAACAAATGAACAAACACCT GAATACACAAGTCTCAAAAGAAGACATAAAAATGGCC AAC | 7201 |
| TEE-588 | ATGGAATCAACATCAAACGGAATCACACGGAATTATC GAATGGAATCGAAAAGAATCATCGAACGGACTCGAAT GGAATCATCTAATGGAATGGAATGGAAG | 7202 |
| TEE-589 | AATGGAATCAACATCAAACGGAATCAAGCGAAATTAT CGAATGGAATCGAAGAGAATCATCGAATGGACTCGAA TGGAATCATCTAATGGAATGGAATGGGAT | 7203 |
| TEE-590 | AAACACAGTACAAATACTAATTCAAATCAAACTTACTC AAAGTCTATAATCAAACATGCCAGACGGGCTGAGGGGC AGCATTA | 7204 |
| TEE-591 | GGAATCGAGTGGAATCATCGAAAGAAATCGAATGGAA TCATTGTCGAATGGAATGGAATGGAATCAAAGAATGG AATCGAAGGGAATCATTGGATGGGCT | 7205 |
| TEE-592 | AAAGAAAGACAGAGAACAAACGTAATTCAAGATGACT GTTTACATATCCAAGAACATTAGATGGTCAAAGACTTT AAGAAGGAATACATTCAAAGGCAAAAGTCACTTACT GATTTTGGTGGAGTTTGCCACATGGAC | 7206 |
| TEE-593 | GAAAGGAATCATCATTGAATGCAATCACATGGAATCA TCACAGAATGGAATCGTACGGAATCATCATCGAATGG AATTGAATGGAATCATCAATTGGACTCGAATGGAATC ATCAAATGGAATCGATTGGAAGTGTCAAATGGACTCG | 7207 |
| TEE-594 | CAATCAGAGCGGACACAAACAAATTGCATGGGAAGAA TCAATATCGTGAAAATGGCC | 7208 |
| TEE-595 | CAGCGCACCACAGCACACACAGTATACACATGACCCA CAATACACACAACACACAACACATTCACACACCAC | 7209 |
| TEE-596 | GCAAACAGAATTCAACACTACATTAGAACGATCATTC ATCACGACCTAGTAGGATGTTTTTCCTGGGATGCAAGG ATGGTTCAACAT | 7210 |
| TEE-597 | CAATCAAAACAGCAATGAGATACCATTTTACACCAATC AAAATGGCTACTAAAAAGTCAAAAGCAAATGCC | 7211 |
| TEE-598 | TGGAATAGAATGGAATCAATGTTAAGTGGAATCGAGT GGAATCATCGAAAGAAATCGAATGGAATCATTGTCGA ATGGTATGGAATGGAATCA | 7212 |
| TEE-599 | AATGGAATGGAATCATCGCATAGAATGGAATGGAATT ATCATCGAATTGAATCGAATGGTATCAACATCAAACG GAAAAAAACGGAAATATCGAATGGAATCGAAGAGAAT CATCGAACGGACC | 7213 |
| TEE-600 | GAAAACAAAACAAAACAAACAAACAAACAATCAAA AAAGTGGTAGCAGAAACCAGAAAGTCCATGTATATAG CTAATTGGCCTGGTTGT | 7214 |
| TEE-601 | AGACCTTTCTCAGAAGACACACAAATTGCCAACAGGT ATATGAAAAAATGTTCAATATCACTAATCATCAGGGCG ATGCC | 7215 |

TABLE 35-continued

TEE Sequences

| TEE Identifier | Sequence | SEQ ID NO |
|---|---|---|
| TEE-602 | CATGGAATCGAATGGAATTATCATCGAATGGAATCGA ATGGTACCAACACCAAACGGAAAAAAACGGAATTATC GAATGGAATCGAAGAGAATCTTCGAACGGACC | 7216 |
| TEE-603 | AGAGCAGAAACAAATGGAATTGAAATGAAGACAACA ATCAAAAGCATCAATGAAATGAAAAGTTGGGTTTTGG AAGAGAGAAACAAT | 7217 |
| TEE-604 | ACACAAACACACACACACACACACACACACACACACA CACACACACACACACACACACACACACACATAC | 7218 |
| TEE-605 | AACAAACAAATGAGATGATTTCAGATAGTGATAAACA CTATAACATAATTAATTCGTGCCAATCAGAGCATAACA GTGGTGTGGTGGCTGTGGAACAGATAGCAGAC | 7219 |
| TEE-606 | AATGGAATCGAGTGGAATGGAAGGCAATGGAATAGAA TGGAATGGAATCGAAAGGAACGGAATGGAATGGAATG GAATG | 7220 |
| TEE-607 | AGAAATGGAATCGGAGAGAATGGAAACAAATGGAAT GGAATTGAATGGAATGGAATTGAATGGAATGGGAACG | 7221 |
| TEE-608 | AAGAGAACTGCAAAACACTGCTCAAAGAAATCAGAGA TGACAAAAACACATGGAAAAACGTTTCATGCTCATGG ATTGGAAGACTTA | 7222 |
| TEE-609 | AATCAACACGAATAGAATGGAACGGAATGGAATGGAA TGGAATGGAATGGAATGGAGTGGAATGGAACAGAATG GAGTGGAAT | 7223 |
| TEE-610 | AACATCAAACGAAATCAAACGGAATTATCAAATTGAA TCGAAGAGAATCATCGAATTGCCACGAATGCAACCAT CTAATGGTATGGAATGGAATAATCCATGGACCCAGATG | 7224 |
| TEE-611 | CGGAATTATCATCGAATGTAATCGAATGGAATCAACAT CAAACGGAAAAAAACGGAATTATCGAATGGAATCGAA GAGAATCATCGAATGGACC | 7225 |
| TEE-612 | TGGACACACACGAACACACACCTACACACACGTGGAC ACACACGGACACATGGACACACACGAACACATGGACA CACACACGGGGACACACACACAGACACACACAGAGACAC ACACGGACACATGG | 7226 |
| TEE-613 | ATCAAACGGAATCAAACGGAATTATCGAATGGAATCG AAGAGAATCATCGAATGGACTCGAATGGAATCATCTA ATGGAATGGAATGGAAGAATCCATGG | 7227 |
| TEE-614 | AAATGGAATGGAATGCACTTGAAAGGAATAGACTGGA ACAAAATGAAATCGAACGGTAGGAATCATACAGAACA GAAAGAAATGGAACGGAATGGAATG | 7228 |
| TEE-615 | ACCACACACAAAATACACCACACACCCACACACACACC ACACACTATACACACACCACACACCACACAC | 7229 |
| TEE-616 | AAAGAAATAGAAGGGAGTTGAACAGAATCGAATGGA ATCGAATCAAATGGAATCGAATGGCATCAAATGGAAT CGAATGGAATGTGGTGAAGTGGATTGG | 7230 |
| TEE-617 | GGAATCATCATAAAATGGAATCGAATGGAATCATCAT CAAATGGAATCAAATGGAATCATTGAACGGAATTGAA TGGAATCGTCAT | 7231 |
| TEE-618 | AAAGATCAATGTACAAAAATCAGCAGCATTTCTATAA ACCAACAATGTCCAGGCTGAGAGAGAAATCAAGAAAA CAATTC | 7232 |
| TEE-619 | TGGAATGGAATGGAATGAAATAAACACGAATAGAATG GAACGGAATGGAACGGAATGGAATGGAATGGAATGG AAAG | 7233 |
| TEE-620 | TAATCAGCACAATCAACTGTAGTCACAAAACAAATAG TAACGCAATGATAAAGAAACAGAGAACTAGTTCAAAT AAACATGATAAGATGGGG | 7234 |

TABLE 35-continued

TEE Sequences

| TEE Identifier | Sequence | SEQ ID NO |
|---|---|---|
| TEE-621 | AAGCGGAATTATCAAATGGAATCGAAGAGAATGGAAA CAAATGGAATGGAATTGAATGGAATGGAATTGAATGG AATG | 7235 |
| TEE-622 | AATGGAATCAACATCAAACGGAAAAAAACGGAATTAT CGAATGGAATCGAAGAGAATCATCGAATGGACC | 7236 |
| TEE-623 | ACTTGAATCGAATGGAAAGGAATTTAATGAACTTAAA TCGAATGGAATATAATGGTATGGAATGGACTCATGGA ATGGAATGGAAAGGAATC | 7237 |
| TEE-624 | TGGAATCATCATCGAAAGCAAGCGAATGGAATCATCA AATGGAAACGAATGGAATCATCGAATGGACTCGGATG GAATTGTTGAATGGACT | 7238 |
| TEE-625 | TGGAATCAACATCAAACGGAAAAAAACGGAATTATCG AATGGAATCGAAGAGAATCATCGAATGGACC | 7239 |
| TEE-626 | TAAGTGAATTGAATAGAATCAATCTGAATGTAATGAA ATGGAATGGAACGGAATGGAATGGAATGGAATGGAAT GGAATGGAATGG | 7240 |
| TEE-627 | AGGAAAATTTAATCAGCAGGAATAGAAACACACTTGA GAAATCCATGTGGAATGAAAAGAGAATGGCTGAGCAG CAACAGATTGTCAAAAAGGAAATC | 7241 |
| TEE-628 | AACATCAAACGGAAAAAAAACGGAATTATCGAATGGA ATCGAAGAGAATCATCGAATGGACC | 7242 |
| TEE-629 | TAATTGAGAATAAGCATTCCAGTGGAAAAAAAACTAA ACAATTTGTTGTAAAACATCCTTAAAAGCATCAGAAAG TTAATACAGCAATGAAGAATTACAGGACCAAATTAAG AATGGTATGGAAGCCTGTTA | 7243 |
| TEE-630 | TATCATCGAATGGAATCGAATGGAATCAACATCAAAC GGAAAAAAACGGAATTATCGAATTGAATCGAAGAGAA TCATCGAATGGACC | 7244 |
| TEE-631 | AGCAAAACAAACACAATCTGTCGTTCATGGTACTACG ACATACTGGGAGAGATATTCAAATGATCACACAAAAC AACATG | 7245 |
| TEE-632 | AAGGATTCGAATGGAATGAAAAAGAATTGAATGGAAT AGAACAGAATGGAATCAAATCGAATGAAATGGAGTGG AATAGAAAGGAATGGAATG | 7246 |
| TEE-633 | AACGGAATCAAACGGAATTATCGAATGGAATCGAAGA GAATCATCGAACGGACTCGAATGGAATCATCTAATGG AATGGAAGAATCCATGGACTCGAATGCAATCA TCATCGAATGGAATCGAACGGAATCATCGAATGGCC | 7247 |
| TEE-634 | AATCAACTAGATGTCAATGGAATGCAATGGAATAGAA TGGAATGGAATTAACACGAATAGAATGGAATGGAATG GAATGGAATGG | 7248 |
| TEE-635 | AATGGACTCGAATGGAATAATCATTGAACGGAATCGA ATGGAATCATCATCGGATGGAAATGAATGGAATCATC ATCGCATGGAATCG | 7249 |
| TEE-636 | GAATGGAATGATACGGAATAGAATGGAATGGAACGAA ATGGAATTGAAAGGAAAGGAATGGAATGGAATGGAAT GG | 7250 |
| TEE-637 | AATCATCATCGAATGGAATCGAATGGTATCATTGAGTG GAATCGAATGGAATCATCATCAGATGGAAATGAATGG AATCGTCAT | 7251 |
| TEE-638 | GAATCAAATCAATGGAATCAAATCAAATGGAATGGAA TGGAATTGTATGGAATGGAATGGCATGG | 7252 |
| TEE-639 | TAATGCAGTCCAATAGAATGGAATCGAATGGCATGGA ATATAAAGAAATGGAATCGAAGAGAATGGGAACAAAT GGAATGGAATTGAGTGGAATGGAATTGAATGGAATGG GAACGAATGGAGTG | 7253 |

TABLE 35-continued

TEE Sequences

| TEE Identifier | Sequence | SEQ ID NO |
|---|---|---|
| TEE-640 | AACATCAAACGGAAAAAAACGGAATTATCGAATGGAA<br>TCGAAGAGAATCATCGAATGGACC | 7254 |
| TEE-641 | ATCAAAAGGAACGGAATGGAATGGAATGGAATGGAAT<br>GGAATGGAATGGAATGGAATGAAATCAACCCGAATGG<br>AATGGATTGGCATAGAGTGGAATGG | 7255 |
| TEE-642 | GCCAACAATCATATGAGAAAAAGCTCAACATCACTGA<br>TCATTTCAGGAATGCAAATCAAAACCACAATGAGATA<br>CTATCA | 7256 |
| TEE-643 | AATCAAATGGAATGAAATCGAATGGAATTGAATCGAA<br>TGGAATGCAATAGAATGTCTTCAAATGGAATCGAATG<br>GAAATTGGTGAAGTGGACGGGAGTG | 7257 |
| TEE-644 | TAATGGAATCAACATCAAACGGAAAAAAACGGAATTA<br>TCGAATGCAATCGAAGAGAATCATCGAATGGACC | 7258 |
| TEE-645 | AGCAACTTCAGCAAAGTCTCAGCATACAAAATCAATG<br>TGCAAAAATCACACGCATTCCTATACACCAATAACAG<br>ACAAACAGAGAGCC | 7259 |
| TEE-646 | GAATCAAATGGAATGGACTGTAATGGAATGGATTCGA<br>ATGGAATCGAATGGAGTGGACTCAAATGGAATG | 7260 |
| TEE-647 | AACAAGTGGACGAAGGATATGAACAGACACTTCTCAA<br>GACATTTATGCAGCCAACAGACACACGAAAAAATGCT<br>CATCATCACTGGCCATCAG | 7261 |
| TEE-648 | AAACGGAAAAAAACGGAATTATCGAATGGAATCGAAT<br>AGAATCATCGAATGGACC | 7262 |
| TEE-649 | TGGAACCGAACAAAGTCATCACCGAATGGAATTGAAA<br>TGAATCATAATCGAATGGAATCAAATGGCATCTTCGAA<br>TTGACTCGAATGCAATCATCCACTGGGCTT | 7263 |
| TEE-650 | AACGGAATCACGCGGAATTATCGAATGGAATCGAAGA<br>GAATCATCGAATGGACTCGAATGGAATCATCTAATGG<br>AATGGAATGG | 7264 |
| TEE-651 | GGAATCAACTCGATTGCAATGGAATGCAATGGAAAGG<br>AATGGAATGCAATTAAAGCGAATAGAATGGAATGGAA<br>TGGAATGGAACGGAATGGAATG | 7265 |
| TEE-652 | AAAACAAACAACAACGACAAATCATGAGACCAGAGTT<br>AAGAAACAATGAGACCAGGCTGGGTGTGGTG | 7266 |
| TEE-653 | AATCGAAAGGAATGCAATATTATTGAACAGAATCGAA<br>AAGAATGGAATCAAATGGAATGGAACAGAGTGGAATG<br>GACTGC | 7267 |
| TEE-654 | AAGGAATCGAATGGAAGTGAATGAAATTGAATCAACA<br>GGAATGGAAGGGAATAGAATAGACTGTAATGGAATGG<br>ACTCG | 7268 |
| TEE-655 | AACCCGAGTGCAATAGAATGGAATCGAATGGAATGGA<br>ATGGAATGGAATGGAATGGAGTC | 7269 |
| TEE-656 | GAATGGAATTGAAAGGAATGGAATGCAATGGAATGGA<br>ATGGGATGGAATGGAATGCAATGGAATCAACTCGATT<br>GCAATG | 7270 |
| TEE-657 | GAAAAAACGGAATTATCGAATTGAATCAAATAGAAT<br>CATCGAACGGACCAAAATGGAATCATCTAATGGAATG<br>GAATGGAATAATCCATGGACTCTAATG | 7271 |
| TEE-658 | TGGAATCATCTAATGGAATGGAATGGAATAATCCATG<br>GACTCGAATGCAATCATCATAAAATGGAATCGAATGG<br>AATCAACATCAAATGGAATCAAATGGGATCATTGAAC<br>GGAATTGAATGGAATCGTCAT | 7272 |
| TEE-659 | GAAAAAACGGAATTATCGAATTGAATCGAATAGAAT<br>CATCGAACGGACCAGAATGGAATCATCTAATGGAATG<br>GAATGGAATAATCCATGGACTCGAATG | 7273 |

TABLE 35-continued

TEE Sequences

| TEE Identifier | Sequence | SEQ ID NO |
|---|---|---|
| TEE-660 | AACCACTGCTTAAGGAAATAAGAGAGAACACAAACAA ATGGAAAAACGTTCCATGCTCATGGATAGGAGAATCA ATATCGTGAAAATGGCC | 7274 |
| TEE-661 | TATCGAATGGAATGGAAAGGAGTGGAGTAGACTCGAA TAGAATGGACTGGAATGAAATAGATTCGAATGGAATG GAATGGAATGAAGTGGACTCG | 7275 |
| TEE-662 | GTATCAACATCAAACGGAAAAAAACGGAATTATCGAA TGGAATCATCTAATGGAATGGAATGGAATAATCCATG GACTCGAATG | 7276 |
| TEE-663 | TAAATGGAGACATCATTGAATACAATTGAATGGAATC ATCACATGGAATCGAATGGAATCATCGTAAATGCAAT CAAGTGGAATCAT | 7277 |
| TEE-664 | GAATGGAATTGAAAGGTATCAACACCAAACGGAAAAA AAACGGAATTATCGAATGGAATCGAAGAGAATCATC GAACGGACC | 7278 |
| TEE-665 | AGCAATTTCAGCAAAGTCTCAGGATACAAAATCAATG TACAAATTCACAAGCATTCTTATGGACCAACAACAG | 7279 |
| TEE-666 | GGAATCGAATGGCATCAACATCAAACGGAAAAAAACG GAATTATCGAATGGAATCGAATGGAATCATC | 7280 |
| TEE-667 | AAACAAAACACAGAAATGCAAAGACAAAACATAAAA CGCAGCCATAAAGGACATATTTTAGATAACTGGGGAA ATTTGTATGGGCTGTGT | 7281 |
| TEE-668 | AATGGAATCAACATCAAACGGAATCAAACGGAATTAT CGAATGGAATCGAAGAGAATCATCGAACGGACTCGAA TGGAATCATCTAATGGAATGGAATGGAAG | 7282 |
| TEE-669 | AATCGAATGGAATCAGCATCAAACGGAAAAAAACGGA ATTATCGAATGGAATCGAAGAGAATCATCGAATGGACC | 7283 |
| TEE-670 | AAACGGAATTATAGAATGGACTGGAAGAGAATCATCG AACGGACTAGAATGGAATCATCTAATCGAATGGAATG GAACAATCCATGGTCTAGCA | 7284 |
| TEE-671 | TGAACAGAGAATTGGACAAAACGCACAAAGTAAAGAA AAAGAATGAAGCAACAAAAGCAGAGATTTATTGAAAA CAAAAGTACACACCACAGGGTGGGAGTGG | 7285 |
| TEE-672 | ATCATAACGACAAGAACAAATTCACACACAACAATAT TAACTTCAAATCCAAATGGGTTAAATGCTCCAATTAAA GGATGCAGACGGGCAAATTGGATA | 7286 |
| TEE-673 | ATCATAACGACAAGAACAAATTCACACACAACAATAT TCACTTCAAATCCAAATGGGTTAAATGCTCCAATTAAA GGATGCAGACGGGCAAATTGGATA | 7287 |
| TEE-674 | GAATGGAATCGAATGGATTGATATCAACTGGAATGGA ATGGAAGGGAATGGAATGGAATGGAATTGAACCAAAT GTAATGACTTGAATGGAATG | 7288 |
| TEE-675 | GAATCAACATCAAACGGAAAAAAACGGAATTATCGAA TGGAATCGAAGAGAATCATCGAATGGACC | 7289 |
| TEE-676 | GGAATCAACATCAAACGGAAAAAAACGGAATTATCGA ATGGAATCGAAGAGAATCATCGAATGGACC | 7290 |
| TEE-677 | ATGGAATCAACATCAAACGGAATCAAACGGAATTATC GAATGGAATCAAAGAGAATCATCGAACGGACTCGAAT GGAATCATCTAATGGAATGGAATGGAAGAATCCATGG ACTCGAATGCAATCATCATCGAAT | 7291 |
| TEE-678 | GGAATGGAATGGAATGGAGCCGAATGGAATGGAATGT ACTCAAATGGAATGC | 7292 |

TABLE 35-continued

TEE Sequences

| TEE Identifier | Sequence | SEQ ID NO |
|---|---|---|
| TEE-679 | AAAACACCTAGGAATACAGATAACAAGGGACATTAAC TACCTCTTAAAGAGAACTACAAACCACTGCTCAAGGA AATGAGAGAGGACACAAACACATGGAAAAACATTCCA TCCTCATGGATAGGAAGAATCAATATTGTGAAAATGG CC | 7293 |
| TEE-680 | AACACGACTTTGAGAAGAGTAAGTGATTGTTAATTAA AGCAAGAGAATTATTGATGTATCACAGTCATGAGAAA TATTGGAAGGAATATGGTCCATAC | 7294 |
| TEE-681 | ACACATATCAAACAAACAAAAGCAATTGACTATCTAG AAATGTCTGGGAAATGGCAAGATATTACA | 7295 |
| TEE-682 | GGAATCATCATATAATGGAATCGAATGGAATCAACAT CAAATGGAATCAAATGGAATCATTGAACGGAATTGAA TGGAATCGTCAT | 7296 |
| TEE-683 | AATGGAATCAACATCAAACGGAATCAAATGGAATTAT CGAATGGAATCGAAGAGAATCATCGAATTGTCACGAA TGGAATCATCTAATGGAATGGAATGGAATAATCCATG GCCCCTATGCAATGGACTCGAATGAAATCATCATCAAA CAGAATCGAATGGAATCATCTAATGGAATGGAATGGC ATAATCCATGGACTCGAATG | 7297 |
| TEE-684 | TAAAATGAAACAAATATACAACACGAAGGTTATCACC AGAAATATGCCAAAACTTAAATATGAGAATAAGACAG TCTCAGGGGCCACAGAG | 7298 |
| TEE-685 | AAAATACAGCGTTATGAAAAGAATGAACACACACACA CACACACACACACAGAAAATGT | 7299 |
| TEE-686 | CAAACAAATAGGTACCAAACAAATAACAACATAAACC TGACAACACACTTATTTACAAGAGACATCCCTTATATG AAAGGGTACAGAAAAGTCGATGGTAAGATGATGGGGA AAGGTATACCAACCACTAGCAGAAGG | 7300 |
| TEE-687 | TGGAATCGAATGGAATCAATATCAAACGGAAAAAAAC GGAATTATCGAATGGAATCGAAAAGAATCATCGAATG GGCCCGAATGGAATCATCT | 7301 |
| TEE-688 | ACAAATGGAATCAACAACGAATGGAATCGAATGGAAA CGCCATCGAAAGGAAACGAATGGAATTATCATGAAAT TGAAATGGATG | 7302 |
| TEE-689 | AATCAATAAATGTAAACCAGCATATAAACAGAACCAA CGACAAAAACCACATGATTATCTCAATAGATGCAGAA AAGGCC | 7303 |
| TEE-690 | AAAATAAACGCAAATTAAAATCACAAGATACCAACAC ATTCCCACGGCTAAGTACGAAGAACAAGGGCGAATGG TCAGAATTAAGCTCAAACCT | 7304 |
| TEE-691 | CAACATCAAACGGAATCAAACGGAATTATCGAATGGA ATCGAAGAGAATCATCGAATGGACTCGAATGGAATCA TCTAATGGAATGGAATGGAAG | 7305 |
| TEE-692 | ACATCAAACGGAAAAAAACGGAATTATCGAATGGAAT CGAAGAGAATCATCGAATGGACC | 7306 |
| TEE-693 | AATGGACTCGAATAGAATTGACTGGAATGGAATGGAC TCGAATGGAATGGAATGGAATGGAAGGGACTCG | 7307 |
| TEE-694 | AAGAAAGACAGAGAACAAACGTAATTCAAGATGACTG ATTACATATCCAAGAACATTAGATGGTCAAAGACTTTA AGAAGGAATACATTCAAAGGCAAAACGTCACTTACTG ATTTTGGTGGAGTTTGCCACATGGAC | 7308 |
| TEE-695 | GAATGGAATCGAATGGAATGAACATCAAACGGAAAAA AACGGAATTATCGAATGGAATCAAAGAGAATCATCGA ATGGACCCG | 7309 |
| TEE-696 | ATGGACTCGAATGTAATAATCATTGAACGGAATCGAA TGGAATCATCATCGGATGGAAACGAATGGAATCATCA TCGAATGGAATCGAATGGGATC | 7310 |

TABLE 35-continued

TEE Sequences

| TEE Identifier | Sequence | SEQ ID NO |
|---|---|---|
| TEE-697 | GAAATGGAATGGAAAGGAATAAAATCAAGTGAAATTG GATGGAATGGATTGGAATGGATTGGAATG | 7311 |
| TEE-698 | AAACGGAAAAAAAACGGAATTATCGAATGGAATCGAA GAGAATCATCGAACGAACCAGAATGGAATCATCTAAT GGAATGGAATGGAATAATCCATGG | 7312 |
| TEE-699 | ATTAACCCGAATAGAATGGAATGGAATGGAATGGAAC GGAACGGAATGGAATGGAATGGAATGGAATGGAATGG ATCG | 7313 |
| TEE-700 | AACATCAAACGGAAAAAAACGGAATTATCGTATGGAA TCGAAGAGAATCATCGAATGGACC | 7314 |
| TEE-701 | GAATAGAATTGAATCATCATTGAATGGAATCGAGTAG AATCATTGAAATCGAATGGAATCATCATCGAATGGAA TTGGGTGGAATC | 7315 |
| TEE-702 | CACCGAATAGAATCGAATGGAACAATCATCGAATGGA CTCAAATGGAATTATCCTCAAATGGAATCGAATGGAAT TATCG | 7316 |
| TEE-703 | AATGCAATCGAATAGAATCATCGAATAGACTCGAATG GAATCATCGAATGGAATGGAATGGAACAGTC | 7317 |
| TEE-704 | AAATCATCATCGAATGGAATCGAATGGTATCATTGAAT GGAATCGAATGGAATCATCATCAGATGGAAATGAATG GAATCGTCAT | 7318 |
| TEE-705 | GAATGGAATCGAAAGGAATAGAATGGAATGGATCGTT ATGGAAAGACATCGAATGGAATGGAATTGACTCGAAT GGAATGGACTGGAATGGAACG | 7319 |

Example 46. In Vitro Expression of Modified Nucleic Acids with miR-122

MicroRNA controls gene expression through the translational suppression and/or degradation of target messenger RNA. The expression of G-CSF mRNA and Factor 1x mRNA with human or mouse alpha-globin 3' untranslated regions (UTRs) were down regulated in human primary hepatocytes using miR-122 sequences in the 3'UTR.

Primary human hepatocytes were seeded at a density of 350000 per well in 500 ul cell culture medium (InVitro GRO medium from Celsis, Chicago, Ill.).

G-CSF mRNA having a human alpha-globin 3'UTR (G-CSF Hs3'UTR; mRNA sequence shown in SEQ ID NO: 7320; polyA tail of approximately 140 nucleotides not shown in sequence; 5' cap, Cap1) or a mouse alpha-globin 3'UTR (G-CSF Mm3'UTR; mRNA sequence shown in SEQ ID NO: 7321; polyA tail of approximately 140 nucleotides not shown in sequence; 5' cap, Cap1) were fully modified with 5-methylcytidine and 1-methylpseudouridine. G-CSF mRNA containing a human 3'UTR having a miR-122 sequence in the 3'UTR (G-CSF Hs3'UTR miR-122; mRNA sequence shown in SEQ ID NO: 7322; polyA tail of approximately 140 nucleotides not shown in sequence; 5' cap, Cap1), or a miR-122 seed sequence in the 3'UTR (G-CSF Hs3'UTR miR-122 seed; mRNA sequence shown in SEQ ID NO: 7323; polyA tail of approximately 140 nucleotides not shown in sequence; 5' cap, Cap1) or a miR-122 sequence without the seed sequence in the 3'UTR (G-CSF Hs3'UTR miR-122 seedless; mRNA sequence shown in SEQ ID NO: 7324; polyA tail of approximately 140 nucleotides not shown in sequence; 5' cap, Cap1) were fully modified with 5-methylcytidine and 1-methylpseudouridine. G-CSF mRNA containing a mouse 3'UTR having a miR-122 sequence in the 3'UTR (G-CSF Mm3'UTR miR-122; mRNA sequence shown in SEQ ID NO: 7325; polyA tail of approximately 140 nucleotides not shown in sequence; 5' cap, Cap1), or a miR-122 seed sequence in the 3'UTR (G-CSF Mm3'UTR miR-122 seed; mRNA sequence shown in SEQ ID NO: 7326; polyA tail of approximately 140 nucleotides not shown in sequence; 5' cap, Cap1) or a miR-122 sequence without the seed sequence in the 3'UTR (G-CSF Mm3'UTR miR-122 seedless; mRNA sequence shown in SEQ ID NO: 7327; polyA tail of approximately 140 nucleotides not shown in sequence; 5' cap, Cap1) were fully modified with 5-methylcytidine and 1-methylpseudouridine.

Factor 1x mRNA having a human alpha-globin 3'UTR (Factor 1x Hs3'UTR; mRNA sequence shown in SEQ ID NO: 7328; polyA tail of approximately 140 nucleotides not shown in sequence; 5' cap, Cap1) or a mouse alpha-globin 3'UTR (Factor IX Mm3'UTR; mRNA sequence shown in SEQ ID NO: 7329; polyA tail of approximately 140 nucleotides not shown in sequence; 5' cap, Cap1) were fully modified with 5-methylcytidine and 1-methylpseudouridine. Factor 1x mRNA containing a human 3'UTR having a miR-122 sequence in the 3'UTR (Factor 1x Hs3'UTR miR-122; mRNA sequence shown in SEQ ID NO: 7330; polyA tail of approximately 140 nucleotides not shown in sequence; 5' cap, Cap 1), or a miR-122 seed sequence in the 3'UTR (Factor IX Hs3'UTR miR-122 seed; mRNA sequence shown in SEQ ID NO: 7331; polyA tail of approximately 140 nucleotides not shown in sequence; 5' cap, Cap1) or a miR-122 sequence without the seed sequence in the 3'UTR (Factor 1x Hs3'UTR miR-122 seedless; mRNA sequence shown in SEQ ID NO: 7332; polyA tail of approximately 140 nucleotides not shown in sequence; 5' cap, Cap1) were fully modified with 5-methylcytidine and 1-methylpseudouridine. Factor 1× mRNA containing a mouse 3'UTR having a miR-122 sequence in the 3'UTR (Factor 1× Mm3'UTR miR-122; mRNA sequence shown in SEQ ID NO: 7333; polyA tail of approximately 140 nucleotides not shown in sequence; 5' cap, Cap1), or a miR-122 seed sequence in the 3'UTR (Factor 1× Mm3'UTR miR-122 seed; mRNA sequence shown in SEQ ID NO: 7334; polyA tail of approximately 140 nucleotides not shown in sequence; 5' cap, Cap1) or a miR-122 sequence without the seed sequence in the 3'UTR (Factor 1× Mm3'UTR miR-122 seedless; mRNA sequence shown in SEQ ID NO: 7335; polyA tail of approximately 140 nucleotides not shown in sequence; 5' cap, Cap 1) were fully modified with 5-methylcytidine and 1-methylpseudouridine.

Each G-CSF or Factor 1× mRNA sequence was tested at a concentration of 500 ng per well in 24 well plates. 24, 48 and 72 hours after transfection, the expression of protein was measured by ELISA. The protein levels for G-CSF are shown in Table 36 and the protein levels for Factor 1× are shown in Table 37.

TABLE 36

G-CSF Protein Expression

| Description | Protein Expression (ng/ml) | | |
|---|---|---|---|
| | 24 Hours | 48 Hours | 72 Hours |
| G-CSF Hs3'UTR | 43.9 | 18.8 | 5.7 |
| G-CSF Hs3'UTR miR-122 | 6.9 | 0.7 | 0.12 |
| G-CSF Hs3'UTR miR-122 seed | 48.5 | 25.6 | 8.2 |
| G-CSF Hs3'UTR miR-122 seedless | 31.7 | 11.7 | 3.4 |
| G-CSF Mm3'UTR | 84.9 | 100.4 | 21.3 |
| G-CSF Mm3'UTR miR-122 | 24.0 | 3.03 | 0.8 |
| G-CSF Mm3'UTR miR-122 seed | 115.8 | 96.4 | 19.2 |
| G-CSF Mm3'UTR miR-122 seedless | 113.1 | 92.9 | 18.9 |

TABLE 37

Factor IX Protein Expression

| Description | Protein Expression (ng/ml) | | |
|---|---|---|---|
| | 24 Hours | 48 Hours | 72 Hours |
| G-CSF Hs3'UTR | 43.9 | 18.8 | 5.7 |
| G-CSF Hs3'UTR miR-122 | 6.9 | 0.7 | 0.12 |
| G-CSF Hs3'UTR miR-122 seed | 48.5 | 25.6 | 8.2 |
| G-CSF Hs3'UTR miR-122 seedless | 31.7 | 11.7 | 3.4 |
| G-CSF Mm3'UTR | 84.9 | 100.4 | 21.3 |
| G-CSF Mm3'UTR miR-122 | 24.0 | 3.03 | 0.8 |
| G-CSF Mm3'UTR miR-122 seed | 115.8 | 96.4 | 19.2 |
| G-CSF Mm3'UTR miR-122 seedless | 113.1 | 92.9 | 18.9 |

Example 47. In Vitro Expression of Modified Nucleic Acid with Mir-142 or miR-146 Binding Sites HeLa and RAW264 cells were seeded at a density of 17000 and 80000 per well respectively, in 100 ul cell culture medium (DMEM+10% FBS).

G-CSF mRNA (G-CSF; mRNA sequence shown in SEQ ID NO: 6595; polyA tail of approximately 140 nucleotides not shown in sequence; 5' cap, Cap1) was fully modified with 5-methylcytidine and 1-methylpseudouridine.

G-CSF mRNA having a miR-142-3p sequence in the 3'UTR (G-CSF miR-142-3p; mRNA sequence shown in SEQ ID NO: 6634; polyA tail of approximately 140 nucleotides not shown in sequence; 5' cap, Cap1), or a miR-142-3p seed sequence in the 3'UTR (G-CSF miR-142-3p seed; mRNA sequence shown in SEQ ID NO: 6636; polyA tail of approximately 140 nucleotides not shown in sequence; 5' cap, Cap1) or a miR-142-3p sequence without the seed sequence in the 3'UTR (G-CSF miR-142-3p seedless; mRNA sequence shown in SEQ ID NO: 6638; polyA tail of approximately 140 nucleotides not shown in sequence; 5' cap, Cap1) were fully modified with 5-methylcytidine and 1-methylpseudouridine.

G-CSF mRNA having a miR-142-5p sequence in the 3'UTR (G-CSF miR-142-5p; mRNA sequence shown in SEQ ID NO: 6628; polyA tail of approximately 140 nucleotides not shown in sequence; 5' cap, Cap1), or a miR-142-5p seed sequence in the 3'UTR (G-CSF miR-142-5p seed; mRNA sequence shown in SEQ ID NO: 6630; polyA tail of approximately 140 nucleotides not shown in sequence; 5' cap, Cap1) or a miR-142-5p sequence without the seed sequence in the 3'UTR (G-CSF miR-142-5p seedless; mRNA sequence shown in SEQ ID NO: 6632; polyA tail of approximately 140 nucleotides not shown in sequence; 5' cap, Cap1) were fully modified with 5-methylcytidine and 1-methylpseudouridine.

G-CSF mRNA having a miR-146a sequence in the 3'UTR (G-CSF miR-146a; mRNA sequence shown in SEQ ID NO: 6640; polyA tail of approximately 140 nucleotides not shown in sequence; 5' cap, Cap1), or a miR-146a seed sequence in the 3'UTR (G-CSF miR-146a seed; mRNA sequence shown in SEQ ID NO: 6642; polyA tail of approximately 140 nucleotides not shown in sequence; 5' cap, Cap1) or a miR-146a sequence without the seed sequence in the 3'UTR (G-CSF miR-146a seedless; mRNA sequence shown in SEQ ID NO: 6644; polyA tail of approximately 140 nucleotides not shown in sequence; 5' cap, Cap1) were fully modified with 5-methylcytidine and 1-methylpseudouridine.

Each G-CSF mRNA sequence was tested at a concentration of 500 ng per well in 24 well plates for each cell type. 24 hours after transfection, the expression of protein was measured by ELISA and the protein levels are shown in Table 38. The G-CSF sequences with a miR-142-3p sequence in the 3'UTR down regulated G-CSF expression in RAW264 cells whereas the G-CSF sequences with a miR-142-5p or miR-146a sequence in the 3'UTR did not down regulate G-CSF expression.

TABLE 38

G-CSF Expression

| Description | HeLa Cells Protein Expression (ng/ml) | RAW264 Cells Protein Expression (ng/ml) |
|---|---|---|
| G-CSF | 243.5 | 173.7 |
| G-CSF miR-142-3p | 309.1 | 67.6 |
| G-CSF miR-142-3p seed | 259.8 | 178.1 |
| G-CSF miR-142-3p seedless | 321.7 | 220.2 |
| G-CSF miR-142-5p | 291.8 | 223.3 |
| G-CSF miR-142-5p seed | 261.3 | 233.1 |
| G-CSF miR-142-5p seedless | 330.2 | 255.1 |
| G-CSF miR-146a | 272.6 | 125.2 |
| G-CSF miR-146a seed | 219.4 | 138.3 |
| G-CSF miR-146a seedless | 217.7 | 132.8 |

Example 48. Effect of Kozak Sequence on Expression of Modified Nucleic Acids

HeLa cells were seeded at a density of 17000 per well in 100 ul cell culture medium (DMEM+10% FBS). G-CSF mRNA having an IRES sequence and Kozak sequence (G-CSF IRES Kozak; mRNA sequence shown in SEQ ID NO: 7336; polyA tail of approximately 140 nucleotides not shown in sequence; 5' cap, Cap1), G-CSF mRNA having an IRES sequence but not a Kozak sequence (G-CSF IRES; mRNA sequence shown in SEQ ID NO: 7337; polyA tail of approximately 140 nucleotides not shown in sequence; 5' cap, Cap1), G-CSF mRNA without an IRES or Kozak sequence (GCSF no Kozak; mRNA sequence shown in SEQ ID NO: 7338; polyA tail of approximately 140 nucleotides not shown in sequence; 5' cap, Cap1) or a G-CSF sequence having a Kozak sequence (G-CSF Kozak; mRNA sequence shown in SEQ ID NO: 7339; polyA tail of approximately 140 nucleotides not shown in sequence; 5' cap, Cap1) were fully modified with fully modified with 5-methylcytidine and 1-methylpseudouridine and tested at a concentration of 75 ng per well in 24 well plates. 24 hours after transfection, the expression of G-CSF was measured by ELISA, and the results are shown in Table 39.

TABLE 39

G-CSF expression

| Description | Protein Expression (ng/ml) |
| --- | --- |
| G-CSF IRES Kozak | 2.01 |
| G-CSF IRES | 1.64 |
| G-CSF no Kozak | 795.53 |
| G-CSF Kozak | 606.28 |

Example 49. MALAT1 Constructs

Modified mRNA encoding G-CSF or mCherry with a human or mouse MALAT1 sequence and their corresponding cDNA sequences are shown below in Table 40. In Table 40, the start codon of each sequence is underlined and the MALAT1 sequences are bolded.

TABLE 40

MALAT1 Constructs

| | Sequence | SEQ ID NO: |
| --- | --- | --- |
| G-CSF with Mouse MALAT1 sequence | Optimized G-CSF cDNA sequence containing a T7 polymerase site, kozak sequence, and a Mouse MALAT1 sequence (bold): TAATACGACTCACTATA GGGAAATAAGAGAGAAAAGAAGAGTAAGAAGAAATA TAAGAGCCACC ATGGCCGGTCCCGCGACCCAAAGCCCCATGAAACTTA TGGCCCTGCAGTTGCTGCTTTGGCACTCGGCCCTCTGG ACAGTCCAAGAAGCGACTCCTCTCGGACCTGCCTCAT CGTTGCCGCAGTCATTCCTTTTGAAGTGTCTGGAGCAG GTGCGAAAGATTCAGGGCGATGGAGCCGCACTCCAAG AGAAGCTCTGCGCGACATACAAACTTTGCCATCCCGA GGAGCTCGTACTGCTCGGGCACAGCTTGGGGATTCCC TGGGCTCCTCTCTCGTCCTGTCCGTCGCAGGCTTTGCA GTTGGCAGGGTGCCTTTCCCAGCTCCACTCCGGTTTGT TCTTGTATCAGGGACTGCTGCAAGCCCTTGAGGGAAT CTCGCCAGAATTGGGCCCGACGCTGGACACGTTGCAG CTCGACGTGGCGGATTTCGCAACAACCATCTGGCAGC AGATGGAGGAACTGGGGATGGCACCCGCGCTGCAGCC CACGCAGGGGGCAATGCCGGCCTTTGCGTCCGCGTTT CAGCGCAGGGCGGGTGGAGTCCTCGTAGCGAGCCACC TTCAATCATTTTTGGAAGTCTCGTACCGGGTGCTGAGA CATCTTGCGCAGCCG TGATAATAG GATTCGTCAGTAGGGTTGTAAAGGTTTTTCTTTTCC TGAGAAAACAACCTTTTGTTTTCTCAGGTTTTGCTT TTTGGCCTTTCCCTAGCTTTAAAAAAAAAAAAGCAA AAGTGGTCTTTGAATAAAGTCTGAGTGGGCGGCTCTA GA | 7340 |
| | mRNA sequence (transcribed): GGGAAAUAAGAGAGAAAAGAAGAGUAAGAAGAAAU AUAAGAGCCACC AUGGCCGGUCCCGCGACCCAAAGCCCCAUGAAACUU AUGGCCCUGCAGUUGCUGCUUUGGCACUCGGCCCUC UGGACAGUCCAAGAAGCGACUCCUCUCGGACCUGCC UCAUCGUUGCCGCAGUCAUUCCUUUUGAAGUGUCUG GAGCAGGUGCGAAAGAUUCAGGGCGAUGGAGCCGCA CUCCAAGAGAAGCUCUGCGCGACAUACAAACUUUGC CAUCCCGAGGAGCUCGUACUGCUCGGGCACAGCUUG GGGAUUCCCUGGGCUCCUCUCUCGUCCUGUCCGUCG CAGGCUUUGCAGUUGGCAGGGUGCCUUUCCCAGCUC CACUCCGGUUUGUUCUUGUAUCAGGGACUGCUGCAA GCCCUUGAGGGAAUCUCGCCAGAAUUGGGCCCGACG CUGGACACGUUGCAGCUCGACGUGGCGGAUUUCGCA ACAACCAUCUGGCAGCAGAUGGAGGAACUGGGGAUG GCACCCGCGCUGCAGCCCACGCAGGGGGCAAUGCCG GCCUUUGCGUCCGCGUUUCAGCGCAGGGCGGGUGGA GUCCUCGUAGCGAGCCACCUUCAAUCAUUUUUGGAA GUCUCGUACCGGGUGCUGAGACAUCUUGCGCAGCCG UGAUAAUAG | 7341 |

TABLE 40-continued

MALAT1 Constructs

| | Sequence | SEQ ID NO: |
|---|---|---|
| | GAUUCGUCAGUAGGGUUGUAAAGGUUUUUCUUUU CCUGAGAAAACAACCUUUUGUUUUCUCAGGUUUUG CUUUUUGGCCUUUCCCUAGCUUUAAAAAAAAAAA GCAAAAGUGGUCUUUGAAUAAAGUCUGAGUGGGCG GC | |
| mCherry with Mouse MALAT1 sequence | Optimized mCherry cDNA sequence containing a T7 polymerase site, kozak sequence, and a Mouse MALAT1 sequence (bold): TAATACGACTCACTATA GGGAAATAAGAGAGAAAAGAAGAGTAAGAAGAAATA TAAGAGCCACC ATGGTATCCAAGGGGGAGGAGGACAACATGGCGATC ATCAAGGAGTTCATGCGATTCAAGGTGCACATGGAAG GTTCGGTCAACGGACACGAATTTGAAATCGAAGGAGA GGGTGAAGGAAGGCCCTATGAAGGGACACAGACCGC GAAACTCAAGGTCACGAAAGGGGACCACTTCCTTTC GCCTGGGACATTCTTTCGCCCCAGTTTATGTACGGGTC CAAAGCATATGTGAAGCATCCCGCCGATATTCCTGAC TATCTGAAACTCAGCTTTCCCGAGGGATTCAAGTGGG AGCGGGTCATGAACTTTGAGGACGGGGGTGTAGTCAC CGTAACCCAAGACTCAAGCCTCCAAGACGGCGAGTTC ATCTACAAGGTCAAACTGCGGGGACTAACTTTCCGT CGGATGGGCCGGTGATGCAGAAGAAAACGATGGGAT GGGAAGCGTCATCGGAGAGGATGTACCCAGAAGATG GTGCATTGAAGGGGGAGATCAAGCAGAGACTGAAGTT GAAAGATGGGGACATTATGATGCCGAGGTGAAAAC GACATACAAAGCGAAAAAGCCGGTGCAGCTTCCCGGA GCGTATAATGTGAATATCAAGTTGGATATTACTTCACA CAATGAGGACTACACAATTGTCGAACAGTACGAACGC GCTGAGGGTAGACACTCGACGGGAGGCATGGACGAG TTGTACAAA TGATAATAG GATTCGTCAGTAGGGTTGTAAAGGTTTTTCTTTTCC TGAGAAAACAACCTTTTGTTTTCTCAGGTTTTGCTT TTTGGCCTTTCCCTAGCTTTAAAAAAAAAAAGCAA AAGTGGTCTTTGAATAAAGTCTGAGTGGGCGGCTCTA GA | 7342 |
| | mRNA sequence (transcribed): GGGAAAUAAGAGAGAAAAGAAGAGUAAGAAGAAAU AUAAGAGCCACC AUGGUAUCCAAGGGGGAGGAGGACAACAUGGCGAUC AUCAAGGAGUUCAUGCGAUUCAAGGUGCACAUGGAA GGUUCGGUCAACGGACACGAAUUUGAAAUCGAAGGA GAGGGUGAAGGAAGGCCCUAUGAAGGGACACAGACC GCGAAACUCAAGGUCACGAAAGGGGACCACUUCCU UUCGCCUGGGACAUUCUUUCGCCCCAGUUUAUGUAC GGGUCCAAAGCAUAUGUGAAGCAUCCCGCCGAUAUU CCUGACUAUCUGAAACUCAGCUUUCCCGAGGGAUUC AAGUGGGAGCGGGUCAUGAACUUUGAGGACGGGGG UGUAGUCACCGUAACCCAAGACUCAAGCCUCCAAGA CGGCGAGUUCAUCUACAAGGUCAAACUGCGGGGGAC UAACUUUCCGUCGGAUGGGCCGGUGAUGCAGAAGAA AACGAUGGGAUGGGAAGCGUCAUCGGAGAGGAUGU ACCCAGAAGAUGGUGCAUUGAAGGGGGAGAUCAAGC AGAGACUGAAGUUGAAAGAUGGGGACAUUAUGAU GCCGAGGUGAAAACGACAUACAAAGCGAAAAAGCCG GUGCAGCUUCCCGGAGCGUAUAAUGUGAAUAUCAAG UUGGAUAUUACUUCACACAAUGAGGACUACACAAUU GUCGAACAGUACGAACGCGCUGAGGGUAGACACUCG ACGGGAGGCAUGGACGAGUUGUACAAA UGAUAAUAG GAUUCGUCAGUAGGGUUGUAAAGGUUUUUCUUUU CCUGAGAAAACAACCUUUUGUUUUCUCAGGUUUUG CUUUUUGGCCUUUCCCUAGCUUUAAAAAAAAAAA GCAAAAGUGGUCUUUGAAUAAAGUCUGAGUGGGCG GC | 7343 |
| G-CSF with Human MALAT1 sequence | Optimized G-CSF cDNA sequence containing a T7 polymerase site, kozak sequence, and a Human MALAT1 sequence (bold): TAATACGACTCACTATA GGGAAATAAGAGAGAAAAGAAGAGTAAGAAGAAATA TAAGAGCCACC ATGGCCGGTCCCGCGACCCAAAGCCCCATGAAACTTA TGGCCCTGCAGTTGCTGCTTTGGCACTCGGCCCTCTGG | 7344 |

TABLE 40-continued

MALAT1 Constructs

| Sequence | SEQ ID NO: |
|---|---|
| ACAGTCCAAGAAGCGACTCCTCTCGGACCTGCCTCAT CGTTGCCGCAGTCATTCCTTTTGAAGTGTCTGGAGCAG GTGCGAAAGATTCAGGGCGATGGAGCCGCACTCCAAG AGAAGCTCTGCGCGACATACAAACTTTGCCATCCCGA GGAGCTCGTACTGCTCGGGCACAGCTTGGGGATTCCC TGGGCTCCTCTCTCGTCCTGTCCGTCGCAGGCTTTGCA GTTGGCAGGGTGCCTTTCCCAGCTCCACTCCGGTTTGT TCTTGTATCAGGGACTGCTGCAAGCCCTTGAGGGAAT CTCGCCAGAATTGGGCCCGACGCTGGACACGTTGCAG CTCGACGTGGCGGATTTCGCAACAACCATCTGGCAGC AGATGGAGGAACTGGGGATGGCACCCGCGCTGCAGCC CACGCAGGGGCAATGCCGGCCTTTGCGTCCGCGTTT CAGCGCAGGGCGGGTGGAGTCCTCGTAGCGAGCCACC TTCAATCATTTTTGGAAGTCTCGTACCGGGTGCTGAGA CATCTTGCGCAGCCG TGATAATAG TGCTCTTCAGTAGGGTCATGAAGGTTTTTCTTTTCC TGAGAAAACAACACGTATTGTTTTCTCAGGTTTTGC TTTTTGGCCTTTTTCTAGCTTAAAAAAAAAAAAAGC AAAAGTGGTCTTTGAATAAAGTCTGAGTGGGCGGCTC TAGA | |
| mRNA sequence (transcribed): GGGAAUAAGAGAGAAAAGAAGAGUAAGAAGAAAU AUAAGAGCCACC AUGGCCGGUCCCGCGACCCAAAGCCCCAUGAAACUU AUGGCCCUGCAGUUGCUGCUUUGGCACUCGGCCCUC UGGACAGUCCAAGAAGCGACUCCUCUCGGACCUGCC UCAUCGUUGCCGCAGUCAUUCCUUUUGAAGUGUCUG GAGCAGGUGCGAAAGAUUCAGGGCGAUGGAGCCGCA CUCCAAGAGAAGCUCUGCGCGACAUACAAACUUUGC CAUCCCGAGGAGCUCGUACUGCUCGGGCACAGCUUG GGGAUUCCCUGGGCUCCUCUCUCGUCCUGUCCGUCG CAGGCUUUGCAGUUGGCAGGGUGCCUUUCCCAGCUC CACUCCGGUUUGUUCUUGUAUCAGGGACUGCUGCAA GCCCUUGAGGGAAUCUCGCCAGAAUUGGGCCCGACG CUGGACACGUUGCAGCUCGACGUGGCGGAUUUCGCA ACAACCAUCUGGCAGCAGAUGGAGGAACUGGGGAUG GCACCCGCGCUGCAGCCCACGCAGGGGCAAUGCCGG GCCUUUGCGUCCGCGUUUCAGCGCAGGGCGGGUGGA GUCCUCGUAGCGAGCCACCUUCAAUCAUUUUUGGAA GUCUCGUACCGGGUGCUGAGACAUCUUGCGCAGCCG UGAUAAUAG UGCUCUUCAGUAGGGUCAUGAAGGUUUUUCUUUUC CUGAGAAAACAACACGUAUUGUUUUCUCAGGUUUU GCUUUUUGGCCUUUUUCUAGCUUAAAAAAAAAAAAA AGCAAAAGUGGUCUUUGAAUAAAGUCUGAGUGGGC GGC | 7345 |
| mCherry with Human MALAT1 sequence | Optimized mCherry cDNA sequence containing a T7 polymerase site, kozak sequence, and a Human MALAT1 sequence (bold): TAATACGACTCACTATA GGGAATAAGAGAGAAAAGAAGAGTAAGAAGAAATA TAAGAGCCACC ATGGTATCCAAGGGGGAGGAGGACAACATGGCGATC ATCAAGGAGTTCATGCGATTCAAGGTGCACATGGAAG GTTCGGTCAACGGACACGAATTTGAAATCGAAGGAGA GGGTGAAGGAAGGCCCTATGAAGGGACACAGACCGC GAAACTCAAGGTCACGAAAGGGGGACCACTTCCTTTC GCCTGGGACATTCTTTCGCCCCAGTTTATGTACGGGTC CAAAGCATATGTGAAGCATCCCGCCGATATTCCTGAC TATCTGAAACTCAGCTTTCCCGAGGGATTCAAGTGGG AGCGGGTCATGAACTTTGAGGACGGGGGTGTAGTCAC CGTAACCCAAGACTCAAGCCTCCAAGACGGCGAGTTC ATCTACAAGGTCAAACTGCGGGGACTAACTTTCCGT CGGATGGGCGGTGATGCAGAAGAAACGATGGGAT GGGAAGCGTCATCGGAGAGGATGTACCCAGAAGATG GTGCATTGAAGGGGGAGATCAAGCAGAGACTGAAGTT GAAAGATGGGGACATTATGATGCCGAGGTGAAAAC GACATACAAAGCGAAAAAGCCGGTGCAGCTTCCCGGA GCGTATAATGTGAATATCAAGTTGGATATTACTTCACA CAATGAGGACTACACAATTGTCGAACAGTACGAACGC GCTGAGGGTAGACACTCGACGGGAGGCATGGACGAG TTGTACAAA TGATAATAG | 7346 |

TABLE 40-continued

MALAT1 Constructs

| Sequence | SEQ ID NO: |
|---|---|
| TGCTCTTCAGTAGGGTCATGAAGGTTTTTCTTTTCC<br>TGAGAAAACAACACGTATTGTTTTCTCAGGTTTTGC<br>TTTTTGGCCTTTTTCTAGCTTAAAAAAAAAAAAAGC<br>AAAAGTGGTCTTTGAATAAAGTCTGAGTGGGCGGCTC<br>TAGA | |
| mRNA sequence (transcribed):<br>GGGAAAUAAGAGAGAAAAGAAGAGUAAGAAGAAAU<br>AUAAGAGCCACC<br>AUGGUAUCCAAGGGGGAGGAGGACAACAUGGCGAUC<br>AUCAAGGAGUUCAUGCGAUUCAAGGUGCACAUGGAA<br>GGUUCGGUCAACGGACACGAAUUUGAAAUCGAAGGA<br>GAGGGUGAAGGAAGGCCCUAUGAAGGGACACAGACC<br>GCGAAACUCAAGGUCACGAAAGGGGGACCACUUCCU<br>UUCGCCUGGGACAUUCUUUCGCCCCAGUUUAUGUAC<br>GGGUCCAAAGCAUAUGUGAAGCAUCCCGCCGAUAUU<br>CCUGACUAUCUGAAACUCAGCUUUCCCGAGGGAUUC<br>AAGUGGGAGCGGGUCAUGAACUUUGAGGACGGGGG<br>UGUAGUCACCGUAACCCAAGACUCAAGCCUCCAAGA<br>CGGCGAGUUCAUCUACAAGGUCAAACUGCGGGGGAC<br>UAACUUUCCGUCGGAUGGGCCGGUGAUGCAGAAGAA<br>AACGAUGGGAUGGGAAGCGUCAUCGGAGAGGAUGU<br>ACCCAGAAGAUGGUGCAUUGAAGGGGGAGAUCAAGC<br>AGAGACUGAAGUUGAAAGAUGGGGGACAUUAUGAU<br>GCCGAGGUGAAAACGACAUACAAAGCGAAAAAGCCG<br>GUGCAGCUUCCCGGAGCGUAUAAUGUGAAUAUCAAG<br>UUGGAUAUUACUUCACACAAUGAGGACUACACAAUU<br>GUCGAACAGUACGAACGCGCUGAGGGUAGACACUCG<br>ACGGGAGGCAUGGACGAGUUGUACAAA<br>UGAUAAUAG<br>UGCUCUUCAGUAGGGUCAUGAAGGUUUUUCUUUUC<br>CUGAGAAAACAACACGUAUUGUUUUCUCAGGUUUU<br>GCUUUUUGGCCUUUUUCUAGCUUAAAAAAAAAAAA<br>AGCAAAAGUGGUCUUUGAAUAAAGUCUGAGUGGGC<br>GGC | 7347 |

These modified mRNA sequences can include at least one chemical modification described herein. The G-CSF or mCherry modified mRNA sequence can be formulated, using methods described herein and/or known in the art, prior to transfection and/or administration.

The modified mRNA sequence encoding G-CSF or mCherry can be transfected in vitro to various cell types such as HEK293, HeLa, PBMC and BJ fibroblast and those described in Table 25 of U.S. Provisional Application No. 61/839,903, filed Jun. 27, 2013, the contents of which are herein incorporated by reference in its entirety, using methods disclosed herein and/or are known in the art. The cells are then analyzed using methods disclosed herein and/or are known in the art to determine the concentration of G-CSF or mCherry and/or the cell viability.

Example 50. Oncology-Related Targets

Septin 4 may be an oncology-related polypeptide of interest. Shown in Table 41, in addition to the name and description of the gene encoding the oncology-related polypeptide of interest, are the ENSEMBL Transcript ID (ENST), the ENSEMBL Protein ID (ENSP), each present where applicable, and when available the optimized sequence ID (OPT. SEQ ID).

TABLE 41

Oncology-Related Targets

| Target | Target Description | ENST ID | Trans. SEQ ID NO | ENSP ID | Prot. SEQ ID NO | OPT. SEQ ID NO |
|---|---|---|---|---|---|---|
| SEPT4 | septin 4 | 317256 | 7348 | 321071 | 7355 | 7363, 7368, 7375, 7382, 7389, 7396 |
| SEPT4 | septin 4 | 317268 | 7349 | 321674 | 7356 | 7364, 7369, 7376, 7383, 7390, 7397, 7403-7489 |
| SEPT4 | septin 4 | 393086 | 7350 | 376801 | 7357 | 7370, 7377, 7384, 7391, 7398 |
| SEPT4 | septin 4 | 412945 | 7351 | 414779 | 7358 | 7365, 7371, 7378, 7385, 7392, 7399 |

TABLE 41-continued

Oncology-Related Targets

| Target | Target Description | ENST ID | Trans. SEQ ID NO | ENSP ID | Prot. SEQ ID NO | OPT. SEQ ID NO |
|---|---|---|---|---|---|---|
| SEPT4 | septin 4 | 426861 | 7352 | 402348 | 7359 | 7366, 7372, 7379, 7386, 7393, 7400 |
| SEPT4 | septin 4 | 457347 | 7353 | 402000 | 7360 | 7367, 7373, 7380, 7387, 7394, 7401 |
| SEPT4 | septin 4 | 583114 | 7354 | 463768 | 7361 | 7374, 7381, 7388, 7395, 7402 |
| SEPT4 | septin 4 | | | | | 7362 |

Example 51. Confirmation and of Peptide Identity from Chemically Modified mRNA

Cell lysates containing protein produced from: (a) apoptosis-inducing factor 1, mitochondrial, short isoform (AIFsh; gene name AIFM1) modified mRNA (mRNA sequence shown in SEQ ID NO. 6617 (Table 42); polyA tail of approximately 140 nucleotides not shown in sequence; 5' cap, Cap1); (b) copper metabolism (Murr1) domain containing 1 (COMMD1) modified mRNA (mRNA sequence shown in SEQ ID NO. 7491 (Table 42); polyA tail of approximately 140 nucleotides not shown in sequence; 5' cap, Cap1); (c) septin 4 (SEPT4) modified mRNA (mRNA sequence shown in SEQ ID NO. 7362 (Table 42); polyA tail of approximately 140 nucleotides not shown in sequence; 5' cap, Cap1); and (d) diablo, IAP-binding mitochondrial protein (DIABLO) modified mRNA (mRNA sequence shown in SEQ ID NO. 7494 (Table 42); polyA tail of approximately 140 nucleotides not shown in sequence; 5' cap, Cap1); all fully modified with 5-methylcytidine and pseudouridine (5mC and pU), fully modified with 5-methylcytidine and 1-methylpseudouridine (5mC and 1mpU), modified where 25% of uridine modified with 2-thiouridine and 25% of cytidine modified with 5-methylcytidine (s2U and 5mC), fully modified with pseudouridine (pU), or fully modified with 1-methylpseudouridine (1mpU) were evaluated using the LC-MS/MS with quantitative LC-MRM as described in Example 31.

TABLE 42

Target Sequences

| Description | Sequence | SEQ ID NO: |
|---|---|---|
| AIFsh | GGGAAAUAAGAGAGAAAAGAAGAGUAAGAAGAAAUAU AAGAGCCACCAUGGAAAAAGUCAGACGAGAGGGGGUU AAGGUGAUGCCCAAUGCUAUUGUGCAAUCCGUUGGAG UCAGCAGUGGCAAGUUACUUAUCAAGCUGAAAGACGG CAGGAAGGUAGAAACUGACCACAUAGUGGCAGCUGUG GGCCUGGAGCCCAAUGUUGAGUUGGCCAAGACUGGUG GCCUGGAAAUAGACUCAGAUUUUGGUGGCUUCCGGGU AAAUGCAGAGCUACAAGCACGCUCUAACAUCUGGGUG GCAGGAGAUGCUGCAUGCUUCUACGAUAUAAAGUUGG GAAGGAGGCGGGUAGAGCACCAUGAUCACGCUGUUGU GAGUGGAAGAUUGGCUGGAGAAAAUAUGACUGGAGCU GCUAAGCCGUACUGGCAUCAGUCAAUGUUCUGGAGUG AUUUGGGCCCCGAUGUUGGCUAUGAAGCUAUUGGUCU UGUGGACAGUAGUUUGCCCACAGUUGGUGUUUUUGCA AAAGCAACUGCACAAGACAACCCCAAAUCUGCCACAGA GCAGUCAGGAACUGGUAUCCGAUCAGAGAGUGAGACA GAGUCCGAGGCCUCAGAAAUUACUAUUCCUCCCAGCAC CCCGGCAGUUCCACAGGCUCCCGUCCAGGGGGAGGACU ACGGCAAAGGUGUCAUCUUCUACCUCAGGGACAAAGU GGUCGUGGGGAUUGUGCUAUGGAACAUCUUUAACCGA AUGCCAAUAGCAAGGAAGAUCAUUAAGGACGGUGAGC AGCAUGAAGAUCUCAAUGAAGUAGCCAAACUAUUCAA CAUUCAUGAAGACUGAUAAUAGGCUGGAGCCUCGGUG GCCAUGCUUCUUGCCCCUUGGGCCUCCCCCCAGCCCCU CCUCCCCUUCCUGCACCCGUACCCCCGUGGUCUUUGAA UAAAGUCUGAGUGGGCGGC | 6617 |
| | MEKVRREGVKVMPNAIVQSVGVSSGKLLIKLKDGRK VETDHIVAAVGLEPNVELAKTGGLEIDSDFGGFRVNA ELQARSNIWVAGDAACFYDIKLGRRRVEHHDHAVVS GRLAGENMTGAAKPYWHQSMFWSDLGPDVGYEAIG LVDSSLPTVGVFAKATAQDNPKSATEQSGTGIRSESET ESEASEITIPPSTPAVPQAPVQGEDYGKGVIFYLRDKV VVGIVLWNIFNRMPIARKIIKDGEQHEDLNEVAKLFNI HED | 7490 |

TABLE 42-continued

Target Sequences

| Description | Sequence | SEQ ID NO: |
|---|---|---|
| COMMD1 | GGGAAAUAAGAGAGAAAAGAAGAGUAAGAAGAAA UAUAAGAGCCACCAUGGCGGCGGGCGAGCUUGAG GGUGGCAAACCCCUGAGCGGGCUGCUGAAUGCGC UGGCCCAGGACACUUUCCACGGGUACCCCGGCAUC ACAGAGGAGCUGCUACGGAGCCAGCUAUAUCCAG AGGUGCCACCCGAGGAGUUCCGCCCCUUUCUGGCA AAGAUGAGGGGGAUUCUUAAGUCUAUUGCGUCUG CAGACAUGGAUUUCAACCAGCUGGAGGCAUUCUU GACUGCUCAAACCAAAAAGCAAGGUGGGAUCACA UCUGACCAAGCUGCUGUCAUUUCCAAAUUCUGGA AGAGCCACAAGACAAAAAUCCGUGAGAGCCUCAU GAACCAGAGCCGCUGGAAUAGCGGGCUUCGGGGC CUGAGCUGGAGAGUUGAUGGCAAGUCUCAGUCAA GGCACUCAGCUCAAAUACACACACCUGUUGCCAU UAUAGAGCUGGAAUUAGGCAAAUAUGGACAGGAA UCUGAAUUUCUGUGUUUGGAAUUUGAUGAGGUCA AAGUCAACCAAAUUCUGAAGACGCUGUCAGAGGU AGAAGAAAGUAUCAGCACACUGAUCAGCCAGCCU AACUGAUAAUAGGCUGGAGCCUCGGUGGCCAUGC UUCUUGCCCCUUGGGCCUCCCCCCAGCCCCUCCUC CCCUUCCUGCACCCGUACCCCCGUGGUCUUUGAAU AAAGUCUGAGUGGGCGGC | 7491 |
| | MAAGELEGGKPLSGLLNALAQDTFHGYPGITEELLRS QLYPEVPPEEFRPFLAKMRGILKSIASADMDFNQLEAF LTAQTKKQGGITSDQAAVISKFWKSHKTKIRESLMNQ SRWNSGLRGLSWRVDGKSQSRHSAQIHTPVAIIELELG KYGQESEFLCLEFDEVKVNQILKTLSEVEESISTLISQPN | 7492 |
| SEPT4 | GGGAAAUAAGAGAGAAAAGAAGAGUAAGAAGAAA UAUAAGAGCCACCAUGGACCGUUCACUGGGAUGG CAAGGGAAUUCUGUCCCUGAGGACAGGACUGAAG CUGGGAUCAAGCGUUUCCUGGAGGACACCACGGA UGAUGGAGAACUGAGCAAGUUCGUGAAGGAUUUC UCAGGAAAUGCGAGCUGCCACCCACCAGAGGCUA AGACCUGGGCAUCCAGGCCCCAAGUCCCGGAGCCA AGGCCCCAGGCCCCGGACCUCUAUGAUGAUGACCU GGAGUUCAGACCCCCCUCGCGGCCCCAGUCCUCUG ACAACCAGCAGUACUUCUGUGCCCCAGCCCCUCUC AGCCCAUCUGCCAGGCCCCGCAGCCCAUGGGGCAA GCUUGAUCCCUAUGAUUCCUCUGAGGAUGACAAG GAGUAUGUGGGCUUUGCAACCCUCCCCAACCAAG UCCACCGAAAGUCCGUGAAGAAAGGCUUUGACUU UACCCUCAUGGUGGCAGGAGAGUCUGGCCUGGGC AAAUCCACACUUGUCAAUAGCCUCUUCCUCACUG AUCUGUACCGGGACCGGAAACUUCUUGGUGCUGA AGAGAGGAUCAUGCAAACUGUGGAGAUCACUAAG CAUGCAGUGGACAUAGAAGAGAAGGGUGUGAGGC UGCGGCUCACCAUUGUGGACACACCAGGUUUUGG GGAUGCAGUCAACAACACAGAGUGCUGGAAGCCU GUGGCAGAAUACAUUGAUCAGCAGUUUGAGCAGU AUUUCCGAGACGAGAGUGGCCUGAACCGAAAGAA CAUCCAAGACAACAGGGUGCACUGCUGCCUGUAC UUCAUCUCACCCUUCGGCCAUGGGCUCCGGCCAUU GGAUGUUGAAUUCAUGAAGGCCCUGCAUCAGCGG GUCAACAUCGUGCCUAUCCUGGCUAAGGCAGACA CACUGACACCUCCCGAAGUGGACCACAAGAAACGC AAAAUCCGGGAGGAGAUUGAGCAUUUUGGAAUCA AGAUCUAUCAAUUCCCAGACUGUGACUCUGAUGA GGAUGAGGACUUCAAAUUGCAGGACCAAGCCCUA AAGGAAAGCAUCCCAUUUGCAGUAAUUGGCAGCA ACACUGUAGUAGAGGCCAGAGGGCGGCGAGUUCG GGGUCGACUCUACCCCUGGGGCAUCGUGGAAGUG GAAAACCCAGGGCACUGCGACUUUGUGAAGCUGA GGACAAUGCUGGUACGUACCCACAUGCAGGACCU GAAGGAUGUGACACGGGAGACACAUUAUGAGAAC UACCGGGCACAGUGCAUCCAGAGCAUGACCCGCCU GGUGGUGAAGGAACGGAAUCGCAACAAACUGACU CGGGAAAGUGGUACCGACUUCCCCAUCCCUGCUG UCCCACCAGGGACAGAUCCAGAAACUGAGAAGCU UAUCCGAGAGAAAGAUGAGGAGCUGCGGCGGAUG CAGGAGAUGCUACACAAAAUACAAAAACAGAUGA AGGAGAACUAUUGAUAAUAGGCUGGAGCCUCGGU GGCCAUGCUUCUUGCCCCUUGGGCCUCCCCCCAGC CCCUCCUCCCCUUCCUGCACCCGUACCCCCGUGGU CUUUGAAUAAAGUCUGAGUGGGCGGC | 7362 |

TABLE 42-continued

Target Sequences

| Description | Sequence | SEQ ID NO: |
|---|---|---|
| | MDRSLGWQGNSVPEDRTEAGIKRFLEDTTDDGELSKF VKDFSGNASCHPPEAKTWASRPQVPEPRPQAPDLYDD DLEFRPPSRPQSSDNQQYFCAPAPLSPSARPRSPWGKL DPYDSSEDDKEYVGFATLPNQVHRKSVKKGFDFTLM VAGESGLGKSTLVNSLFLTDLYRDRKLLGAEERIMQT VEITKHAVDIEEKGVRLRLTIVDTPGFGDAVNNTECW KPVAEYIDQQFEQYFRDESGLNRKNIQDNRVHCCLYF ISPFGHGLRPLDVEFMKALHQRVNIVPILAKADTLTPP EVDHKKRKIREEIEHFGIKIYQFPDCDSDEDEDFKLQD QALKESIPFAVIGSNTVVEARGRRVRGRLYPWGIVEV ENPGHCDFVKLRTMLVRTHMQDLKDVTRETHYENY RAQCIQSMTRLVVKERNRNKLTRESGTDFPIPAVPPGT DPETEKLIREKDEELRRMQEMLHKIQKQMKENY | 7493 |
| Diablo, IAP-binding mitochondrial protein (DIABLO) | GGGAAAUAAGAGAGAAAAGAAGAGUAAGAAGAAA UAUAAGAGCCACCAUGGCGGCUCUGAAGAGUUGG CUGUCGCGCAGCGUAACUUCAUUCUUCAGGUACA GACAGUGUUUGUGUGUUCCUGUUGUGGCUAACUU UAAGAAGCGGUGUUUCUCAGAAUUGAUAAGACCA UGGCACAAAACUGUGACGAUUGGCUUUGGAGUAA CCCUGUGUGCGGUUCCUAUUGCACAGAAAUCAGA GCCUCAUUCCCUUAGUAGUGAAGCAUUGAUGAGG AGAGCAGUGUCUUUGGUAACAGAUAGCACCUCUA CCUUUCUCUCAGACCACAUAUGCGUUGAUUGA AGCUAUUACUGAAUAUACUAAGGCUGUUUAUACC UUAACUUCUCUUUACCGACAAUAUACAAGUUUAC UUGGGAAAAUGAAUUCAGAGGAGGAAGAUGAAGU GUGGCAGGUGAUCAUAGGAGCCAGAGCUGAGAUG ACUUCAAAACACCAAGAGUACUUGAAGCUGGAAA CCACUUGGAUGACUGCAGUUGGUCUUUCAGAGAU GGCAGCAGAAGCUGCAUAUCAAACUGGCGCAGAU CAGGCCUCUAUAACCGCCAGGAAUCACAUUCAGC UGGUGAAACUGCAGGUGGAAGAGGUGCACCAGCU CUCCCGGAAAGCAGAAACCAAGCUGGCAGAAGCA CAGAUAGAAGAGCUCCGUCAGAAAACACAGGAGG AAGGGGAGGAGCGGGCUGAGUCGGAGCAGGAGGC CUACCUGCGUGAGGAUUGAUAAUAGGCUGGAGCC UCGGUGGCCAUGCUUCUUGCCCCUUGGGCCUCCCC CCAGCCCCUCCUCCCCUUCCUGCACCCGUACCCCC GUGGUCUUUGAAUAAAGUCUGAGUGGGCGGC | 7494 |
| | MAALKSWLSRSVTSFFRYRQCLCVPVVANFKKRCFSE LIRPWHKTVTIGFGVTLCAVPIAQKSEPHSLSSEALMR RAVSLVTDSTSTFLSQTTYALIEAITEYTKAVYTLTSLY RQYTSLLGKMNSEEEDEVWQVIIGARAEMTSKHQEY LKLETTWMTAVGLSEMAAEAAYQTGADQASITARNH IQLVKLQVEEVHQLSRKAETKLAEAQIEELRQKTQEE GEERAESEQEAYLRED | 1986 |

Peptide fragments identified for the evaluated proteins are shown in Table 43.

TABLE 43

Protein and Peptide Fragment Sequences

| Peptide Fragment | SEQ ID NO | 5mC and pU | 5mC and 1mpU | s2U and 5mC | pU | 1mpU |
|---|---|---|---|---|---|---|
| AIFM1 | | | | | | |
| DGEQHEDLNEVAK | 7495 | — | — | — | — | YES |
| TGGLEIDSDFGGFR | 7496 | YES | — | — | YES | YES |
| COMMD1 | | | | | | |
| ESLMNQSR | 7497 | YES | YES | YES | YES | YES |
| HSAQIHTPVAIIELELGK | 7498 | — | — | YES | YES | YES |
| WNSGLR | 7499 | — | YES | YES | YES | YES |
| SEPT4 | | | | | | |
| ESGTDFPIPAVPPGTDPETEK | 7500 | YES | YES | YES | YES | YES |
| FLEDTTDDGELSK | 7501 | YES | YES | YES | YES | YES |
| HAVDIEEK | 7502 | YES | YES | YES | YES | YES |
| DIABLO | | | | | | |
| AVYTLTSLYR | 7503 | YES | YES | YES | YES | YES |
| LAEAQIEELR | 7504 | YES | YES | YES | YES | YES |
| NHIQLVK | 7505 | YES | YES | YES | YES | YES |

Example 52. Detection of C.A. Caspase 3 and C.A Caspase 6

Figure 7A:
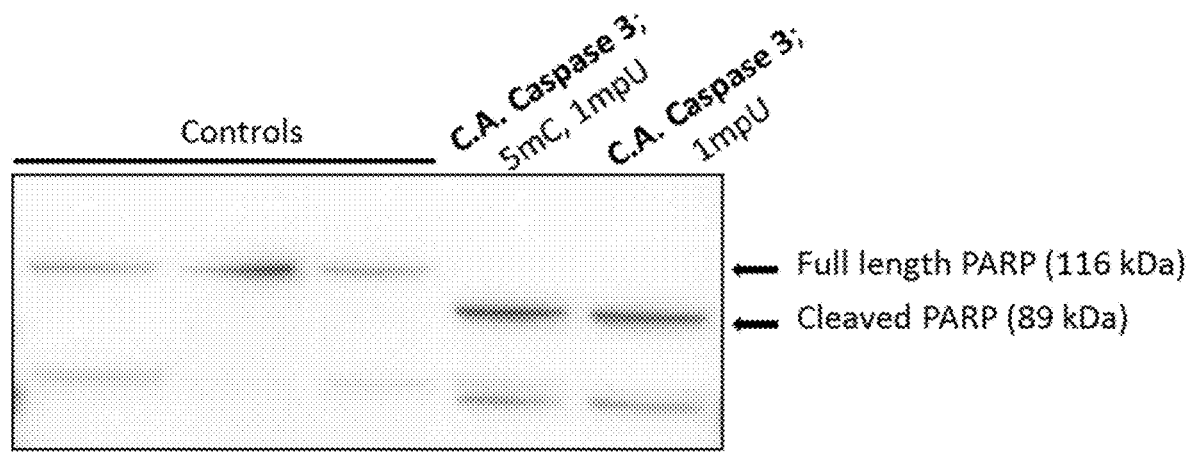
FIGS. 7A and 7B are western blots of C.A. caspase 3 and C.A. caspase 6.
Figure 7B:
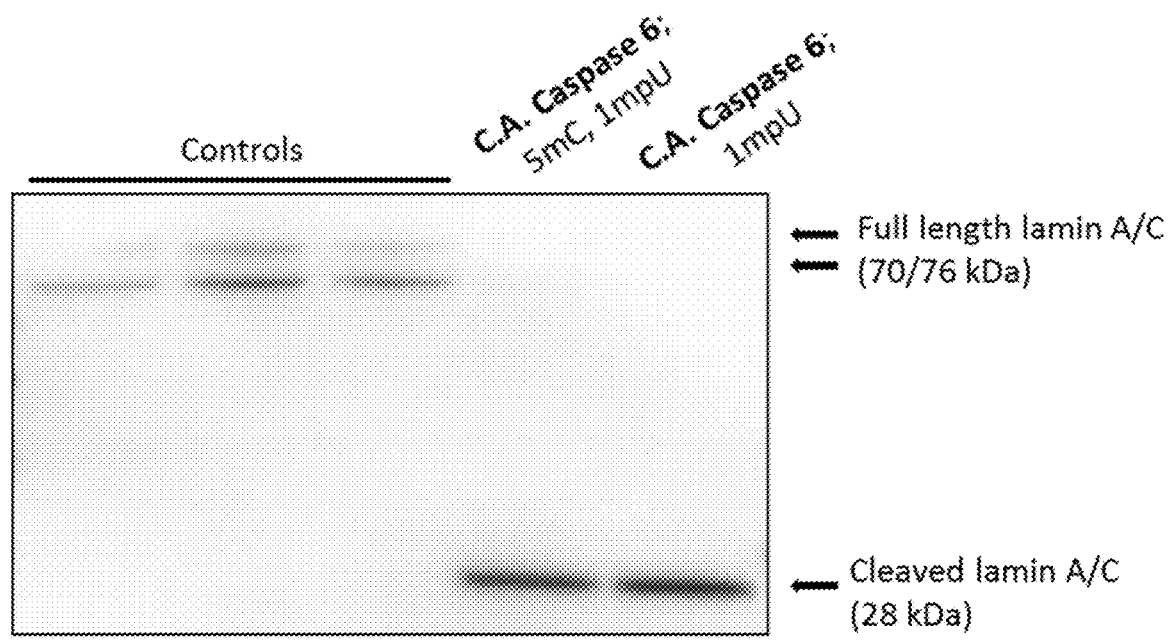

Human lung cancer A549 cells were plated in 6-wells, and transfected with Lipofectamine 2000 (Life Technologies) and 5 μg of constitutively active (C.A.) caspase 3 mRNA (mRNA sequence shown in SEQ ID NO: 6619 (Table 44); polyA tail of approximately 140 nucleotides not shown in sequence; 5' cap, Cap 1) or constitutively active (C.A.) caspase 6 mRNA (mRNA sequence shown in SEQ ID NO: 7506 (Table 44); polyA tail of approximately 140 nucleotides not shown in sequence; 5' cap, Cap1) fully modified with 5-methylcytidine and 1-methylpseudouridine (5mC and 1 mpU) or fully modified with 1-methylpseudouridine (1mpU). Cells were harvested 7-10 hours post-transfection and lysed in RIPA buffer containing a protease inhibitor cocktail (Roche, Indianapolis, Ind.). 20 μg of cell lysate per lane was run for Western blotting to detect endogenous and introduced caspase 3; endogenous and introduced caspase 6; the caspase 3 downstream-substrate PARP; and the caspase 6 downstream-substrate lamin A/C. Compared to control lysate, higher levels of cleaved caspase 3 and cleaved caspase 6 were detected in C.A. caspase 3 and C.A. caspase 6 modified mRNA transfected cells, respectively. As shown in FIG. 7, cleavage of the downstream substrates PARP and lamin A/C were detected in cells treated with C.A. caspase 3 modified mRNA (FIG. 7A) and C.A. caspase 6 modified mRNAs (FIG. 7B). The 5 lanes of the Westerns shown in FIGS. 7A and 7B contain lysate from the following: 1) untransfected HeLa cells, 2) untransfected A549, 3) A549 lipofectamine alone control, 4) A549 transfected with 5mC, 1mpU modified mRNA, and 5) A549 transfected with 1 mpU modified mRNA.

TABLE 44

C.A. Caspase Sequences

| Description | Sequence | SEQ ID NO: |
|---|---|---|
| C.A. caspase 3 | GGGAAAUAAGAGAGAAAAGAAGAGUAAGAAGAAAUA UAAGAGCCACCAUGAUUGAGACAGACAGUGGUGUUGA UGAUGACAUGGCGUGUCAUAAAAUACCAGUGGAGGCC GACUUCUUGUAUGCAUACUCCACAGCACCUGGUUAUU AUUCUUGGCGAAAUUCAAAGGAUGGCUCCUGGUUCAU CCAGUCGCUUUGUGCCAUGCUGAAACAGUAUGCCGAC AAGCUUGAAUUUAUGCACAUUCUUACCCGGGUUAACC GAAAGGUGGCAACAGAAUUUGAGUCCUUUUCCUUUGA CGCUACUUUUCAUGCAAAGAAACAGAUUCCAUGUAUU GUUUCCAUGCUCACAAAAGAACUCUAUUUUUAUCACG AUGAAGUUGAUGGGGGAUCCCCCAUGGAGAACACUGA AAACUCAGUGGAUUCAAAAUCCAUUAAAAAUUUGGA ACCAAAGAUCAUACAUGGAAGCGAAUCAAUGGACUCU GGAAUAUCCCUGGACAACAGUUAUAAAAUGGAUUAUC CUGAGAUGGGUUUAUGUAUAAUAAUUAAUAAUAAGA AUUUUCAUAAGAGCACUGGAAUGACAUCUCGGUCUGG UACAGAUGUCGAUGCAGCAAACCUCAGGGAAACAUUC AGAAACUUGAAAUAUGAAGUCAGGAAUAAAAAUGAU CUUACACGUGAAGAAAUUGUGGAAUUGAUGCGUGAU GUUUCUAAAGAAGAUCACAGCAAAAGGAGCAGUUUU GUUUGUGUGCUUCUGAGCCAUGGUGAAGAAGGAAUA AUUUUUGGAACAAAAUGGACCUGUUGACCUGAAAAAA AUAACAAACUUUUUCAGAGGGGAUCGUUGUAGAAGU CUAACUGGAAAACCCAAACUUUUUCAUUAUUCAGGCCU GCCGUGGUACAGAACUGGACUGUGGCAUUGAGACAGA CUGAUAAUAGGCUGGAGCCUCGGUGGCCAUGCUUCUU GCCCCUUGGGCCUCCCCCCAGCCCCUCCUCCCCUUCCU GCACCCGUACCCCCGUGGUCUUUGAAUAAAGUCUGAG UGGGCGGC | 6619 |
| | MIETDSGVDDDMACHKIPVEADFLYAYSTAPGYYSW RNSKDGSWFIQSLCAMLKQYADKLEFMHILTRVNRK VATEFESFSFDATFHAKKQIPCIVSMLTKELYFYHDE VDGGSPMENTENSVDSKSIKNLEPKIIHGSESMDSGIS LDNSYKMDYPEMGLCIIINNKNFHKSTGMTSRSGTD VDAANLRETFRNLKYEVRNKNDLTREEIVELMRDVS KEDHSKRSSFVCVLLSHGEEGIIFGTNGPVDLKKITNF FRGDRCRSLTGKPKLFIIQACRGTELDCGIETD | 2484 |
| C.A. caspase 6 | GGGAAAUAAGAGAGAAAAGAAGAGUAAGAAGAA AUAUAAGAGCCACCAUGGUAGAAAUAGAUGCAGC CUCCGUUUACACGCUGCCUGCUGGAGCUGACUUC CUCAUGUGUUACUCUGUUGCAGAAGGAUAUUAU UCUCACCGGGAAACUGUGAACGGCUCAUGGUACA UUCAAGAUUUGUGUGAGAUGUUGGGAAAAUAUG GCUCCUCCUUAGAGUUCACAGAACUCCUCACACU GGUGAACAGGAAAGUUUCUCAGCGCCGAGUGGAC UUUUGCAAAGACCCAAGUGCAAUUGGAAAGAAGC AGGUUCCCUGUUUUGCCUCAAUGCUAACUAAAAA GCUGCAUUUCUUUCCAAAAUCUAAUCUCGAGCAC CACCACCACCACCGUUGAAAUUGAUGGGGGAU CCCCCAUGAGCUCGGCCUCGGGGCUCCGCAGGGG GCACCCGGCAGGUGGGGAAGAAAACAUGACAGAA ACAGAUGCCUUCUAUAAAAGAGAAAUGUUUGAU | 7506 |

TABLE 44-continued

C.A. Caspase Sequences

| Description | Sequence | SEQ ID NO: |
|---|---|---|
| | CCGGCAGAAAAGUACAAAAUGGACCACAGGAGGA<br>GAGGAAUUGCUUUAAUCUUCAAUCAUGAGAGGU<br>UCUUUUGGCACUUAACACUGCCAGAAAGGCGGGG<br>CACCUGCGCAGAUAGAGACAAUCUUACCCGCAGG<br>UUUUCAGAUCUAGGAUUUGAAGUGAAAUGCUUU<br>AAUGAUCUUAAAGCAGAAGAACUACUGCUCAAAA<br>UUCAUGAGGUGUCAACUGUUAGCCACGCAGAUGC<br>CGAUUGCUUUGUGUGUGUCUUCCUGAGCCAUGGC<br>GAAGGCAAUCACAUUUAUGCAUAUGAUGCUAAA<br>AUCGAAAUUCAGACAUUAACUGGCUUGUUCAAAG<br>GAGACAAGUGUCACAGCCUGGUUGGAAAACCCAA<br>GAUAUUUAUCAUCCAGGCAUGUCGGGGAAACCAG<br>CACGAUGUGCCAGUCAUUCCUUUGGAUGUAGUAG<br>AUUGAUAAUAGGCUGGAGCCUCGGUGGCCAUGCU<br>UCUUGCCCCUUGGGCCUCCCCCCAGCCCCUCCUCC<br>CCUUCCUGCACCCGUACCCCCGUGGUCUUUGAAU<br>AAAGUCUGAGUGGGCGGC<br>MVEIDAASVYTLPAGADFLMCYSVAEGYYSHRETVN<br>GSWYIQDLCEMLGKYGSSLEFTELLTLVNRKVSQRR<br>VDFCKDPSAIGKKQVPCFASMLTKKLHFFPKSNLEHH<br>HHHHVEIDGGSPMSSASGLRRGHPAGGEENMTETDA<br>FYKREMFDPAEKYKMDHRRRGIALIFNHERFFWHLT<br>LPERRGTCADRDNLTRRFSDLGFEVKCFNDLKAEELL<br>LKIHEVSTVSHADADCFVCVFLSHGEGNHIYAYDAKI<br>EIQTLTGLFKGDKCHSLVGKPKIFIIQACRGNQHDVPV<br>IPLDVVD | 2486 |

Example 53. Expression of Modified C.A. Caspase 3 and C.A. Caspase 6 mRNA

The activity of cultured human lung adenocarcinoma A549 cells was evaluated through the measurement of formazan converted by mitochondrial dehydrogenases from WST-1 substrate (Roche, Indianapolis, Ind.). 7500 cells per 96-well were treated with a single dose of varying amounts of Lipofectamine 2000-lipoplexed constitutively active (C.A.) caspase 3 mRNA (mRNA sequence shown in SEQ ID NO: 6619 (Table 44); polyA tail of approximately 140 nucleotides not shown in sequence; 5' cap, Cap1) or constitutively active (C.A.) caspase 6 mRNA (mRNA sequence shown in SEQ ID NO: 7506 (Table 44); polyA tail of approximately 140 nucleotides not shown in sequence; 5' cap, Cap1) fully modified with 5-methylcytidine and 1-methylpseudouridine (5mC and 1 mpU) or fully modified with 1-methylpseudouridine (1 mpU) or a control proteins (eGFP (mRNA sequence shown in SEQ ID NO: 7507; polyA tail of approximately 140 nucleotides not shown in sequence; 5' cap, Cap1; fully modified with 5-methylcytidine and 1-methylpseudouridine (5mC and 1 mpU) or fully modified with 1-methylpseudouridine (1mpU)) and luciferase (mRNA sequence shown in SEQ ID NO: 7508; polyA tail of approximately 140 nucleotides not shown in sequence; 5' cap, Cap1; fully modified with 5-methylcytidine and 1-methylpseudouridine (5mC and 1 mpU) or fully modified with 1-methylpseudouridine (1mpU))). Cellular activity was measured in cultured cells 1 day after mRNA treatment according to the WST-1 manufacturer's protocol, and is plotted as a 450 nm absorbance reading of the converted formazan that had been corrected for background signal. As shown in Table 45, increasing amounts of transfected C.A. caspase mRNA (0 ng, 2 ng, 10 ng, 50 ng and 250 ng) markedly inhibited the optical density (OD) signal (as a readout of cellular activity) compared to controls. Similar results were obtained in human lung adenocarcinoma H441 cells and human cervical cancer HeLa cells.

TABLE 45

Cellular Activity

| Description | Amount of mRNA (ng) | WST-1 OD mean (450-690 nm) |
|---|---|---|
| C.A. caspase 3 (1mpU and 5mC) | 0 | 2.46 |
| | 2 | 1.93 |
| | 10 | 1.05 |
| | 50 | 0.31 |
| | 250 | 0.04 |
| C.A. caspase 6 (1mpU and 5mC) | 0 | 2.49 |
| | 2 | 2.41 |
| | 10 | 1.64 |
| | 50 | 0.75 |
| | 250 | 0.30 |
| eGFP (1mpU and 5mC) | 0 | 2.37 |
| | 2 | 2.36 |
| | 10 | 2.19 |
| | 50 | 1.84 |
| | 250 | 1.84 |
| Luciferase (1mpU and 5mC) | 0 | 2.26 |
| | 2 | 1.93 |
| | 10 | 2.00 |
| | 50 | 1.94 |
| | 250 | 1.87 |
| C.A. caspase 3 (1mpU) | 0 | 2.62 |
| | 2 | 2.35 |
| | 10 | 1.80 |
| | 50 | 0.91 |
| | 250 | 0.17 |
| C.A. caspase 6 (1mpU) | 0 | 2.17 |
| | 2 | 2.34 |
| | 10 | 2.01 |
| | 50 | 1.29 |
| | 250 | 0.42 |
| eGFP (1mpU) | 0 | 2.56 |
| | 2 | 2.67 |
| | 10 | 2.86 |
| | 50 | 2.72 |
| | 250 | 2.38 |

TABLE 45-continued

Cellular Activity

| Description | Amount of mRNA (ng) | WST-1 OD mean (450-690 nm) |
|---|---|---|
| Luciferase (1mpU) | 0 | 2.12 |
|  | 2 | 2.56 |
|  | 10 | 2.68 |
|  | 50 | 2.64 |
|  | 250 | 2.21 |

Example 54. MYC Inhibitors Modified mRNA

Human hepatocellular carcinoma Hep3B cells were plated in a 6-well plate at a seeding density of 3×10$^6$ cells/well and Lipofectamine 2000-transfected with mRNAs fully modified with 5-methylcytidine and 1-methylpseudouridine (5mC and 1 mpU) or fully modified with 1-methylpseudouridine (1mpU) designed to encode the following: fluorescent protein mCherry (mRNA sequence shown in SEQ ID NO: 6602; polyA tail of approximately 140 nucleotides not shown in sequence; 5' cap, Cap1), non-translatable Factor 1x (mRNA sequence shown in SEQ ID NO: 7509; polyA tail of approximately 140 nucleotides not shown in sequence; 5' cap, Cap 1), full length wildtype C-MYC (mRNA sequence shown in SEQ ID NO: 7510; polyA tail of approximately 140 nucleotides not shown in sequence; 5' cap, Cap1), MYC inhibitor A (mRNA sequence shown in SEQ ID NO: 7511 (Table 46); polyA tail of approximately 140 nucleotides not shown in sequence; 5' cap, Cap1), MYC inhibitor B (mRNA sequence shown in SEQ ID NO: 7513 (Table 46); polyA tail of approximately 140 nucleotides not shown in sequence; 5' cap, Cap 1), MYC inhibitor C (mRNA sequence shown in SEQ ID NO: 7418 (Table 46); polyA tail of approximately 140 nucleotides not shown in sequence; 5' cap, Cap1) and MYC inhibitor D (mRNA sequence shown in SEQ ID NO: 7515 (Table 46); polyA tail of approximately 140 nucleotides not shown in sequence; 5' cap, Cap1). Cells were collected 8 hours post-transfection and lysates were made using RIPA lysis buffer including a protease inhibitor cocktail (Roche, Indianapolis, Ind.). Equal amounts of lysate determined by BCA assay were resolved by SDS-PAGE through 4-12% BIS-TRIS gels, transferred to nitrocellulose blots and probed with appropriate primary and secondary antibodies. Western blot analyses revealed positive expression of the 4 modified mRNA MYC inhibitors, as well as full length C-MYC, in Hep3B cells.

TABLE 46

MYC Inhibitor Sequences

| Description | Sequence | SEQ ID NO: |
|---|---|---|
| MYC inhibitor A | GGGAAAUAAGAGAGAAAAGAAGAGUAAGAAGAA AUAUAAGAGCCACCAUGACCGAAGAAAACGUCAA GAGAAGAACCCAUAAUGUCCUCGAGCGCCAGCGG CGCAAUGAGCUCAAGCGCAGCUUCUUUGCACUCA GGGACCAAAUUCCAGAGUUGGAGAACAACGAAAA GGCCCCGAAGGUGGUGAUCCUUAAGAAGGCGACU GCCUACAUCCUGUCGGUGCAGGCUGAGACUCAAA AGCUGAUCUCCGAAAUCGAUCUGCUCCGGAAACA GAACGAACAACUGAAACACAAACUGGAACAGCUG CGGAAUUCAUGCGCGUGAUAAUAGGCUGGAGCCU CGGUGGCCAUGCUUCUUGCCCCUUGGGCCUCCCC CCAGCCCCUCCUCCCCUUCCUGCACCCGUACCCCC GUGGUCUUUGAAUAAAGUCUGAGUGGGCGGC MTEENVKRRTHNVLERQRRNELKRSFFALRDQIPELE NNEKAPKVVILKKATAYILSVQAETQKLISEIDLLRKQ NEQLKHKLEQLRNSCA | 7511 7512 |
| MYC inhibitor B | GGGAAAUAAGAGAGAAAAGAAGAGUAAGAAGAA AUAUAAGAGCCACCAUGACCGAAGAAAACGUCAA GAGAAGAACCCAUAAUGUCCUCGAGCGCCAGCGG CGCAAUGAGCUCAAGCGCAGCUUCUUUGCACUCA GGGACCAAAUUCCAGAGUUGGAGAACAACGAAAA GGCCCCGAAGGUGGUGAUCCUUAAGAAGGCGACU GCCUACAUCCUGUCGGUGCAGGCUGAGAAUCAAA AGCUGAUCUCCGAAAUCGAUCUGCUCCGGAAACA GAACGAACAACUGAAACACAAACUGGAACAGCUG CGGAAUUCAUGCGCGUGAUAAUAGGCUGGAGCCU CGGUGGCCAUGCUUCUUGCCCCUUGGGCCUCCCC CCAGCCCCUCCUCCCCUUCCUGCACCCGUACCCCC GUGGUCUUUGAAUAAAGUCUGAGUGGGCGGC MTEENVKRRTHNVLERQRRNELKRSFFALRDQIPELE NNEKAPKVVILKKATAYILSVQAENQKLISEIDLLRK QNEQLKHKLEQLRNSCA | 7513 7514 |
| MYC inhibitor C | GGGAAAUAAGAGAGAAAAGAAGAGUAAGAAGAA AUAUAAGAGCCACCAUGAGCGCCGCUGAUAAGCG GGCUCACCACAAUGCGUUGGAGAGGAAGAGGCGC GACCACAUCAAAGACUCGUUCCAUUCACUCCGGG ACUCCGUGCCGUCGCUGCAAGGAGAAAAAGCCUC CCGGGCACAGAUCCUCGACAAGGCGACUGAGUAC AUUCAGUACAUGCGCCGCAAGAACCACACCCAUC AGCAAGAUAUCGACGAUCUUAAGAGACAGAACGC GCUGCUGGAACAACAGGUCCGCGCACUGGAAAAG GCCAGAAGCUCAGCCUGAUAAUAGGCUGGAGCCU | 7515 |

TABLE 46-continued

MYC Inhibitor Sequences

| Description | Sequence | SEQ ID NO: |
|---|---|---|
| | CGGUGGCCAUGCUUCUUGCCCCUUGGGCCUCCCC CCAGCCCCUCCUCCCCUUCCUGCACCCGUACCCCC GUGGUCUUUGAAUAAAGUCUGAGUGGGCGGC MSAADKRAHHNALERKRRDHIKDSFHSLRDSVPSLQ GEKASRAQILDKATEYIQYMRRKNHTHQQDIDDLKR QNALLEQQVRALEKARSSA | 7516 |
| MYC inhibitor D | GGGAAAUAAGAGAGAAAAGAAGAGUAAGAAGAAAUA UAAGAGCCACCAUGACCGAAGAAAACGUCAAGAGAAG AACCCAUAAUGUCCUCGAGCGCCAGCGGCGCAAUGAG CUCAAGCGCAGCUUCUUUGCACUCAGGGACCAAAUUC CAGAGUUGGAGAACAACGAAAAGGCCCCGAAGGUGGU GAUCCUUAAGAAGGCGACUGCCUACAUCCUGUCGGUG CAGGCUGAGACUCAAAAGCUGAUCUCCGAAAUCGAUC UGCUCCGGAAACAGAACGAACAACUGAAACACAAACU GGAACAGCUGCGGAAUUCAUGCUGAUAAUAGGCUGGA GCCUCGGUGGCCAUGCUUCUUGCCCCUUGGGCCUCCC CCCAGCCCCUCCUCCCCUUCCUGCACCCGUACCCCCGU GGUCUUUGAAUAAAGUCUGAGUGGGCGGC | 6621 |
| | MTEENVKRRTHNVLERQRRNELKRSFFALRDQIPELE NNEKAPKVVILKKATAYILSVQAETQKLISEIDLLRKQ NEQLKHKLEQLRNSC | 7517 |

Example 55. Expression of MYC Inhibitors Modified mRNA

Hep3B cells were plated in a 96-well plate at a seeding density of 2500 cells/well and Lipofectamine 2000-transfected with 0, 0.2 nM, 0.7 nM, 2 nM or 6 nM of modified mRNAs fully modified with 1-methylpseudouridine (1mpU) designed to encode the following: mCherry (mRNA sequence shown in SEQ ID NO: 6602; polyA tail of approximately 140 nucleotides not shown in sequence; 5' cap, Cap1), non-translatable Factor 1× (mRNA sequence shown in SEQ ID NO: 7509; polyA tail of approximately 140 nucleotides not shown in sequence; 5' cap, Cap1), full length wildtype C-MYC (mRNA sequence shown in SEQ ID NO: 7510; polyA tail of approximately 140 nucleotides not shown in sequence; 5' cap, Cap1), MYC inhibitor A (mRNA sequence shown in SEQ ID NO: 7511; polyA tail of approximately 140 nucleotides not shown in sequence; 5' cap, Cap1), MYC inhibitor B (mRNA sequence shown in SEQ ID NO: 7513; polyA tail of approximately 140 nucleotides not shown in sequence; 5' cap, Cap1), MYC inhibitor C (mRNA sequence shown in SEQ ID NO: 7515; polyA tail of approximately 140 nucleotides not shown in sequence; 5' cap, Cap1) and MYC inhibitor D (mRNA sequence shown in SEQ ID NO: 6621; polyA tail of approximately 140 nucleotides not shown in sequence; 5' cap, Cap1). Cellular activity was measured 48 hours post-transfection with the use of WST-1 according to manufacturer's instructions (Roche, Indianapolis, Ind.). Absorbance readings were taken at 450 nm 4 hours after the addition of WST-1, and background-corrected results are shown in Table 47. The three highest concentrations of each of the inhibitors (MYC inhibitor A, MYC inhibitor B, MYC inhibitor C and MYC inhibitor D) reduced absorbance signal compared to the controls.

TABLE 47

| Cellular Activity | | |
|---|---|---|
| Description | Amount of mRNA (nM) | WST-1 OD mean (450-690 nm) |
| MYC inhibitor A | 0 | 0.45 |
| | 0.2 | 0.42 |
| | 0.7 | 0.09 |
| | 2 | 0.12 |
| | 6 | 0.05 |
| MYC inhibitor B | 0 | 0.67 |
| | 0.2 | 0.69 |
| | 0.7 | 0.24 |
| | 2 | 0.09 |
| | 6 | 0.05 |
| MYC inhibitor C | 0 | 0.73 |
| | 0.2 | 0.73 |
| | 0.7 | 0.34 |
| | 2 | 0.09 |
| | 6 | 0.04 |
| MYC inhibitor D | 0 | 0.74 |
| | 0.2 | 0.68 |
| | 0.7 | 0.32 |
| | 2 | 0.14 |
| | 6 | 0.07 |
| mCherry | 0 | 0.66 |
| | 0.2 | 0.66 |
| | 0.7 | 0.62 |
| | 2 | 0.60 |
| | 6 | 0.51 |
| Non-translatable FIX | 0 | 0.65 |
| | 0.2 | 0.65 |
| | 0.7 | 0.61 |
| | 2 | 0.62 |
| | 6 | 0.49 |
| Wild-Type MYC | 0 | 0.58 |
| | 0.2 | 0.51 |
| | 0.7 | 0.51 |
| | 2 | 0.51 |
| | 6 | 0.46 |

Example 56. In Vivo Expression of Modified mRNA

A. BALB/C Nude Mice

BALB/c nude mice were injected intravenously with 0.1 mg/kg luciferase modified mRNA without a miR-122 binding site ("non-targeted mRNA"; mRNA sequence shown in SEQ ID NO: 7518; polyA tail of approximately 140 nucleotides not shown in sequence; 5' cap, Cap1; fully modified with 5-methylcytidine and 1-methylpseudouridine) formulated in a lipid nanoparticle described in Table 48 or luciferase modified mRNA with a miR-122 binding site in the 3'UTR ("miR-122 targeted mRNA"; mRNA sequence shown in SEQ ID NO: 7519; polyA tail of approximately 140 nucleotides not shown in sequence; 5' cap, Cap 1; fully modified with 5-methylcytidine and 1-methylpseudouridine) formulated in a lipid nanoparticle described in Table 49.

TABLE 48

Lipid Nanoparticle for Non-targeted mRNA

| | |
|---|---|
| LNP | Luciferase: non-targeted mRNA |
| Lipid | DLin-KC2-DMA |
| Lipid/RNA wt/wt | 20 |
| Mean size | 73.3 nm |
| | PDI: 0.06 |

TABLE 49

Lipid Nanoparticle for Targeted mRNA

| | |
|---|---|
| LNP | Luciferase: targeted mRNA |
| Lipid | DLin-KC2-DMA |
| Lipid/RNA wt/wt | 20 |
| Mean size | 70.6 nm |
| | PDI: 0.08 |

24 hours post-treatment, animals were anesthetized, injected with the luciferase substrate D-luciferin and the bioluminescence imaging (BLI) from living animals was evaluated in an IVIS imager 15 minutes later. Signals were obtained from animals injected with non-targeted mRNA and from miR-122 targeted mRNA, and presented in Table 50. The total light signal produced from livers of animals treated with miR 122 targeted mRNA is 29× lower than non-targeted mRNA, showing that the engineered element in the 3'UTR may inhibit protein expression in normal tissue.

TABLE 50

In vivo expression of modified mRNA modulated by an engineered miR122 binding site

| Description | Luciferase signal from liver (photons/sec) |
|---|---|
| Non-targeted mRNA | $7.9 \times 10^7$ |
| miR-122 targted mRNA | $2.7 \times 10^6$ |

B. BALB/c Nude Mice with Hepatocellular Carcinoma Hep3B Cells

BALB/c nude mice were intrahepatic ally implanted with $2\times10^6$ hepatocellular carcinoma Hep3B cells and resulting orthotopic tumors allowed to grow for 24 days. Tumor-bearing mice were then intravenously injected with 0.1 mg/kg luciferase modified mRNA without a miR-122 binding site ("non-targeted mRNA"; mRNA sequence shown in SEQ ID NO: 7518; polyA tail of approximately 140 nucleotides not shown in sequence; 5' cap, Cap1; fully modified with 5-methylcytidine and 1-methylpseudouridine) or luciferase modified mRNA with a miR-122 binding site in the 3'UTR ("miR-122 targeted mRNA"; mRNA sequence shown in SEQ ID NO: 7519; polyA tail of approximately 140 nucleotides not shown in sequence; 5' cap, Cap1; fully modified with 5-methylcytidine and 1-methylpseudouridine) formulated in a lipid nanoparticle described in Table 45 (above). 24 hr post-treatment animals were anesthetized, injected with the luciferase substrate D-luciferin and bioluminescence imaging (BLI) from living animals was evaluated in an IVIS imager 20 minutes later. Signal from orthotopic tumors compared to adjacent normal liver was quantified, and miR-122-targeted mRNA systemically delivered via lipid nanoparticles achieved over 2-fold enrichment in tumor compared to normal liver.

Example 57. Modified Nucleic Acids with a Mir-122 Sequence

A. HeLa Cells

HeLa cells were seeded at a density of 15,000 per well in 100 ul cell culture medium (DMEM+10% FBS). G-CSF mRNA having a miR-122 sequence in the 3'UTR (G-CSF miR122; mRNA sequence shown in SEQ ID NO: 7325; polyA tail of approximately 140 nucleotides not shown in sequence; 5' cap, Cap 1; fully modified with 5-methylcytosine and 1-methylpseudouridine) or G-CSF mRNA having a miR-122 sequence without the seed sequence in the 3'UTR (G-CSF seedless; mRNA sequence shown in SEQ ID NO: 7327; polyA tail of approximately 140 nucleotides not shown in sequence; 5' cap, Cap1; fully modified with 5-methylcytosine and 1-methylpseudouridine) were transfected with 0.3 ul per well of Lipofectamine 2000 at a concentration of 75 ng of mRNA per well in 96 well plates. The supernatant was collected between 16-18 hours after transfection and expression of G-CSF was measured by ELISA, and the results are shown in Table 51.

TABLE 51

G-CSF Expression in HeLa

| Description | Protein Expression (ng/ml) |
|---|---|
| G-CSF miR122 | 292.1 |
| G-CSF seedless | 335.7 |

B. Primary Human and Rat Hepatocytes

Primary human or rat hepatocytes cells were seeded at a density of 350,000 cells per well in 500 ul cell culture medium (InvitroGRO CP and InVitroGRO HI Medium+ 2.2% Torpedo Antibiotic Mix). G-CSF mRNA having a miR-122 sequence in the 3'UTR (G-CSF miR122; mRNA sequence shown in SEQ ID NO: 7520; polyA tail of approximately 140 nucleotides not shown in sequence; 5' cap, Cap1; fully modified with 5-methylcytosine and 1-methylpseudouridine) or G-CSF mRNA having a miR-122 sequence without the seed sequence in the 3'UTR (G-CSF seedless; mRNA sequence shown in SEQ ID NO: 7521; polyA tail of approximately 140 nucleotides not shown in sequence; 5' cap, Cap1; fully modified with 5-methylcytosine and 1-methylpseudouridine) were transfected with 1 ul per well of Lipofectamine 2000 at a concentration of 500 ng of mRNA per well in 24 well plates for the primary human hepatocytes and the primary rat hepatocytes. The supernatant was collected between 16-18 hours after transfection and expression of G-CSF was measured by ELISA, and the results are shown in Table 52. The mir-122 binding site sequence in the mRNA dampened the G-CSF protein expression in the primary hepatocytes.

TABLE 52

G-CSF Expression in Hepatocytes

| Description | Primary Human Hepatocytes Protein Expression (ng/ml) | Primary Rat Hepatocytes Protein Expression (ng/ml) |
|---|---|---|
| G-CSF miR122 | 116 | 26 |
| G-CSF seedless | 463 | 85 |

Example 58. Time Course of Modified Nucleic Acids with a Mir-122 Sequence

A. HeLa Cells

HeLa cells were seeded at a density of 17,000 per well in 100 ul cell culture medium (DMEM+10% FBS). G-CSF mRNA without a miR-122 sequence in the 3'UTR (G-CSF; mouse 3' UTR mRNA sequence shown in SEQ ID NO: 7321; polyA tail of approximately 140 nucleotides not shown in sequence; 5' cap, Cap1; fully modified with 5-methylcytosine and 1-methylpseudouridine; human 3'UTR mRNA sequence shown in SEQ ID NO: 7320; polyA tail of approximately 140 nucleotides not shown in sequence; 5' cap, Cap1; fully modified with 5-methylcytosine and 1-methylpseudouridine), G-CSF mRNA having a miR-122 sequence in the 3'UTR (G-CSF miR122; mouse 3' UTR mRNA sequence shown in SEQ ID NO: 7325; polyA tail of approximately 140 nucleotides not shown in sequence; 5' cap, Cap1; fully modified with 5-methylcytosine and 1-methylpseudouridine; human 3'UTR mRNA sequence shown in SEQ ID NO: 7322; polyA tail of approximately 140 nucleotides not shown in sequence; 5' cap, Cap1; fully modified with 5-methylcytosine and 1-methylpseudouridine), G-CSF mRNA having a miR-122 seed sequence in the 3'UTR (G-CSF seed; mouse 3' UTR mRNA sequence shown in SEQ ID NO: 7326; polyA tail of approximately 140 nucleotides not shown in sequence; 5' cap, Cap1; fully modified with 5-methylcytosine and 1-methylpseudouridine; human 3'UTR mRNA sequence shown in SEQ ID NO: 7323; polyA tail of approximately 140 nucleotides not shown in sequence; 5' cap, Cap1; fully modified with 5-methylcytosine and 1-methylpseudouridine), G-CSF mRNA having a miR-122 sequence without the seed sequence in the 3'UTR (G-CSF seedless; mouse 3' UTR mRNA sequence shown in SEQ ID NO: 7327; polyA tail of approximately 140 nucleotides not shown in sequence; 5' cap, Cap1; fully modified with 5-methylcytosine and 1-methylpseudouridine; human 3'UTR mRNA sequence shown in SEQ ID NO: 7324; polyA tail of approximately 140 nucleotides not shown in sequence; 5' cap, Cap1; fully modified with 5-methylcytosine and 1-methylpseudouridine), Factor 1× mRNA without a miR-122 sequence in the 3'UTR (FIX; mouse 3' UTR mRNA sequence shown in SEQ ID NO: 7329; polyA tail of approximately 140 nucleotides not shown in sequence; 5' cap, Cap1; fully modified with 5-methylcytosine and 1-methylpseudouridine; human 3'UTR mRNA sequence shown in SEQ ID NO: 7328; polyA tail of approximately 140 nucleotides not shown in sequence; 5' cap, Cap1; fully modified with 5-methylcytosine and 1-methylpseudouridine), Factor 1× mRNA having a miR-122 sequence in the 3'UTR (FIX miR122; mouse 3' UTR mRNA sequence shown in SEQ ID NO: 7333; polyA tail of approximately 140 nucleotides not shown in sequence; 5' cap, Cap1; fully modified with 5-methylcytosine and 1-methylpseudouridine; human 3'UTR mRNA sequence shown in SEQ ID NO: 7330; polyA tail of approximately 140 nucleotides not shown in sequence; 5' cap, Cap1; fully modified with 5-methylcytosine and 1-methylpseudouridine), Factor 1× mRNA having a miR-122 seed sequence in the 3'UTR (FIX seed; mouse 3' UTR mRNA sequence shown in SEQ ID NO: 7334; polyA tail of approximately 140 nucleotides not shown in sequence; 5' cap, Cap1; fully modified with 5-methylcytosine and 1-methylpseudouridine; human 3'UTR mRNA sequence shown in SEQ ID NO: 7331; polyA tail of approximately 140 nucleotides not shown in sequence; 5' cap, Cap1; fully modified with 5-methylcytosine and 1-methylpseudouridine) or Factor 1× mRNA having a miR-122 sequence without the seed sequence in the 3'UTR (FIX seedless; mouse 3' UTR mRNA sequence shown in SEQ ID NO: 7335; polyA tail of approximately 140 nucleotides not shown in sequence; 5' cap, Cap1; fully modified with 5-methylcytosine and 1-methylpseudouridine; human 3'UTR mRNA sequence shown in SEQ ID NO: 7332; polyA tail of approximately 140 nucleotides not shown in sequence; 5' cap, Cap1; fully modified with 5-methylcytosine and 1-methylpseudouridine) were transfected with 0.3 ul per well of Lipofectamine 2000 at a concentration of 75 ng of mRNA per well in 96 well plates. The supernatant was collected between 16-18 hours after transfection, expression of G-CSF or Factor 1× was measured by ELISA, and the results are shown in Table 53.

TABLE 53

Expression in HeLa

| Description | Protein Expression Mm 3'UTR (ng/ml) | Protein Expression Hs 3'UTR (ng/ml) |
|---|---|---|
| G-CSF | 271.72 | 69.4 |
| G-CSF miR122 | 305.36 | 68.8 |
| G-CSF seed | 209.5 | 98.0 |
| G-CSF seedless | 243.2 | 80.9 |
| FIX | 249.8 | 131.6 |
| FIX mir122 | 204.6 | 55.4 |
| FIX seed | 290.05 | 127.6 |
| FIX seedless | 180.9 | 31.6 |

B. Primary Human and Rat Hepatocytes

Primary human or rat hepatocytes cells were seeded at a density of 350,000 cells per well in 500 ul cell culture medium (InvitroGRO CP and InVitroGRO HI Medium+ 2.2% Torpedo Antibiotic). G-CSF mRNA without a miR-122 sequence in the 3'UTR (G-CSF; mouse 3' UTR mRNA sequence shown in SEQ ID NO: 7321; polyA tail of approximately 140 nucleotides not shown in sequence; 5' cap, Cap1; fully modified with 5-methylcytosine and 1-methylpseudouridine; human 3'UTR mRNA sequence shown in SEQ ID NO: 7320; polyA tail of approximately 140 nucleotides not shown in sequence; 5' cap, Cap1; fully modified with 5-methylcytosine and 1-methylpseudouridine), G-CSF mRNA having a miR-122 sequence in the 3'UTR (G-CSF miR122; mouse 3' UTR mRNA sequence shown in SEQ ID NO: 7325; polyA tail of approximately 140 nucleotides not shown in sequence; 5' cap, Cap1; fully modified with 5-methylcytosine and 1-methylpseudouridine; human 3'UTR mRNA sequence shown in SEQ ID NO: 7322; polyA tail of approximately 140 nucleotides not shown in sequence; 5' cap, Cap1; fully modified with 5-methylcytosine and 1-methylpseudouridine), G-CSF mRNA having a miR-122 seed sequence in the 3'UTR (G-CSF seed; mouse 3' UTR mRNA sequence shown in SEQ ID NO: 7326; polyA tail of approximately 140 nucleotides not shown in sequence; 5' cap, Cap1; fully modified with 5-methylcytosine and 1-methylpseudouridine; human 3'UTR mRNA sequence shown in SEQ ID NO: 7323; polyA tail of approximately 140 nucleotides not shown in sequence; 5' cap, Cap1; fully modified with 5-methylcytosine and 1-methylpseudouridine), G-CSF mRNA having a miR-122 sequence without the seed sequence in the 3'UTR (G-CSF seedless; mouse 3' UTR mRNA sequence shown in SEQ ID NO: 7327; polyA tail of approximately 140 nucleotides not shown in sequence; 5' cap, Cap1; fully modified with 5-methylcytosine and 1-methylpseudouridine; human 3'UTR mRNA sequence shown in SEQ ID NO: 7324; polyA tail of approximately 140 nucleotides not shown in sequence; 5' cap, Cap1; fully modified with 5-methylcytosine and 1-methylpseudouridine), Factor 1x mRNA without a miR-122 sequence in the 3'UTR (FIX; mouse 3' UTR mRNA sequence shown in SEQ ID NO: 7329; polyA tail of approximately 140 nucleotides not shown in sequence; 5' cap, Cap1; fully modified with 5-methylcytosine and 1-methylpseudouridine; human 3'UTR mRNA sequence shown in SEQ ID NO: 7328; polyA tail of approximately 140 nucleotides not shown in sequence; 5' cap, Cap1; fully modified with 5-methylcytosine and 1-methylpseudouridine), Factor 1x mRNA having a miR-122 sequence in the 3'UTR (FIX miR122; mouse 3' UTR mRNA sequence shown in SEQ ID NO: 7333; polyA tail of approximately 140 nucleotides not shown in sequence; 5' cap, Cap1; fully modified with 5-methylcytosine and 1-methylpseudouridine; human 3'UTR mRNA sequence shown in SEQ ID NO: 7330; polyA tail of approximately 140 nucleotides not shown in sequence; 5' cap, Cap1; fully modified with 5-methylcytosine and 1-methylpseudouridine), Factor 1x mRNA having a miR-122 seed sequence in the 3'UTR (FIX seed; mouse 3' UTR mRNA sequence shown in SEQ ID NO: 7334; polyA tail of approximately 140 nucleotides not shown in sequence; 5' cap, Cap1; fully modified with 5-methylcytosine and 1-methylpseudouridine; human 3'UTR mRNA sequence shown in SEQ ID NO: 7331; polyA tail of approximately 140 nucleotides not shown in sequence; 5' cap, Cap1; fully modified with 5-methylcytosine and 1-methylpseudouridine) or Factor 1x mRNA having a miR-122 sequence without the seed sequence in the 3'UTR (FIX seedless; mouse 3' UTR mRNA sequence shown in SEQ ID NO: 7335; polyA tail of approximately 140 nucleotides not shown in sequence; 5' cap, Cap1; fully modified with 5-methylcytosine and 1-methylpseudouridine; human 3'UTR mRNA sequence shown in SEQ ID NO: 7332; polyA tail of approximately 140 nucleotides not shown in sequence; 5' cap, Cap1; fully modified with 5-methylcytosine and 1-methylpseudouridine) were transfected with 1 ul per well of Lipofectamine 2000 at a concentration of 500 ng per well in 24 well plates for the primary human hepatocytes and the primary rat hepatocytes. The supernatant was collected at 24 hours, 48 hours and 72 hours after transfection, expression of G-CSF and Factor 1x was measured by ELISA, and the results are shown in Table 54. The mir-122 binding site sequence in the mRNA dampened the G-CSF and Factor 1x protein expression in the primary hepatocytes.

TABLE 54

G-CSF Expression in Hepatocytes

| Description | Time Point | Primary Human Hepatocytes Protein Expression (ng/ml) Mm 3'UTR | Primary Human Hepatocytes Protein Expression (ng/ml) Hs 3'UTR |
|---|---|---|---|
| G-CSF | 24 hours | 43.9 | 84.9 |
| | 48 hours | 18.8 | 100.4 |
| | 72 hours | 5.7 | 21.3 |
| G-CSF miR122 | 24 hours | 6.9 | 24.0 |
| | 48 hours | .7 | 3.03 |
| | 72 hours | .12 | .88 |
| G-CSF seed | 24 hours | 48.5 | 115.8 |
| | 48 hours | 25.6 | 96.4 |
| | 72 hours | 8.2 | 19.2 |
| G-CSF seedless | 24 hours | 31.7 | 113.1 |
| | 48 hours | 11.7 | 92.9 |
| | 72 hours | 3.4 | 18.9 |
| FIX | 24 hours | 90.8 | 63.2 |
| | 48 hours | 159.6 | 124.8 |
| | 72 hours | 70.5 | 44.3 |
| FIX mir122 | 24 hours | 11.8 | 15.9 |
| | 48 hours | 5.0 | 4.4 |
| | 72 hours | 1.0 | .4 |
| FIX seed | 24 hours | 77.2 | 60.2 |
| | 48 hours | 115.0 | 63.0 |
| | 72 hours | 41.7 | 20.1 |
| FIX seedless | 24 hours | 69.3 | 53.7 |
| | 48 hours | 123.8 | 75.0 |
| | 72 hours | 49.0 | 24.5 |

Example 59. Time Course of Modified Nucleic Acids with a Mir-122 Sequence in Cancer Cells A. Base Level of miR-122

The base level of mir-122 in Human hepatocytes, rat hepatocytes, human hepatocellular carcinoma cells (Hep3B) and HeLa cells were determined by TAQMAN® analysis using the manufacturers protocol. The levels were normalized to U6 and the results are shown in Table 55.

TABLE 55 miR-122 Levels in Various Cell Types

| Cell Type | miR-122 level (normalized to U6) |
|---|---|
| Human Hepatocytes | 16.8 |
| Rat Hepatocytes | 10.9 |
| Hep3B | 0 |
| HeLa | 0 |

B. Primary Human Hepatocytes and Hep3B Cells

Primary human hepatocytes were seeded at a density of 50,000 cells per well in 100 ul cell culture medium (InvitroGRO CP and InVitroGRO HI Medium+2.2% Torpedo Antibiotic Mix) and Hep3B cells were seeded at a density of 20,000 cells per well in 100 ul cell culture medium MEM+ 10% FBS. G-CSF mRNA without a miR-122 sequence in the 3'UTR (G-CSF; mRNA sequence shown in SEQ ID NO: 7320; polyA tail of approximately 140 nucleotides not shown in sequence; 5' cap, cap1; fully modified with 5-methylcytosine and 1-methylpseudouridine), G-CSF mRNA having a miR-122 sequence in the 3'UTR (G-CSF miR122; mRNA sequence shown in SEQ ID NO: 7322; polyA tail of approximately 140 nucleotides not shown in sequence; 5' cap, cap1; fully modified with 5-methylcytosine and 1-methylpseudouridine), G-CSF mRNA having a miR-122 seed sequence in the 3'UTR (G-CSF seed; mRNA sequence shown in SEQ ID NO: 7323; polyA tail of approximately 140 nucleotides not shown in sequence; 5' cap, cap1; fully modified with 5-methylcytosine and 1-methylpseudouridine) or G-CSF mRNA having a miR-122 sequence without the seed sequence in the 3'UTR (G-CSF seedless; mRNA sequence shown in SEQ ID NO: 7324; polyA tail of approximately 140 nucleotides not shown in sequence; 5' cap, Cap1; fully modified with 5-methylcytosine and 1-methylpseudouridine) were transfected with 0.3 ul per well of Lipofectamine 2000 at a concentration of 75 ng of mRNA per well in 96 well plates for the primary human hepatocytes and the Hep3B cells. The supernatant was collected at 24 hours, 48 hours and 72 hours after transfection, expression of G-CSF was measured by ELISA, and the results are shown in Table 56. The mir-122 binding site sequence in the mRNA dampened the G-CSF protein expression in the primary human hepatocytes but not in the Hep3B cells.

TABLE 56

G-CSF Expression

| Description | Time Point | Primary Human Hepatocytes Protein Expression (ng/ml) Hs 3'UTR | Hep3B Protein Expression (ng/ml) Hs 3'UTR |
|---|---|---|---|
| G-CSF | 24 hours | 76 | 55 |
| | 48 hours | 12 | 33 |
| | 72 hours | 6 | 10 |
| G-CSF miR122 | 24 hours | 32 | 37 |
| | 48 hours | 1 | 27 |
| | 72 hours | 0 | 6 |
| G-CSF seed | 24 hours | 75 | 39 |
| | 48 hours | 11 | 28 |
| | 72 hours | 4 | 6 |
| G-CSF seedless | 24 hours | 79 | 49 |
| | 48 hours | 15 | 35 |
| | 72 hours | 6 | 9 |

Example 60. Time Course of Modified Nucleic Acids with a Mir-142 3p Sequence

A. Base Level of miR-143 0.3p

The base level of miR-142 3p in RAW264.7 cells and HeLa cells were determined by TAQMAN® analysis using the manufacturer's protocol. The levels were normalized to U6 and the results are shown in Table 57.

TABLE 57 miR-142 3p Levels in Various Cell Types

| Cell Type | miR-122 level (normalized to U6) |
|---|---|
| Human Hepatocytes | 16.8 |
| Rat Hepatocytes | 10.9 |
| Hep3B | 0 |
| HeLa | 0 |

B. HeLa and RAW264.7 Cells

HeLa cells were seeded at a density of 17,000 per well in 100 ul cell culture medium DMEM+10% FBS and RAW264.7 cells were seeded at a density of 200,000 per well in 100 ul cell culture medium DMEM+10% FBS. G-CSF mRNA without a miR-142 3p sequence in the 3'UTR (G-CSF; mRNA sequence shown in SEQ ID NO: 7522; polyA tail of approximately 140 nucleotides not shown in sequence; 5' cap, Cap1; fully modified with 5-methylcytosine and 1-methylpseudouridine), G-CSF mRNA having a miR-142 3p sequence in the 3'UTR (G-CSF miR142 3p; mRNA sequence shown in SEQ ID NO: 7523; polyA tail of approximately 140 nucleotides not shown in sequence; 5' cap, Cap1; fully modified with 5-methylcytosine and 1-methylpseudouridine), G-CSF mRNA having a miR-142 3p seed sequence in the 3'UTR (G-CSF seed; mRNA sequence shown in SEQ ID NO: 7524; polyA tail of approximately 140 nucleotides not shown in sequence; 5' cap, cap1; fully modified with 5-methylcytosine and 1-methylpseudouridine) or G-CSF mRNA having a miR-142 3p sequence without the seed sequence in the 3'UTR (G-CSF seedless; mRNA sequence shown in SEQ ID NO: 7525; polyA tail of approximately 140 nucleotides not shown in sequence; 5' cap, Cap1; fully modified with 5-methylcytosine and 1-methylpseudouridine) were transfected with 0.3 ul per well of Lipofectamine 2000 at a concentration of 75 ng of mRNA per well in 96 well plates for HeLa or with 1 ul per well of Lipofectamine 2000 at a concentration of 250 ng of mRNA per well in 24 well plates for RAW264.7 cells. The supernatant was collected 16-18 hours after transfection, expression of G-CSF was measured by ELISA, and the results are shown in Table 58. miR-142 3p sites in G-CSF were shown to down-regulate G-CSF expression in RAW264.7 cells.

TABLE 58

Expression

| Description | HeLa Protein Expression (ng/ml) | RAW264.7 Protein Expression (ng/ml) |
|---|---|---|
| G-CSF | 243.5 | 124.8 |
| G-CSF miR142 3p | 309.1 | 42.8 |
| G-CSF seed | 259.8 | 148.1 |
| G-CSF seedless | 321.7 | 185.2 |

C. Time Course in RAW264.7 Cells

RAW264.7 cells were seeded at a density of 60,000 cells per well in 100 ul cell culture medium (DMEM+10% FBS). G-CSF mRNA without a miR-142 3p sequence in the 3'UTR (G-CSF; mRNA sequence shown in SEQ ID NO: 7522; polyA tail of approximately 140 nucleotides not shown in sequence; 5' cap, Cap1; fully modified with 5-methylcytosine and 1-methylpseudouridine), G-CSF mRNA having a miR-142 3p sequence in the 3'UTR (G-CSF miR142 3p; mRNA sequence shown in SEQ ID NO: 7523; polyA tail of approximately 140 nucleotides not shown in sequence; 5' cap, Cap1; fully modified with 5-methylcytosine and 1-methylpseudouridine), G-CSF mRNA having a miR-142 3p seed sequence in the 3'UTR (G-CSF seed; mRNA sequence shown in SEQ ID NO: 7524; polyA tail of approximately 140 nucleotides not shown in sequence; 5' cap, cap1; fully modified with 5-methylcytosine and 1-methylpseudouridine) or G-CSF mRNA having a miR-142 3p sequence without the seed sequence in the 3'UTR (G-CSF seedless; mRNA sequence shown in SEQ ID NO: 7525; polyA tail of approximately 140 nucleotides not shown in sequence; 5' cap, Cap1; fully modified with 5-methylcytosine and 1-methylpseudouridine) were transfected with 0.3 ul per well of Lipofectamine 2000 at a concentration of 75 ng of mRNA per well in 96 well plates. The supernatant was collected at 24 hours, 48 hours and 72 hours after transfection, expression of G-CSF was measured by ELISA, and the results are shown in Table 59. The mir-142 3p binding site sequence in the mRNA showed a strong suppression of G-CSF expression in RAW264.7 cells over time.

TABLE 59

G-CSF Expression

| Description | Time Point | RAW264.7 Cells Protein Expression (ng/ml) |
|---|---|---|
| G-CSF | 24 hours | 133.5 |
|  | 48 hours | 69.7 |
|  | 72 hours | 2.1 |
| G-CSF miR142 3p | 24 hours | 60.1 |
|  | 48 hours | 9.2 |
|  | 72 hours | .3 |
| G-CSF seed | 24 hours | 244.9 |
|  | 48 hours | 68.9 |
|  | 72 hours | 2.3 |
| G-CSF seedless | 24 hours | 250.2 |
|  | 48 hours | 95.9 |
|  | 72 hours | 3.0 |

D. miR-142 3p in PBMC

Peripheral blood mononuclear cells (PBMCs) were seeded at a density of 150,000 cells per well in 100 ul cell culture medium (Opti-MEM and after transfection add 10% FBS). G-CSF mRNA having a miR-142 3p sequence in the 3'UTR (G-CSF miR142 3p; mRNA sequence shown in SEQ ID NO: 7523; polyA tail of approximately 140 nucleotides not shown in sequence; 5' cap, Cap1; fully modified with 5-methylcytosine and 1-methylpseudouridine), G-CSF mRNA having a miR-142 3p seed sequence in the 3'UTR (G-CSF seed; mRNA sequence shown in SEQ ID NO: 7524; polyA tail of approximately 140 nucleotides not shown in sequence; 5' cap, cap1; fully modified with 5-methylcytosine and 1-methylpseudouridine) or G-CSF mRNA having a miR-142 3p sequence without the seed sequence in the 3'UTR (G-CSF seedless; mRNA sequence shown in SEQ ID NO: 7525; polyA tail of approximately 140 nucleotides not shown in sequence; 5' cap, cap1; fully modified with 5-methylcytosine and 1-methylpseudouridine) were transfected in triplicate with 0.4 ul per well of Lipofectamine 2000 at a concentration of 500 ng of mRNA per well in 96 well plates for 2 or 3 donors. The supernatant was collected at 24 hours after transfection and the expression of G-CSF was measured by ELISA. The results for the 2 donors are shown in Table 60 and the results for the 3 donors are shown in Table 61. The mir-142 3p binding site sequence in the mRNA was shown to down regulate G-CSF expression in human PBMC.

TABLE 60

Expression PBMC (2 donors)

| Description | Protein Expression (ng/ml) |
|---|---|
| G-CSF miR142 3p | 5.09 |
| G-CSF seed | 10.06 |
| G-CSF seedless | 9.38 |

TABLE 61

Expression PBMC (3 donors)

| Description | Protein Expression (ng/ml) |
|---|---|
| G-CSF miR142 3p | 7.48 |
| G-CSF seed | 13.40 |
| G-CSF seedless | 13.98 |

Other Embodiments

It is to be understood that the words which have been used are words of description rather than limitation, and that changes may be made within the purview of the appended claims without departing from the true scope and spirit of the invention in its broader aspects.

While the present invention has been described at some length and with some particularity with respect to the several described embodiments, it is not intended that it should be limited to any such particulars or embodiments or any particular embodiment, but it is to be construed with references to the appended claims so as to provide the broadest possible interpretation of such claims in view of the prior art and, therefore, to effectively encompass the intended scope of the invention.

All publications, patent applications, patents, and other references mentioned herein are incorporated by reference in their entirety. In case of conflict, the present specification, including definitions, will control. In addition, section headings, the materials, methods, and examples are illustrative only and not intended to be limiting.

SEQUENCE LISTING (7525 sequences)

SEQ ID NO: 1 - DNA, 47 bp, Homo sapiens
gggaaataagagagaaaagaagagtaagaagaaatataagagccacc

SEQ ID NO: 2 - DNA, 47 bp, Homo sapiens
gggagatcagagagaaaagaagagtaagaagaaatataagagccacc

SEQ ID NO: 3 - DNA, 145 bp, Homo sapiens
ggaataaaagtctcaacacaacatatacaaaacaaacgaatctcaagcaatcaagcattctacttctattgcagcaatttaaatcatttcttttaaagcaaaagcaattttctgaaaattttcaccatttacgaacgatagcaac

SEQ ID NO: 4 - RNA, 42 nt, Homo sapiens
gggagacaagcuuggcauuccgguacuguugguaaagccacc

SEQ ID NO: 5 - DNA, 371 bp, Homo sapiens
gcgcctgcccacctgccaccgactgctggaacccagccagtgggagggcctggcccaccagagtcctgctccctcactcctcgccccgccccctgtcccagagtcccacctgggggctctctccacccttctcagagttccagtttcaaccagagttccaaccaatgggctccatcctctggattctggccaatgaaatatctccctggcagggtcctcttcttttcccagagctccaccccaaccaggagctctagttaatggagagctcccagcacactcggagcttgtgctttgtctccacgcaaagcgataaataaaagcattggtggcctttggtctttgaataaagcctgagtaggaagtctaga

SEQ ID NO: 6 - DNA, 568 bp, Homo sapiens
gcccctgccgctcccacccccacccatctgggccccgggttcaagagagagcggggtctgatctcgtgtagccatatagagtttgcttctgagtgtctgctttgtttagtagaggtgggcaggaggagctgaggggctggggctggggtgttgaagttggctttgcatgcccagcgatgcgcctccctgtgggatgtcatcaccctgggaaccgggagtggcccttggctcactgtgttctgcatggtttggatctgaattaattgtcctttcttctaaatcccaaccgaacttcttccaacctccaaactggctgtaaccccaaatccaagccattaactacacctgacagtagcaattgtctgattaatcactggccccttgaagacagcagaatgtccctttgcaatgaggaggagatctgggctgggcgggccagctggggaagcatttgactatctggaacttgtgtgtgcctcctcaggtatggcagtgactcacctggttttaataaaacaacctgcaacatctcatggtctttgaataaagcctgagtaggaagtctaga

SEQ ID NO: 7 - DNA, 289 bp, Homo sapiens
acacactccacctccagcacgcgacttctcaggacgacgaatcttctcaatgggggggcggctgagctccagccaccccgcagtcactttctttgtaacaacttccgttgctgccatcgtaaactgacacagtgtttataacgtgtacatacattaacttattacctcattttgttatttttcgaaacaaagccctgtggaagaaaatggaaaacttgaagaagcattaaagtcattctgttaagctgcgtaaatggtctttgaataaagcctgagtaggaagtctaga

SEQ ID NO: 8 - DNA, 379 bp, Homo sapiens
catcacatttaaaagcatctcagcctaccatgagaataagagaaagaaaatgaagatcaaaagcttattcatctgtttttctttttcgttggtgtaaagccaacaccctgtctaaaaaacataaatttctttaatcattttgcctcttttctctgtgcttcaattaataaaaaatggaaagaatctaatagagtggtacagcactgttatttttcaaagatgtgttgctatcctgaaaattctgtaggttctgtggaagttccagtgttctctcttattccacttcggtagaggatttctagtttcttgtgggctaattaaataaatcattaatactcttctaatggtctttgaataaagcctgagtaggaagtctaga

SEQ ID NO: 9 - DNA, 118 bp, Mus sp.
gctgccttctgcggggcttgccttctggccatgcccttcttctctcccttgcacctgtacctcttggtctttgaataaagcctgagtaggaaggcggccgctcgagcatgcatctaga

SEQ ID NO: 10 - DNA, 908 bp, Homo sapiens
gccaagccctccccatcccatgtatttatctctatttaatatttatgtctatttaagcctcatatttaaagacagggaagagcagaacggagccccaggcctctgtgtccttccctgcatttctgagtttcattctcctgcctgtagcagtgagaaaaagctcctgtcctcccatcccctggactgggaggtagataggtaaataccaagtatttattactatgactgctccccagccctggctctgcaatgggcactgggatgagccgctgtgagcccctggtcctgagggtccccacctgggacccttgagagtatcaggtctcccacgtgggagacaagaaatccctgtttaatatttaaacagcagtgttccccatctgggtccttgcacccctcactctggcctcagccgactgcacagcggcccctgcatccccttggctgtgaggcccctggacaagcagaggtggccagagctgggaggcatggccctggggtcccacgaatttgctggggaatctcgtttttcttcttaagacttttgggacatggtttgactcccgaacatcaccgacgcgtctcctgtttttctgggtggcctcgggacacctgccctgcccccacgagggtcaggactgtgactctttttagggccaggcaggtgcctggacatttgccttgctggacggggactggggatgtgggagggagcagacaggaggaatcatgtcaggcctgtgtgtgaaaggaagctccactgtcaccctccacctcttcaccccccactcaccagtgtcccctccactgtcacattgtaactgaacttcaggataataaagtgtttgcctccatggtctttgaataaagcctgagtaggaaggcggccgctcgagcatgcatctaga

SEQ ID NO: 11 - DNA, 835 bp, Homo sapiens
actcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttcccccgctcccccaaaaatttgaatttttttttcaacactcttacacctgttatggaaaatgtcaacctttgtaagaaaaccaaaataaaaattgaaaaataaaaaccataaacatttgcaccacttgtggcttttgaatatcttccacagagggaagtttaaaacccaaacttccaaaggtttaaactacctcaaaacactttcccatgagtgtgatccacattgttaggtgctgacctagacagagatgaactgaggtccttgttttgttttgttcataatacaaaggtgctaattaatagtatttcagatacttgaagaatgttgatggtgctagaagaatttgagaagaaatactcctgtattgagttgtatcgtgtggtgtattttttaaaaaatttgatttagcattcatattttccatcttattcccaattaaaagtatgcagattatttgcccaaatcttcttcagattcagcatttgttctttgccagtctcattttcatcttcttccatggttccacagaagctttgtttcttgggcaagcagaaaaattaaattgtacctattttgtatatgtgagatgtttaaataaattgtgaaaaaaatgaaataaagcatgtttggttttccaaaagaacatat

SEQ ID NO: 12 - DNA, 297 bp, Homo sapiens
cgccgccgcccgggccccgcagtcgagggtcgtgagcccaccccgtccatggtgctaagcgggcccgggtcccacacggccagcaccgctgctcactcggacgacgccctgggcctgcacctctccagctcctcccacggggtccccgtagccccggcccccgcccagccccaggtctccccaggccctccgcaggctgcccggcctccctccccctgcagccatcccaaggctcctgacctacctggcccctgagctctggagcaagccctgacccaataaaggctttgaacccat

SEQ ID NO: 13 - DNA, 602 bp, Homo sapiens
ggggctagagccctctccgcacagcgtggagacggggcaaggaggggggttattaggattggtggttttgttttgctttgtttaaagccgtgggaaaatggcacaactttacctctgtgggagatgcaacactgagagccaaggggtgggagttgggataatttttatataaaagaagtttttccactttgaattgctaaaagtggcatttttcctatgtgcagtcactcctctcatttctaaaatagggacgtggccaggcacggtggctcatgcctgtaatcccagcactttgggaggccgaggcaggcggctcacgaggtcaggagatcgagactatcctggctaacacggtaaaaccctgtctctactaaaagtacaaaaaattagctgggcgtggtggtgggcacctgtagtcccagctactcgggaggctgaggcaggagaaaggcatgaatccaagaggcagagcttgcagtgagctgagatcacgccattgcactccagcctgggcaacagtgttaagactctgtctcaaatataaataaataaataaataaataaataaataaataaaaataaagcgagatgttgccctcaaa

SEQ ID NO: 14 - DNA, 785 bp, Homo sapiens
ggccctgccccgtcggactgcccccagaaagcctcctgccccctgccagtgaagtccttcagtgagcccctccccagccagcccttccctggccccgccggatgtataaatgtaaaaatgaaggaattacattttatatgtgagcgagcaagccggcaagcgagcacagtattatttctccatcccctccctgcctgctccttggcacccccatgctgccttcagggagacaggcagggagggcttggggctgcacctcctaccctcccaccagaacgcaccccactgggagagctggtggtgcagccttcccctccctgtataagacactttgccaaggctctcccctctcgccccatccctgcttgcccgctcccacagcttcctgagggctaattctgggaagggagagttctttgctgcccctgtctggaagacgtggctctgggtgaggtaggcgggaaaggatggagtgttttagttcttgggggaggccaccccaaaccccagccccaactccaggggcacctatgagatggccatgctcaacccccctcccagacaggccctccctgtctccagggcccccaccgaggttcccagggctggagacttcctctggtaaacattcctccagcctcccctcccctggggacgccaaggaggtgggccacacccaggaagggaaagcgggcagccccgttttggggacgtgaacgttttaataatttttgctgaattcctttacaactaaataacacagatattgttataaataaaattgt

SEQ ID NO: 15 - DNA, 3001 bp, Homo sapiens
atattaaggatcaagctgttagctaataatgccacctctgcagttttgggaacaggcaaataaagtatcagtatacatggtgatgtacatctgtagcaaagctcttggagaaaatgaagactgaagaaagcaaagcaaaaactgtatagagagatttttcaaaagcagtaatccctcaattttaaaaaaggattgaaaattctaaatgtctttctgtgcatattttttgtgttaggaatcaaaagtattttataaaaggagaaagaacagcctcattttagatgtagtcctgttggattttttatgcctcctcagtaaccagaaatgttttaaaaaactaagtgtttaggatttcaagacaacattatacatggctctgaaatatctgacacaatgtaaacattgcaggcacctgcattttatgttttttttttcaacaaatgtgactaatttgaaacttttatgaacttctgagctgtccccttgcaattcaaccgcagtttgaattaatcatatcaaatcagttttaattttttaaattgtacttcagagtctatatttcaagggcacattttctcactactattttaatacattaaaggactaaataatctttcagagatgctggaaacaaatcatttgctttatatgtttcattagaataccaatgaaacatacaacttgaaaattagtaatagtatttttgaagatcccatttctaattggagatctctttaatttcgatcaacttataatgtgtagtactatattaagtgcacttgagtggaattcaacatttgactaataaaatgagttcatcatgttggcaagtgatgtggcaattatctctggtgacaaaagagtaaaatcaaatatttctgcctgttacaaatatcaaggaagacctgctactatgaaatagatgacattaatctgtcttcactgtttataatacggatggattttttttcaaatcagtgtgtgttttgaggtcttatgtaattgatgacatttgagagaaatggtggctttttttagctacctctttgttcatttaagcaccagtaaagatcatgtctttttatagaagtgtagattttctttgtgactttgctatcgtgcctaaagctctaaatataggtgaatgtgtgatgaatactcagattatttgtctctctatataattagtttggtactaagtttctcaaaaaattattaacacatgaaagacaatctctaaaccagaaaaagaagtagtacaaattttgttactgtaatgctcgcgtttagtgagtttaaaacacacagtatcttttggttttataatcagtttctattttgctgtgcctgagattaagatctgtgtatgtgtgtgtgtgtgtgtgtgcgtttgtgtgttaaagcagaaaagacttttttaaaagttttaagtgataaatgcaatttgttaattgatcttagatcactagtaaactcagggctgaattataccatgtatattctattagaagaaagtaaacaccatctttattcctgccctttttcttctctcaaagtagttgtagttatatctagaaagaagcaattttgatttcttgaaaaggtagttcctgcactcagtttaaactaaaaataatcatacttggattttatttatttttgtcatagtaaaaattttaatttatatatatttttatttagtattatcttattctttgctatttgccaatcctttgtcatcaattgtgttaaatgaattgaaaattcatgccctgttcattttattttactttattggttaggatatttaaaggatttttgtatatataatttcttaaattaatattccaaaaggttagtggacttagattataaattatggcaaaaatctaaaaacaacaaaaatgatttttatacattctatttcattattcctctttttccaataagtcatacaattggtagatatgacttattttatttttgtattattcactatatctttatgatatttaagtataaataattaaaaaaatttattgtaccttatagtctgtcaccaaaaaaaaaaaattatctgtaggtagtgaaatgctaatgttgatttgtctttaagggcttgttaactatcctttattttctcatttgtcttaaattaggagtttgtgtttaaattactcatctaagcaaaaaatgtatataaatcccattactgggtatatacccaaaggattataaatcatgctgctataaagacacatgcacacgtatgtttattgcagcactattcacaatagcaaagacttggaaccaacccaaatgtccatcaatgatagacttgattaagaaaatgtgcacatatacaccatggaatactatgcagccataaaaaaggatgagttcatgtcctttgtagggacatggataaagctggaaaccatcattctgagcaaactattgcaaggacagaaaaccaaacactgcatgttctcactcataggtgggaattgaacaatgagaacacttggacacaaggtggggaacaccacacaccagggcctgtcatggggtggggggagtggggagggatagcattaggagatatacctaatgtaaatgatgagttaatgggtgcagcacaccaacatggcacatgtatacatatgtagcaaacctgcacgttgtgcacatgtaccctagaacttaaagtataattaaaaaaaaaaagaaaacagaagctatttataaagaagttatttgctgaaataaatgtgatctttcccattaaaaaaataaagaaattttggggtaaaaaaacacaatatattgtattcttgaaaaattctaagagagtggatgtgaagtgttctcaccacaaaagtgataactaattgaggtaatgcacatattaattagaaagattttgtcattccacaatgtatatatacttaaaaatatgttatacacaataaatacatacattaaaaaataagtaaatgta

SEQ ID NO: 16 - DNA, 1037 bp, Homo sapiens
cccaccctgcacgccggcaccaaaccctgtcctcccacccctccccactcatcactaaacagagtaaaatgtgatgcgaattttcccgaccaacctgattcgctagattttttttaaggaaaagcttggaaagccaggacacaacgctgctgcctgctttgtgcagggtcctccggggctcagccctgagttggcatcacctgcgcagggccctctggggctcagccctgagctagtgtcacctgcacagggccctctgaggctcagccctgagctggcgtcacctgtgcagggccctctggggctcagccctgagctggcctcacctgggttccccaccccgggctctcctgccctgccctcctgcccgccctccctcctgcctgcgcagctccttccctaggcacctctgtgctgcatcccaccagcctgagcaagacgccctctcggggcctgtgccgcactagcctccctctcctctgtccccatagctggtttttcccaccaatcctcacctaacagttactttacaattaaactcaaagcaagctcttctcctcagcttggggcagccattggcctctgtctcgttttgggaaaccaaggtcaggaggccgttgcagacataaatctcggcgactcggccccgtctcctgagggtcctgctggtgaccggcctggaccttggccctacagccctggaggccgctgctgaccagcactgaccccgacctcagagagtactcgcaggggcgctggctgcactcaagaccctcgagattaacggtgctaaccccgtctgctcctccctcccgcagagactggggcctggactggacatgagagccccttggtgccacagagggctgtgtcttactagaaacaacgcaaacctctccttcctcagaatagtgatgtgttcgacgttttatcaaaggccccctttctatgttcatgttagttttgctccttctgtgtttttttctgaaccatatccatgttgctgacttttccaaataaaggttttcactcctctc

SEQ ID NO: 17 - DNA, 577 bp, Homo sapiens
agaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 18 - DNA, 2212 bp, Homo sapiens
ctccctccatcccaacctggctccctcccacccaaccaactttccccccaacccggaaacagacaagcaacccaaactgaaccccctcaaaagccaaaaaatgggagacaatttcacatggactttggaaaatatttttttcctttgcattcatctctcaaacttagtttttatctttgaccaaccgaacatgaccaaaaaccaaaagtgcattcaaccttaccaaaaaaaaaaaaaaaaaaagaataaataaataactttttaaaaaaggaagcttggtccacttgcttgaagacccatgcgggggtaagtccctttctgcccgttgggcttatgaaaccccaatgctgccctttctgctcctttctccacaccccccttggggcctcccctccactccttcccaaatctgtctccccagaagacacaggaaacaatgtattgtctgcccagcaatcaaaggcaatgctcaaacacccaagtggcccccaccctcagcccgctcctgcccgcccagcacccccaggccctgggggacctggggttctcagactgccaaagaagccttgccatctggcgctcccatggctcttgcaacatctccccttcgtttttgagggggtcatgccgggggagccaccagcccctcactgggttcggaggagagtcaggaagggccacgacaaagcagaaacatcggatttggggaacgcgtgtcaatcccttgtgccgcagggctgggcgggagagactgttctgttccttgtgtaactgtgttgctgaaagactacctcgttcttgtcttgatgtgtcaccggggcaactgcctgggggcggggatgggggcagggtggaagcggctccccattttataccaaaggtgctacatctatgtgatgggtggggtggggagggaatcactggtgctatagaaattgagatgcccccccaggccagcaaatgttcctttttgttcaaagtctatttttattccttgatatttttctttttttttttttttttttgtggatggggacttgtgaatttttctaaaggtgctatttaacatgggaggagagcgtgtgcggctccagcccagcccgctgctcactttccaccctctctccacctgcctctggcttctcaggcctctgctctccgacctctctcctctgaaaccctcctccacagctgcagcccatcctcccggctccctcctagtctgtcctgcgtcctctgtccccgggtttcagagacaacttcccaaagcacaaagcagtttttccccctaggggtgggaggaagcaaaagactctgtacctattttgtatgtgtataataatttgagatgtttttaattattttgattgctggaataaagcatgtggaaatgacccaaacataatccgcagtggcctcctaatttccttctttggagttgggggaggggtagacatggggaaggggctttggggtgatgggcttgccttccattcctgccctttccctccccactattctcttctagatccctccataaccccactcccctttctctcacccttcttataccgcaaacctttctacttcctctttcattttctattcttgcaatttccttgcaccttttccaaatcctcttctcccctgcaataccatacaggcaatccacgtgcacaacacacacacacactcttcacatctggggttgtccaaacctcatacccactccccttcaagcccatccactctccaccccctggatgccctgcacttggtggcggtgggatgctcatggatactgggagggtgaggggagtggaacccgtgaggaggacctgggggcctctccttgaactgacatgaagggtcatctggcctctgctcccttctcacccacgctgacctcctgccgaaggagcaacgcaacaggagaggggtctgctgagcctggcgagggtctgggagggaccaggaggaaggcgtgctccctgctcgctgtcctggccctgggggagtgagggagacagacacctgggagagctgtggggaaggcactcgcaccgtgctcttgggaaggaaggagacctggccctgctcaccacggactgggtgcctcgacctcctgaatccccagaacacaacccccctgggctggggtggtctggggaaccatcgtgcccccgcctcccgcctactcctttttaagctt

SEQ ID NO: 19 - DNA, 729 bp, Homo sapiens
ttggccaggcctgaccctcttggacctttcttctttgccgacaaccactgcccagcagcctctgggacctcggggtcccagggaacccagtccagcctcctggctgttgacttcccattgctcttggagccaccaatcaaagagattcaaagagattcctgcaggccagaggcggaacacacctttatggctggggctctccgtggtgttctggacccagcccctggagacaccattcacttttactgctttgtagtgactcgtgctctccaacctgtcttcctgaaaaaccaaggcccccttcccccacctcttccatggggtgagacttgagcagaacaggggcttccccaagttgcccagaaagactgtctgggtgagaagccatggccagagcttctcccaggcacaggtgttgcaccagggacttctgcttcaagttttggggtaaagacacctggatcagactccaagggctgccctgagtctgggacttctgcctccatggctggtcatgagagcaaaccgtagtcccctggagacagcgactccagagaacctcttgggagacagaagaggcatctgtgcacagctcgatcttctacttgcctgtggggaggggagtgacaggtccacacaccacactgggtcaccctgtcctggatgcctctgaagagagggacagaccgtcagaaactggagagtttctattaaaggtcatttaaacca

SEQ ID NO: 20 - DNA, 847 bp, Homo sapiens
tcctccgggaccccagccctcaggattcctgatgctccaaggcgactgatgggcgctggatgaagtggcacagtcagcttccctgggggctggtgtcatgttgggctcctggggcgggggcacggcctggcatttcacgcattgctgccaccccaggtccacctgtctccactttcacagcctccaagtctgtggctcttcccttctgtcctccgaggggcttgccttctctcgtgtccagtgaggtgctcagtgatcggcttaacttagagaagcccgccccctccccttctccgtctgtcccaagagggtctgctctgagcctgcgttcctaggtggctcggcctcagctgcctgggttgtggccgccctagcatcctgtatgcccacagctactggaatccccgctgctgctccgggccaagcttctggttgattaatgagggcatggggtggtccctcaagaccttcccctaccttttgtggaaccagtgatgcctcaaagacagtgtcccctccacagctgggtgccaggggcaggggatcctcagtatagccggtgaaccctgataccaggagcctgggcctccctgaacccctggcttccagccatctcatcgccagcctcctcctggacctcttggcccccagccccttccccacacagccccagaagggtcccagagctgaccccactccaggacctaggcccagcccctcagcctcatctggagcccctgaagaccagtcccacccacctttctggcctcatctgacactgctccgcatcctgctgtgtgtcctgttccatgttccggttccatccaaatacactttctggaacaaa

SEQ ID NO: 21 - DNA, 110 bp, Homo sapiens
gctggagcctcggtggccatgcttcttgccccttgggcctccccccagcccctcctccccttcctgcacccgtacccccgtggtctttgaataaagtctgagtgggcggc

SEQ ID NO: 22 - DNA, 27 bp, Homo sapiens
ttggaccctcgtacagaagctaatacg

SEQ ID NO: 23 - DNA, 189 bp, Homo sapiens
ttttttttttttttttttttttttttttttttttttttttttttttttttttttttttttttttttttttttttttttttttttttttttttttttttttttttttttttttttttttttttttttttttttttttttttttttttttttttttttttttcttcctactcaggctttattcaaagacca

SEQ ID NO: 24 - DNA, 20 bp, Homo sapiens
ccttgaccttctggaacttc

SEQ ID NO: 25 - DNA, 20 bp, Homo sapiens
ccaagcactgaaacggatat

SEQ ID NO: 26 - DNA, 20 bp, Homo sapiens
gatgaaaagtgctccaagga

SEQ ID NO: 27 - DNA, 20 bp, Homo sapiens
aaccgtgatgaaaaggtacc

SEQ ID NO: 28 - DNA, 20 bp, Homo sapiens
tcatgcagattggaaaggtc

SEQ ID NO: 29 - DNA, 20 bp, Homo sapiens
cttcttggactgtccagagg

SEQ ID NO: 30 - DNA, 20 bp, Homo sapiens
gcagtccctgatacaagaac

SEQ ID NO: 31 - DNA, 20 bp, Homo sapiens
gattgaaggtggctcgctac

SEQ ID NO: 32 - DNA, 75 bp, Homo sapiens
atgatgccatcctcagtctcatggggtattttgctcttggcgggtctgtgctgtctcgtgccggtgtcgctcgca

SEQ ID NO: 33 - DNA, 90 bp, Homo sapiens
atggccggaccggcgactcagtcgcccatgaaactcatggccctgcagttgttgctttggcactcagccctctggaccgtccaagaggcg

SEQ ID NO: 34 - DNA, 137 bp, Homo sapiens
atgcagagagtgaacatgattatggccgagtccccatcgctcatcacaatctgcctgcttggtacctgctttccgccgaatgcactgtctttctggatcacgagaatgcgaataagatcttgaaccgacccaaacgg

SEQ ID NO: 35 - DNA, 63 bp, Homo sapiens
atgaaaggatcattgctgttgctcctcgtgtcgaaccttctgctttgccagtccgtagccccc

SEQ ID NO: 36 - DNA, 72 bp, Homo sapiens
atgaaatgggtgacgttcatctcactgttgtttttgttctcgtccgcctactccaggggagtattccgccga

SEQ ID NO: 37 - DNA, 63 bp, Homo sapiens
atgtggtggcggctctggtggctgctcctgttgctcctcttgctgtggcccatggtgtgggca

SEQ ID NO: 38 - DNA, 95 bp, Homo sapiens
tgctctttaacctccgcatcctgttgaataacgctgcgttccgaaatgggcataacttcatggtacgcaacttcagatgcggccagccactccag

SEQ ID NO: 39 - DNA, 87 bp, Homo sapiens
atgtccgtcttgacacccctgctcttgagagggctgacggggtccgctagacgcctgccggtaccgcgagcgaagatccactccctg

SEQ ID NO: 40 - DNA, 87 bp, Homo sapiens
atgagcgtgctcactccgttgcttcttcgagggcttacgggatcggctcggaggttgcccgtcccgagagcgaagatccattcgttg

SEQ ID NO: 41 - DNA, 175 bp, Artificial Sequence
  Description of Artificial Sequence: Bacterial Signal Sequence
tgacaaaaataactttatctccccagaattttagaatccaaaaacaggaaaccacactactaaaagaaaaatcaaccgagaaaaattctttagcaaaaagtattctcgcagtaaaaatcacttcatcgaattaaggtcaaaattatcggaacgttttatttcgcataagaacact

SEQ ID NO: 42 - DNA, 69 bp, Artificial Sequence
  Description of Artificial Sequence: Viral Signal Sequence
atgctgagctttgtggatacccgcaccctgctgctgctggcggtgaccagctgcctggcgacctgccag

SEQ ID NO: 43 - DNA, 96 bp, Artificial Sequence
  Description of Artificial Sequence: Viral Signal Sequence
atgggcagcagccaggcgccgcgcatgggcagcgtgggcggccatggcctgatggcgctgctgatggcgggcctgattctgccgggcattctggcg

SEQ ID NO: 44 - DNA, 51 bp, Artificial Sequence
  Description of Artificial Sequence: Viral Signal Sequence
atggcgggcattttttattttctgtttagctttctgtttggcatttgcgat

SEQ ID NO: 45 - DNA, 66 bp, Artificial Sequence
  Description of Artificial Sequence: Viral Signal Sequence
atggaaaaccgcctgctgcgcgtgtttctggtgtgggcggcgctgaccatggatggcgcgagcgcg

SEQ ID NO: 46 - DNA, 81 bp, Artificial Sequence
  Description of Artificial Sequence: Viral Signal Sequence
atggcgcgccagggctgctttggcagctatcaggtgattagcctgtttacctttgcgattggcgtgaacctgtgcctgggc

SEQ ID NO: 47 - DNA, 57 bp, Artificial Sequence
  Description of Artificial Sequence: Bacterial Signal Sequence
atgagccgcctgccggtgctgctgctgctgcagctgctggtgcgcccgggcctgcag

SEQ ID NO: 48 - DNA, 87 bp, Artificial Sequence
  Description of Artificial Sequence: Bacterial Signal Sequence
atgaaacagcagaaacgcctgtatgcgcgcctgctgaccctgctgtttgcgctgatttttctgctgccgcatagcagcgcgagcgcg

SEQ ID NO: 49 - DNA, 78 bp, Homo sapiens
atggcgacgccgctgcctccgccctccccgcggcacctgcggctgctgcggctgctgctctccgccctcgtcctcggc

SEQ ID NO: 50 - DNA, 54 bp, Homo sapiens
atgaaggctccgggtcggctcgtgctcatcatcctgtgctccgtggtcttctct

SEQ ID NO: 51 - DNA, 45 bp, Homo sapiens
atgcttcagctttggaaacttgttctcctgtgcggcgtgctcact

SEQ ID NO: 52 - DNA, 39 bp, Homo sapiens
atgctttatctccagggttggagcatgcctgctgtggca

SEQ ID NO: 53 - DNA, 144 bp, Homo sapiens
atggataacgtgcagccgaaaataaaacatcgccccttctgcttcagtgtgaaaggccacgtgaagatgctgcggctggatattatcaactcactggtaacaacagtattcatgctcatcgtatctgtgttggcactgatacca

SEQ ID NO: 54 - DNA, 96 bp, Homo sapiens
atgccctgcctagaccaacagctcactgttcatgccctaccctgccctgcccagccctcctctctggccttctgccaagtggggttcttaacagca

SEQ ID NO: 55 - DNA, 138 bp, Homo sapiens
atgaaaaccttgttcaatccagcccctgccattgctgacctggatccccagttctacaccctctcagatgtgttctgctgcaatgaaagtgaggctgagattttaactggcctcacggtgggcagcgctgcagatgct

SEQ ID NO: 56 - DNA, 57 bp, Homo sapiens
atgaagcctctccttgttgtgtttgtctttcttttcctttgggatccagtgctggca

SEQ ID NO: 57 - DNA, 63 bp, Homo sapiens
atgtcctgttccctaaagtttactttgattgtaatttttttttactgttggctttcatccagc

SEQ ID NO: 58 - DNA, 210 bp, Homo sapiens
atggttcttactaaacctcttcaaagaaatggcagcatgatgagctttgaaaatgtgaaagaaaagagcagagaaggagggccccatgcacacacacccgaagaagaattgtgtttcgtggtaacacactaccctcaggttcagaccacactcaacctgtttttccatatattcaaggttcttactcaaccactttcccttctgtggggt

SEQ ID NO: 59 - DNA, 96 bp, Homo sapiens
atggccaccccgccattccggctgataaggaagatgttttccttcaaggtgagcagatggatggggcttgcctgcttccggtccctggcggcatcc

SEQ ID NO: 60 - DNA, 87 bp, Homo sapiens
atgagctttttccaactcctgatgaaaaggaaggaactcattcccttggtggtgttcatgactgtggcggcgggtggagcctcatct

SEQ ID NO: 61 - DNA, 123 bp, Homo sapiens
atggtctcagctctgcggggagcacccctgatcagggtgcactcaagccctgtttcttctccttctgtgagtggaccacggaggctggtgagctgcctgtcatcccaaagctcagctctgagc

SEQ ID NO: 62 - DNA, 60 bp, Homo sapiens
atgatggggtccccagtgagtcatctgctggccggcttctgtgtgtgggtcgtcttgggc

SEQ ID NO: 63 - DNA, 69 bp, Homo sapiens
atggcaagcatggctgccgtgctcacctgggctctggctcttctttcagcgttttcggccacccaggca

SEQ ID NO: 64 - DNA, 135 bp, Homo sapiens
atggtgctcatgtggaccagtggtgacgccttcaagacggcctacttcctgctgaagggtgcccctctgcagttctccgtgtgcggcctgctgcaggtgctggtggacctggccatcctggggcaggcctacgcc

SEQ ID NO: 65 - DNA, 204 bp, Homo sapiens
atggattttgtcgctggagccatcggaggcgtctgcggtgttgctgtgggctaccccctggacacggtgaaggtcaggatccagacggagccaaagtacacaggcatctggcactgcgtccgggatacgtatcaccgagagcgcgtgtggggcttctaccggggcctctcgctgcccgtgtgcacggtgtccctggtatcttcc

SEQ ID NO: 66 - DNA, 147 bp, Homo sapiens
atggagaagcccctcttcccattagtgcctttgcattggtttggctttggctacacagcactggttgtttctggtgggatcgttggctatgtaaaaacaggcagcgtgccgtccctggctgcagggctgctcttcggcagtctagcc

SEQ ID NO: 67 - DNA, 45 bp, Homo sapiens
atgggtctgctccttcccctggcactctgcatcctagtcctgtgc

SEQ ID NO: 68 - DNA, 78 bp, Homo sapiens
atggggatccagacgagccccgtcctgctggcctccctgggggtggggctggtcactctgctcggcctggctgtgggc

SEQ ID NO: 69 - DNA, 75 bp, Homo sapiens
atgtcggacctgctactactgggcctgattgggggcctgactctcttactgctgctgacgctgctagcctttgcc

SEQ ID NO: 70 - DNA, 87 bp, Homo sapiens
atggagactgtggtgattgttgccataggtgtgctggccaccatgtttctggcttcgtttgcagccttggtgctggtttgcaggcag

SEQ ID NO: 71 - DNA, 105 bp, Homo sapiens
atgcgcggctctgtggagtgcacctggggttgggggcactgtgcccccagccccctgctcctttggactctacttctgtttgcagccccatttggcctgctgggg

SEQ ID NO: 72 - DNA, 171 bp, Homo sapiens
atgatgccgtcccgtaccaacctggctactggaatccccagtagtaaagtgaaatattcaaggctctccagcacagacgatggctacattgaccttcagtttaagaaaacccctcctaagatcccttataaggccatcgcacttgccactgtgctgtttttgattggcgcc

SEQ ID NO: 73 - DNA, 108 bp, Homo sapiens
atggccctgccccagatgtgtgacgggagccacttggcctccaccctccgctattgcatgacagtcagcggcacagtggttctggtggccgggacgctctgcttcgct

SEQ ID NO: 74 - DNA, 63 bp, Artificial Sequence
  Description of Artificial Sequence: Bacterial Signal Sequence
tgaaaaagtggttcgttgctgccggcatcggcgctgccggactcatgctctccagcgccgcca

SEQ ID NO: 75 - DNA, 63 bp, Artificial Sequence
  Description of Artificial Sequence: Bacterial Signal Sequence
atgaaacagagcaccattgcgctggcgctgctgccgctgctgtttaccccggtgaccaaagcg

SEQ ID NO: 76 - DNA, 63 bp, Artificial Sequence
  Description of Artificial Sequence: Bacterial Signal Sequence
atgaaaaaaaccgcgattgcgattgcggtggcgctggcgggctttgcgaccgtggcgcaggcg

SEQ ID NO: 77 - DNA, 63 bp, Artificial Sequence
  Description of Artificial Sequence: Bacterial Signal Sequence
atgaaaaaactgatgctggcgattttttttagcgtgctgagctttccgagctttagccagagc

SEQ ID NO: 78 - DNA, 69 bp, Artificial Sequence
  Description of Artificial Sequence: Bacterial Signal Sequence
atgaaaaaaaacattgcgtttctgctggcgagcatgtttgtgtttagcattgcgaccaacgcgtatgcg

SEQ ID NO: 79 - DNA, 96 bp, Homo sapiens
atgtttgcgaaacgctttaaaaccagcctgctgccgctgtttgcgggctttctgctgctgtttcatctggtgctggcgggcccggcggcggcgagc

SEQ ID NO: 80 - DNA, 57 bp, Homo sapiens
atgcgctttccgagcatttttaccgcggtgctgtttgcggcgagcagcgcgctggcg

SEQ ID NO: 81 - DNA, 57 bp, Homo sapiens
atgcgctttccgagcatttttaccaccgtgctgtttgcggcgagcagcgcgctggcg

SEQ ID NO: 82 - DNA, 57 bp, Homo sapiens
atgcgctttccgagcatttttaccagcgtgctgtttgcggcgagcagcgcgctggcg

SEQ ID NO: 83 - DNA, 57 bp, Homo sapiens
atgcgctttccgagcatttttacccatgtgctgtttgcggcgagcagcgcgctggcg

SEQ ID NO: 84 - DNA, 57 bp, Homo sapiens
atgcgctttccgagcatttttaccattgtgctgtttgcggcgagcagcgcgctggcg

SEQ ID NO: 85 - DNA, 57 bp, Homo sapiens
atgcgctttccgagcatttttacctttgtgctgtttgcggcgagcagcgcgctggcg

SEQ ID NO: 86 - DNA, 57 bp, Homo sapiens
atgcgctttccgagcatttttaccgaagtgctgtttgcggcgagcagcgcgctggcg

SEQ ID NO: 87 - DNA, 57 bp, Homo sapiens
atgcgctttccgagcatttttaccggcgtgctgtttgcggcgagcagcgcgctggcg

SEQ ID NO: 88 - DNA, 63 bp, Homo sapiens
atgcgttcctcccccctcctccgctccgccgttgtggccgccctgccggtgttggcccttgcc

SEQ ID NO: 89 - DNA, 66 bp, Homo sapiens
atgggcgcggcggccgtgcgctggcacttgtgcgtgctgctggccctgggcacacgcgggcggctg

SEQ ID NO: 90 - DNA, 53 bp, Artificial Sequence
  Description of Artificial Sequence: Signal Sequence
atgaggagctcccttgtgctgttctttgtctctgcgtggacggccttggccag

SEQ ID NO: 91 - DNA, 96 bp, Homo sapiens
atgctcaggggtccgggacccgggcggctgctgctgctagcagtcctgtgcctggggacatcggtgcgctgcaccgaaaccgggaagagcaagagg

SEQ ID NO: 92 - DNA, 69 bp, Homo sapiens
atgcttaggggtccggggcccgggctgctgctgctggccgtccagctggggacagcggtgccctccacg

SEQ ID NO: 93 - DNA, 93 bp, Homo sapiens
atgcgccggggggccctgaccgggctgctcctggtcctgtgcctgagtgttgtgctacgtgcagccccctctgcaacaagcaagaagcgcagg

SEQ ID NO: 94 - protein, 24 aa, Homo sapiens
MMPSSVSWGILLAGLCCLVPVSLA

SEQ ID NO: 95 - protein, 30 aa, Homo sapiens
MAGPATQSPMKLMALQLLLWHSALWTVQEA

SEQ ID NO: 96 - protein, 46 aa, Homo sapiens
MQRVNMIMAESPSLITICLLGYLLSAECTVFLDHENANKILNRPKR

SEQ ID NO: 97 - protein, 21 aa, Homo sapiens
MKGSLLLLLVSNLLLCQSVAP

SEQ ID NO: 98 - protein, 24 aa, Homo sapiens
MKWVTFISLLFLFSSAYSRGVFRR

SEQ ID NO: 99 - protein, 19 aa, Homo sapiens
MWWRLWWLLLLLLLLPMWA

SEQ ID NO: 100 - protein, 32 aa, Homo sapiens
MLFNLRILLNNAAFRNGHNFMVRNFRCGQPLQ

SEQ ID NO: 101 - protein, 29 aa, Homo sapiens
MSVLTPLLLRGLTGSARRLPVPRAKIHSL

SEQ ID NO: 102 - protein, 29 aa, Homo sapiens
MSVLTPLLLRGLTGSARRLPVPRAKIHSL

SEQ ID NO: 103 - protein, 59 aa, Artificial Sequence
  Description of Artificial Sequence: Bacterial Signal Sequence
VTKITLSPQNFRIQKQETTLLKEKSTEKNSLAKSILAVKNHFIELRSKLSERFISHKNT

SEQ ID NO: 104 - protein, 23 aa, Artificial Sequence
  Description of Artificial Sequence: Viral Signal Sequence
MLSFVDTRTLLLLAVTSCLATCQ

SEQ ID NO: 105 - protein, 32 aa, Artificial Sequence
  Description of Artificial Sequence: Viral Signal Sequence
MGSSQAPRMGSVGGHGLMALLMAGLILPGILA

SEQ ID NO: 106 - protein, 17 aa, Artificial Sequence
  Description of Artificial Sequence: Viral Signal Sequence
MAGIFYFLFSFLFGICD

SEQ ID NO: 107 - protein, 22 aa, Artificial Sequence
  Description of Artificial Sequence: Viral Signal Sequence
MENRLLRVFLVWAALTMDGASA

SEQ ID NO: 108 - protein, 27 aa, Artificial Sequence
  Description of Artificial Sequence: Viral Signal Sequence
MARQGCFGSYQVISLFTFAIGVNLCLG

SEQ ID NO: 109 - protein, 19 aa, Artificial Sequence
  Description of Artificial Sequence: Bacterial Signal Sequence
MSRLPVLLLLQLLVRPGLQ

SEQ ID NO: 110 - protein, 29 aa, Artificial Sequence
  Description of Artificial Sequence: Bacterial Signal Sequence
MKQQKRLYARLLTLLFALIFLLPHSSASA

SEQ ID NO: 111 - protein, 22 aa, Homo sapiens
MATPLPPPSPRHLRLLRLLLSG

SEQ ID NO: 112 - protein, 18 aa, Homo sapiens
MKAPGRLVLIILCSVVFS

SEQ ID NO: 113 - protein, 13 aa, Homo sapiens
MLQLWKLLCGVLT

SEQ ID NO: 114 - protein, 13 aa, Homo sapiens
MLYLQGWSMPAVA

SEQ ID NO: 115 - protein, 48 aa, Homo sapiens
MDNVQPKIKHRPFCFSVKGHVKMLRLDIINSLVTTVFMLIVSVLALIP

SEQ ID NO: 116 - protein, 32 aa, Homo sapiens
MPCLDQQLTVHALPCPAQPSSLAFCQVGFLTA

SEQ ID NO: 117 - protein, 46 aa, Homo sapiens
MKTLFNPAPAIADLDPQFYTLSDVFCCNESEAEILTGLTVGSAADA

SEQ ID NO: 118 - protein, 19 aa, Homo sapiens
MKPLLVVFVFLFLWDPVLA

SEQ ID NO: 119 - protein, 21 aa, Homo sapiens [sequence omitted]

SEQ ID NO: 120 - protein, 70 aa, Homo sapiens
MVLTKPLQRNGSMMSFENVKEKSREGGPHAHTPEEELCFVVTHTPQVQTTLNLFFHIFKVLTQPLSLLWG

SEQ ID NO: 121 - protein, 32 aa, Homo sapiens
MATPPFRLIRKMFSFKVSRWMGLACFRSLAAS

SEQ ID NO: 122 - protein, 29 aa, Homo sapiens
MSFFQLLMKRKELIPLVVFMTVAAGGASS

SEQ ID NO: 123 - protein, 41 aa, Homo sapiens
MVSALRGAPLIRVHSSPVSSPSVSGPAALVSCLSSQSSALS

SEQ ID NO: 124 - protein, 20 aa, Homo sapiens
MMGSPVSHLLAGFCVWVVLG

SEQ ID NO: 125 - protein, 23 aa, Homo sapiens
MASMAAVLTWALALLSAFSATQA

SEQ ID NO: 126 - protein, 45 aa, Homo sapiens
MVLMWTSGDAFKTAYFLLKGAPLQFSVCGLLQVLVDLAILGQATA

SEQ ID NO: 127 - protein, 68 aa, Homo sapiens
MDFVAGAIGGVCGVAVGYPLDTVKVRIQTEPLYTGIWHCVRDTYHRERVWGFYRGLSLPVCTVSLVSS

SEQ ID NO: 128 - protein, 49 aa, Homo sapiens
MEKPLFPLVPLHWFGFGYTALVVSGGIVGYVKTGSVPSLAAGLLFGSLA

SEQ ID NO: 129 - protein, 15 aa, Homo sapiens
MGLLLPLALCILVLC

SEQ ID NO: 130 - protein, 26 aa, Homo sapiens
MGIQTSPVLLASLGVGLVTLLGLAVG

SEQ ID NO: 131 - protein, 25 aa, Homo sapiens
MSDLLLLGLIGGLTLLLLLTLLAFA

SEQ ID NO: 132 - protein, 29 aa, Homo sapiens
METVVIVAIGVLATIFLASFAALVLVCRQ

SEQ ID NO: 133 - protein, 35 aa, Homo sapiens
MAGSVECTWGWGHCAPSPLLLWTLLLFAAPFGLLG

SEQ ID NO: 134 - protein, 57 aa, Homo sapiens
MMPSRTNLATGIPSSKVKYSRLSSTDDGYIDLQFKKTPPKIPYKAIALATVLFLIGA

SEQ ID NO: 135 - protein, 36 aa, Homo sapiens
MALPQMCDGSHLASTLRYCMTVSGTVVLVAGTLCFA

SEQ ID NO: 136 - protein, 21 aa, Homo sapiens
MKKWFVAAGIGAGLLMLSSAA

SEQ ID NO: 137 - protein, 21 aa, Homo sapiens
MKQSTIALALLPLLFTPVTKA

SEQ ID NO: 138 - protein, 21 aa, Homo sapiens
MKKTAIAIAVALAGFATVAQA

SEQ ID NO: 139 - protein, 21 aa, Artificial Sequence
  Description of Artificial Sequence: Bacterial Signal Sequence
MKKLMLAIFFSVLSFPSFSQS

SEQ ID NO: 140 - protein, 23 aa, Artificial Sequence
  Description of Artificial Sequence: Bacterial Signal Sequence
MKKNIAFLLASMFVFSIATNAYA

SEQ ID NO: 141 - protein, 32 aa, Homo sapiens
MFAKRFKTSLLPLFAGFLLLFHLVLAGPAAAS

SEQ ID NO: 142 - protein, 19 aa, Homo sapiens
MRFPSIFTAVLFAASSALA

SEQ ID NO: 143 - protein, 19 aa, Homo sapiens
MRFPSIFTTVLFAASSALA

SEQ ID NO: 144 - protein, 19 aa, Homo sapiens
MRFPSIFTSVLFAASSALA

SEQ ID NO: 145 - protein, 19 aa, Homo sapiens
MRFPSIFTHVLFAASSALA

SEQ ID NO: 146 - protein, 19 aa, Homo sapiens
MRFPSIFTIVLFAASSALA

SEQ ID NO: 147 - protein, 19 aa, Homo sapiens
MRFPSIFTFVLFAASSALA

SEQ ID NO: 148 - protein, 19 aa, Homo sapiens
MRFPSIFTEVLFAASSALA

SEQ ID NO: 149 - protein, 19 aa, Homo sapiens
MRFPSIFTGVLFAASSALA

SEQ ID NO: 150 - protein, 21 aa, Homo sapiens
MRSSPLLRSAVVAALPVLALA

SEQ ID NO: 151 - protein, 22 aa, Homo sapiens
MGAAAVRWHLCVLLALGTRGRL

SEQ ID NO: 152 - protein, 17 aa, Artificial Sequence
  Description of Artificial Sequence: Signal Sequence
MRSSLVLFFVSAWTALA

SEQ ID NO: 153 - protein, 32 aa, Homo sapiens
MLRGPGPGRLLLLAVLCLGTSVRCTETGKSKR

SEQ ID NO: 154 - protein, 26 aa, Homo sapiens
MLRGPGPGLLLLAVQCLGTAVPSTGA

SEQ ID NO: 155 - protein, 31 aa, Homo sapiens
MRRGALTGLLLVLCLSVVLRAAPSATSKKRR

SEQ ID NO: 156 - DNA, 2208 bp, Homo sapiens
cgggagggtcctcagctaaagccaaaagcagatcaaagtggtgggactcgcgtcgcggccgcggagacgtgaagctctcgaggctcctcccgctgcgggtcggcgctcgccctcgctctcctcgccctccgccccggccccggccccgcgcccgccatggagaagactgagctgatccagaaggccaagctggccgagcaggccgagcgctacgacgacatggccacctgcatgaaggcagtgaccgagcagggcgccgagctgtccaacgaggagcgcaacctgctctccgtggcctacaagaacgtggtcgggggccgcaggtccgcctggagggtcatctctagcatcgagcagaagaccgacacctccgacaagaagttgcagctgattaaggactatcgggagaaagtggagtccgagctgagatccatctgcaccacggtgctggaattgttggataaatatttaatagccaatgcaactaatccagagagtaaggtcttctatctgaaaatgaagggtgattacttccggtaccttgctgaagttgcgtgtggtgatgatcgaaaacaaacgatagataattcccaaggagcttaccaagaggcatttgatataagcaagaaagagatgcaacccacacacccaatccgcctggggcttgctcttaacttttctgtattttactatgagattcttaataacccagagcttgcctgcacgctggctaaaacggcttttgatgaggccattgctgaacttgatacactgaatgaagactcatacaaagacagcaccctcatcatgcagttgcttagagacaacctaacactttggacatcagacagtgcaggagaagaatgtgatgcggcagaaggggctgaaaactaaatccatacagggtgtcatccttctttccttcaagaaacctttttacacatctccattccttattccacttggatttcctatagcaaagaaacccattcatgtgtatggaatcaactgtttatagtcttttcacactgcagctttgggaaaacttcattccttgatttgtgtttgtcttggccttcctggtgtgcagtactgctgtagaaaagtattaatagcttcatttcatataaacataagtaactcccaaacacttatgtagaggactaaaaatgtatctggtatttaagtaatctgaaccagttctgcaagtgactgtgttttgtattactgtgaaaataagaaaatgtagttaattacaatttaaagagtattccacataacttcttaatttctacattccctcccttactcttcgggggtttcctttcagtaagcaacttttccatgctcttaatgtattcctttttagtaggaatccggaagtattagattgaatggaaaagcacttgccatctctgtctaggggtcacaaattgaaatggctcctgtatcacatacggaggtcttgtgtatctgtggcaacagggagtttccttattcactctttatttgctgctgtttaagttgccaacctcccctcccaataaaaattcacttacacctcctgcctttgtagttctggtattcactttactatgtgatagaagtagcatgttgctgccagaatacaagcattgcttttggcaaattaaagtgcatgtcatttcttaatacactagaaaggggaaataaattaaagtacacaagtccaagtctaaaactttagtacttttccatgcagatttgtgcacatgtgagagggtgtccagtttgtctagtgattgttatttagagagttggaccactattgtgtgttgctaatcattgactgtagtcccaaaaaagccttgtgaaaatgttatgccctatgtaacagcagagtaacataaaataaaagtacattttataaaccatttactatggctttgtaacaattgcatacccatattttaagggacaggtgaatttactactttctaaagtttattgatacttcccttttatgtaaaatgtagtagtgatacctatatttccacattgtgcattgtgacacacttgtctagggatgcctggaagtgtataaaattggactgcatttcttagagtgttttactatagatcagtctcatgggccatctcttcctcagatgtaaatgatatctggttaagtgttatatggaataaagtggacattttaaaactagcaaa

SEQ ID NO: 157 - DNA, 1825 bp, Homo sapiens
gcaggcgtcgtcccgtcctcccatcccccagcgcggccgcgtctcctccctcggcgttgtccgcggcgcgagccacagcgcgcggggcgagccagcgagagggcgcgagcggcggcgctgcctgcagcctgcagcctgcagcctccggccggccggcgagccagtgcgcgtgcgcggcggcggcctccgcagcgaccggggagcggactgaccggcgggagggctagcgagccagcggtgtgaggcgcgaggcgaggccgagccgcgagcgacatgggggaccgggagcagctgctgcagcgggcgcggctggccgagcaggcggagcgctacgacgacatggcctccgctatgaaggcggtgacagagctgaatgaacctctctccaatgaagatcgaaatctcctctctgtggcctacaagaatgtggttggtgccaggcgatcttcctggagggtcattagcagcattgagcagaaaaccatggctgatggaaacgaaaagaaattggagaaagttaaagcttaccgggagaagattgagaaggagctggagacagtttgcaatgatgtcctgtctctgcttgacaagttcctgatcaagaactgcaatgatttccagtatgagagcaaggtgttttacctgaaaatgaagggtgattactaccgctacttagcagaggtcgcttctggggagaagaaaaacagtgtggtcgaagcttctgaagctgcctacaaggaagcctttgaaatcagcaaagagcagatgcaacccacgcatcccatccggctgggcctggccctcaacttctccgtgttctactatgagatccagaatgcacctgagcaagcctgcctcttagccaaacaagccttcgatgatgccatagctgagctggacacactaaacgaggattcctataaggactccacgctgatcatgcagttgctgcgagacaacctcaccctctggacgagcgaccagcaggatgaagaagcaggagaaggcaactgaagatccttcaggtcccctggcccttccttcacccaccacccccatcatcaccgattcttccttgccacaatcactaaatatctagtgctaaacctatctgtattggcagcacagctactcagatctgcactcctgtctcttgggaagcagtttcagataaatcatgggcattgctggactgatggttgctttgagcccacaggagctccctttttgaattgtgtggagaagtgtgttctgatgaggcattttactatgcctgttgatctatgggaaatctaggcgaaagtaatggggaagattagaaagaattagccaaccaggctacagttgatatttaaaagatccatttaaaacaagctgatagtgtttcgttaagcagtacatcttgtgcatgcaaaaatgaattcacccctcccacctctttcttcaattaatggaaaactgttaagggaagctgatacagagagacaacttgctcctttccatcagctttataataaactgtttaacgtgaggtttcagtagctccttggttttgcctctttaaattatgacgtgcacaaaccttcttttcaatgcaatgcatctgaaagttttgatacttgtaacttttttttttttttggttgcaattgtttaagaatcatggatttattttttgtaactctttggctattgtccttgtgtatcctgacagcgccatgtgtgtcagcccatgtcaatcaagatgggtgattatgaaatgccagacttctaaaataaatgttttggaattcaatgggtaaataaatgctgctttggggatatta

SEQ ID NO: 158 - DNA, 2044 bp, Homo sapiens
ccgccatttttgctgcccggacgcggagcgagaggctgagagagtcggagacactatccgcttccatccgtcgcgcagaccctgccggagccgctgccgctatggatgatcgagaggatctggtgtaccaggcgaagctggccgagcaggctgagcgatacgacgaaatggtggagtcaatgaagaaagtagcagggatggatgtggagctgacagttgaagaaagaaacctcctatctgttgcatataagaatgtgattggagctagaagagcctcctggagaataatcagcagcattgaacagaaagaagaaaacaagggaggagaagacaagctaaaaatgattcgggaatatcggcaaatggttgagactgagctaaagttaatctgttgtgacattctggatgtactggacaaacacctcattccagcagctaacactggcgagtccaaggttttctattataaaatgaaaggggactaccacaggtatctggcagaatttgccacaggaaacgacaggaaggaggctgcggagaacagcctagtggcttataaagctgctagtgatattgcaatgacagaacttccaccaacgcatcctattcgcttaggtcttgctctcaatttttccgtattctactacgaaattcttaattcccctgaccgtgcctgcaggttggcaaaagcagcttttgatgatgcaattgcagaactggatacgctgagtgaagaaagctataaggactctacacttatcatgcagttgttacgtgataatctgacactatggacttcagacatgcagggtgacggtgaagagcagaataaagaagcgctgcaggacgtggaagacgaaaatcagtgagacataagccaacaagagaaaccatctctgaccaccccctcctccccatcccaccctttggaaactccccattgtcactgagaaccaccaaatctgacttttacatttggtctcagaatttaggttcctgccctgttggttttttttttttttttttaaacagttttcaaaagttcttaaaggcaagagtgaatttctgtggattttactggtcccagcttttaggttctttaagacactaacaggactacatagaggctttttcagcattactgtgtcgtctccgtgccagatgtggcaagatcaccattagcaaatggaaattacatttgaaagccattagacttataggtgatgcaagcatctaagagagaggttaatcacactatagaggcataagtggtatcagttttcatttttctaattgtttaaactgtgttttataccagtgtttgcaagtaattgggtgttagcttgagatggttaaaggtggtttggggagggacttcgttgtaatggttttgctgtaaaaaatgtttccaactccgctgaaatgttgctgaaaagcatggtgctggtaacagttcaacaatccgtggctgctcattcttgcctactttactctcccactgaagcaggttagcgttgaaggtggtatggaaaagcctgcatgcctgttcaattcttttgtttcttctccttccccctccccctacctccttcccctcactcctcccctccttcgctcgctcaacctcttttgttcagtatgtgtaacttgaagctaatttgtactactggatatctgactggagccacagatacagaatctgtattgttcttactgaaacacagcatggaattaacattaaacttaaataaaacaaacctaaattaaaaatgccaaatatcgcgcctccatcctttatacttctaaaataaaatctctagtccaaacacactgacagtattatgtttgcctgaatgtgaaacattcctccttttttcttccataaataatttgtttgcttcccaaagatgtatgttttggaaaaaaattgcctgtagtctggttgtgaagaacactgagtcagttgatggtgtgtcttgtcctccagaccaggcagcaacatggtatttattttaatcattaaagtacaacatgagtagtacaa

SEQ ID NO: 159 - DNA, 3745 bp, Homo sapiens
ggccgcagggggttgtccgtcagtggcacgcacagcagccgcagccgcctcgcgcccggtcccgcggtcgcagctccagccgcctcctccgcgcagccgccgcctcagctgctcgctctgtgggtcggtcctctccggcacttgggctccagtcgcgccctccaagcccttcaggccgccccagtgtcctcctccttctccggccagacccagccccgcgaagatggtggaccgcgagcaactggtgcagaaagcccggctggccgagcaggcggagcgctacgacgacatggccgcggccatgaagaacgtgacagagctgaatgagccactgtcgaatgaggaacgaaaccttctgtctgtggcctacaagaacgttgtgggggcacgccgctcttcctggagggtcatcagtagcattgagcagaagacatctgcagacggcaatgagaagaagattgagatggtccgtgcgtaccgggagaagatagagaaggagttggaggctgtgtgccaggatgtgctgagcctgctggataactacctgatcaagaattgcagcgagacccagtacgagagcaaagtgttctacctgaagatgaaaggggactactaccgctacctggctgaagtggccaccggagagaaaagggcgacggtggtggagtcctccgagaaggcctacagcgaagcccacgagatcagcaaagagcacatgcagcccacccaccccatccgattaggcctggctcttaactactccgtcttctactatgagatccagaacgccccagagcaagcgtgccacttggccaagaccgcgttcgacgacgccatcgccgagcttgacaccctcaacgaggactcctacaaggactccacgctcatcatgcagctcctccgcgacaacctcacgctctggacgagcgaccagcaggacgacgatggcggcgaaggcaacaattaaggccccaggggaactggcagcgcacgcggatgctactactgcagtctttatttttttcccatgagttgggggtcgggtgggggagggaaagggagggatgaccttcccagggagaaacccacgacctgtcctgtctttgatcgcctctttgacatttttgccaaaataccactagtggaaagtcaggctagctgtgctggtattggaatagcagcctcacactggcgtctggactgttctgtagattcatgcaagtggagctgtctgtctctaatttaacttattgctagataatagggttttcagatgaaaagaaaacttaaagaggaatggccctcattcagtaagttctgtggttccagtaaggatttttatgtacatacgctctcgtctctcgttttgggtactttctatctcatctgtctcggctctgcatgttttccagggtgtagcctacagacatggaacagtgtaaatcccagactgacagacttagaacctgaggtctcattcatccttatggtttaggccttgccagttttccgaagtctctgattagttgacagtattaacactaaattgcagtttacagtatttctacattacagccatatgtaacatcaagccatcgattgtgtacttttcctttgctagttgtttgggctttaacatccttattcagccttatccaggttggttttgctgttgatcggtctcctaggctaaatgagaatgaaagcgacttcaggtcaggtggctgtgggattttttttttttggtccttctttcctcttaacgtaaatccaccaccaaaattattaatcctcttgagagaaacgtgaaacgccacaaaaatagagaaaattcaggtctgtatgtcatggatcgtgttggtattttcagagaacatcccgcttctgaagctgctgcagctccctcctcagggatcacactgccgtcacccactctgcactggggcgtttcctactgcgcctcgtgctggcggacgcagctgggtgcagaagctgtggggtcggagaggcgtttggagaaggtctgtggtgcagtgtgtgaaaattcaggtgctagaagcctactggtagaaaaacccaaaaggaagagctatatccttaaccattctgtccaatttcgggagccttgtcagtgtgtcagtttttcctccccgaagacactccttccccaagtaattgtaggaagataaaaaaactgttaccagataacaaacactgaactcctatttgaccagaactttttcctctcgagatagttttttctttttaatgaaaaaagcataggaattggagattggcttgtctcacgcagccagtgcacatttggaattgacggaaacaacgttgctatttccacccatttgttttcggcagccttaaggccctcattctcatttcgggtgaatctgtctatctgtgaacgtggcccgcatgtgcattcttttttttatatatataaagtcagtgacgaggaactcccgagacgtgtaatgacaccacacttgttttctttgtttctttgttttatttaggcaagaagaggtgtgagtaattgaggaaaaactgacagatgcttttgctaataccaaaattgagcttacaattaggaactgagtatgtgtaacaggatacaggtgacagtgaagatagaagaaccacgatgaccacagactcaatgtgctctgtaacatcgcacagtttacccagcatgactttccttaggaggccccctcctcacgctagagtaaaagtcccagttaagtgaagcctaccagaagaactagtagaagaagctttgccgcttttgtgcctctcacaggcgcctaaagtcattgccatgggaggaagacgatttggggggggaggggggggggggcagggtaggtggggctttccctaatttatcttcatgtccagtgagcagtgttgcgtttttccttgtagcatttggaaatgatttactggaattacaaaacctatttttcctttaaatttcagctttggctctggctgctttttagaataatgcaagataaaaatcacacctgagggctgaaaacggagagggaatgggagacttgatatttaagcagcttgaatggtttttcttttctttatttttaaagaaatgcacttgcctatgatactgtctctccagtgaaatgattactcctccattactctattgatacaatattgtgcatgctagtgttgtatttctatacagtagcttgaaattgattaacttatactgtaggtgttatgtattcctatgacaaaaaaaattaagtcttcaaattttttaaaggttttttttttttaatttaatttttccttttgggggtaaagtttgctctaccaaatagtgattgtaacaaattgatctgttttggatgttgctatagtgacatgcagttatatattttgtttttaaaagggggggagcaaaagaaacaccagtgttagcttaatcttaatgtctggtgtttgtcatggtgaaattataactattacagtgttggagaacaacaaatatgttctctgaatgagcctttgtgctttttgtcatgttatgcagtgaactatttttaaggtctaatcagtgattatttttccagctccgtgtttctctaaggaattatttcacacacggaccatctttagcagtttcctcagtgatggaatatcatgaatgtgagtcattatgtagctgtcgtacattgagcaaataaacttacagatctga

SEQ ID NO: 160 - DNA, 2829 bp, Homo sapiens
gcccactcccaccgccagctggaaccctggggactacgacgtccctcaaaccttgcttctaggagataaaaagaacatccagtcatggataaaaatgagctggttcagaaggccaaactggccgagcaggctgagcgatatgatgacatggcagcctgcatgaagtctgtaactgagcaaggagctgaattatccaatgaggagaggaatcttctctcagttgcttataaaaatgttgtaggagcccgtaggtcatcttggagggtcgtctcaagtattgaacaaaagacggaaggtgctgagaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacatttagggagttatctgttttcatcttgaggtggccaatatggggatgtggaatttttatacaagttataagtgtttggcatagtacttttggtacattgtggcttcaaaagggccagtgtaaaactgcttccatgtctaagcaaagaaaactgcctacatactggtttgtcctggcggggaataaaagggatcattggttccagtcacaggtgtagtaattgtgggtactttaaggtttggagcacttacaaggctgtggtagaatcataccccatggataccacatattaaaccatgtatatctgtggaatactcaatgtgtacacctttgactacagctgcagaagtgttcctttagacaaagttgtgacccattttactctggataagggcagaaacggttcacattccattatttgtaaagttacctgctgttagctttcattatttttgctacactcattttatttgtatttaaatgttttaggcaacctaagaacaaatgtaaaagtaaagatgcaggaaaaatgaattgcttggtattcattacttcatgtatatcaagcacagcagtaaaacaaaaacccatgtatttaacttttttttaggatttttgcttttgtgatttttttttttttgatacttgcctaacatgcatgtgctgtaaaaatagttaacagggaaataacttgagatgatggctagctttgtttaatgtcttatgaaattttcatgaacaatccaagcataattgttaagaacacgtgtattaaattcatgtaagtggaataaaagttttatgaatggacttttcaactactttctctacagcttttcatgtaaattagtcttggttctgaaacttctctaaaggaaattgtacattttttgaaatttattccttattccctcttggcagctaatgggctcttaccaagtttaaacacaaaatttatcataacaaaaatactactaatataactactgtttccatgtcccatgatcccctctcttcctccccaccctgaaaaaaatgagttcctattttttctgggagagggggggattgattagaaaaaaatgtagtgtgttccatttaaaattttggcatatggcattttctaacttaggaagccacaatgttcttggcccatcatgacattgggtagcattaactgtaagttttgtgcttccaaatcactttttggtttttaagaatttcttgatactcttatagcctgccttcaattttgatcctttattctttctatttgtcaggtgcacaagattaccttcctgttttagccttctgtcttgtcaccaaccattcttacttggtggccatgtacttggaaaaaggccgcatgatctttctggctccactcagtgtctaaggcaccctgcttcctttgcttgcatcccacagactatttccctcatcctatttactgcagcaaatctctccttagttgatgagactgtgtttatctccctttaaaaccctacctatcctgaatggtctgtcattgtctgcctttaaaatccttcctctttcttcctcctctattctctaaataatgatggggctaagttatacccaaagctcactttacaaaatatttcctcagtactttgcagaaaacaccaaacaaaaatgccattttaaaaaaggtgtattttttcttttagaatgtaagctcctcaagagcagggacaatgttttctgtatgttctattgtgcctagtacactgtaaatgctcaataaatattgatgatgggaggcagtgagtcttgatgataagggtgagaaactgaaatccc

SEQ ID NO: 161 - DNA, 3049 bp, Homo sapiens
aggaccggagcggaagtggcgatcggagcggaagtggagctaccgccaccgccgccgccgattccggagccggggtagtcgccgccgccgccgccgctgcagccactgcaggcaccgctgccgccgcctgagtagtgggcttaggaaggaagaggtcatctcgctcggagcttcgctcggaagggtctttgttccctgcagccctcccacgggaatgacaatggataaaagtgagctggtacagaaagccaaactcgctgagcaggctgagcgatatgatgatatggctgcagccatgaaggcagtcacagaacaggggcatgaactctccaacgaagagagaaatctgctctctgttgcctacaagaatgtggtaggcgcccgccgctcttcctggcgtgtcatctccagcattgagcagaaaacagagaggaatgagaagaagcagcagatgggcaaagagtaccgtgagaagatagaggcagaactgcaggacatctgcaatgatgttctggagctgttggacaaatatcttattcccaatgctacacaaccagaaagtaaggtgttctacttgaaaatgaaaggagattattttaggtatctttctgaagtggcatctggagacaacaaacaaaccactgtgtcgaactcccagcaggcttaccaggaagcatttgaaattagtaagaaagaaatgcagcctacacacccaattcgtcttggtctggcactaaatttctcagtcttttactatgagattctaaactctcctgaaaaggcctgtagcctggcaaaaacggcatttgatgaagcaattgctgaattggatacgctgaatgaagagtcttataaagacagcactctgatcatgcagttacttagggacaatctcactctgtggacatcggaaaaccagggagacgaaggagacgctggggagggagagaactaatgtttctcgtgctttgtgatctgttcagtgtcactctgtaccctcaacatatatcccttgtgcgataaaaaaaaaaaaaaaaaaaaaaagagaatcgtacgtcgactttcgatttttcacagcctcagcctaggaaaaatggttcatgggataaacagctggtatttgtatctaaaactcagattggtcacataaatgccacggcattccgaagttttgattttgattaacattgacaggattactgtgtgtttaattttttaaaaactgaacactgtgattatggggttttgtaatttagcagaactcttactggtagaaaaaatagacctgaattatgtgtaactttttggaaggtttaatctgatatcaaaataatcattgaaatacaattccattgtaaagttgtacagaaagttatagagattatattgtgatgctggaacttggagtgagacacacatcatttggcatttgagttgaatggtaattcacagtaatgctgccgttgttcgggacttaaagacacttgacctgtttgggctgttgccacttaaaagttcatgaccacaaatgtccacagtgtcttcctctgaggaaactcgaatcctgaaatggaaattctttgtggcagataactggcttatgacaccttgaaaagttcaagtgctcatataacacaccacactgaaccccctttcctacagcaatatgttcactatgttaccaatttgcaacttgtgcttcaatagtggaatctactttcattgttaacactgagctaaagaaaaaaagccgtgtgttttatgaatgaccttatctgtttcctggataatacctttaagaataatgtcctgagtcaggcgtggtggtgcgtgcatctagtcccaactatttgggaggctgaggcaggaggatcgcttgagcccaggagtttaaagctgcagtgccctgtggttgcacctgtgaataactgcactccagcctgggcaacatagcgagacctcatctccaaaaaagaaaacaaaaaacaaaaaaaggaatgatgttctgtagagatggcctttcacttgaggagtactcagttttcaggttcttcctagctcggggcttttaaattttgaaatctaaacattctttcccaccatcctttttgactgttgaccttggttttctcttctaagtttctgtccctctgcttccttactttttttcctttttgaattctatctttatctgtcttttgttcactttttaatgctatatatgggcaggggtgagagacattactgagcaccttggtgagcaagcctggctttaaagattggagaagagcttctggcaccagaaccctgtcttcctccagttctcaacacggtgttgctcttcagtcataccggaatctgaatcaaaaaagtatttttaaatatccatgatttctccctgtattgaggctagccctgatcatgctttttgtgcctgtcaccaggtctcccaagtgcactcatccaggtcagtgctcagatgtgtttaaggagaccctatattcagggaagttgcgtgaacactgcagtggggagaattgagaatagtcaggcctatcagtctcacagaatcacccctctacctttgatattccacttagctgtagagtccatctgtttgtccatctgctgaaatgagaaaagaaaaatttatgcactgatttaaaacaaaccaaaaaaaaagaaaaaaacaaaaaaaaaaatccctcctttctagctgaacaaaaatgtgcagttaatacttggcgcttgaaaatgcagtagtgaatgtggaaccaagcctgtctgtatatctggtagctcttttcttgctttgttttttcttaccagtattctgcctaacgtttgcttctgtgatggttatattgcctagcaagcacacccgtggttgtgaaaatagtatagcaaaaaagaaaaatccccggttattgatgtactagatttgtgtatgtcttttaaacagttctagtttcaccttacacagaataatcaggaaaagtgtaaaaattcaaaagtgaaataaaaattttatcagttagttgcctgtgaa

SEQ ID NO: 162 - DNA, 3109 bp, Homo sapiens
ggagctaccgccaccgccgccgccgattccggagccggggtagtcgccgccgccgccgccgctgcagccactgcaggcaccgctgccgccgcctgagtagtgggcttaggaaggaagaggtcatctcgctcggagcttcgctcggaagggtctttgttccctgcagccctcccacggcagagtctccagagatttgggccgctacaaaaagtgcattttgcccattcggctgtggatagagaagcaggaagagcactggacttggagtcagggaatgacaatggataaaagtgagctggtacagaaagccaaactcgctgagcaggctgagcgatatgatgatatggctgcagccatgaaggcagtcacagaacaggggcatgaactctccaacgaagagagaaatctgctctctgttgcctacaagaatgtggtaggcgcccgccgctcttcctggcgtgtcatctccagcattgagcagaaaacagagaggaatgagaagaagcagcagatgggcaaagagtaccgtgagaagatagaggcagaactgcaggacatctgcaatgatgttctggagctgttggacaaatatcttattcccaatgctacacaaccagaaagtaaggtgttctacttgaaaatgaaaggagattattttaggtatctttctgaagtggcatctggagacaacaaacaaaccactgtgtcgaactcccagcaggcttaccaggaagcatttgaaattagtaagaaagaaatgcagcctacacacccaattcgtcttggtctggcactaaatttctcagtcttttactatgagattctaaactctcctgaaaaggcctgtagcctggcaaaaacggcatttgatgaagcaattgctgaattggatacgctgaatgaagagtcttataaagacagcactctgatcatgcagttacttagggacaatctcactctgtggacatcggaaaaccagggagacgaaggagacgctggggagggagagaactaatgtttctcgtgctttgtgatctgttcagtgtcactctgtaccctcaacatatatcccttgtgcgataaaaaaaaaaaaaaaaaaaaaaagagaatcgtacgtcgactttcgatttttcacagcctcagcctaggaaaaatggttcatgggataaacagctggtatttgtatctaaaactcagattggtcacataaatgccacggcattccgaagttttgattttgattaacattgacaggattactgtgtgtttaattttttaaaaactgaacactgtgattatggggttttgtaatttagcagaactcttactggtagaaaaaatagacctgaattatgtgtaactttttggaaggtttaatctgatatcaaaataatcattgaaatacaattccattgtaaagttgtacagaaagttatagagattatattgtgatgctggaacttggagtgagacacacatcatttggcatttgagttgaatggtaattcacagtaatgctgccgttgttcgggacttaaagacacttgacctgtttgggctgttgccacttaaaagttcatgaccacaaatgtccacagtgtcttcctctgaggaaactcgaatcctgaaatggaaattctttgtggcagataactggcttatgacaccttgaaaagttcaagtgctcatataacacaccacactgaaccccctttcctacagcaatatgttcactatgttaccaatttgcaacttgtgcttcaatagtggaatctactttcattgttaacactgagctaaagaaaaaaagccgtgtgttttatgaatgaccttatctgtttcctggataatacctttaagaataatgtcctgagtcaggcgtggtggtgcgtgcatctagtcccaactatttgggaggctgaggcaggaggatcgcttgagcccaggagtttaaagctgcagtgccctgtggttgcacctgtgaataactgcactccagcctgggcaacatagcgagacctcatctccaaaaaagaaaacaaaaaacaaaaaaaggaatgatgttctgtagagatggcctttcacttgaggagtactcagttttcaggttcttcctagctcggggcttttaaattttgaaatctaaacattctttcccaccatcctttttgactgttgaccttggttttctcttctaagtttctgtccctctgcttccttactttttttcctttttgaattctatctttatctgtcttttgttcactttttaatgctatatatgggcaggggtgagagacattactgagcaccttggtgagcaagcctggctttaaagattggagaagagcttctggcaccagaaccctgtcttcctccagttctcaacacggtgttgctcttcagtcataccggaatctgaatcaaaaaagtatttttaaatatccatgatttctccctgtattgaggctagccctgatcatgctttttgtgcctgtcaccaggtctcccaagtgcactcatccaggtcagtgctcagatgtgtttaaggagaccctatattcagggaagttgcgtgaacactgcagtggggagaattgagaatagtcaggcctatcagtctcacagaatcacccctctacctttgatattccacttagctgtagagtccatctgtttgtccatctgctgaaatgagaaaagaaaaatttatgcactgatttaaaacaaaccaaaaaaaaagaaaaaaacaaaaaaaaaaatccctcctttctagctgaacaaaaatgtgcagttaatacttggcgcttgaaaatgcagtagtgaatgtggaaccaagcctgtctgtatatctggtagctcttttcttgctttgttttttcttaccagtattctgcctaacgtttgcttctgtgatggttatattgcctagcaagcacacccgtggttgtgaaaatagtatagcaaaaaagaaaaatccccggttattgatgtactagatttgtgtatgtcttttaaacagttctagtttcaccttacacagaataatcaggaaaagtgtaaaaattcaaaagtgaaataaaaattttatcagttagttgcctgtgaa

SEQ ID NO: 163 - DNA, 2216 bp, Homo sapiens
aaaagcgggcggcgggccgcattgtctgacggcgctccctctctgctttttgttctcgcctcgccgccccgcccctccgcagctctcgaggctcctcccgctgcgggtcggcgctcgccctcgctctcctcgccctccgccccggccccggccccgcgcccgccatggagaagactgagctgatccagaaggccaagctggccgagcaggccgagcgctacgacgacatggccacctgcatgaaggcagtgaccgagcagggcgccgagctgtccaacgaggagcgcaacctgctctccgtggcctacaagaacgtggtcgggggccgcaggtccgcctggagggtcatctctagcatcgagcagaagaccgacacctccgacaagaagttgcagctgattaaggactatcgggagaaagtggagtccgagctgagatccatctgcaccacggtgctggaattgttggataaatatttaatagccaatgcaactaatccagagagtaaggtcttctatctgaaaatgaagggtgattacttccggtaccttgctgaagttgcgtgtggtgatgatcgaaaacaaacgatagataattcccaaggagcttaccaagaggcatttgatataagcaagaaagagatgcaacccacacacccaatccgcctggggcttgctcttaacttttctgtattttactatgagattcttaataacccagagcttgcctgcacgctggctaaaacggcttttgatgaggccattgctgaacttgatacactgaatgaagactcatacaaagacagcaccctcatcatgcagttgcttagagacaacctaacactttggacatcagacagtgcaggagaagaatgtgatgcggcagaaggggctgaaaactaaatccatacagggtgtcatccttctttccttcaagaaacctttttacacatctccattccttattccacttggatttcctatagcaaagaaacccattcatgtgtatggaatcaactgtttatagtcttttcacactgcagctttgggaaaacttcattccttgatttgtgtttgtcttggccttcctggtgtgcagtactgctgtagaaaagtattaatagcttcatttcatataaacataagtaactcccaaacacttatgtagaggactaaaaatgtatctggtatttaagtaatctgaaccagttctgcaagtgactgtgttttgtattactgtgaaaataagaaaatgtagttaattacaatttaaagagtattccacataacttcttaatttctacattccctcccttactcttcgggggtttcctttcagtaagcaacttttccatgctcttaatgtattcctttttagtaggaatccggaagtattagattgaatggaaaagcacttgccatctctgtctaggggtcacaaattgaaatggctcctgtatcacatacggaggtcttgtgtatctgtggcaacagggagtttccttattcactctttatttgctgctgtttaagttgccaacctcccctcccaataaaaattcacttacacctcctgcctttgtagttctggtattcactttactatgtgatagaagtagcatgttgctgccagaatacaagcattgcttttggcaaattaaagtgcatgtcatttcttaatacactagaaaggggaaataaattaaagtacacaagtccaagtctaaaactttagtacttttccatgcagatttgtgcacatgtgagagggtgtccagtttgtctagtgattgttatttagagagttggaccactattgtgtgttgctaatcattgactgtagtcccaaaaaagccttgtgaaaatgttatgccctatgtaacagcagagtaacataaaataaaagtacattttataaaccatttactatggctttgtaacaattgcatacccatattttaagggacaggtgaatttactactttctaaagtttattgatacttcccttttatgtaaaatgtagtagtgatacctatatttccacattgtgcattgtgacacacttgtctagggatgcctggaagtgtataaaattggactgcatttcttagagtgttttactatagatcagtctcatgggccatctcttcctcagatgtaaatgatatctggttaagtgttatatggaataaagtggacattttaaaactagcaaa

SEQ ID NO: 164 - DNA, 812 bp, Homo sapiens
cccctcgcgcagtcaccgagcgcagatcccgcgctctcgattggaacgcctccccatcactcagccacactcaggggctggacgcctcactcccgtttccgagccataaaaggtctaggaccgcttcccccgagccagcaggagcccgtaggtcatcttggagggtcgtctcaagtattgaacaaaagacggaaggtgctgagaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgttta

SEQ ID NO: 165 - DNA, 964 bp, Homo sapiens
atgacaaaggaggagagtcggggacttgagccgtggctccgacttgggcggagcctggaggggggtggttgcgatacgcggaccggagaatttgcactttaaagtccgggtctgcccgttttcgtttcacagtaaccgacgtctcaagtcagaacatccagtcatggataaaaatgagctggttcagaaggccaaactggccgagcaggctgagcgatatgatgacatggcagcctgcatgaagtctgtaactgagcaaggagctgaattatccaatgaggagaggaatcttctctcagttgcttataaaaatgttgtaggagcccgtaggtcatcttggagggtcgtctcaagtattgaacaaaagacggaaggtgctgagaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccat

SEQ ID NO: 166 - DNA, 994 bp, Homo sapiens
gcatggccggggcgccgccggccgcgatccatccccacccttgtctctgcgggcttccaccccctccctcgccgcccttctcgcttccgcccgagataatgactcggcggcggcggcggcgggcatcgcagtggcgcagaacatccagtcatggataaaaatgagctggttcagaaggccaaactggccgagcaggctgagcgatatgatgacatggcagcctgcatgaagtctgtaactgagcaaggagctgaattatccaatgaggagaggaatcttctctcagttgcttataaaaatgttgtaggagcccgtaggtcatcttggagggtcgtctcaagtattgaacaaaagacggaaggtgctgagaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtt

SEQ ID NO: 167 - DNA, 2974 bp, Homo sapiens
ccgccccctcccctctccctcggccgccccctcctttccctccccctcgcgcagcctccgcgctgggcgctgcggcggcgggacccggccctcccccaccccgggaggcggtggcgcggcggggaggggccgggggcctcggggacccaagcgcgagggaaaggcctggccgagagcgggccggagcccaggcctggcgcggcggcgcccgccagaacatccagtcatggataaaaatgagctggttcagaaggccaaactggccgagcaggctgagcgatatgatgacatggcagcctgcatgaagtctgtaactgagcaaggagctgaattatccaatgaggagaggaatcttctctcagttgcttataaaaatgttgtaggagcccgtaggtcatcttggagggtcgtctcaagtattgaacaaaagacggaaggtgctgagaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacatttagggagttatctgttttcatcttgaggtggccaatatggggatgtggaatttttatacaagttataagtgtttggcatagtacttttggtacattgtggcttcaaaagggccagtgtaaaactgcttccatgtctaagcaaagaaaactgcctacatactggtttgtcctggcggggaataaaagggatcattggttccagtcacaggtgtagtaattgtgggtactttaaggtttggagcacttacaaggctgtggtagaatcataccccatggataccacatattaaaccatgtatatctgtggaatactcaatgtgtacacctttgactacagctgcagaagtgttcctttagacaaagttgtgacccattttactctggataagggcagaaacggttcacattccattatttgtaaagttacctgctgttagctttcattatttttgctacactcattttatttgtatttaaatgttttaggcaacctaagaacaaatgtaaaagtaaagatgcaggaaaaatgaattgcttggtattcattacttcatgtatatcaagcacagcagtaaaacaaaaacccatgtatttaacttttttttaggatttttgcttttgtgatttttttttttttgatacttgcctaacatgcatgtgctgtaaaaatagttaacagggaaataacttgagatgatggctagctttgtttaatgtcttatgaaattttcatgaacaatccaagcataattgttaagaacacgtgtattaaattcatgtaagtggaataaaagttttatgaatggacttttcaactactttctctacagcttttcatgtaaattagtcttggttctgaaacttctctaaaggaaattgtacattttttgaaatttattccttattccctcttggcagctaatgggctcttaccaagtttaaacacaaaatttatcataacaaaaatactactaatataactactgtttccatgtcccatgatcccctctcttcctccccaccctgaaaaaaatgagttcctattttttctgggagagggggggattgattagaaaaaaatgtagtgtgttccatttaaaattttggcatatggcattttctaacttaggaagccacaatgttcttggcccatcatgacattgggtagcattaactgtaagttttgtgcttccaaatcactttttggtttttaagaatttcttgatactcttatagcctgccttcaattttgatcctttattctttctatttgtcaggtgcacaagattaccttcctgttttagccttctgtcttgtcaccaaccattcttacttggtggccatgtacttggaaaaaggccgcatgatctttctggctccactcagtgtctaaggcaccctgcttcctttgcttgcatcccacagactatttccctcatcctatttactgcagcaaatctctccttagttgatgagactgtgtttatctccctttaaaaccctacctatcctgaatggtctgtcattgtctgcctttaaaatccttcctctttcttcctcctctattctctaaataatgatggggctaagttatacccaaagctcactttacaaaatatttcctcagtactttgcagaaaacaccaaacaaaaatgccattttaaaaaaggtgtattttttcttttagaatgtaagctcctcaagagcagggacaatgttttctgtatgttctattgtgcctagtacactgtaaatgctcaataaatattgatgatgggaggcagtgagtcttgatgataagggtgagaaactgaaatcccaaa

SEQ ID NO: 168 - DNA, 3197 bp, Homo sapiens
cgcagtcaccgagcgcagatcccgcgctctcgattggaacgcctccccatcactcagccacactcaggggctggacgcctcactcccgtttccgagccataaaaggtctaggaccgcttcccccgagccagcagcgtttgacgtcatcgtgcgtgtggtgcccctgctgccggggctggtgattggaggaaaccccgtgtctgcggagcggctgtagcctgtgagcagcgagatccagggacagagtctcagcctcgccgctgctgccgccgccgccgcccagagactgctgagcccgtccgtccgccgccaccacccactccggacacagaacatccagtcatggataaaaatgagctggttcagaaggccaaactggccgagcaggctgagcgatatgatgacatggcagcctgcatgaagtctgtaactgagcaaggagctgaattatccaatgaggagaggaatcttctctcagttgcttataaaaatgttgtaggagcccgtaggtcatcttggagggtcgtctcaagtattgaacaaaagacggaaggtgctgagaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacatttagggagttatctgttttcatcttgaggtggccaatatggggatgtggaatttttatacaagttataagtgtttggcatagtacttttggtacattgtggcttcaaaagggccagtgtaaaactgcttccatgtctaagcaaagaaaactgcctacatactggtttgtcctggcggggaataaaagggatcattggttccagtcacaggtgtagtaattgtgggtactttaaggtttggagcacttacaaggctgtggtagaatcataccccatggataccacatattaaaccatgtatatctgtggaatactcaatgtgtacacctttgactacagctgcagaagtgttcctttagacaaagttgtgacccattttactctggataagggcagaaacggttcacattccattatttgtaaagttacctgctgttagctttcattatttttgctacactcattttatttgtatttaaatgttttaggcaacctaagaacaaatgtaaaagtaaagatgcaggaaaaatgaattgcttggtattcattacttcatgtatatcaagcacagcagtaaaacaaaaacccatgtatttaacttttttttaggatttttgcttttgtgatttttttttttttgatacttgcctaacatgcatgtgctgtaaaaatagttaacagggaaataacttgagatgatggctagctttgtttaatgtcttatgaaattttcatgaacaatccaagcataattgttaagaacacgtgtattaaattcatgtaagtggaataaaagttttatgaatggacttttcaactactttctctacagcttttcatgtaaattagtcttggttctgaaacttctctaaaggaaattgtacattttttgaaatttattccttattccctcttggcagctaatgggctcttaccaagtttaaacacaaaatttatcataacaaaaatactactaatataactactgtttccatgtcccatgatcccctctcttcctccccaccctgaaaaaaatgagttcctattttttctgggagagggggggattgattagaaaaaaatgtagtgtgttccatttaaaattttggcatatggcattttctaacttaggaagccacaatgttcttggcccatcatgacattgggtagcattaactgtaagttttgtgcttccaaatcactttttggtttttaagaatttcttgatactcttatagcctgccttcaattttgatcctttattctttctatttgtcaggtgcacaagattaccttcctgttttagccttctgtcttgtcaccaaccattcttacttggtggccatgtacttggaaaaaggccgcatgatctttctggctccactcagtgtctaaggcaccctgcttcctttgcttgcatcccacagactatttccctcatcctatttactgcagcaaatctctccttagttgatgagactgtgtttatctccctttaaaaccctacctatcctgaatggtctgtcattgtctgcctttaaaatccttcctctttcttcctcctctattctctaaataatgatggggctaagttatacccaaagctcactttacaaaatatttcctcagtactttgcagaaaacaccaaacaaaaatgccattttaaaaaaggtgtattttttcttttagaatgtaagctcctcaagagcagggacaatgttttctgtatgttctattgtgcctagtacactgtaaatgctcaataaatattgatgatgggaggcagtgagtcttgatgataagggtgagaaactgaaatcccaaacactgttttgttgcttgttttattatgacctcagattaaattgggaaatattggcccttttgaataattgtcccaaatattacattcaaataaaagtgcaatggaga

SEQ ID NO: 169 - DNA, 3064 bp, Homo sapiens
gcagcgtttgacgtcatcgtgcgtgtggtgcccctgctgccggggctggtgattggaggaaaccccgtgtctgcggagcggctgtagcctgtgagcagcgagatccagggacagagtctcagcctcgccgctgctgccgccgccgccgcccagagactgctgagcccgtccgtccgccgccaccacccactccggacacagaacatccagtcatggataaaaatgagctggttcagaaggccaaactggccgagcaggctgagcgatatgatgacatggcagcctgcatgaagtctgtaactgagcaaggagctgaattatccaatgaggagaggaatcttctctcagttgcttataaaaatgttgtaggagcccgtaggtcatcttggagggtcgtctcaagtattgaacaaaagacggaaggtgctgagaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacatttagggagttatctgttttcatcttgaggtggccaatatggggatgtggaatttttatacaagttataagtgtttggcatagtacttttggtacattgtggcttcaaaagggccagtgtaaaactgcttccatgtctaagcaaagaaaactgcctacatactggtttgtcctggcggggaataaaagggatcattggttccagtcacaggtgtagtaattgtgggtactttaaggtttggagcacttacaaggctgtggtagaatcataccccatggataccacatattaaaccatgtatatctgtggaatactcaatgtgtacacctttgactacagctgcagaagtgttcctttagacaaagttgtgacccattttactctggataagggcagaaacggttcacattccattatttgtaaagttacctgctgttagctttcattatttttgctacactcattttatttgtatttaaatgttttaggcaacctaagaacaaatgtaaaagtaaagatgcaggaaaaatgaattgcttggtattcattacttcatgtatatcaagcacagcagtaaaacaaaaacccatgtatttaacttttttttaggatttttgcttttgtgatttttttttttttgatacttgcctaacatgcatgtgctgtaaaaatagttaacagggaaataacttgagatgatggctagctttgtttaatgtcttatgaaattttcatgaacaatccaagcataattgttaagaacacgtgtattaaattcatgtaagtggaataaaagttttatgaatggacttttcaactactttctctacagcttttcatgtaaattagtcttggttctgaaacttctctaaaggaaattgtacattttttgaaatttattccttattccctcttggcagctaatgggctcttaccaagtttaaacacaaaatttatcataacaaaaatactactaatataactactgtttccatgtcccatgatcccctctcttcctccccaccctgaaaaaaatgagttcctattttttctgggagagggggggattgattagaaaaaaatgtagtgtgttccatttaaaattttggcatatggcattttctaacttaggaagccacaatgttcttggcccatcatgacattgggtagcattaactgtaagttttgtgcttccaaatcactttttggtttttaagaatttcttgatactcttatagcctgccttcaattttgatcctttattctttctatttgtcaggtgcacaagattaccttcctgttttagccttctgtcttgtcaccaaccattcttacttggtggccatgtacttggaaaaaggccgcatgatctttctggctccactcagtgtctaaggcaccctgcttcctttgcttgcatcccacagactatttccctcatcctatttactgcagcaaatctctccttagttgatgagactgtgtttatctccctttaaaaccctacctatcctgaatggtctgtcattgtctgcctttaaaatccttcctctttcttcctcctctattctctaaataatgatggggctaagttatacccaaagctcactttacaaaatatttcctcagtactttgcagaaaacaccaaacaaaaatgccattttaaaaaaggtgtattttttcttttagaatgtaagctcctcaagagcagggacaatgttttctgtatgttctattgtgcctagtacactgtaaatgctcaataaatattgatgatgggaggcagtgagtcttgatgataagggtgagaaactgaaatcccaaacactgttttgttgcttgttttattatgacctcagattaaattgggaaatattggcccttttgaataattgtcccaaatattacattcaaataaaagtgcaatgg

SEQ ID NO: 170 - DNA, 1295 bp, Homo sapiens
gctgcccggacgcggagcgagaggctgagagagtcggagacactatccgcttccatccgtcgcgcaggctgagcgatacgacgaaatggtggagtcaatgaagaaagtagcagggatggatgtggagctgacagttgaagaaagaaacctcctatctgttgcatataagaatgtgattggagctagaagagcctcctggagaataatcagcagcattgaacagaaagaagaaaacaagggaggagaagacaagctaaaaatgattcgggaatatcggcaaatggttgagactgagctaaagttaatctgttgtgacattctggatgtactggacaaacacctcattccagcagctaacactggcgagtccaaggttttctattataaaatgaaaggggactaccacaggtatctggcagaatttgccacaggaaacgacaggaaggaggctgcggagaacagcctagtggcttataaagctgctagtgatattgcaatgacagaacttccaccaacgcatcctattcgcttaggtcttgctctcaatttttccgtattctactacgaaattcttaattcccctgaccgtgcctgcaggttggcaaaagcagcttttgatgatgcaattgcagaactggatacgctgagtgaagaaagctataaggactctacacttatcatgcagttgttacgtgataatctgacactatggacttcagacatgcagggtgacggtgaagagcagaataaagaagcgctgcaggacgtggaagacgaaaatcagtgagacataagccaacaagagaaaccatctctgaccaccccctcctccccatcccaccctttggaaactccccattgtcactgagaaccaccaaatctgacttttacatttggtctcagaatttaggttcctgccctgttggttttttttttttttttttaaacagttttcaaaagttcttaaaggcaagagtgaatttctgtggattttactggtcccagcttttaggttctttaagacactaacaggactacatagaggctttttcagcattactgtgtcgtctccgtgccagatgtggcaagatcaccattagcaaatggaaattacatttgaaagccattagacttataggtgatgcaagcatctaagagagaggttaatcacactatagaggcataagtggtatcagttttcatttttctaattgtttaaactgtgttttataccagtgtttgcaagtaattgggtgttagcttgagatggttaaaggtggtttggggagggactt

SEQ ID NO: 171 - DNA, 996 bp, Homo sapiens
agttactaccgcgaagcacggagggtggggcgggccgggcctcggggaggggtggggggatgtgaaaggtcccggatgttgctgaacgggagccccttccagagggagtgactggggcaagcgcagacgggctgagcgaaagctaaggtgggggtagggagagaacgccttcccgccggctgagaggaagagtgggccggcagaggctgcaggggagagggagagagagggcgttggggacccaaagggaaggcgaggagtgggggatttgcgttggggaggaaaaggaaaaaagcagcctcctgccctaggtgcactcgggacaagcgtagaggagctggaagccgagcggggtgggaggagtggcggctgcgggcgaggacgcgcgcgcctccgctcgccctccagcgcgggcgggcaggacgagcgccggggagcggcggttacgcggggccccgatcgctgtgggcaccaatcaacggttgccatagcagcgtttgacgtcatcgtgcgtgtggtgcccctgctgccggggctggtgattggaggaaaccccgtgtctgcggagcggctgtagcctgtgagcagcgagatccagggacagagtctcagcctcgccgctgctgccgccgccgccgcccagagactgctgagcccgtccgtccgccgccaccacccactccggacacagaacatccagtcatggataaaaatgagctggttcagaaggccaaactggccgagcaggctgagcgatatgatgacatggcagcctgcatgaagtctgtaactgagcaaggagctgaattatccaatgaggagaggaatcttctctcagttgcttataaaaatgttgtaggagcccgtaggtcatcttggagggtcgtctcaagtattgaacaaaagacggaaggtgctgagaaaaaacagcagatggctcgagaatacagagagaaaattgagacggagctaagagatatctgcaatgatgtactg

SEQ ID NO: 172 - DNA, 891 bp, Homo sapiens
gagcgggccggagcccaggcctggcgcggcggcgcccgccaggtagaccggggcgaggctgcgcgccggcgggaggggagtccactgcgggaacatccagtcatggataaaaatgagctggttcagaaggccaaactggccgagcaggctgagcgatatgatgacatggcagcctgcatgaagtctgtaactgagcaaggagctgaattatccaatgaggagaggaatcttctctcagttgcttataaaaatgttgtaggagcccgtaggtcatcttggagggtcgtctcaagtattgaacaaaagacggaaggtgctgagaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagacca

SEQ ID NO: 173 - DNA, 648 bp, Homo sapiens
cggagccggggtagtcgccgccgccgccgccgctgcagccactgcaggcaccgctgccgccgcctgagtagtgggcttaggaaggaagaggtcatctcgctcggagcttcgctcggaagggtctttgttccctgcagccctcccacgtgcttgttatattgaagccattttagaattggagcgctatagatcagggaggcagcctctataaaaccaggctgagcaaattcccatgatgctggttctctaggcagagtctccagagatttgggccgctacaaaaagtgcattttgcccattcggctgtggatagagaagcaggaagagcactggacttggagtcagggaatgacaatggataaaagtgagctggtacagaaagccaaactcgctgagcaggctgagcgatatgatgatatggctgcagccatgaaggcagtcacagaacaggggcatgaactctccaacgaagagagaaatctgctctctgttgcctacaagaatgtggtaggcgcccgccgctcttcctggcgtgtcatctccagcattgagcagaaaacagagaggaatgagaagaagcagcagatgggcaaagagtaccgtgagaagatagaggcagaactgcaggacatctgcaatgatgttctg

SEQ ID NO: 174 - DNA, 701 bp, Homo sapiens
aaaaggtctaggaccgcttcccccgagccagcaggtgcactcgggacaagcgtagaggagctggaagccgagcggggtgggaggagtggcggctgcgggcgaggacgcgcgcgcctccgctcgccctccagcgcgggcgggcaggacgagcgccggggagcggcggttacgcggggccccgatcgctgtgggcaccaatcaacggttgccatagcagcgtttgacgtcatcgtgcgtgtggtgcccctgctgccggggctggtgattggaggaaaccccgtgtctgcggagcggctgtagcctgtgagcagcgagatccagggacagagtctcagcctcgccgctgctgccgccgccgccgcccagagactgctgagcccgtccgtccgccgccaccacccactccggacacagaacatccagtcatggataaaaatgagctggttcagaaggccaaactggccgagcaggctgagcgatatgatgacatggcagcctgcatgaagtctgtaactgagcaaggagctgaattatccaatgaggagaggaatcttctctcagttgcttataaaaatgttgtaggagcccgtaggtcatcttggagggtcgtctcaagtattgaacaaaagacggaaggtgctgagaaaaaacagcagatggctcgagaatacagagagaaaattgagacggagctaagagat

SEQ ID NO: 175 - DNA, 556 bp, Homo sapiens
agtcgccgccgccgccgccgctgcagccactgcaggcaccgctgccgccgcctgagtagtgggcttaggaaggaagaggtcatctcgctcggagcttcgctcggaagggtctttgttccctgcagccctcccacgatagcatcaggtcctgattttgcttgccctgtgtgggagatggaatttggcaagatgatgctatgaacataaaatcagcctcgggaaccaaaagagaaaggcagagtctccagagatttgggccgctacaaaaagtgcattttgcccattcggctgtggatagagaagcaggaagagcactggacttggagtcagggaatgacaatggataaaagtgagctggtacagaaagccaaactcgctgagcaggctgagcgatatgatgatatggctgcagccatgaaggcagtcacagaacaggggcatgaactctccaacgaagagagaaatctgctctctgttgcctacaagaatgtggtaggcgcccgccgctcttcctggcgtgtcatctccagcattgagcagaaaacagagaggaatg

SEQ ID NO: 176 - DNA, 665 bp, Homo sapiens
gtgaaggtgagcgcctgggtcggcccgcgggcttcctccggccgcgctcggattgagggccgggcggaggtgccgcccttgagagcagccggttgtcgatgccgctcccctcagggacggctccgggcgggaagctctcgaggctcctcccgctgcgggtcggcgctcgccctcgctctcctcgccctccgccccggccccggccccgcgcccgccatggagaagactgagctgatccagaaggccaagctggccgagcaggccgagcgctacgacgacatggccacctgcatgaaggcagtgaccgagcagggcgccgagctgtccaacgaggagcgcaacctgctctccgtggcctacaagaacgtggtcgggggccgcaggtccgcctggagggtcatctctagcatcgagcagaagaccgacacctccgacaagaagttgcagctgattaaggactatcgggagaaagtggagtccgagctgagatccatctgcaccacggtgctggaattgttggataaatatttaatagccaatgcaactaatccagagagtaaggtcttctatctgaaaatgaagggtgattacttccggtaccttgctgaagttgcgtgtggtgatgatcgaaaacaaacgatagataattcccaaggagcttacca

SEQ ID NO: 177 - DNA, 884 bp, Homo sapiens
agccgcctcgcgcccggtcccgcggtcgcagctccagccgcctcctccgcgcagccgccgcctcagctgctcgctctgtgggtcggtcctctccggcacttgggctccagtcgcgccctccaagcccttcaggccgccccagtgtcctcctccttctccggccagacccagccccgcgaagatggtggaccgcgagcaactggtgcagaaagcccggctggccgagcaggcggagcgctacgacgacatggccgcggccatgaagaacgtgacagagctgaatgagccactgtcgaatgaggaacgaaaccttctgtctgtggcctacaagaacgttgtgggggcacgccgctcttcctggagggtcatcagtagcattgagcagaagacatctgcagacggcaatgagaagaagattgagatggtccgtgcgtaccgggagaagatagagaaggagttggaggctgaagtggccaccggagagaaaagggcgacggtggtggagtcctccgagaaggcctacagcgaagcccacgagatcagcaaagagcacatgcagcccacccaccccatccgattaggcctggctcttaactactccgtcttctactatgagatccagaacgccccagagcaagcgtgccacttggccaagaccgcgttcgacgacgccatcgccgagcttgacaccctcaacgaggactcctacaaggactccacgctcatcatgcagctcctccgcgacaacctcacgctctggacgagcgaccagcaggacgacgatggcggcgaaggcaacaattaaggccccaggggaactggcagcgcacgcggatgctactactgcagtctttatttttttcccatgagttgggggtcgggtg

SEQ ID NO: 178 - DNA, 3007 bp, Homo sapiens
tgtcccctcgcgcagtcaccgagcgcagatcccgcgctctcgattggaacgcctccccatcactcagccacactcaggggctggacgcctcactcccgtttccgagccataaaaggtctaggaccgcttcccccgagccagcagaacatccagtcatggataaaaatgagctggttcagaaggccaaactggccgagcaggctgagcgatatgatgacatggcagcctgcatgaagtctgtaactgagcaaggagctgaattatccaatgaggagaggaatcttctctcagttgcttataaaaatgttgtaggagcccgtaggtcatcttggagggtcgtctcaagtattgaacaaaagacggaaggtgctgagaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacatttagggagttatctgttttcatcttgaggtggccaatatggggatgtggaatttttatacaagttataagtgtttggcatagtacttttggtacattgtggcttcaaaagggccagtgtaaaactgcttccatgtctaagcaaagaaaactgcctacatactggtttgtcctggcggggaataaaagggatcattggttccagtcacaggtgtagtaattgtgggtactttaaggtttggagcacttacaaggctgtggtagaatcataccccatggataccacatattaaaccatgtatatctgtggaatactcaatgtgtacacctttgactacagctgcagaagtgttcctttagacaaagttgtgacccattttactctggataagggcagaaacggttcacattccattatttgtaaagttacctgctgttagctttcattatttttgctacactcattttatttgtatttaaatgttttaggcaacctaagaacaaatgtaaaagtaaagatgcaggaaaaatgaattgcttggtattcattacttcatgtatatcaagcacagcagtaaaacaaaaacccatgtatttaacttttttttaggatttttgcttttgtgatttttttttttttgatacttgcctaacatgcatgtgctgtaaaaatagttaacagggaaataacttgagatgatggctagctttgtttaatgtcttatgaaattttcatgaacaatccaagcataattgttaagaacacgtgtattaaattcatgtaagtggaataaaagttttatgaatggacttttcaactactttctctacagcttttcatgtaaattagtcttggttctgaaacttctctaaaggaaattgtacattttttgaaatttattccttattccctcttggcagctaatgggctcttaccaagtttaaacacaaaatttatcataacaaaaatactactaatataactactgtttccatgtcccatgatcccctctcttcctccccaccctgaaaaaaatgagttcctattttttctgggagagggggggattgattagaaaaaaatgtagtgtgttccatttaaaattttggcatatggcattttctaacttaggaagccacaatgttcttggcccatcatgacattgggtagcattaactgtaagttttgtgcttccaaatcactttttggtttttaagaatttcttgatactcttatagcctgccttcaattttgatcctttattctttctatttgtcaggtgcacaagattaccttcctgttttagccttctgtcttgtcaccaaccattcttacttggtggccatgtacttggaaaaaggccgcatgatctttctggctccactcagtgtctaaggcaccctgcttcctttgcttgcatcccacagactatttccctcatcctatttactgcagcaaatctctccttagttgatgagactgtgtttatctccctttaaaaccctacctatcctgaatggtctgtcattgtctgcctttaaaatccttcctctttcttcctcctctattctctaaataatgatggggctaagttatacccaaagctcactttacaaaatatttcctcagtactttgcagaaaacaccaaacaaaaatgccattttaaaaaaggtgtattttttcttttagaatgtaagctcctcaagagcagggacaatgttttctgtatgttctattgtgcctagtacactgtaaatgctcaataaatattgatgatgggaggcagtgagtcttgatgataagggtgagaaactgaaatcccaaacactgttttgttgcttgttttattatgacctcagattaaattgggaaatattggcccttttgaataattgtcccaaatattacattcaaataaaagtgcaatgg

SEQ ID NO: 179 - DNA, 1012 bp, Homo sapiens
agagtctcagcctcgccgctgctgccgccgccgccgcccagagactgctgagcccgtccgtccgccgccaccacccactccggacacagaacatccagtcatggataaaaatgagctgaattatccaatgaggagaggaatcttctctcagttgcttataaaaatgttgtaggagcccgtaggtcatcttggagggtcgtctcaagtattgaacaaaagacggaaggtgctgagaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacatttagggagttatctgttttcatcttgaggtggccaatatggggatgtggaatttttatacaagttataagtgtt

SEQ ID NO: 180 - DNA, 1399 bp, Homo sapiens
acagagtctcagcctcgccgctgctgccgccgccgccgcccagagactgctgagcccgtccgtccgccgccaccacccactccggacacagtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacatttagggagttatctgttttcatcttgaggtggccaatatggggatgtggaatttttatacaagttataagtgtttggcatagtacttttggtacattgtggcttcaaaagggccagtgtaaaactgcttccatgtctaagcaaagaaaactgcctacatactggtttgtcctggcggggaataaaagggatcattggttccagtcacaggtgtagtaattgtgggtactttaaggtttggagcacttacaaggctgtggtagaatcataccccatggataccacatattaaaccatgtatatctgtggaatactcaatgtgtacacctttgactacagctgcagaagtgttcctttagacaaagttgtgacccattttactctggataagggcagaaacggttcacattccattatttgtaaagttacctgctgttagctttcattatttttgctacactcattttatttgtatttaaatgttttaggcaacctaagaacaaatgtaaaagtaaagatgcaggaaaaatgaattgcttggtattcattacttcatgtatatcaagcacagcagtaaaacaaaaacccatgtatttaacttttttttaggatttttgcttttgtgatttttttttttttgatacttgcctaacatgcatgtgctgtaaaaatagttaaca

SEQ ID NO: 181 - DNA, 511 bp, Homo sapiens
agcccgcagtcggctcccgtgcttgatggactagaactggagggtccctgcgctcggtttggggacgcatatcctgctttgggggcggaacatccagtcatggataaaaatgagctggttcagaaggccaaactggccgagcaggctgagcgatatgatgacatggcagcctgcatgaagtctgtaactgagcaaggagctgaattatccaatgaggagaggaatcttctctcagttgcttataaaaatgttgtaggagcccgtaggtcatcttggagggtcgtctcaagtattgaacaaaagacggaaggtgctgagaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgaca

SEQ ID NO: 182 - DNA, 750 bp, Homo sapiens
aacatccagtcatggataaaaatgagctggttcagaaggccaaactggccgagcaggctgagcgatatgatgacatggcagcctgcatgaagtctgtaactgagcaaggagctgaattatccaatgaggagaggaatcttctctcagttgcttataaaaatgttgtaggagcccgtaggtcatcttggagggtcgtctcaagtattgaacaaaagacggaaggtgctgagaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagtacgttttggtgtgtcttatccagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaag

SEQ ID NO: 183 - DNA, 1394 bp, Homo sapiens
gctataatgttaatgtaatgagtcaaccatgcagaaaactctggcgtcacaactatgaaacctcttcctgcattgaattcttgaagtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacatttagggagttatctgttttcatcttgaggtggccaatatggggatgtggaatttttatacaagttataagtgtttggcatagtacttttggtacattgtggcttcaaaagggccagtgtaaaactgcttccatgtctaagcaaagaaaactgcctacatactggtttgtcctggcggggaataaaagggatcattggttccagtcacaggtgtagtaattgtgggtactttaaggtttggagcacttacaaggctgtggtagaatcataccccatggataccacatattaaaccatgtatatctgtggaatactcaatgtgtacacctttgactacagctgcagaagtgttcctttagacaaagttgtgacccattttactctggataagggcagaaacggttcacattccattatttgtaaagttacctgctgttagctttcattatttttgctacactcattttatttgtatttaaatgttttaggcaacctaagaacaaatgtaaaagtaaagatgcaggaaaaatgaattgcttggtattcattacttcatgtatatcaagcacagcagtaaaacaaaaacccatgtatttaacttttttttaggatttttgcttttgtgatttttttttttttgatacttgcctaacatgcatgtgctgtaaaaatagttaaca

SEQ ID NO: 184 - DNA, 875 bp, Homo sapiens
tcagcctcccgagtagctgggattacagtcgtgtgccaccacatccaatttttttttttttcccagtagagacggggtgtcacccaggctggtaatctttattttaaattgtacttgctcctaagaatttaggtgttaagagcatagcatgtagaaggaaaaaataaagctgctgtaacctcatcctgccttcttggagatgagaatctgagacccaggaagatttcagagttttgtcaaggtgacagagtttgaatttaggcatctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattagggg

SEQ ID NO: 185 - DNA, 567 bp, Homo sapiens
gcacggagggtggggcgggccgggcctcggggaggggtggggggatgtgaaaggtcccggatgttgctgaacgggagccccttccagagggagtgactggggcaagcgcagacgggctgagcgaaagctaagcgtttgacgtcatcgtgcgtgtggtgcccctgctgccggggctggtgattggaggaaaccccgtgtctgcggagcggctgtagcctgtgagcagcgagatccagggacagagtctcagcctcgccgctgctgccgccgccgccgcccagagactgctgagcccgtccgtccgccgccaccacccactccggacacagaacatccagtcatggataaaaatgagctggttcagaaggccaaactggccgagcaggctgagcgatatgatgacatggcagcctgcatgaagtctgtaactgagcaaggagctgaattatccaatgaggagaggaatcttctctcagttgcttataaaaatgttgtaggagcccgtaggtcatcttggagggtcgtctcaagtattgaacaaaagacggaaggtgctgagaaaaaaca

SEQ ID NO: 186 - DNA, 664 bp, Homo sapiens
gtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtgcacaagattaccttcctgttttagccttctgtcttgtcaccaaccattcttacttggtggccatgtacttggaaaaaggccgcatgatctttctggctccactcagtgtctaaggcaccctgcttcctttgcttgcatcccacagactatttccctcatcctatt

SEQ ID NO: 187 - DNA, 1362 bp, Homo sapiens
agctccagccgcctcctccgcgcagccgccgcctcagctgctcgctctgtgggtcggtcctctccggcacttgggctccagtcgcgccctccaagcccttcaggccgccccagtgtcctcctccttctccggctggccgagcaggcggagcgctacgacgacatggccgcggccatgaagaacgtgacagagctgaatgagccactgtcgaatgaggaacgaaaccttctgtctgtggcctacaagaacgttgtgggggcacgccgctcttcctggagggtcatcagtagcattgagcagaagacatctgcagacggcaatgagaagaagattgagatggtccgtgcgtaccgggagaagatagagaaggagttggaggctgtgtgccaggatgtgctgagcctgctggataactacctgatcaagaattgcagcgagacccagtacgagagcaaagtgttctacctgaagatgaaaggggactactaccgctacctggctgaagtggccaccggagagaaaagggcgacggtggtggagtcctccgagaaggcctacagcgaagcccacgagatcagcaaagagcacatgcagcccacccaccccatccgattaggcctggctcttaactactccgtcttctactatgagatccagaacgccccagagcaagcgtgccacttggccaagaccgcgttcgacgacgccatcgccgagcttgacaccctcaacgaggactcctacaaggactccacgctcatcatgcagctcctccgcgacaacctcacgctctggacgagcgaccagcaggacgacgatggcggcgaaggcaacaattaaggccccaggggaactggcagcgcacgcggatgctactactgcagtctttatttttttcccatgagttgggggtcgggtgggggagggaaagggagggatgaccttcccagggagaaacccacgacctgtcctgtctttgatcgcctctttgacatttttgccaaaataccactagtggaaagtcaggctagctgtgctggtattggaatagcagcctcacactggcgtctggactgttctgtagattcatgcaagtggagctgtctgtctctaatttaacttattgctagataatagggttttcagatgaaaagaaaacttaaagaggaatggccctcattcagtaagttctgtggttccagtaaggatttttatgtacatacgctctcgtctctcgttttgggtactttctatctcatctgtctcggctctgcatgttttccagggtgtagcctacagacatggaacagtgtaaatcccagactgacagacttagaacctgaggtctcattcatccttatg

SEQ ID NO: 188 - DNA, 1651 bp, Homo sapiens
atggagaagactgagctgatccagaaggccgtggcctacaagaacgtggtcgggggccgcaggtccgcctggagggtcatctctagcatcgagcagaagaccgacacctccgacaagaagttgcagctgattaaggactatcgggagaaagtggagtccgagctgagatccatctgcaccacggtgctggaattgttggataaatatttaatagccaatgcaactaatccagagagtaaggtcttctatctgaaaatgaagggtgattacttccggtaccttgctgaagttgcgtgtggtgatgatcgaaaacaaacgatagataattcccaaggagcttaccaagaggcatttgatataagcaagaaagagatgcaacccacacacccaatccgcctggggcttgctcttaacttttctgtattttactatgagattcttaataacccagagcttgcctgcacgctggctaaaacggcttttgatgaggccattgctgaacttgatacactgaatgaagactcatacaaagacagcaccctcatcatgcagttgcttagagacaacctaacactttggacatcagacagtgcaggagaagaatgtgatgcggcagaaggggctgaaaactaaatccatacagggtgtcatccttctttccttcaagaaacctttttacacatctccattccttattccacttggatttcctatagcaaagaaacccattcatgtgtatggaatcaactgtttatagtcttttcacactgcagctttgggaaaacttcattccttgatttgtgtttgtcttggccttcctggtgtgcagtactgctgtagaaaagtattaatagcttcatttcatataaacataagtaactcccaaacacttatgtagaggactaaaaatgtatctggtatttaagtaatctgaaccagttctgcaagtgactgtgttttgtattactgtgaaaataagaaaatgtagttaattacaatttaaagagtattccacataacttcttaatttctacattccctcccttactcttcgggggtttcctttcagtaagcaacttttccatgctcttaatgtattcctttttagtaggaatccggaagtattagattgaatggaaaagcacttgccatctctgtctaggggtcacaaattgaaatggctcctgtatcacatacggaggtcttgtgtatctgtggcaacagggagtttccttattcactctttatttgctgctgtttaagttgccaacctcccctcccaataaaaattcacttacacctcctgcctttgtagttctggtattcactttactatgtgatagaagtagcatgttgctgccagaatacaagcattgcttttggcaaattaaagtgcatgtcatttcttaatacactagaaaggggaaataaattaaagtacacaagtccaagtctaaaactttagtacttttccatgcagatttgtgcacatgtgagagggtgtccagtttgtctagtgattgttatttagagagttggaccactattgtgtgttgctaatcattgactgtagtcccaaaaaagccttgtgaaaatgttatgccctatgtaacagcagagtaacataaaataaaagtacattttataaacc

SEQ ID NO: 189 - DNA, 2260 bp, Homo sapiens
aatgcggcagcgagtgctacgcctgcgcagtaggcctccggtcgccgttccccttccccggctctagcaggccggcttctctgtccaatgcccacccggagctgggaggaggagtctgcgtaatgtgcgtgtgaagagactgggggagctggccggggctcacggtgtttgacccgtcggtcgtgcgtgagaggaaagggaaggaggaggtcccgaatagcggtcgccgaaatgttccggtgtggaggcctggcggcgggtgctttgaagcagaagctggtgcccttggtgcggaccgtgtgcgtccgaagcccgaggcagaggaaccggctcccaggcaacttgttccagcgatggcatgttcctctagaactccagatgacaagacaaatggctagctctggtgcatcagggggcaaaatcgataattctgtgttagtccttattgtgggcttatcaacagtaggagctggtgcctatgcctacaagactatgaaagaggatgaaaaaagatacaatgaaagaatttcagggttagggctgacaccagaacagaaacagaaaaaggccgcgttatctgcttcagaaggagaggaagttcctcaagacaaggcgccaagtcatgttcctttcctgctaattggtggaggcacagctgcttttgctgcagccagatccatccgggctcgggatcctggggccagggtactgattgtatctgaagatcctgagctgccgtacatgcgacctcctctttcaaaagaactgtggttttcagatgacccaaatgtcacaaagacactgcgattcaaacagtggaatggaaaagagagaagcatatatttccagccaccttctttctatgtctctgctcaggacctgcctcatattgagaatggtggtgtggctgtcctcactgggaagaaggtagtacagctggatgtgagagacaacatggtgaaacttaatgatggctctcaaataacctatgaaaagtgcttgattgcaacaggaggtactccaagaagtctgtctgccattgatagggctggagcagaggtgaagagtagaacaacgcttttcagaaagattggagactttagaagcttggagaagatttcacgggaagtcaaatcaattacgattatcggtgggggcttccttggtagcgaactggcctgtgctcttggcagaaaggctcgagccttgggcacagaagtgattcaactcttccccgagaaaggaaatatgggaaagatcctccccgaatacctcagcaactggaccatggaaaaagtcagacgagagggggttaaggtgatgcccaatgctattgtgcaatccgttggagtcagcagtggcaagttacttatcaagctgaaagacggcaggaaggtagaaactgaccacatagtggcagctgtgggcctggagcccaatgttgagttggccaagactggtggcctggaaatagactcagattttggtggcttccgggtaaatgcagagctacaagcacgctctaacatctgggtggcaggagatgctgcatgcttctacgatataaagttgggaaggaggcgggtagagcaccatgatcacgctgttgtgagtggaagattggctggagaaaatatgactggagctgctaagccgtactggcatcagtcaatgttctggagtgatttgggccccgatgttggctatgaagctattggtcttgtggacagtagtttgcccacagttggtgtttttgcaaaagcaactgcacaagacaaccccaaatctgccacagagcagtcaggaactggtatccgatcagagagtgagacagagtccgaggcctcagaaattactattcctcccagcaccccggcagttccacaggctcccgtccagggggaggactacggcaaaggtgtcatcttctacctcagggacaaagtggtcgtggggattgtgctatggaacatctttaaccgaatgccaatagcaaggaagatcattaaggacggtgagcagcatgaagatctcaatgaagtagccaaactattcaacattcatgaagactgaagccccacagtggaattggcaaacccactgcagcccctgagaggaggtcgaatgggtaaaggagcatttttttattcagcagactttctctgtgtatgagtgtgaatgatcaagtcctttgtgaatattttcaactatgtaggtaaattcttaatgttcacatagtgaaataaattctgattcttct

SEQ ID NO: 190 - DNA, 3240 bp, Homo sapiens
ggccgttcggagaccagccccagcgtgccaggaccgtttccggggcctggccggggcgttgccgcggggtcggggaccagcacgagtgctgagtcacgccccgcccgggagcgcctcgggtcagtaactcgggaagacgaccaagcgggagcgggagcgggagcgggagccggagcgagagcgcgcgggcgcggccgacagtgcctgatttgagatggggtcccaggtctcggtggaatcgggagctctgcacgtggtgattgtgggtgggggctttggcgggatcgcagcagccagccagctgcaggccctgaacgtccccttcatgctggtggacatgaaggactccttccaccacaatgtggctgctctccgagcctccgtggagacagggttcgccaaaaagacattcatttcttactcggtgactttcaaggacaacttccggcaggggctagtagtggggatagacctgaagaaccagatggtgctgctgcagggtggcgaggccctgcccttctctcatcttatcctggccacgggcagcactgggcccttcccgggcaagtttaatgaggtttccagccagcaggccgctatccaggcctatgaggacatggtgaggcaggtccagcgctcacggttcatcgtggtggtgggaggaggctcggctggagtggagatggcagcagagattaaaacagaatatcctgagaaagaggtcactctcattcactcccaagtggccctggctgacaaggagctcctgccctccgtccggcaggaagtgaaggagatcctcctccggaagggcgtgcagctgctgctgagtgagcgggtgagcaatctggaggagctgcctctcaatgagtatcgagagtacatcaaagtgcagacggacaaaggcacagaggtggccaccaacctggtgattctctgcaccggcatcaagatcaacagctccgcctaccgcaaagcgtttgagagcagactagccagcagtggtgctctgagagtgaacgagcacctccaggtggagggccacagcaacgtctacgccattggtgactgtgccgacgtgaggacgcccaagatggcctatcttgccggcctccacgccaacatcgccgtggccaacatcgtcaactctgtgaagcagcggcctctccaggcctacaagccgggtgcactgacgttcctcctgtccatggggagaaatgacggtgtgggccaaatcagtggcttctatgtgggccggctcatggttcggctgaccaagagccgggacctgttcgtctctacgagctggaaaaccatgaggcagtctccaccttgatggagaggccaggcgggagaactaccgcagcaggtgggcgtacggactgcttggcgcatggcacccgcctggcaagtgctagaactaatgctattcttctggaataagatgccaatgatgtggtggctagaaatgcaacttgtataaaacaaaaatgggagagagagaggtattaaacaaataccccccttagaggatactttctgggtttggaaggtgtgcttgctgtggtactgggtgagcggctcatgtgtgctggctgcatggtgctggggaggccacagccagcccttcctctgcacctgcctcctctgggatgtgcatgtgtgtgtacgtgcttgtggtcatgacgcgtgccatttagagctctcagagcagggcagattgctgggctctggtggccagtgtctgtctgtgagggcaggaaggagagctgcacattgagaacaaaggagggacctgaggtggagagaggcccagcaccccaaatctctgccatcacacggtcggggagcccatacattctgcaacaaccagggacttcacaggagccttgttttcaatttgctaacaggtgcataatccctgtgctccttaagcctcatggccttcctacatttccactttatttgtttgtttgtttatttatttttgagacagtctcgccctgtcacccaggctggagtgcagtggcacgatctcagctcactgcaacctacgccttctgggttcacgtgattctcttgccttagcctcccaagtagctgggactacaggcacgtgccaccatgcctggctaatttttgtattttttaaatagagacggggtttcactgtgttggccaggctggtctcgaacacctgacctcaggtgatccattcgtcttggcctctcgaagtgctgggattccaggcgtgagccactgcggccagcacatttccacttttagatcctactccataccacaggtttcatttaagaagaaagagctagataaatgtgctcttctggttaccccaccctgacagagtgcatttttacacggctagcaggggttgagactgcagcctggcctgccagccattggaggtgtttaaggaagggcagataatgtgactctttgcggggtgccatctgcttacccattagcgagcagagggggtttctgcgggtgacccccagcatatttctaggttacttatgggcagatttgtaagtgacaaaactccagctgatgctgggaatggggagagggcccttgagggactttgtggttttgtgcttctggtttcctggccaaccccagggtcacttgtctggaggcccagctgggcactaatgtctgccaccgactatgttacagtgtataaatgattcctctatttgggagagatcttccaatccagaggagcccctcttggactgcctgggttaaatctgcatagcagaagtggttgatgagttcatctgaagaaattcaggccccacctccccaccctgcccctccctgctcccttttgatggtggcctctgggtactcgggcagagtccttgggacaccagcctctctggggttctcaggccatcccgttggggctgtcgcccaggcctaagtgagtcgtgtgcctctattggaggatggctgttcccctggtggttgcatccaagtatctgtctttctttatggaccacgaagggaagcccaccttcctggaggcaggaccttcggcctaagaaacacaggccctggtgctatctgacctggggtccagcgaggtgggaatcccagtgtgtgagcgacaggccttcttctattgacttacaatattctagaaggacctacgtgtggggacacagttttccaaactgaggaaaatgttgcaataaaagaatatgttgtaag

SEQ ID NO: 191 - DNA, 2248 bp, Homo sapiens
agcgagtgctacgcctgcgcagtaggcctccggtcgccgttccccttccccggctctagcaggccggcttctctgtccaatgcccacccggagctgggaggaggagtctgcgtaatgtgcgtgtgaagagactgggggagctggccggggctcacggtgtttgacccgtcggtcgtgcgtgagaggaaagggaaggaggaggtcccgaatagcggtcgccgaaatgttccggtgtggaggcctggcggcgggtgctttgaagcagaagctggtgcccttggtgcggaccgtgtgcgtccgaagcccgaggcagaggaaccggctcccagttgtgcagtctcatcacctaggatccccttctagatcactagcatctacaggtgcttctgggaaagatggcagcaacctagtgtacttcttaattgtaggagcaacagtcactggggcaggagtttattatgcctacaagactatgaaagaggatgaaaaaagatacaatgaaagaatttcagggttagggctgacaccagaacagaaacagaaaaaggccgcgttatctgcttcagaaggagaggaagttcctcaagacaaggcgccaagtcatgttcctttcctgctaattggtggaggcacagctgcttttgctgcagccagatccatccgggctcgggatcctggggccagggtactgattgtatctgaagatcctgagctgccgtacatgcgacctcctctttcaaaagaactgtggttttcagatgacccaaatgtcacaaagacactgcgattcaaacagtggaatggaaaagagagaagcatatatttccagccaccttctttctatgtctctgctcaggacctgcctcatattgagaatggtggtgtggctgtcctcactgggaagaaggtagtacagctggatgtgagagacaacatggtgaaacttaatgatggctctcaaataacctatgaaaagtgcttgattgcaacaggaggtactccaagaagtctgtctgccattgatagggctggagcagaggtgaagagtagaacaacgcttttcagaaagattggagactttagaagcttggagaagatttcacgggaagtcaaatcaattacgattatcggtgggggcttccttggtagcgaactggcctgtgctcttggcagaaaggctcgagccttgggcacagaagtgattcaactcttccccgagaaaggaaatatgggaaagatcctccccgaatacctcagcaactggaccatggaaaaagtcagacgagagggggttaaggtgatgcccaatgctattgtgcaatccgttggagtcagcagtggcaagttacttatcaagctgaaagacggcaggaaggtagaaactgaccacatagtggcagctgtgggcctggagcccaatgttgagttggccaagactggtggcctggaaatagactcagattttggtggcttccgggtaaatgcagagctacaagcacgctctaacatctgggtggcaggagatgctgcatgcttctacgatataaagttgggaaggaggcgggtagagcaccatgatcacgctgttgtgagtggaagattggctggagaaaatatgactggagctgctaagccgtactggcatcagtcaatgttctggagtgatttgggccccgatgttggctatgaagctattggtcttgtggacagtagtttgcccacagttggtgtttttgcaaaagcaactgcacaagacaaccccaaatctgccacagagcagtcaggaactggtatccgatcagagagtgagacagagtccgaggcctcagaaattactattcctcccagcaccccggcagttccacaggctcccgtccagggggaggactacggcaaaggtgtcatcttctacctcagggacaaagtggtcgtggggattgtgctatggaacatctttaaccgaatgccaatagcaaggaagatcattaaggacggtgagcagcatgaagatctcaatgaagtagccaaactattcaacattcatgaagactgaagccccacagtggaattggcaaacccactgcagcccctgagaggaggtcgaatgggtaaaggagcatttttttattcagcagactttctctgtgtatgagtgtgaatgatcaagtcctttgtgaatattttcaactatgtaggtaaattcttaatgttcacatagtgaaataaattctgattcttctaaattaaa

SEQ ID NO: 192 - DNA, 2230 bp, Homo sapiens
caggtcctagagcagctccagcaggatggcggctccagcgtctctaaggcctgcagggggtccagccccatggggggcgccctaggcctccgacagctccccatctgtgctcctgcctgccggccatcctcaggccactcgccatgggcggctgcttctccaaacccaaaccagtggagctcaagatcgaggtggtgctgcctgagaaggagcgaggcaaggaggagctgtcggccagtgggaagggcagcccccgggcctaccagggcaatggcacggcccgccacttccacacggaggagcgcctgtccacccctcacccctaccccagccctcaggattgcgtggaggctgctgtctgccacgtcaaggacctcgagaatggccagatgcgggaagtggagctgggctgggggaaggtgttgctggtgaaggacaatggggagttccacgccctgggccataagtgtccgcactacggcgcacccctggtgaaaggcgttctgtcccgtggtcgggtgcgctgcccctggcacggcgcctgcttcaacatcagcactggggacctggaggacttccctggcctggacagtctacacaagttccaggtgaagattgagaaggagaaggtgtacgtccgggccagcaagcaggccctacagctgcagcgaaggaccaaggtgatggccaagtgtatctctccaagtgctgggtacagcagtagcaccaatgtgctcattgtgggtgcaggtgcagctggcctggtgtgtgcagagacactgcggcaggagggcttctccgaccggatcgtcctgtgcacgctagaccggcaccttccctacgaccgtcccaagctcagcaagtccctggacacacagcctgagcagctggccctgaggcccaaggagtttttccgagcctatggcatcgaggtgctcaccgaggctcaggtggtcacagtggacgtgagaactaagaaggtcgtgttcaaggatggcttcaagctggagtacagcaagctgctgctggcaccagggagcagccccaagactctgagctgcaaaggcaaagaagtggagaacgtgttcactatccggacgccagaggatgccaatcgcgtggtgaggctggcccgaggccgcaacgtggtcgtcgtgggagccggcttcctggggatggaggtggccgcttacctgacggagaaggcccactctgtgtctgtggtggagctggaggagacgcccttcaggaggttcctgggggagcgcgtgggtcgagccctcatgaagatgtttgagaacaaccgggtgaagttctacatgcagacggaggtgtctgagctgcggggccaggagggaaagctgaaggaggttgtgctgaagagcagcaaggtcgtgcgggctgacgtctgcgtggtgggcattggtgcagtgcccgccacaggcttcctgaggcaaagcggcatcggtttggattcccgaggcttcatccctgtcaacaagatgatgcagaccaatgtcccaggcgtgtttgcagctggcgatgctgtcaccttcccccttgcctggaggaacaaccgcaaagtgaacattccacattggcagatggctcatgctcaggggcgcgtggcagcccagaacatgttggcgcaggaggcggagatgagcactgtgccctacctctggaccgccatgtttggcaagagcctgcgctacgcgggctacggagaaggcttcgacgacgtcatcatccagggggatctggaggagctgaagtttgtggctttttacactaaaggcgacgaggtgatcgccgtggccagcatgaactacgatcccattgtgtccaaggtcgctgaggtgctggcctcaggccgtgccatccggaagcgggaggtggagactggcgacatgtcctggcttacggggaaaggatcctgagctcacatgcagtagacttgggcaggcaaagggggcaccaagggcacaggccaagccttgggggcaggtgccaatctccagtcccaggatcccccagggcagaacctgagccctcccagtgcttgccttcagccacctggctcccctcctgggaggcctctgctggatccagaagatgctcaaccctcaaggcctctgctgccactgacagctggcactggaggcaggacaagccctgcctcttctccctctattgggactggtcccctgaagaaccctgcaacacgtta

SEQ ID NO: 193 - DNA, 2157 bp, Homo sapiens
gctgggcctggaacacggagcagtggctgccctgcgaggaggtcctagagcagctccagcaggatggcggctccagcgtctctaaggcctgcagggggtccagccccatggggggcgccctaggcctccgacagctccccatctgtgctcctgcctgccggccatcctcaggccactcgccatgggcggctgcttctccaaacccaaaccagtggagctcaagatcgaggtggtgctgcctgagaaggagcgaggcaaggaggagctgtcggccagtgggaagggcagcccccgggcctaccagggcaatggcacggcccgccacttccacacggaggagcgcctgtccacccctcacccctaccccagccctcaggattgcgtggaggctgctgtctgccacgtcaaggacctcgagaatggccagcgttctgtcccgtggtcgggtgcgctgcccctggcacggcgcctgcttcaacatcagcactggggacctggaggacttccctggcctggacagtctacacaagttccaggtgaagattgagaaggagaaggtgtacgtccgggccagcaagcaggccctacagctgcagcgaaggaccaaggtgatggccaagtgtatctctccaagtgctgggtacagcagtagcaccaatgtgctcattgtgggtgcaggtgcagctggcctggtgtgtgcagagacactgcggcaggagggcttctccgaccggatcgtcctgtgcacgctagaccggcaccttccctacgaccgtcccaagctcagcaagtccctggacacacagcctgagcagctggccctgaggcccaaggagtttttccgagcctatggcatcgaggtgctcaccgaggctcaggtggtcacagtggacgtgagaactaagaaggtcgtgttcaaggatggcttcaagctggagtacagcaagctgctgctggcaccagggagcagccccaagactctgagctgcaaaggcaaagaagtggagaacgtgttcactatccggacgccagaggatgccaatcgcgtggtgaggctggcccgaggccgcaacgtggtcgtcgtgggagccggcttcctggggatggaggtggccgcttacctgacggagaaggcccactctgtgtctgtggtggagctggaggagacgcccttcaggaggttcctgggggagcgcgtgggtcgagccctcatgaagatgtttgagaacaaccgggtgaagttctacatgcagacggaggtgtctgagctgcggggccaggagggaaagctgaaggaggttgtgctgaagagcagcaaggtcgtgcgggctgacgtctgcgtggtgggcattggtgcagtgcccgccacaggcttcctgaggcaaagcggcatcggtttggattcccgaggcttcatccctgtcaacaagatgatgcagaccaatgtcccaggcgtgtttgcagctggcgatgctgtcaccttcccccttgcctggaggaacaaccgcaaagtgaacattccacattggcagatggctcatgctcaggggcgcgtggcagcccagaacatgttggcgcaggaggcggagatgagcactgtgccctacctctggaccgccatgtttggcaagagcctgcgctacgcgggctacggagaaggcttcgacgacgtcatcatccagggggatctggaggagctgaagtttgtggctttttacactaaaggcgacgaggtgatcgccgtggccagcatgaactacgatcccattgtgtccaaggtcgctgaggtgctggcctcaggccgtgccatccggaagcgggaggtggagactggcgacatgtcctggcttacggggaaaggatcctgagctcacatgcagtagacttgggcaggcaaagggggcaccaagggcacaggccaagccttgggggcaggtgccaatctccagtcccaggatcccccagggcagaacctgagccctcccagtgcttgccttcagccacctggctcccctcctgggaggcctctgctggatccagaagatgctcaaccctcaaggcctctgctgccactgacagctggcactggaggcaggacaagccctgcctcttctccctctattgggactggtcccctgaagaaccctgcaacacgtt

SEQ ID NO: 194 - DNA, 1200 bp, Homo sapiens
aggtcccgaatagcggtcgccgaaatgttccggtgtggaggcctggcggcgggtgctttgaagcagaagctggtgcccttggtgcggaccgtgtgcgtccgaagcccgaggcagaggaaccggctcccagctcgagccttgggcacagaagtgattcaactcttccccgagaaaggaaatatgggaaagatcctccccgaatacctcagcaactggaccatggaaaaagtcagacgagagggggttaaggtgatgcccaatgctattgtgcaatccgttggagtcagcagtggcaagttacttatcaagctgaaagacggcaggaaggtagaaactgaccacatagtggcagctgtgggcctggagcccaatgttgagttggccaagactggtggcctggaaatagactcagattttggtggcttccgggtaaatgcagagctacaagcacgctctaacatctgggtggcaggagatgctgcatgcttctacgatataaagttgggaaggaggcgggtagagcaccatgatcacgctgttgtgagtggaagattggctggagaaaatatgactggagctgctaagccgtactggcatcagtcaatgttctggagtgatttgggccccgatgttggctatgaagctattggtcttgtggacagtagtttgcccacagttggtgtttttgcaaaagcaactgcacaagacaaccccaaatctgccacagagcagtcaggaactggtatccgatcagagagtgagacagagtccgaggcctcagaaattactattcctcccagcaccccggcagttccacaggctcccgtccagggggaggactacggcaaaggtgtcatcttctacctcagggacaaagtggtcgtggggattgtgctatggaacatctttaaccgaatgccaatagcaaggaagatcattaaggacggtgagcagcatgaagatctcaatgaagtagccaaactattcaacattcatgaagactgaagccccacagtggaattggcaaacccactgcagcccctgagaggaggtcgaatgggtaaaggagcatttttttattcagcagactttctctgtgtatgagtgtgaatgatcaagtcctttgtgaatattttcaactatgtaggtaaattcttaatgttcacatagtgaaataaattctgattcttctaaattaaa

SEQ ID NO: 195 - DNA, 2570 bp, Homo sapiens
agcagtgcctgatttgagatggggtcccaggtctcggtggaatcgggagctctgcacgtggtgattgtgggtgggggctttggcgggatcgcagcagccagccagctgcaggccctgaacgtccccttcatgctggtggacatgaaggactccttccaccacaatgtggctgctctccgagcctccgtggagacagggttcgccaaaaagacattcatttcttactcggtgactttcaaggacaacttccggcaggggctagtagtggggatagacctgaagaaccagatggtgctgctgcagggtggcgaggccctgcccttctctcatcttatcctggccacgggcagcactgggcccttcccgggcaagtttaatgaggtttccagccagcaggccgctatccaggcctatgaggacatggtgaggcaggtccagcgctcacggttcatcgtggtggtgggaggaggctcggctggagtggagatggcagcagagattaaaacagaatatcctgagaaagaggtcactctcattcactcccaagtggccctggctgacaaggagctcctgccctccgtccggcaggaagtgaaggagatcctcctccggaagggcgtgcagctgctgctgagtgagcgggtgagcaatctggaggagctgcctctcaatgagtatcgagagtacatcaaagtgcagacggacaaaggcacagaggtggccaccaacctggtgattctctgcaccggcatcaagatcaacagctccgcctaccgcaaagcgtttgagagcagactagccagcagtggtgctctgagagtgaacgagcacctccaggtggagggccacagcaacgtctacgccattggtgactgtgccgacgtgaggacgcccaagatggcctatcttgccggcctccacgccaacatcgccgtggccaacatcgtcaactctgtgaagcagcggcctctccaggcctacaagccgggtgcactgacgttcctcctgtccatggggagaaatgacggtgtgggccaaatcagtggcttctatgtgggccggctcatggttcggctgaccaagagccgggacctgttcgtctctacgagctggaaaaccatgaggcagtctccaccttgatggagaggccaggcgggagaactaccgcagcaggccaagtggaacccctgggagatgacaggacaccacctctgaccccacaggaaccctgtcggtgtgcaccagcgcatccagctctcatgtctctgagatgacatgggtgttttgtccagactgggatgacggcagctttggggcagcagaggaggcatttttcagatgttttcatcttcgaatgaacttggtgatctggatgtctgcagcaagtctcagcaatctctttatgaatcatcattattattatggttcagttcatggtctttcccagggcctgggtgctgatgcttccccactccacactcgagcctcaagtatatgtggacagccacagtacactgtgcagctggtttaggacaagtgtctattccagtggtcactgtccactgggggagggcgtgcagaggggttttctttgttaatgttcttgggtttccatgatgcaactgagaaatggtgattgtgcattatacccagtacccctgagactcctttctggcccccagattcctggacactgttgatctattgggtccagaagcctggagaaggccgggtaactgaagctggtagccagttcatgttgagaagcagaggactaggtctacactggcgccctctgcattcaggtcaagggccaaatgggaatgtgcagaaggcaaggggaatccaccctcctcactgaagccttttaagaaaaaagcatcctggagagaggtagtttctctctacagaagcattcccaagaaggaaaggagcaatgctagaatgagaataccacagctttgcaactcctaacgaatggcggaatctagagaagaggcatcaatggccaccagcatcacaccaatacagacaaccaggcacgacgcgcctcctcgggcacgagcactcgccactgaccaaggagtcttggcaaagttttcgaacctacacctcatgaaacctctagatccaaccaccaagttataaaaaagcaaagaaacatgttttatgatgccaggaggatataatcaacaaaatccggactgcatgaaaccctataggacaaatggcccagcttcctcaacaaatgaattgcaaagaaataagaaagagatgaaggaggaacctatggtataagagactcatcaaccaactgcagtgcgtggactgatttggatccgaaatcaaataaacaaattttctttctttcctttcttcctttctctctccccctccccctccttccctccctccttccttctctaccttcccttccttcctttctctctctctctccctctgcctctctctttctctctttttctttccctccctccctccctctctctctctctttttctttctttcctttcttaatttcttgacatggtctcactctgtgcactctg

SEQ ID NO: 196 - DNA, 3007 bp, Homo sapiens
agtaactcgggaagacgaccaagcgggagcgggagcgggagcgggagccggagcgagagcgcgcgggcgcggccgacagtgcctgatttgagatggggtcccaggtctcggtggaatcgggagctctgcacgtggtgattgtgggtgggggctttggcgggatcgcagcagccagccagctgcaggccctgaacgtccccttcatgctggtggacatgaaggactccttccaccacaatgtggctgctctccgagcctccgtggagacagggttcgccaaaaagacattcatttcttactcggtgactttcaaggacaacttccggcaggggctagtagtggggatagacctgaagaaccagatggtgctgctgcagggtggcgaggtccagcgctcacggttcatcgtggtggtgggaggaggctcggctggagtggagatggcagcagagattaaaacagaatatcctgagaaagaggtcactctcattcactcccaagtggccctggctgacaaggagctcctgccctccgtccggcaggaagtgaaggagatcctcctccggaagggcgtgcagctgctgctgacccttctaggtgagcgggtgagcaatctggaggagctgcctctcaatgagtatcgagagtacatcaaagtgcagacggacaaaggcacagaggtggccaccaacctggtgattctctgcaccggcatcaagatcaacagctccgcctaccgcaaagcgtttgagagcagactagccagcagtggtgctctgagagtgaacgagcacctccaggtggagggccacagcaacgtctacgccattggtgactgtgccgacgtgaggacgcccaagatggcctatcttgccggcctccacgccaacatcgccgtggccaacatcgtcaactctgtgaagcagcggcctctccaggcctacaagccgggtgcactgacgttcctcctgtccatggggagaaatgacggtgtgggccaaatcagtggcttctatgtgggccggctcatggttcggctgaccaagagccgggacctgttcgtctctacgagctggaaaaccatgaggcagtctccaccttgatggagaggccaggcgggagaactaccgcagcaggtgggcgtacggactgcttggcgcatggcacccgcctggcaagtgctagaactaatgctattcttctggaataagatgccaatgatgtggtggctagaaatgcaacttgtataaaacaaaaatgggagagagagaggtattaaacaaataccccccttagaggatactttctgggtttggaaggtgtgcttgctgtggtactgggtgagcggctcatgtgtgctggctgcatggtgctggggaggccacagccagcccttcctctgcacctgcctcctctgggatgtgcatgtgtgtgtacgtgcttgtggtcatgacgcgtgccatttagagctctcagagcagggcagattgctgggctctggtggccagtgtctgtctgtgagggcaggaaggagagctgcacattgagaacaaaggagggacctgaggtggagagaggcccagcaccccaaatctctgccatcacacggtcggggagcccatacattctgcaacaaccagggacttcacaggagccttgttttcaatttgctaacaggtgcataatccctgtgctccttaagcctcatggccttcctacatttccactttatttgtttgtttgtttatttatttttgagacagtctcgccctgtcacccaggctggagtgcagtggcacgatctcagctcactgcaacctacgccttctgggttcacgtgattctcttgccttagcctcccaagtagctgggactacaggcacgtgccaccatgcctggctaatttttgtattttttaaatagagacggggtttcactgtgttggccaggctggtctcgaacacctgacctcaggtgatccattcgtcttggcctctcgaagtgctgggattccaggcgtgagccactgcggccagcacatttccacttttagatcctactccataccacaggtttcatttaagaagaaagagctagataaatgtgctcttctggttaccccaccctgacagagtgcatttttacacggctagcaggggttgagactgcagcctggcctgccagccattggaggtgtttaaggaagggcagataatgtgactctttgcggggtgccatctgcttacccattagcgagcagagggggtttctgcgggtgacccccagcatatttctaggttacttatgggcagatttgtaagtgacaaaactccagctgatgctgggaatggggagagggcccttgagggactttgtggttttgtgcttctggtttcctggccaaccccagggtcacttgtctggaggcccagctgggcactaatgtctgccaccgactatgttacagtgtataaatgattcctctatttgggagagatcttccaatccagaggagcccctcttggactgcctgggttaaatctgcatagcagaagtggttgatgagttcatctgaagaaattcaggccccacctccccaccctgcccctccctgctcccttttgatggtggcctctgggtactcgggcagagtccttgggacaccagcctctctggggttctcaggccatcccgttggggctgtcgcccaggcctaagtgagtcgtgtgcctctattggaggatggctgttcccctggtggttgcatccaagtatctgtctttctttatggaccacgaagggaagcccaccttcctggaggcaggaccttcggcctaagaaacacaggccctggtgctatctgacctggggtccagcgaggtgggaatcccagtgtgtgagcgacaggccttcttctattgacttacaatattctagaaggacctacgtgtggggacacagttttccaaactgaggaaaatgttgcaataaaagaatatgttgtaag

SEQ ID NO: 197 - DNA, 2309 bp, Homo sapiens
cgcggccccaagcggttcccgagcccaggcccgcgccgagcccaggtcctagagcagctccagcaggatggcggctccagcgtctctaaggcctgcagggggtccagccccatggggggcgccctaggcctccgacagctccccatctgtgctcctgcctgccggccatcctcaggccactcgccatgggcggctgcttctccaaacccaaaccagtggagctcaagatcgaggtggtgctgcctgagaaggagcgaggcaaggaggagctgtcggccagtgggaagggcagcccccgggcctaccagggcaatggcacggcccgccacttccacacggaggagcgcctgtccacccctcacccctaccccagccctcaggattgcgtggaggctgctgtctgccacgtcaaggacctcgagaatggccagatgcgggaagtggagctgggctgggggaaggtgttgctggtgaaggacaatggggagttccacgccctgggccataagtgtccgcactacggcgcacccctggtgaaaggcgttctgtcccgtggtcgggtgcgctgcccctggcacggcgcctgcttcaacatcagcactggggacctggaggacttccctggcctggacagtctacacaagttccaggtgaagattgagaaggagaaggtgtacgtccgggccagcaagcaggccctacagctgcagcgaaggaccaaggtgatggccaagtgtatctctccaagtgctgggtacagcagtagcaccaatgtgctcattgtgggtgcaggtgcagctggcctggtgtgtgcagagacactgcggcaggagggcttctccgaccggatcgtcctgtgcacgctagaccggcaccttccctacgaccgtcccaagctcagcaagtccctggacacacagcctgagcagctggccctgaggcccaaggagtttttccgagcctatggcatcgaggtgctcaccgaggctcaggtggtcacagtggacgtgagaactaagaaggtcgtgttcaaggatggcttcaagctggagtacagcaagctgctgctggcaccagggagcagccccaagactctgagctgcaaaggcaaagaagtggagaacgtgttcactatccggacgccagaggatgccaatcgcgtggtgaggctggcccgaggccgcaacgtggtcgtcgtgggagccggcttcctggggatggaggtggccgcttacctgacggagaaggcccactctgtgtctgtggtggagctggaggagacgcccttcaggaggttcctgggggagcgcgtgggtcgagccctcatgaagatgtttgagaacaaccgggtgaagttctacatgcagacggaggtgtctgagctgcggggccaggagggaaagctgaaggaggttgtgctgaagagcagcaaggtcgtgcgggctgacgtctgcgtggtgggcattggtgcagtgcccgccacaggcttcctgaggcaaagcggcatcggtttggattcccgaggcttcatccctgtcaacaagatgatgcagaccaatgtcccaggcgtgtttgcagctggcgatgctgtcaccttcccccttgcctggaggaacaaccgcaaagtgaacattccacattggcagatggctcatgctcaggggcgcgtggcagcccagaacatgttggcgcaggaggcggagatgagcactgtgccctacctctggaccgccatgtttggcaagagcctgcgctacgcgggctacggagaaggcttcgacgacgtcatcatccagggggatctggaggagctgaagtttgtggctttttacactaaaggcgacgaggtgatcgccgtggccagcatgaactacgatcccattgtgtccaaggtcgctgaggtgctggcctcaggccgtgccatccggaagcgggaggtggagactggcgacatgtcctggcttacggggaaaggatcctgagctcacatgcagtagacttgggcaggcaaagggggcaccaagggcacaggccaagccttgggggcaggtgccaatctccagtcccaggatcccccagggcagaacctgagccctcccagtgcttgccttcagccacctggctcccctcctgggaggcctctgctggatccagaagatgctcaaccctcaaggcctctgctgccactgacagctggcactggaggcaggacaagccctgcctcttctccctctattgggactggtcccctgaagaaccctgcaacacgttaaacattaccgtaaaattaaaacgcacaaatttgcaga

SEQ ID NO: 198 - DNA, 2387 bp, Homo sapiens
agtgcaaacgcagcgccagacacgccccgcccgcgcctccccgcccccccgcgcccgcggccccaagcggttcccgagcccaggcccgcgccgagcccaggtcctagagcagctccagcaggatggcggctccagcgtctctaaggcctgcagggggtccagccccatggggggcgccctaggcctccgacagctccccatctgtgctcctgcctgccggccatcctcaggccactcgccatgggcggctgcttctccaaacccaaaccagtggagctcaagatcgaggtggtgctgcctgagaaggagcgaggcaaggaggagctgtcggccagtgggaagggcagcccccgggcctaccagggcaatggcacggcccgccacttccacacggaggagcgcctgtccacccctcacccctaccccagccctcaggattgcgtggaggctgctgtctgccacgtcaaggacctcgagaatggccagatgcgggaagtggagctgggctgggggaaggtgttgctggtgaaggacaatggggagttccacgccctgggccataagtgtccgcactacggcgcacccctggtgaaaggcgttctgtcccgtggtcgggtgcgctgcccctggcacggcgcctgcttcaacatcagcactggggacctggaggacttccctggcctggacagtctacacaagttccaggtgaagattgagaaggagaaggtgtacgtccgggccagcaagcaggccctacagctgcagcgaaggaccaaggtgatggccaagtgtatctctccaagtgctgggtacagcagtagcaccaatgtgctcattgtgggtgcaggtgcagctggcctggtgtgtgcagagacactgcggcaggagggcttctccgaccggatcgtcctgtgcacgctagaccggcaccttccctacgaccgtcccaagctcagcaagtccctggacacacagcctgagcagctggccctgaggcccaaggagtttttccgagcctatggcatcgaggtgctcaccgaggctcaggtggtcacagtggacgtgagaactaagaaggtcgtgttcaaggatggcttcaagctggagtacagcaagctgctgctggcaccagggagcagccccaagactctgagctgcaaaggcaaagaagtggagaacgtgttcactatccggacgccagaggatgccaatcgcgtggtgaggctggcccgaggccgcaacgtggtcgtcgtgggagccggcttcctggggatggaggtggccgcttacctgacggagaaggcccactctgtgtctgtggtggagctggaggagacgcccttcaggaggttcctgggggagcgcgtgggtcgagccctcatgaagatgtttgagaacaaccgggtgaagttctacatgcagacggaggtgtctgagctgcggggccaggagggaaagctgaaggaggttgtgctgaagagcagcaaggtcgtgcgggctgacgtctgcgtggtgggcattggtgcagtgcccgccacaggcttcctgaggcaaagcggcatcggtttggattcccgaggcttcatccctgtcaacaagatgatgcagaccaatgtcccaggcgtgtttgcagctggcgatgctgtcaccttcccccttgcctggaggaacaaccgcaaagtgaacattccacattggcagatggctcatgctcaggggcgcgtggcagcccagaacatgttggcgcaggaggcggagatgagcactgtgccctacctctggaccgccatgtttggcaagagcctgcgctacgcgggctacggagaaggcttcgacgacgtcatcatccagggggatctggaggagctgaagtttgtggctttttacactaaaggcgacgaggtgatcgccgtggccagcatgaactacgatcccattgtgtccaaggtcgctgaggtgctggcctcaggccgtgccatccggaagcgggaggtggagctgtttgtgctgcacagcaagactggcgacatgtcctggcttacggggaaaggatcctgagctcacatgcagtagacttgggcaggcaaagggggcaccaagggcacaggccaagccttgggggcaggtgccaatctccagtcccaggatcccccagggcagaacctgagccctcccagtgcttgccttcagccacctggctcccctcctgggaggcctctgctggatccagaagatgctcaaccctcaaggcctctgctgccactgacagctggcactggaggcaggacaagccctgcctcttctccctctattgggactggtcccctgaagaaccctgcaacacgttaaacattaccgtaaaattaaaacgcacaaatttgcagatc

SEQ ID NO: 199 - DNA, 2333 bp, Homo sapiens
agtccactgctgggcctggaacacggagcagtggctgccctgcgaggaggtcctagagcagctccagcaggatggcggctccagcgtctctaaggcctgcagggggtccagccccatggggggcgccctaggcctccgacagctccccatctgtgctcctgcctgccggccatcctcaggccactcgccatgggcggctgcttctccaaacccaaaccaggcgctgccttgcccacagtggagctcaagatcgaggtggtgctgcctgagaaggagcgaggcaaggaggagctgtcggccagtgggaagggcagcccccgggcctaccagggcaatggcacggcccgccacttccacacggaggagcgcctgtccacccctcacccctaccccagccctcaggattgcgtggaggctgctgtctgccacgtcaaggacctcgagaatggccagatgcgggaagtggagctgggctgggggaaggtgttgctggtgaaggacaatggggagttccacgccctgggccataagtgtccgcactacggcgcacccctggtgaaaggcgttctgtcccgtggtcgggtgcgctgcccctggcacggcgcctgcttcaacatcagcactggggacctggaggacttccctggcctggacagtctacacaagttccaggtgaagattgagaaggagaaggtgtacgtccgggccagcaagcaggccctacagctgcagcgaaggaccaaggtgatggccaagtgtatctctccaagtgctgggtacagcagtagcaccaatgtgctcattgtgggtgcaggtgcagctggcctggtgtgtgcagagacactgcggcaggagggcttctccgaccggatcgtcctgtgcacgctagaccggcaccttccctacgaccgtcccaagctcagcaagtccctggacacacagcctgagcagctggccctgaggcccaaggagtttttccgagcctatggcatcgaggtgctcaccgaggctcaggtggtcacagtggacgtgagaactaagaaggtcgtgttcaaggatggcttcaagctggagtacagcaagctgctgctggcaccagggagcagccccaagactctgagctgcaaaggcaaagaagtggagaacgtgttcactatccggacgccagaggatgccaatcgcgtggtgaggctggcccgaggccgcaacgtggtcgtcgtgggagccggcttcctggggatggaggtggccgcttacctgacggagaaggcccactctgtgtctgtggtggagctggaggagacgcccttcaggaggttcctgggggagcgcgtgggtcgagccctcatgaagatgtttgagaacaaccgggtgaagttctacatgcagacggaggtgtctgagctgcggggccaggagggaaagctgaaggaggttgtgctgaagagcagcaaggtcgtgcgggctgacgtctgcgtggtgggcattggtgcagtgcccgccacaggcttcctgaggcaaagcggcatcggtttggattcccgaggcttcatccctgtcaacaagatgatgcagaccaatgtcccaggcgtgtttgcagctggcgatgctgtcaccttcccccttgcctggaggaacaaccgcaaagtgaacattccacattggcagatggctcatgctcaggggcgcgtggcagcccagaacatgttggcgcaggaggcggagatgagcactgtgccctacctctggaccgccatgtttggcaagagcctgcgctacgcgggctacggagaaggcttcgacgacgtcatcatccagggggatctggaggagctgaagtttgtggctttttacactaaaggcgacgaggtgatcgccgtggccagcatgaactacgatcccattgtgtccaaggtcgctgaggtgctggcctcaggccgtgccatccggaagcgggaggtggagactggcgacatgtcctggcttacggggaaaggatcctgagctcacatgcagtagacttgggcaggcaaagggggcaccaagggcacaggccaagccttgggggcaggtgccaatctccagtcccaggatcccccagggcagaacctgagccctcccagtgcttgccttcagccacctggctcccctcctgggaggcctctgctggatccagaagatgctcaaccctcaaggcctctgctgccactgacagctggcactggaggcaggacaagccctgcctcttctccctctattgggactggtcccctgaagaaccctgcaacacgttaaacattaccgtaaaattaaaacgcacaaatttgcagatc

SEQ ID NO: 200 - DNA, 1094 bp, Homo sapiens
ctcctggccacagcttgagctgggaggagggtggaggctgggccgcctcctggacccctgccctccctgcccggccttccaaggcccggcagcctcagtccactgctgggcctggaacacggagcagtggctgccctgcgaggaggtcctagagcagctccagcaggatggcggctccagcgtctctaaggcctgcagggggtccagccccatggggggcgccctaggcctccgacagctccccatctgtgctcctgcctgccggccatcctcaggccactcgccatgggcggctgcttctccaaacccaaaccagtggagctcaagatcgaggtggtgctgcctgagaaggagcgaggcaaggaggagctgtcggccagtgggaagggcagcccccgggcctaccagggcaatggcacggcccgccacttccacacggaggagcgcctgtccacccctcacccctaccccagccctcaggattgcgtggaggctgctgtctgccacgtcaaggacctcgagaatggccagatgcgggaagtggagctgggctgggggaaggtgttgctggtgaaggacaatggggagttccacgccctgggccataagtgtccgcactacggcgcacccctggtgaaaggcgttctgtcccgtggtcgggtgcgctgcccctggcacggcgcctgcttcaacatcagcactggggacctggaggacttccctggcctggacagtctacacaagttccaggtgaagattgagaaggagaaggtgtacgtccgggccagcaagcaggccctacagctgcagcgaaggaccaaggtgatggccaagtgtatctctccaagtgctgggtacagcagtagcaccaatgtgctcattgtgggtgcaggtgcagctggcctggtgtgtgcagagacactgcggcaggagggcttctccgaccggatcgtcctgtgcacgctagaccggcaccttccctacgaccgtcccaagctcagcaagtccctggacacacagcctgagcagctggccctgaggcccaaggagtttttccgagcctatggcatcgaggtgctcaccgaggctcaggt

SEQ ID NO: 201 - DNA, 2251 bp, Homo sapiens
caggtcctagagcagctccagcaggatggcggctccagcgtctctaaggcctgcagggggtccagccccatggggggcgccctaggcctccgacagctccccatctgtgctcctgcctgccggccatcctcaggccactcgccatgggcggctgcttctccaaacccaaaccagtggagctcaagatcgaggtggtgctgcctgagaaggagcgaggcaaggaggagctgtcggccagtgggaagggcagcccccgggcctaccagggcaatggcacggcccgccacttccacacggaggagcgcctgtccacccctcacccctaccccagccctcaggattgcgtggaggctgctgtctgccacgtcaaggacctcgagaatggccagatgcgggaagtggagctgggctgggggaaggtgttgctggtgaaggacaatggggagttccacgccctgggccataagtgtccgcactacggcgcacccctggtgaaaggcgttctgtcccgtggtcgggtgcgctgcccctggcacggcgcctgcttcaacatcagcactggggacctggaggacttccctggcctggacagtctacacaagttccaggtgaagattgagaaggagaaggtgtacgtccgggccagcaagcaggccctacagctgcagcgaaggaccaaggtgatggccaagtgtatctctccaagtgctgggtacagcagtagcaccaatgtgctcattgtgggtgcaggtgcagctggcctggtgtgtgcagagacactgcggcaggagggcttctccgaccggatcgtcctgtgcacgctagaccggcaccttccctacgaccgtcccaagctcagcaagtccctggacacacagcctgagcagctggccctgaggcccaaggagtttttccgagcctatggcatcgaggtgctcaccgaggctcaggtggtcacagtggacgtgagaactaagaaggtcgtgttcaaggatggcttcaagctggagtacagcaagctgctgctggcaccagggagcagccccaagactctgagctgcaaaggcaaagaagtggagaacgtgttcactatccggacgccagaggatgccaatcgcgtggtgaggctggcccgaggccgcaacgtggtcgtcgtgggagccggcttcctggggatggaggtggccgcttacctgacggagaaggcccactctgtgtctgtggtggagctggaggagacgcccttcaggaggttcctgggggagcgcgtgggtcgagccctcatgaagatgtttgagaacaaccgggtgaagttctacatgcagacggaggtgtctgagctgcggggccaggagggaaagctgaaggaggttgtgctgaagagcagcaaggtcgtgcgggctgacgtctgcgtggtgggcattggtgcagtgcccgccacaggcttcctgaggcaaagcggcatcggtttggattcccgaggcttcatccctgtcaacaagatgatgcagaccaatgtcccaggcgtgtttgcagctggcgatgctgtcaccttcccccttgcctggaggaacaaccgcaaagtgaacattccacattggcagatggctcatgctcaggggcgcgtggcagcccagaacatgttggcgcaggaggcggagatgagcactgtgccctacctctggaccgccatgtttggcaagagcctgcgctacgcgggctacggagaaggcttcgacgacgtcatcatccagggggatctggaggagctgaagtttgtggctttttacactaaaggcgacgaggtgatcgccgtggccagcatgaactacgatcccattgtgtccaaggtcgctgaggtgctggcctcaggccgtgccatccggaagcgggaggtggagctgtttgtgctgcacagcaagactggcgacatgtcctggcttacggggaaaggatcctgagctcacatgcagtagacttgggcaggcaaagggggcaccaagggcacaggccaagccttgggggcaggtgccaatctccagtcccaggatcccccagggcagaacctgagccctcccagtgcttgccttcagccacctggctcccctcctgggaggcctctgctggatccagaagatgctcaaccctcaaggcctctgctgccactgacagctggcactggaggcaggacaagccctgcctcttctccctctattgggactggtcccctgaagaaccctgcaacacgtta

SEQ ID NO: 202 - DNA, 1925 bp, Homo sapiens
gcccaggctggagtgcaatggtgtgatctctgctcaccacaacctccgcctcccaggttcaagcgattctcctgtctcagcctctggagtagctgggattacaggcatgcaccaccacacctggctaattttgtatttttggtagagacagggtttctccatgttggtcaggctggtcttgaactcccaacctcaggtgatccacccacctcggccacccaaagtgctgggattataggtgtgagtcactgcacctggccaacagcaatactttctttcctttcttttcctctaccctctatgccaggactccttagaaataaaatattaaggaaagtgagttatgaagatgataagggcaatgcagactacagaattatgggtgtctttgaactgctgcttcctgtaaaatgccaaaaacttctttgggcacatgatggttcccagcttgagagatctgtgagctccagttggaatgtttcatggcaactagttttcttaatgttctttttcagatatatgaaatcagggcatcttttcaggaggatgcttcctattcagaggttgcaaagcacttatgtaagccttaggtgactgcatgggtggaagtgcacagagttcaccatctgaagcttaatctggggccagcagttctgatacctgttgtatttgcgttacaaatgaacttgagcaccgaggccctcatgcccactgtcctgtaagtgggcgctcggcctggattgcagctctgccctgtctgtagtgagggctgcctgctgctcctttacttctcttcctgtattcctaggattgacttttgcttcctgctgtaactactctgtttcttcttcccagctcgagccttgggcacagaagtgattcaactcttccccgagaaaggaaatatgggaaagatcctccccgaatacctcagcaactggaccatggaaaaagtcagacgagagggggttaaggtgatgcccaatgctattgtgcaatccgttggagtcagcagtggcaagttacttatcaagctgaaagacggcaggaaggtagaaactgaccacatagtggcagctgtgggcctggagcccaatgttgagttggccaagactggtggcctggaaatagactcagattttggtggcttccgggtaaatgcagagctacaagcacgctctaacatctgggtggcaggagatgctgcatgcttctacgatataaagttgggaaggaggcgggtagagcaccatgatcacgctgttgtgagtggaagattggctggagaaaatatgactggagctgctaagccgtactggcatcagtcaatgttctggagtgatttgggccccgatgttggctatgaagctattggtcttgtggacagtagtttgcccacagttggtgtttttgcaaaagcaactgcacaagacaaccccaaatctgccacagagcagtcaggaactggtatccgatcagagagtgagacagagtccgaggcctcagaaattactattcctcccagcaccccggcagttccacaggctcccgtccagggggaggactacggcaaaggtgtcatcttctacctcagggacaaagtggtcgtggggattgtgctatggaacatctttaaccgaatgccaatagcaaggaagatcattaaggacggtgagcagcatgaagatctcaatgaagtagccaaactattcaacattcatgaagactgaagccccacagtggaattggcaaacccactgcagcccctgagaggaggtcgaatgggtaaaggagcatttttttattcagcagactttctctgtgtatgagtgtgaatgatcaagtcctttgtgaatattttcaactatgtaggtaaattcttaatgttcacatagtgaaataaattctgattcttctaaattaaa

SEQ ID NO: 203 - DNA, 609 bp, Homo sapiens
aagcggttcccgagcccaggcccgcgccgagcccagcaggcacccacccacggcccttcctggtatctggaccagaccaggtcctagagcagctccagcaggatggcggctccagcgtctctaaggcctgcagggggtccagccccatggggggcgccctaggcctccgacagctccccatctgtgctcctgcctgccggccatcctcaggccactcgccatgggcggctgcttctccaaacccaaaccagtggagctcaagatcgaggtggtgctgcctgagaaggagcgaggcaaggaggagctgtcggccagtgggaagggcagcccccgggcctaccagggcaatggcacggcccgccacttccacacggaggagcgcctgtccacccctcacccctaccccagccctcaggattgcgtggaggctgctgtctgccacgtcaaggacctcgagaatggccagatgcgggaagtggagctgggctgggggaaggtgttgctggtgaaggacaatggggagttccacgccctgggccataagtgtccgcactacggcgcacccctggtgaaaggcgttctgtcccgtggtcgggtgcgctgcccctg

SEQ ID NO: 204 - DNA, 1925 bp, Homo sapiens; identical to SEQ ID NO: 202

SEQ ID NO: 205 - DNA, 2105 bp, Homo sapiens
tcgccgaaatgttccggtgtggaggcctggcggcgggtgctttgaagcagaagctggtgcccttggtgcggaccgtgtgcgtccgaagcccgaggcagaggaaccggctcccaggcctacaagactatgaaagaggatgaaaaaagatacaatgaaagaatttcagggttagggctgacaccagaacagaaacagaaaaaggccgcgttatctgcttcagaaggagaggaagttcctcaagacaaggcgccaagtcatgttcctttcctgctaattggtggaggcacagctgcttttgctgcagccagatccatccgggctcgggatcctggggccagggtactgattgtatctgaagatcctgagctgccgtacatgcgacctcctctttcaaaagaactgtggttttcagatgacccaaatgtcacaaagacactgcgattcaaacagtggaatggaaaagagagaagcatatatttccagccaccttctttctatgtctctgctcaggacctgcctcatattgagaatggtggtgtggctgtcctcactgggaagaaggtagtacagctggatgtgagagacaacatggtgaaacttaatgatggctctcaaataacctatgaaaagtgcttgattgcaacaggaggtactccaagaagtctgtctgccattgatagggctggagcagaggtgaagagtagaacaacgcttttcagaaagattggagactttagaagcttggagaagatttcacgggaagtcaaatcaattacgattatcggtgggggcttccttggtagcgaactggcctgtgctcttggcagaaaggatatatgaaatcagggcatcttttcaggaggatgcttcctattcagaggttgcaaagcacttatgtaagccttaggtgactgcatgggtggaagtgcacagagttcaccatctgaagcttaatctggggccagcagttctgatacctgttgtatttgcgttacaaatgaacttgagcaccgaggccctcatgcccactgtcctctcgagccttgggcacagaagtgattcaactcttccccgagaaaggaaatatgggaaagatcctccccgaatacctcagcaactggaccatggaaaaagtcagacgagagggggttaaggtgatgcccaatgctattgtgcaatccgttggagtcagcagtggcaagttacttatcaagctgaaagacggcaggaaggtagaaactgaccacatagtggcagctgtgggcctggagcccaatgttgagttggccaagactggtggcctggaaatagactcagattttggtggcttccgggtaaatgcagagctacaagcacgctctaacatctgggtggcaggagatgctgcatgcttctacgatataaagttgggaaggaggcgggtagagcaccatgatcacgctgttgtgagtggaagattggctggagaaaatatgactggagctgctaagccgtactggcatcagtcaatgttctggagtgatttgggccccgatgttggctatgaagctattggtcttgtggacagtagtttgcccacagttggtgtttttgcaaaagcaactgcacaagacaaccccaaatctgccacagagcagtcaggaactggtatccgatcagagagtgagacagagtccgaggcctcagaaattactattcctcccagcaccccggcagttccacaggctcccgtccagggggaggactacggcaaaggtgtcatcttctacctcagggacaaagtggtcgtggggattgtgctatggaacatctttaaccgaatgccaatagcaaggaagatcattaaggacggtgagcagcatgaagatctcaatgaagtagccaaactattcaacattcatgaagactgaagccccacagtggaattggcaaacccactgcagcccctgagaggaggtcgaatgggtaaaggagcatttttttattcagcagactttctctgtgtatgagtgtgaatgatcaagtcctttgtgaatattttcaactatgtaggtaaattcttaatgttcacatagtgaaataaattctgattcttctaaattaaa

SEQ ID NO: 206 - DNA, 3588 bp, Homo sapiens
gcagcagcagagaatccaaaccctaaagctgatatcacaaagtaccatttctccaagttgggggctcagaggggagtcatcatgagcgatgttaccattgtgaaagaaggttgggttcagaagaggggagaatatataaaaaactggaggccaagatacttccttttgaagacagatggctcattcataggatataaagagaaacctcaagatgtggatttaccttatcccctcaacaacttttcagtggcaaaatgccagttaatgaaaacagaacgaccaaagccaaacacatttataatcagatgtctccagtggactactgttatagagagaacatttcatgtagatactccagaggaaagggaagaatggacagaagctatccaggctgtagcagacagactgcagaggcaagaagaggagagaatgaattgtagtccaacttcacaaattgataatataggagaggaagagatggatgcctctacaacccatcataaaagaaagacaatgaatgattttgactatttgaaactactaggtaaaggcacttttgggaaagttattttggttcgagagaaggcaagtggaaaatactatgctatgaagattctgaagaaagaagtcattattgcaaaggatgaagtggcacacactctaactgaaagcagagtattaaagaacactagacatccctttttaacatccttgaaatattccttccagacaaaagaccgtttgtgttttgtgatggaatatgttaatgggggcgagctgtttttccatttgtcgagagagcgggtgttctctgaggaccgcacacgtttctatggtgcagaaattgtctctgccttggactatctacattccggaaagattgtgtaccgtgatctcaagttggagaatctaatgctggacaaagatggccacataaaaattacagattttggactttgcaaagaagggatcacagatgcagccaccatgaagacattctgtggcactccagaatatctggcaccagaggtgttagaagataatgactatggccgagcagtagactggtggggcctaggggttgtcatgtatgaaatgatgtgtgggaggttacctttctacaaccaggaccatgagaaactttttgaattaatattaatggaagacattaaatttcctcgaacactctcttcagatgcaaaatcattgctttcagggctcttgataaaggatccaaataaacgccttggtggaggaccagatgatgcaaaagaaattatgagacacagtttcttctctggagtaaactggcaagatgtatatgataaaaagcttgtacctccttttaaacctcaagtaacatctgagacagatactagatattttgatgaagaatttacagctcagactattacaataacaccacctgaaaaatatgatgaggatggtatggactgcatggacaatgagaggcggccgcatttccctcaattttcctactctgcaagtggacgagaataagtctctttcattctgctacttcactgtcatcttcaatttattactgaaaatgattcctggacatcaccagtcctagctcttacacatagcaggggcaccttccgacatcccagaccagccaagggtcctcacccctcgccacctttcaccctcatgaaaacacacatacacgcaaatacactccagtttttgtttttgcatgaaattgtatctcagtctaaggtctcatgctgttgctgctactgtcttactattatagcaactttaagaagtaattttccaacctttggaagtcatgagcccaccattgttcatttgtgcaccaattatcatcttttgatcttttagtttttccctcagtgaaggctaaatgagatacactgattctaggtacattttttaactttctagaagagaaaaactaactagactaagaagatttagtttataaattcagaacaagcaattgtggaagggtggtggcgtgcatatgtaaagcacatcagatccgtgcgtgaagtaggcatatatcactaagctgtggctggaattgattaggaagcatttggtagaaggactgaacaactgttgggatatatatatatatatataattttttttttttaaattcctggtggatactgtagaagaagcccatatcacatgtggatgtcgagacttcacgggcaatcatgagcaagtgaacactgttctaccaagaactgaaggcatatgcacagtcaaggtcacttaaagggtcttatgaaacaatttgagccagagagcatctttcccctgtgcttggaaaccttttttccttcttgacatttatcacctctgatggctgaagaatgtagacaggtataatgatactgcttttcaccaaaatttctacaccaaggtaaacaggtgtttgccttatttaattttttactttcagttctacgtgaattagctttttctcagatgttgaaactttgaatgtccttttatgattttgtttatattgcagtagtatttattttttagtgatgagaattgtatgtcatgttagcaaacgcagctccaacttatataaaatagacttactgcagttacttttgacccatgtgcaaggattgtacacgctgatgagaatcatgcactttttctcctctgttaaaaaaaatgataaggctctgaaatggaatatattggttagaatttggctttgggagaagagatgctgccatttaaccccttggtactgaaaatgagaaaatccccaactatgcatgccaaggggttaatgaaacaaatagctgttgacgtttgctcatttaagaatttgaaacgttatgatgacctggcaacaaaaagtaatgaagaaaattgagacctgagtgaagataagaaatgatctttacgtggcaaaatgaacacatcttgagtatttaggaaatgggcagtgaaggctaagaacctggtgtgtttcttgggatcatggtacatttatcactgaattaagccatcagggaaaaaacaacaaaaaaagagaacacctccagcttttctttttctgtatatactcatgtcccccagattccaacatttctcactgaaagggggcatgtatgcaaacctcatctttctccttcattaatgatgatcttcagattaaaccctttggtgctaggagctgacaatttccaaagcagcctgtgaagtcctaggggctgggggccactcttgcggcaagcagaaggccatcctactccgcggagtgatcatggaaatgtattttagttaaactctgacagctcccaaacggaagactacagcatgacgtagtattatgattgcattgtatgaaagagcaagtgactttctaagtaggatgaatcatattcatatgcagatgtcttagcctcttgacgctggaagtgtggatttatagctatgaaaccactgctggcagtgggtgggccactgggactgacgggggttaaagggcattttactaaggcagctaagacatattcagacatcaacgttatccttctttttcatatttctacctgagtgaag

SEQ ID NO: 207 - DNA, 1393 bp, Homo sapiens
ccctgagctgtcccgagctaggtgacagcgtaccacgctgccaccatgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactgaggagatggaagtggcggtcagcaaggcacgggctaaagtgaccatgaatgacttcgactatctcaaactccttggcaagggaacctttggcaaagtcatcctggtgcgggagaaggccactggccgctactacgccatgaagatcctgcggaaggaagtcatcattgccaaggatgaagtcgctcacacagtcaccgagagccgggtcctccagaacaccaggcacccgttcctcactgcgctgaagtatgccttccagacccacgaccgcctgtgctttgtgatggagtatgccaacgggggtgagctgttcttccacctgtcccgggagcgtgtcttcacagaggagcgggcccggttttatggtgcagagattgtctcggctcttgagtacttgcactcgcgggacgtggtataccgcgacatcaaggtgctggaggacaatgactatggccgggccgtggactggtgggggctgggtgtggtcatgtacgagatgatgtgcggccgcctgcccttctacaaccaggaccacgagcgcctcttcgagctcatcctcatggaagagatccgcttcccgcgcacgctcagccccgaggccaagtccctgcttgctgggctgcttaagaaggaccccaagcagaggcttggtggggggcccagcgatgccaaggaggtcatggagcacaggttcttcctcagcatcaactggcaggacgtggtccagaagaagctcctgccacccttcaaacctcaggtcacgtccgaggtcgacacaaggtacttcgatgatgaatttaccgcccagtccatcacaatcacaccccctgaccgctatgacagcctgggcttactggagctggaccagcggacccacttcccccagttctcctactcggccagcatccgcgagtgagcagtctgcccacgcagaggacgcacgctcg

SEQ ID NO: 208 - DNA, 1688 bp, Homo sapiens
ccaaaccctaaagctgatatcacaaagtaccatttctccaagttgggggctcagaggggagtcatcatgagcgatgttaccattgtgaaagaaggttgggttcagaagaggggagaatatataaaaaactggaggccaagatacttccttttgaagacagatggctcattcataggatataaagagaaacctcaagatgtggatttaccttatcccctcaacaacttttcagtggcaaaatgccagttaatgaaaacagaacgaccaaagccaaacacatttataatcagatgtctccagtggactactgttatagagagaacatttcatgtagatactccagaggaaagggaagaatggacagaagctatccaggctgtagcagacagactgcagaggcaagaagaggagagaatgaattgtagtccaacttcacaaattgataatataggagaggaagagatggatgcctctacaacccatcataaaagaaagacaatgaatgattttgactatttgaaactactaggtaaaggcacttttgggaaagttattttggttcgagagaaggcaagtggaaaatactatgctatgaagattctgaagaaagaagtcattattgcaaaggatgaagtggcacacactctaactgaaagcagagtattaaagaacactagacatccctttttaacatccttgaaatattccttccagacaaaagaccgtttgtgttttgtgatggaatatgttaatgggggcgagctgtttttccatttgtcgagagagcgggtgttctctgaggaccgcacacgtttctatggtgcagaaattgtctctgccttggactatctacattccggaaagattgtgtaccgtgatctcaagttggagaatctaatgctggacaaagatggccacataaaaattacagattttggactttgcaaagaagggatcacagatgcagccaccatgaagacattctgtggcactccagaatatctggcaccagaggtgttagaagataatgactatggccgagcagtagactggtggggcctaggggttgtcatgtatgaaatgatgtgtgggaggttacctttctacaaccaggaccatgagaaactttttgaattaatattaatggaagacattaaatttcctcgaacactctcttcagatgcaaaatcattgctttcagggctcttgataaaggatccaaataaacgccttggtggaggaccagatgatgcaaaagaaattatgagacacagtttcttctctggagtaaactggcaagatgtatatgataaaaagcttgtacctccttttaaacctcaagtaacatctgagacagatactagatattttgatgaagaatttacagctcagactattacaataacaccacctgaaaaatgtcagcaatcagattgtggcatgctgggtaactggaaaaaataataaaaatcggcttcctacagccagcagcacagtcacccatggaactgttggctttggattaaatgtggaattgaacgactacccagaagtgttctggaaagaagcgagatgtgtggcctgcctcaccgtcctcacccatcaaaagcaccagcaggcacgttaactcgaattctcacaaggaaaaggccattaaagctcaaggtgcatttcaaactccaggctac

SEQ ID NO: 209 - DNA, 2866 bp, Homo sapiens
ggcggcggcggcaggaccgagcgcggcaggcggctggcccagcgcacgcagcgcggcccgaagacgggagcaggcggccgagcaccgagcgctgggcaccgggcaccgagcggcggcggcacgcgaggcccggccccgagcagcgcccccgcccgccgcggcctccagcccggccccgcccagcgccggcccgcggggatgcggagcggcgggcgccggaggccgcggcccggctaggcccgcgctcgcgcccggacgcggcggcccggggcttagggaaggccgagccagcctgggtcaaagaagtcaaaggggctgcctggaggaggcagcctgtcagctggtgcatcagaggctgtggccaggccagctgggctcggggagcgccagcctgagaggagcgcgtgagcgtcgcgggagcctcgggcaccatgagcgacgtggctattgtgaaggagggttggctgcacaaacgaggggagtacatcaagacctggcggccacgctacttcctcctcaagaatgatggcaccttcattggctacaaggagcggccgcaggatgtggaccaacgtgaggctcccctcaacaacttctctgtggcgcagtgccagctgatgaagacggagcggccccggcccaacaccttcatcatccgctgcctgcagtggaccactgtcatcgaacgcaccttccatgtggagactcctgaggagcgggaggagtggacaaccgccatccagactgtggctgacggcctcaagaagcaggaggaggaggagatggacttccggtcgggctcacccagtgacaactcaggggctgaagagatggaggtgtccctggccaagcccaagcaccgcgtgaccatgaacgagtttgagtacctgaagctgctgggcaagggcactttcggcaaggtgatcctggtgaaggagaaggccacaggccgctactacgccatgaagatcctcaagaaggaagtcatcgtggccaaggacgaggtggcccacacactcaccgagaaccgcgtcctgcagaactccaggcaccccttcctcacagccctgaagtactctttccagacccacgaccgcctctgctttgtcatggagtacgccaacgggggcgagctgttcttccacctgtcccgggagcgtgtgttctccgaggaccgggcccgcttctatggcgctgagattgtgtcagccctggactacctgcactcggagaagaacgtggtgtaccgggacctcaagctggagaacctcatgctggacaaggacgggcacattaagatcacagacttcgggctgtgcaaggaggggatcaaggacggtgccaccatgaagaccttttgcggcacacctgagtacctggcccccgaggtgctggaggacaatgactacggccgtgcagtggactggtgggggctgggcgtggtcatgtacgagatgatgtgcggtcgcctgcccttctacaaccaggaccatgagaagctttttgagctcatcctcatggaggagatccgcttcccgcgcacgcttggtcccgaggccaagtccttgctttcagggctgctcaagaaggaccccaagcagaggcttggcgggggctccgaggacgccaaggagatcatgcagcatcgcttctttgccggtatcgtgtggcagcacgtgtacgagaagaagctcagcccacccttcaagccccaggtcacgtcggagactgacaccaggtattttgatgaggagttcacggcccagatgatcaccatcacaccacctgaccaagatgacagcatggagtgtgtggacagcgagcgcaggccccacttcccccagttctcctactcggccagcggcacggcctgaggcggcggtggactgcgctggacgatagcttggagggatggagaggcggcctcgtgccatgatctgtatttaatggtttttatttctcgggtgcatttgagagaagccacgctgtcctctcgagcccagatggaaagacgtttttgtgctgtgggcagcaccctcccccgcagcggggtagggaagaaaactatcctgcgggttttaatttatttcatccagtttgttctccgggtgtggcctcagccctcagaacaatccgattcacgtagggaaatgttaaggacttctgcagctatgcgcaatgtggcattggggggccgggcaggtcctgcccatgtgtcccctcactctgtcagccagccgccctgggctgtctgtcaccagctatctgtcatctctctggggccctgggcctcagttcaacctggtggcaccagatgcaacctcactatggtatgctggccagcaccctctcctgggggtggcaggcacacagcagccccccagcactaaggccgtgtctctgaggacgtcatcggaggctgggcccctgggatgggaccagggatgggggatgggccagggtttacccagtgggacagaggagcaaggtttaaatttgttattgtgtattatgttgttcaaatgcattttgggggtttttaatctttgtgacaggaaagccctcccccttccccttctgtgtcacagttcttggtgactgtcccaccgggagcctccccctcagatgatctctccacggtagcacttgaccttttcgacgcttaacctttccgctgtcgccccaggccctccctgactccctgtgggggtggccatccctgggcccctccacgcctcctggccagacgctgccgctgccgctgcaccacggcgtttttttacaacattcaactttagtatttttactattataatataatatggaaccttccctccaaattcttcaataaaagttgcttttcaaa

SEQ ID NO: 210 - DNA, 1873 bp, Homo sapiens
cggtaagcgggggctggggggagggggcggggggggccgcgccgtgctagccgttgggcctgcctcggaggaggcgtcgccgccgccgctgccgctgccggcgccgttgccgctgccgggaaacacaaggaaagggaaccagcgcagcgtggcgatgggcgggggtagagccccgccggagaggctgggcggctgccggtgacagactgtgccctgtccacggtgcctcctgcatgtcctgctgccctgagctgtcccgagctaggtgacagcgtaccacgctgccaccatgaatgaggtgtctgtcatcaaagaaggctggctccacaagcgtggtaaaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctccagcctcacctttgtgcccagactcgcatttggaagactccacctcccgcccaggcctgggctgttgggcggttggagattcaggttttaatccacacaagccccagtgaggggtgaagcatggcgcctggggcctgcctgagtttctggcctgggtgtcgtgctggtgtctgcctccgcgctgctgcatctggacgaaggctgccttctggtgggacgcgacacccggcagacagtggtgctgccttccaggccccgtggcctaggctcggagtggccaggcacggggcggtccaatcccccacccgctgtccccctatgggggcagaaaagcaataatgtccaggggcaggcaggggcccttgggagctgcagggctgggggttagggctgctccctggtgaatggagtcagatcctaggatctgtaccatggggaaccaggagtggccgggctgggtgccgcctcctggtccggcctcctccccaccaaactgtcctcaccctatggatgaggcaggaggaacatttggggccaaacctgcctgcctcccagccccgtgccttactagggcttccttccagctggccttacctcccgctggaccctgggcctggcctggccccactgggggctatgggctgggctcaccctctcctctgcgggggtggagggccaccagccttggctgttacaatcttacaccggacagtattgggcccctccctctccccagggccccacgttctgcagccttaaggttgaacatgagtgcacgtccatgtcagtgctgtgggactcctgtgcgtgcctcggactgcgtgtgtcggcgggacgcaggcacacgtgggtgtgtgtgcatgtgtgtttgtgtgagggcagcgtgtcctccagtgtgcatggtgtgtgggcttgggccccatccctggcccgagcatttcatcctgtgggggaggggtgctgacctagtgggaggagccccactgtgatccatgagctgccctgcccacgcctcccctccctgtagcaacacctctgggtgtttggagtttagcttttgtgggtttgctctccctatcccatctcctgtactacacagttcatggcagggtggggaggggtggggttggttcgggtgggtgagggtctttttcctctgtgtgcgatgttgttatctgacagttctccgtccctactggcctttctcctcgtcttcatatttgtacggtacaagcaataaagacactcatttc

SEQ ID NO: 211 - DNA, 5127 bp, Homo sapiens
ccctctcctccccccgcccccccccggctccatcctccgccgccgcccgagcagctgcggggccgccaccgccgccgccgccgttgcaggctgagtcatcactagagagtgggaagggcagcagcagcagagaatccaaaccctaaagctgatatcacaaagtaccatttctccaagttgggggctcagaggggagtcatcatgagcgatgttaccattgtgaaagaaggttgggttcagaagaggggagaatatataaaaaactggaggccaagatacttccttttgaagacagatggctcattcataggatataaagagaaacctcaagatgtggatttaccttatcccctcaacaacttttcagtggcaaaatgccagttaatgaaaacagaacgaccaaagccaaacacatttataatcagatgtctccagtggactactgttatagagagaacatttcatgtagatactccagaggaaagggaagaatggacagaagctatccaggctgtagcagacagactgcagaggcaagaagaggagagaatgaattgtagtccaacttcacaaattgataatataggagaggaagagatggatgcctctacaacccatcataaaagaaagacaatgaatgattttgactatttgaaactactaggtaaaggcacttttgggaaagttattttggttcgagagaaggcaagtggaaaatactatgctatgaagattctgaagaaagaagtcattattgcaaaggatgaagtggcacacactctaactgaaagcagagtattaaagaacactagacatccctttttaacatccttgaaatattccttccagacaaaagaccgtttgtgttttgtgatggaatatgttaatgggggcgagctgtttttccatttgtcgagagagcgggtgttctctgaggaccgcacacgtttctatggtgcagaaattgtctctgccttggactatctacattccggaaagattgtgtaccgtgatctcaagttggagaatctaatgctggacaaagatggccacataaaaattacagattttggactttgcaaagaagggatcacagatgcagccaccatgaagacattctgtggcactccagaatatctggcaccagaggtgttagaagataatgactatggccgagcagtagactggtggggcctaggggttgtcatgtatgaaatgatgtgtgggaggttacctttctacaaccaggaccatgagaaactttttgaattaatattaatggaagacattaaatttcctcgaacactctcttcagatgcaaaatcattgctttcagggctcttgataaaggatccaaataaacgccttggtggaggaccagatgatgcaaaagaaattatgagacacagtttcttctctggagtaaactggcaagatgtatatgataaaaagcttgtacctccttttaaacctcaagtaacatctgagacagatactagatattttgatgaagaatttacagctcagactattacaataacaccacctgaaaaatatgatgaggatggtatggactgcatggacaatgagaggcggccgcatttccctcaattttcctactctgcaagtggacgagaataagtctctttcattctgctacttcactgtcatcttcaatttattactgaaaatgattcctggacatcaccagtcctagctcttacacatagcaggggcaccttccgacatcccagaccagccaagggtcctcacccctcgccacctttcaccctcatgaaaacacacatacacgcaaatacactccagtttttgtttttgcatgaaattgtatctcagtctaaggtctcatgctgttgctgctactgtcttactattatagcaactttaagaagtaattttccaacctttggaagtcatgagcccaccattgttcatttgtgcaccaattatcatcttttgatcttttagtttttccctcagtgaaggctaaatgagatacactgattctaggtacattttttaactttctagaagagaaaaactaactagactaagaagatttagtttataaattcagaacaagcaattgtggaagggtggtggcgtgcatatgtaaagcacatcagatccgtgcgtgaagtaggcatatatcactaagctgtggctggaattgattaggaagcatttggtagaaggactgaacaactgttgggatatatatatatatatataattttttttttttaaattcctggtggatactgtagaagaagcccatatcacatgtggatgtcgagacttcacgggcaatcatgagcaagtgaacactgttctaccaagaactgaaggcatatgcacagtcaaggtcacttaaagggtcttatgaaacaatttgagccagagagcatctttcccctgtgcttggaaaccttttttccttcttgacatttatcacctctgatggctgaagaatgtagacaggtataatgatactgcttttcaccaaaatttctacaccaaggtaaacaggtgtttgccttatttaattttttactttcagttctacgtgaattagctttttctcagatgttgaaactttgaatgtccttttatgattttgtttatattgcagtagtatttattttttagtgatgagaattgtatgtcatgttagcaaacgcagctccaacttatataaaatagacttactgcagttacttttgacccatgtgcaaggattgtacacgctgatgagaatcatgcactttttctcctctgttaaaaaaaatgataaggctctgaaatggaatatattggttagaatttggctttgggagaagagatgctgccatttaaccccttggtactgaaaatgagaaaatccccaactatgcatgccaaggggttaatgaaacaaatagctgttgacgtttgctcatttaagaatttgaaacgttatgatgacctggcaacaaaaagtaatgaagaaaattgagacctgagtgaagataagaaatgatctttacgtggcaaaatgaacacatcttgagtatttaggaaatgggcagtgaaggctaagaacctggtgtgtttcttgggatcatggtacatttatcactgaattaagccatcagggaaaaaacaacaaaaaaagagaacacctccagcttttctttttctgtatatactcatgtcccccagattccaacatttctcactgaaagggggcatgtatgcaaacctcatctttctccttcattaatgatgatcttcagattaaaccctttggtgctaggagctgacaatttccaaagcagcctgtgaagtcctaggggctgggggccactcttgcggcaagcagaaggccatcctactccgcggagtgatcatggaaatgtattttagttaaactctgacagctcccaaacggaagactacagcatgacgtagtattatgattgcattgtatgaaagagcaagtgactttctaagtaggatgaatcatattcatatgcagatgtcttagcctcttgacgctggaagtgtggatttatagctatgaaaccactgctggcagtgggtgggccactgggactgacgggggttaaagggcattttactaaggcagctaagacatattcagacatcaacgttatccttctttttcatatttctacctgagtgaagttcatccttagtattgagtaggaagttacagtaaatggtagttcattcttacttacacacatagctaatcttttttttttcacttggaattatgttgaatgtttcattttgacaaaaaagtagactagaaggtatgttctttaagttgtcttgcatccattatataagaaagaaacaggtgagaggaagagcagaaagctgagactggctgatgttcagagcacttactcctctagagggaaagcatgacaccgaacactaagcacacagctttttgttgttttggttttttctcccgcaaatcttaaagtgattcccatgaccttggccaaggacacttcttaaagattaatgactggcactgacattgccccaggcgggccactcctcacactggctctcagttcccagccatgcctggggctcagtcacttctattccaccctctgagactccattggtgtcacacaaggtgtcttcttggctttgattttgagaatcccctattttcacttccagatctgtcagctgccatggaggaataatagaaaaccagaaatgcgtgtagagggagatttctaaaacttcccttgtgtcgcccatagttgtagttttgggttctggcaggtggaacaccctgaaacctggaatcattctatgagaatacagttcagactttgcagactccagcccatactaactgtcatgaagcttgacttcttgtcataatgcagccatcttggaggaaattggccatttctgcttagatggttggcagggtcgcgctcagctttgctttctacactaattacatagcattattcaagtattgttttccatttcccatccctgatttccagcttcttaaagctgactgttcttgcaggggccacttgcttctcctagagtacaaaagtaagggccttccttactaactgcagggtctctctattacacctcaacatacacactttgctgctactgtttgtactgtctacagtagaatttccttatcttgctcctggtagtgcattacaggcaagcatgaaatgtaaagtatttatttaaataaaaagaaaacctctaaattggtaattgaattacctccctgtagctttatagtttgtgacatttcttgaccttgctagttctttcattagatctgcgcaagatctagtcatctggttaaggattttaagcagatgcaactataaacccaagaaactgtattactattactgttggtcatactaaacctgtctatttcctgaagtatatgacccacaaggatgtggaataactaggagaaactgtttttgtacactgtacatccttagtatttttacacgtatatgatagggatgaacatgattttccttcgtacagacagcttaaataaagcactatgtcaatctgcta

SEQ ID NO: 212 - DNA, 1575 bp, Homo sapiens
ctcaaatacacatcaccaaacaaattttctctattatttgggctgagtcatcactagagagtgggaagggcagcagcagcagagaatccaaaccctaaagctgatatcacaaagtaccatttctccaagttgggggctcagaggggagtcatcatgagcgatgttaccattgtgaaagaaggttgggttcagaagaggggagaatatataaaaaactggaggccaagatacttccttttgaagacagatggctcattcataggatataaagagaaacctcaagatgtggatttaccttatcccctcaacaacttttcagtggcaaaatgccagttaatgaaaacagaacgaccaaagccaaacacatttataatcagatgtctccagtggactactgttatagagagaacatttcatgtagatactccagaggaaagggaagaatggacagaagctatccaggctgtagcagacagactgcagaggcaagaagaggagagaatgaattgtagtccaacttcacaaattgataatataggagaggaagagatggatgcctctacaacccatcataaaagaaagacaatgaatgattttgactatttgaaactactaggtaaaggcacttttgggaaagttattttggttcgagagaaggcaagtggaaaatactatgctatgaagattctgaagaaagaagtcattattgcaaaggatgaagtggcacacactctaactgaaagcagagtattaaagaacactagacatccctttttaacatccttgaaatattccttccagacaaaagaccgtttgtgttttgtgatggaatatgttaatgggggcgagctgtttttccatttgtcgagagagcgggtgttctctgaggaccgcacacgtttctatggtgcagaaattgtctctgccttggactatctacattccggaaagattgtgtaccgtgatctcaagttggagaatctaatgctggacaaagatggccacataaaaattacagattttggactttgcaaagaagggatcacagatgcagccaccatgaagacattctgtggcactccagaatatctggcaccagaggtgttagaagataatgactatggccgagcagtagactggtggggcctaggggttgtcatgtatgaaatgatgtgtgggaggttacctttctacaaccaggaccatgagaaactttttgaattaatattaatggaagacattaaatttcctcgaacactctcttcagatgcaaaatcattgctttcagggctcttgataaaggatccaaataaacgccttggtggaggaccagatgatgcaaaagaaattatgagacacagtttcttctctggagtaaactggcaagatgtatatgataaaaagcttgtacctccttttaaacctcaagtaacatctgagacagatactagatattttgatgaagaatttacagctcagactattacaataacaccacctgaaaaatgtcagcaatcagattgtggcatgctgggtaactggaaaaaataataaaaagtaagtttcaatagctca

SEQ ID NO: 213 - DNA, 3213 bp, Homo sapiens
attcaaggctcagggtggtggctcattttcaaggggctgtgaaaagagagggtcactcctttttgatcatttccctgctgcctggcttcaaatggccctcaggccaggtcactttagggaaattggtgatcgctcttggtattccactttttttttttttttgagacggagtctcgcactgtcaccaggctggagtgcagtggtgcgatctctgctcactgcaccctccgcctcccgggttcaagcaattctcctgcctcagcctcctgagtagctgggattaggcgaatgccacccctgactaatttttgtatttttagtagagacggggtttcaccatgttggccaggctggtctcgaactcctgaccttgtgatccatccgcctcagcctcccaaagtgctgggattataggcatgagccactgcgcctggcgtggaatttcactcaggtcccttcagctctctctggttctgacagatcttgcccaaattcccatggttatgtggtcatttgcttgcctgttgctgggggtggctgggaggtggcactcagctgttcgactctgaggcccaggactcctggctgctgggactcacgtgtgtccctgcacagggaggagtggatgcgggccatccagatggtcgccaacagcctcaagcagcgggccccaggcgaggaccccatggactacaagtgtggctcccccagtgactcctccacgactgaggagatggaagtggcggtcagcaaggcacgggctaaagtgaccatgaatgacttcgactatctcaaactccttggcaagggaacctttggcaaagtcatcctggtgcgggagaaggccactggccgctactacgccatgaagatcctgcggaaggaagtcatcattgccaaggatgaagtcgctcacacagtcaccgagagccgggtcctccagaacaccaggcacccgttcctcactgcgctgaagtatgccttccagacccacgaccgcctgtgctttgtgatggagtatgccaacgggggtgagctgttcttccacctgtcccgggagcgtgtcttcacagaggagcgggcccggttttatggtgcagagattgtctcggctcttgagtacttgcactcgcgggacgtggtataccgcgacatcaagctggaaaacctcatgctggacaaagatggccacatcaagatcactgactttggcctctgcaaagagggcatcagtgacggggccaccatgaaaaccttctgtgggaccccggagtacctggcgcctgaggtgctggaggacaatgactatggccgggccgtggactggtgggggctgggtgtggtcatgtacgagatgatgtgcggccgcctgcccttctacaaccaggaccacgagcgcctcttcgagctcatcctcatggaagagatccgcttcccgcgcacgctcagccccgaggccaagtccctgcttgctgggctgcttaagaaggaccccaagcagaggcttggtggggggcccagcgatgccaaggaggtcatggagcacaggttcttcctcagcatcaactggcaggacgtggtccagaagaagctcctgccacccttcaaacctcaggtcacgtccgaggtcgacacaaggtacttcgatgatgaatttaccgcccagtccatcacaatcacaccccctgaccgctatgacagcctgggcttactggagctggaccagcggacccacttcccccagttctcctactcggccagcatccgcgagtgagcagtctgcccacgcagaggacgcacgctcgctgccatcaccgctgggtggttttttccccctaactttttacttagcctttttggtttgtgtccccacccccacctcctcaccccctttccagttcttcttcaggcccctcccagacgcaccccagcggcccctgcagcccctgcctccagcctccagcctcacctttgtgcccagactcgcatttggaagactccacctcccgcccaggcctgggctgttgggcggttggagattcaggttttaatccacacaagccccagtgaggggtgaagcatggcgcctggggcctgcctgagtttctggcctgggtgtcgtgctggtgtctgcctccgcgctgctgcatctggacgaaggctgccttctggtgggacgcgacacccggcagacagtggtgctgccttccaggccccgtggcctaggctcggagtggccaggcacggggcggtccaatcccccacccgctgtccccctatgggggcagaaaagcaataatgtccaggggcaggcaggggcccttgggagctgcagggctgggggttagggctgctccctggtgaatggagtcagatcctaggatctgtaccatggggaaccaggagtggccgggctgggtgccgcctcctggtccggcctcctccccaccaaactgtcctcaccctatggatgaggcaggaggaacatttggggccaaacctgcctgcctcccagccccgtgccttactagggcttccttccagctggccttacctcccgctggaccctgggcctggcctggccccactgggggctatgggctgggctcaccctctcctctgcgggggtggagggccaccagccttggctgttacaatcttacaccggacagtattgggcccctccctctccccagggccccacgttctgcagccttaaggttgaacatgagtgcacgtccatgtcagtgctgtgggactcctgtgcgtgcctcggactgcgtgtgtcggcgggacgcaggcacacgtgggtgtgtgtgcatgtgtgtttgtgtgagggcagcgtgtcctccagtgtgcatggtgtgtgggcttgggccccatccctggcccgagcatttcatcctgtgggggaggggtgctgacctagtgggaggagccccactgtgatccatgagctgccctgcccacgcctcccctccctgtagcaacacctctgggtgtttggagtttagcttttgtgggtttgctctccctatcccatctcctgtactacacagttcatggcagggtggggaggggtggggttggttcgggtgggtgagggtctttttcctctgtgtgcgatgttgttatctgacagttctccgtccctactggcctttctcctcgtcttcatatttgtacggtacaagcaataaagacactcatttc

SEQ ID NO: 214 - DNA, 681 bp, Homo sapiens
ttggggtcgctggggacattgccacatctctctgctcagaatgggtccttgagagcgggctccacgccacccttgctggccttaccctttgctgagtgggcagaacagccagagggcctcagagcccggcgtcctcagggaaggggctggtgtggaatcccctcccgccctgaccagctcctctcttgtcttgcagactgtgccctgtccacggtgcctcctgcatgtcctgctgccctgagctgtcccgagctaggtgacagcgtaccacgctgccaccatgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactga

SEQ ID NO: 215 - DNA, 5300 bp, Homo sapiens
tgggagggggcggtaagcgggggctggggggagggggcggggggggccgcgccgtgctagccgttgggcctgcctcggaggaggcgtcgccgccgccgctgccgctgccggcgccgttgccgctgccgggaaacacaaggaaagggaaccagcgcagcgtggcgatgggcgggggtagagccccgccggagaggctgggcggctgccggtgacagactgtgccctgtccacggtgcctcctgcatgtcctgctgccctgagctgtcccgagctaggtgacagcgtaccacgctgccaccatgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactgaggagatggaagtggcggtcagcaaggcacgggctaaagtgaccatgaatgacttcgactatctcaaactccttggcaagggaacctttggcaaagtcatcctggtgcgggagaaggccactggccgctactacgccatgaagatcctgcggaaggaagtcatcattgccaaggatgaagtcgctcacacagtcaccgagagccgggtcctccagaacaccaggcacccgttcctcactgcgctgaagtatgccttccagacccacgaccgcctgtgctttgtgatggagtatgccaacgggggtgagctgttcttccacctgtcccgggagcgtgtcttcacagaggagcgggcccggttttatggtgcagagattgtctcggctcttgagtacttgcactcgcgggacgtggtataccgcgacatcaagctggaaaacctcatgctggacaaagatggccacatcaagatcactgactttggcctctgcaaagagggcatcagtgacggggccaccatgaaaaccttctgtgggaccccggagtacctggcgcctgaggtgctggaggacaatgactatggccgggccgtggactggtgggggctgggtgtggtcatgtacgagatgatgtgcggccgcctgcccttctacaaccaggaccacgagcgcctcttcgagctcatcctcatggaagagatccgcttcccgcgcacgctcagccccgaggccaagtccctgcttgctgggctgcttaagaaggaccccaagcagaggcttggtggggggcccagcgatgccaaggaggtcatggagcacaggttcttcctcagcatcaactggcaggacgtggtccagaagaagctcctgccacccttcaaacctcaggtcacgtccgaggtcgacacaaggtacttcgatgatgaatttaccgcccagtccatcacaatcacaccccctgaccgctatgacagcctgggcttactggagctggaccagcggacccacttcccccagttctcctactcggccagcatccgcgagtgagcagtctgcccacgcagaggacgcacgctcgctgccatcaccgctgggtggttttttccccctaactttttacttagcctttttggtttgtgtccccacccccacctcctcaccccctttccagttcttcttcaggcccctcccagacgcaccccagcggcccctgcagcccctgcctccagcctccagcctcacctttgtgcccagactcgcatttggaagactccacctcccgcccaggcctgggctgttgggcggttggagattcaggttttaatccacacaagccccagtgaggggtgaagcatggcgcctggggcctgcctgagtttctggcctgggtgtcgtgctggtgtctgcctccgcgctgctgcatctggacgaaggctgccttctggtgggacgcgacacccggcagacagtggtgctgccttccaggccccgtggcctaggctcggagtggccaggcacggggcggtccaatcccccacccgctgtccccctatgggggcagaaaagcaataatgtccaggggcaggcaggggcccttgggagctgcagggctgggggttagggctgctccctggtgaatggagtcagatcctaggatctgtaccatggggaaccaggagtggccgggctgggtgccgcctcctggtccggcctcctccccaccaaactgtcctcaccctatggatgaggcaggaggaacatttggggccaaacctgcctgcctcccagccccgtgccttactagggcttccttccagctggccttacctcccgctggaccctgggcctggcctggccccactgggggctatgggctgggctcaccctctcctctgcgggggtggagggccaccagccttggctgttacaatcttacaccggacagtattgggccccatggacttggtcagggaggggtgggggtgggcatctctggtacctattggggtggggggcctctgaaaagggaggctcctaggcccccctcacccctccctctccccagggccccacgttctgcagccttaaggttgaacatgagtgcacgtccatgtcagtgctgtgggactcctgtgcgtgcctcggactgcgtgtgtcggcgggacgcaggcacacgtgggtgtgtgtgcatgtgtgtttgtgtgagggcagcgtgtcctccagtgtgcatggtgtgtgggcttgggccccatccctggcccgagcatttcatcctgtgggggaggggtgctgacctagtgggaggagccccactgtgatccatgagctgccctgcccacgcctcccctccctgtagcaacacctctgggtgtttggagtttagcttttgtgggtttgctctccctatcccatctcctgtactacacagttcatggcagggtggggaggggtggggttggttcgggtgggtgagggtctttttcctctgtgtgcgatgttgttatctgacagttctccgtccctactggcctttctcctcgtcttcatatttgtacggtacaagcaataaagacactcatttcagaccagggcccagcctgcactcacgccagcccaaccactctgggctttgccttggtgatggagtcagacccctgggccccagctcctcctgtactagccgttcccttcagcaaggagggcactgagctcagggtgagggcagctggggtgtgtgcaggagctcaggctggagagggtgggtggagctggtgctgtggggctgaggggtatgggaaggctccccgcatgtgggggtggggtggacagagaccactccaggccctcagtgctgcttaggctaagagaggtggggtggagggacagggctggaagatctgggtagcccagaatgaggagggtgcctgtgctgtcactgaatgagagggagtggttcattccacccggctgccgagcctcagaggggggcattcctatcctgccccacctccctgtttatgctgccacctggaagccttgaggcccccaaattccagtacagacccagtggtgtgttcatggtggcgtggttgctgtcacctgggagctcctgagcgtttggttagaaccctgttcagcttggggtcagccctcccctagtcactgccctttagcctggatgtgtctgggcccctgcacttcccgtgcttgagtcacgtggctgcatggccgggcgctggccggatggaacacctcccccagcaagggaccagggaccagagccctggcctgccctgctgagccctgctgtgcagagggcctggcacagatgaatttgagattttgccgcaaggtgttagcacttcacacccattgagtctttgagattttaagtgaatgtaagcagaaaaagtcagatccaatttacagaaatcagagttagctacagctaggactcgtttggttggggttttttagtttgtctttctaaagtcatgtggaccttaatttaattacaaaagtctaccctggtggtcataaaataggcaggcctatgaagaaaggccttttactcttccatctcatcccagccccgagttgacccacgttgctgctcctcacaccatggtgatgcaggtctcgtagtgtgggcacaggcctggctacctcatctttttagtgcctctctcctcttccacaggatggggtcccacagctgcagcagctggccccgtagttgagcatgtgtggttatcctgtagagcttttcccaagaagggtgtttgaacttagagtcttaataaaatcttaccaaataaattttgagtagaataatcgtcttttgcaatgtacattttaaaaatttcacacattcttttttgtatataaagaacagtgactgggcacagtggctcatgcctgtaatcccagcaatttgggaggccgaggcgggcgggtctcttgaggccaggggttcgagaccagcctgggcatcatagggagaccttcatctctacaaaaaatacaaaaattagctgggcatggtggtgcatgcctgcaatcccagctaacttggaaggctgaggtgaggtgggaagatcacttgagcccaggagtttgaggctgcagtgagctatgattgcggcactgcactgcagcctgggacaatgagactgtgtctctaaaaataaaaaaaaaaaaaacatgatacatgctattaaaaaagacagcaaagcaggagtataagaaaggaaattcacccgaggtcgcagggccttgagtactcattttggtgctgattacctctctgcaaatggacacggcatcataaattggtagtttcctgctctttttgtgtaatcttttccagttaatgtgaagcctctgggggctgccctcgtgcactgatggttgtgtggagtcgggggcggcagtgcgattcccttttagctgctgcatggggggaactcaggctttccagctgcttcctggggttccatggggtagacccctcaaccgcttcagctgccccgttaacaggaattgacttggtttcgtttggtgctaccagcagtcctgtaataaactagctatccatctgta

SEQ ID NO: 216 - DNA, 3913 bp, Homo sapiens
aagaatatgtgcttatggtaaaggcaggcggcaggtacggaggctgtgggaagtcggggtccctccgcccccacaggcagccctgtgctggcctggtgtatacgtttctgtgcagacgtacaccaccctgtgtgagcacagatgtatttttacacatggctctggacagctgtctgactctgtcagcagcaggccttggaggggctcaggcccgtgtgggggtggggggacatccagaggtctttgagtccagccctctgcctccaggccacgcccactcagtgtcgtcagagccccctgtgcctgaggcgtgcgcggctcggagccctgccctcggagtcctgcggtgccttcctcgagtctggcctgctttccatcctgctaagtacttggggcatttccctctttgggtaaggtgtggtcttccctgtcctggcattagacacaaggcagtgggccttcctgccattctaagtgtagcttaagacaatcagtgcaaagcaaccctttgtgggtgtccagcccttgcctcgggaggccagaaaggtggcctggggggagagcgtctaagctggctgtggaaagacccatgttgggatccattccacagaggtcgtcaggggtctctgcctggcctggaggtcccagagaggaccctcctcccctcaggaaggcccatctggaagggtagcagaggactgctcacaggaagagcatgcgaagtgctctttctggggatgcctgtagttggtgatgtgggaactgggttttgagggatgcctaggagttcatccatcagaggggaaatgaggaagccatgcaggatcaatggataaagtgtgctcaggtgagggttggctggtgggccgctgcagggcgggggcctgtccagtgctcccccacttacttgctgcctcccgactgctgtaattatgggtctgtaaccaccctggactgggtgctcctcactgacggacttgtctgaacctctctttgtctccagcgcccagcactgggcctggcaaaacctgagacgcccggtacatgttggccaaatgaatgaaccagattcagaccggcaggggcgctgtggtttaggaggggcctggggtttctcccaggaggtttttgggcttgcgctggagggctctggactcccgtttgcgccagtggcctgcatcctggtcctgtcttcctcatgtttgaatttctttgctttcctagtctggggagcagggaggagccctgtgccctgtcccaggatccatgggtaggaacaccatggacagggagagcaaacggggccatctgtcaccaggggcttagggaaggccgagccagcctgggtcaaagaagtcaaaggggctgcctggaggaggcagcctgtcagctggtgcatcagaggctgtggccaggccagctgggctcggggagcgccagcctgagaggagcgcgtgagcgtcgcgggagcctcgggcaccatgagcgacgtggctattgtgaaggagggttggctgcacaaacgaggggagtacatcaagacctggcggccacgctacttcctcctcaagaatgatggcaccttcattggctacaaggagcggccgcaggatgtggaccaacgtgaggctcccctcaacaacttctctgtggcgcagtgccagctgatgaagacggagcggccccggcccaacaccttcatcatccgctgcctgcagtggaccactgtcatcgaacgcaccttccatgtggagactcctgaggagcgggaggagtggacaaccgccatccagactgtggctgacggcctcaagaagcaggaggaggaggagatggacttccggtcgggctcacccagtgacaactcaggggctgaagagatggaggtgtccctggccaagcccaagcaccgcgtgaccatgaacgagtttgagtacctgaagctgctgggcaagggcactttcggcaaggtgatcctggtgaaggagaaggccacaggccgctactacgccatgaagatcctcaagaaggaagtcatcgtggccaaggacgaggtggcccacacactcaccgagaaccgcgtcctgcagaactccaggcaccccttcctcacagccctgaagtactctttccagacccacgaccgcctctgctttgtcatggagtacgccaacgggggcgagctgttcttccacctgtcccgggagcgtgtgttctccgaggaccgggcccgcttctatggcgctgagattgtgtcagccctggactacctgcactcggagaagaacgtggtgtaccgggacctcaagctggagaacctcatgctggacaaggacgggcacattaagatcacagacttcgggctgtgcaaggaggggatcaaggacggtgccaccatgaagaccttttgcggcacacctgagtacctggcccccgaggtgctggaggacaatgactacggccgtgcagtggactggtgggggctgggcgtggtcatgtacgagatgatgtgcggtcgcctgcccttctacaaccaggaccatgagaagctttttgagctcatcctcatggaggagatccgcttcccgcgcacgcttggtcccgaggccaagtccttgctttcagggctgctcaagaaggaccccaagcagaggcttggcgggggctccgaggacgccaaggagatcatgcagcatcgcttctttgccggtatcgtgtggcagcacgtgtacgagaagaagctcagcccacccttcaagccccaggtcacgtcggagactgacaccaggtattttgatgaggagttcacggcccagatgatcaccatcacaccacctgaccaagatgacagcatggagtgtgtggacagcgagcgcaggccccacttcccccagttctcctactcggccagcggcacggcctgaggcggcggtggactgcgctggacgatagcttggagggatggagaggcggcctcgtgccatgatctgtatttaatggtttttatttctcgggtgcatttgagagaagccacgctgtcctctcgagcccagatggaaagacgtttttgtgctgtgggcagcaccctcccccgcagcggggtagggaagaaaactatcctgcgggttttaatttatttcatccagtttgttctccgggtgtggcctcagccctcagaacaatccgattcacgtagggaaatgttaaggacttctgcagctatgcgcaatgtggcattggggggccgggcaggtcctgcccatgtgtcccctcactctgtcagccagccgccctgggctgtctgtcaccagctatctgtcatctctctggggccctgggcctcagttcaacctggtggcaccagatgcaacctcactatggtatgctggccagcaccctctcctgggggtggcaggcacacagcagccccccagcactaaggccgtgtctctgaggacgtcatcggaggctgggcccctgggatgggaccagggatgggggatgggccagggtttacccagtgggacagaggagcaaggtttaaatttgttattgtgtattatgttgttcaaatgcattttgggggtttttaatctttgtgacaggaaagccctcccccttccccttctgtgtcacagttcttggtgactgtcccaccgggagcctccccctcagatgatctctccacggtagcacttgaccttttcgacgcttaacctttccgctgtcgccccaggccctccctgactccctgtgggggtggccatccctgggcccctccacgcctcctggccagacgctgccgctgccgctgcaccacggcgtttttttacaacattcaactttagtatttttactattataatataatatggaaccttccctccaaattcttcaataaaagttgcttttc

SEQ ID NO: 217 - DNA, 2710 bp, Homo sapiens
ggcggccgagcaccgagcgctgggcaccgggcaccgagcggcggcggcacgcgaggcccggccccgagcagcgcccccgcccgccgcggcctccagcccggccccgcccagcgccggcccgcggggatgcggagcggcgggcgccggaggccgcggcccggctaggcccgcgctcgcgcccggacgcggcggcccgaggctgtggccaggccagctgggctcggggagcgccagcctgagaggagcgcgtgagcgtcgcgggagcctcgggcaccatgagcgacgtggctattgtgaaggagggttggctgcacaaacgaggggagtacatcaagacctggcggccacgctacttcctcctcaagaatgatggcaccttcattggctacaaggagcggccgcaggatgtggaccaacgtgaggctcccctcaacaacttctctgtggcgcagtgccagctgatgaagacggagcggccccggcccaacaccttcatcatccgctgcctgcagtggaccactgtcatcgaacgcaccttccatgtggagactcctgaggagcgggaggagtggacaaccgccatccagactgtggctgacggcctcaagaagcaggaggaggaggagatggacttccggtcgggctcacccagtgacaactcaggggctgaagagatggaggtgtccctggccaagcccaagcaccgcgtgaccatgaacgagtttgagtacctgaagctgctgggcaagggcactttcggcaaggtgatcctggtgaaggagaaggccacaggccgctactacgccatgaagatcctcaagaaggaagtcatcgtggccaaggacgaggtggcccacacactcaccgagaaccgcgtcctgcagaactccaggcaccccttcctcacagccctgaagtactctttccagacccacgaccgcctctgctttgtcatggagtacgccaacgggggcgagctgttcttccacctgtcccgggagcgtgtgttctccgaggaccgggcccgcttctatggcgctgagattgtgtcagccctggactacctgcactcggagaagaacgtggtgtaccgggacctcaagctggagaacctcatgctggacaaggacgggcacattaagatcacagacttcgggctgtgcaaggaggggatcaaggacggtgccaccatgaagaccttttgcggcacacctgagtacctggcccccgaggtgctggaggacaatgactacggccgtgcagtggactggtgggggctgggcgtggtcatgtacgagatgatgtgcggtcgcctgcccttctacaaccaggaccatgagaagctttttgagctcatcctcatggaggagatccgcttcccgcgcacgcttggtcccgaggccaagtccttgctttcagggctgctcaagaaggaccccaagcagaggcttggcgggggctccgaggacgccaaggagatcatgcagcatcgcttctttgccggtatcgtgtggcagcacgtgtacgagaagaagctcagcccacccttcaagccccaggtcacgtcggagactgacaccaggtattttgatgaggagttcacggcccagatgatcaccatcacaccacctgaccaagatgacagcatggagtgtgtggacagcgagcgcaggccccacttcccccagttctcctactcggccagcggcacggcctgaggcggcggtggactgcgctggacgatagcttggagggatggagaggcggcctcgtgccatgatctgtatttaatggtttttatttctcgggtgcatttgagagaagccacgctgtcctctcgagcccagatggaaagacgtttttgtgctgtgggcagcaccctcccccgcagcggggtagggaagaaaactatcctgcgggttttaatttatttcatccagtttgttctccgggtgtggcctcagccctcagaacaatccgattcacgtagggaaatgttaaggacttctgcagctatgcgcaatgtggcattggggggccgggcaggtcctgcccatgtgtcccctcactctgtcagccagccgccctgggctgtctgtcaccagctatctgtcatctctctggggccctgggcctcagttcaacctggtggcaccagatgcaacctcactatggtatgctggccagcaccctctcctgggggtggcaggcacacagcagccccccagcactaaggccgtgtctctgaggacgtcatcggaggctgggcccctgggatgggaccagggatgggggatgggccagggtttacccagtgggacagaggagcaaggtttaaatttgttattgtgtattatgttgttcaaatgcattttgggggtttttaatctttgtgacaggaaagccctcccccttccccttctgtgtcacagttcttggtgactgtcccaccgggagcctccccctcagatgatctctccacggtagcacttgaccttttcgacgcttaacctttccgctgtcgccccaggccctccctgactccctgtgggggtggccatccctgggcccctccacgcctcctggccagacgctgccgctgccgctgcaccacggcgtttttttacaacattcaactttagtatttttactattataatataatatggaaccttccctccaaattcttcaataaaagttgcttttcaaa

SEQ ID NO: 218 - DNA, 974 bp, Homo sapiens
aagtgctgggattacacgcgtgagccaccacgtccagcttcctgttgtctttgaatttatctcctgagcaagtcttcctccgggcgctgtggaaaggcacagatctgagtgcaggcgacagaggctcctgagggggtcgctgccacctccccaatgagcctccgcagcaccaggaaggagccccacccaccagctccagctccaagagacgcagatctctgcttccccacctgcctccctagcccatctgtgctgtctggcatcaaaatcagttttccacagtagttgaaccattttgcacctcccaccaataatgagtaagggttctggttcctctacatccgagccagcagttggccttgtcagtttttaaaattcgagccatcccagctgtgctgactccttagttgctgagatgagcttgtaaaaagcagctctgttgatcccagcagcggccagggcctccgctgcttctcggctgggagacccgagactgtgccctgtccacggtgcctcctgcatgtcctgctgccctgagctgtcccgagctaggtgacagcgtaccacgctgccaccatgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgac

SEQ ID NO: 219 - DNA, 592 bp, Homo sapiens
gtgggaggggcgctgggtgggagctcagcctggcccccttggggcaggacccactgccaactcggcacccacagcagggcccaggtgctctgactgtgccgagcgagggacagcaagccgggtcggccaagaggagactgcatgtcagaggtcccagcaggagtttcttcagcccagccgtcctgctggagaagctcgttcgcagatgttgtttctaaggactgtgccctgtccacggtgcctcctgcatgtcctgctgccctgagctgtcccgagctaggtgacagcgtaccacgctgccaccatgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagg

SEQ ID NO: 220 - DNA, 798 bp, Homo sapiens
gtagagggctgtacctttttggcgctgtggaagccgttgctgtgctgtatttacagggagtccgaaattgaagttcagaggaagaattgccttccaccgcatcttatcagaccctatgggtgccagggtgtgtgctgggagaagaagacagcaagagagccatgcagggggtgacacagctaccagggacctgcgttagctagcagcaggacggtgaagtcggttctagctctgcgaccttggaccacactgttcactcccatacagtggtctcagaaggacgtccaccttgggctgttgtgaggattaaatgaattaatccacgagaagctcctagaatggtgcctggtactgtactgtgccctgtccacggtgcctcctgcatgtcctgctgccctgagctgtcccgagctaggtgacagcgtaccacgctgccaccatgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccat

SEQ ID NO: 221 - DNA, 1497 bp, Homo sapiens
atgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactgaggagatggaagtggcggtcagcaaggcacgggctaaagtgaccatgaatgacttcgactatctcaaactccttggcaagggaacctttggcaaagtcatcctggtgcgggagaaggccactggccgctactacgccatgaagatcctgcggaaggaagtcatcattgccaaggatgaagtcgctcacacagtcaccgagagccgggtcctccagaacaccaggcacccgttcctcactgcgctgaagtatgccttccagacccacgaccgcctgtgctttgtgatggagtatgccaacgggggtgagctgttcttccacctgtcccgggagcgtgtcttcacagaggagcgggcccggttttatggtgcagagattgtctcggctcttgagtacttgcactcgcgggacgtggtataccgcgacatcaagctggaaaacctcatgctggacaaagatggccacatcaagatcactgactttggcctctgcaaagagggcatcagtgacggggccaccatgaaaaccttctgtgggaccccggagtacctggcgcctgaggtgctggaggacaatgactatggccgggccgtggactggtgggggctgggtgtggtcatgtacgagatgatgtgcggccgcctgcccttctacaaccaggaccacgagcgcctcttcgagctcatcctcatggaagagatccgcttcccgcgcacgctcagccccgaggccaagtccctgcttgctgggctgcttaagaaggaccccaagcagaggcttggtggggggcccagcgatgccaaggaggtcatggagcacaggttcttcctcagcatcaactggcaggacgtggtccagaagaagctcctgccacccttcaaacctcaggtcacgtccgaggtcgacacaaggtacttcgatgatgaatttaccgcccagtccatcacaatcacaccccctgaccgctatgacagcctgggcttactggagctggaccagcggacccacttcccccagttctcctactcggccagcatccgcgagtgagcagtctgcccacgcagaggacgcacgctcgctgccatcaccgctgggtgg

SEQ ID NO: 222 - DNA, 554 bp, Homo sapiens
aggtcgtgggataggcatatattgagctttgattttgactgcttaacagttttccacagtagttgaaccattttgcacctcccaccaataatgagtaagggttctggttcctctacatccgagccagcagttggccttgtcagtttttaaaattcgagccatcccagctgtgctgactccttagttgctgagatgagcttgtaaaaagcagctctgttgatcccagcagcggccagggcctccgctgcttctcggctgggagacccgagactgtgccctgtccacggtgcctcctgcatgtcctgctgccctgagctgtcccgagctaggtgacagcgtaccacgctgccaccatgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagagg

SEQ ID NO: 223 - DNA, 577 bp, Homo sapiens
gctgcaagtttgcgggacggggagcgcaggccgcagcgtgcgcgggccgggggctggacctttcgggcgcggcgggcagatcgagcctggcactgtgccctgtccacggtgcctcctgcatgtcctgctgccctgagctgtcccgagctaggtgacagcgtaccacgctgccaccatgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactgag

SEQ ID NO: 224 - DNA, 582 bp, Homo sapiens
gcaagtttgcgggacggggagcgcaggccgcagcgtgcgcgggccgggggctggacctttcgggcgcggcgggcagatcgagcctggctggtctcagaaggacgtccaccttgggctgttgtgaggattaaatgaattaatccacgagaagctcctagaatggtgcctggtactgtactgtgccctgtccacggtgcctcctgcatgtcctgctgccctgagctgtcccgagctaggtgacagcgtaccacgctgccaccatgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgcca

SEQ ID NO: 225 - DNA, 1402 bp, Homo sapiens
gagtgtgggaggggcgctgggtgggagctcagcctggcccccttggggcaggacccactgccaactcggcacccacagcagggcccaggtgctctgactgtgccgagcgagggacagcaagccgggtcggccaagaggagactgcatgtcagaggtcccagcaggagtttcttcagcccagccgtcctgctggagaagctcgttcgcagatgttgtttctaaggactgtgccctgtccacggtgcctcctgcatgtcctgctgccctgagctgtcccgagctaggtgacagcgtaccacgctgccaccatgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactgaggagatggaagtggcggtcagcaaggcacgggctaaagtgaccatgaatgacttcgactatctcaaactccttggcaagggaacctttggcaaagtcatcctggtgcgggagaaggccactggccgctactacgccatgaagatcctgcggaaggaagtcatcattgccaaggatgaagtcgctcacacagtcaccgagagccgggtcctccagaacaccaggcacccgttcctcactgtgagttgccctccccttcccagacagtgtgaggccagcctttggacagagctcagagagagagccctaatcttctggtacaaagcacagtcttggggtaggccaggcgggcagggcaaggtgttgctgcgccctgccaagtcatccgaaccaagacatgtggtgggggtgagcaggctcggggagtgggagggtgacagcttcttcatagatggtggcttcatgtaagcatttgaactaactgaagatatcacattatttgctggctgctgtctctatgagttaggagcacttagcccagctggttgaagtggaaacattattttttttgtttttgttttcagatatgctcatagaagcagatgtgttagcattgtgttgtctgtcagcctggactgagtagatgcctgtttgggctgcagtctccatcaaggccagtggccaccagttaaatg

SEQ ID NO: 226 - DNA, 1564 bp, Homo sapiens
ctgccacggagccccagcggctacacactccactcactcacacctctcagggccccgcacgttcccacagccctcagggtgtacgtgctgtaggtgtggctgtgccccagagtgccagctgatgaagacggagcggccccggcccaacaccttcatcatccgctgcctgcagtggaccactgtcatcgaacgcaccttccatgtggagactcctgaggagcgggaggagtggacaaccgccatccagactgtggctgacggcctcaagaagcaggaggaggaggagatggacttccggtcgggctcacccagtgacaactcaggggctgaagagatggaggtgtccctggccaagcccaagcaccgcgtgaccatgaacgagtttgagtacctgaagctgctgggcaagggcactttcggcaaggtgatcctggtgaaggagaaggccacaggccgctactacgccatgaagatcctcaagaaggaagtcatcgtggccaaggacgaggtggcccacacactcaccgagaaccgcgtcctgcagaactccaggcaccccttcctcacagccctgaagtactctttccagacccacgaccgcctctgctttgtcatggagtacgccaacgggggcgagctgttcttccacctgtcccgggagcgtgtgttctccgaggaccgggcccgcttctatggcgctgagattgtgtcagccctggactacctgcactcggagaagaacgtggtgtaccgggacctcaagctggagaacctcatgctggacaaggacgggcacattaagatcacagacttcgggctgtgcaaggaggggatcaaggacggtgccaccatgaagaccttttgcggcacacctgagtacctggcccccgaggtgctggaggacaatgactacggccgtgcagtggactggtgggggctgggcgtggtcatgtacgagatgatgtgcggtcgcctgcccttctacaaccaggaccatgagaagctttttgagctcatcctcatggaggagatccgcttcccgcgcacgcttggtcccgaggccaagtccttgctttcagggctgctcaagaaggaccccaagcagaggcttggcgggggctccgaggacgccaaggagatcatgcagcatcgcttctttgccggtatcgtgtggcagcacgtgtacgagaagaagctcagcccacccttcaagccccaggtcacgtcggagactgacaccaggtattttgatgaggagttcacggcccagatgatcaccatcacaccacctgaccaagatgacagcatggagtgtgtggacagcgagcgcaggccccacttcccccagttctcctactcggccagcggcacggcctgaggcggcggtggactgcgctggacgatagcttggagggatggagaggcggcctcgtgccatgatctgtatttaatggtttttatttctcgggtgcatttgagagaagccacgctgtcctctcgagcccagatggaaagacgtttttgtgctgtgggcagcaccctcccccgcagcggggtagggaag

SEQ ID NO: 227 - DNA, 560 bp, Homo sapiens
attgggcaccgcccacttcgtgggcttccaggctgagtcatcactagagagtgggaagggcagcagcagcagagaatccaaaccctaaagctgatatcacaaagtaccatttctccaagttgggggctcagaggggagtcatcatgagcgatgttaccattgtgaaagaaggttgggttcagaagaggggagaatatataaaaaactggaggccaagatacttccttttgaagacagatggctcattcataggatataaagagaaacctcaagatgtggatttaccttatcccctcaacaacttttcagtggcaaaatgccagttaatgaaaacagaacgaccaaagccaaacacatttataatcagatgtctccagtggactactgttatagagagaacatttcatgtagatactccagaggaaagggaagaatggacagaagctatccaggctgtagcagacagactgcagaggcaagaagaggagagaatgaattgtagtccaacttcacaaattgataatataggagaggaagagatggatgcctctacaacccat

SEQ ID NO: 228 - DNA, 3916 bp, Homo sapiens
ctttgggtaaggtgtggtcttccctgtcctggcattagacacaaggcagtgggccttcctgccattctaagtgtagcttaagacaatcagtgcaaagcaaccctttgtgggtgtccagcccttgcctcgggaggccagaaaggtggcctggggggagagcgtctaagctggctgtggaaagacccatgttgggatccattccacagaggtcgtcaggggtctctgcctggcctggaggtcccagagaggaccctcctcccctcaggaaggcccatctggaagggtagcagaggactgctcacaggaagagcatgcgaagtgctctttctggggatgcctgtagttggtgatgtgggaactgggttttgagggatgcctaggagttcatccatcagaggggaaatgaggaagccatgcaggatcaatggataaagtgtgctcaggtgagggttggctggtgggccgctgcagggcgggggcctgtccagtgctcccccacttacttgctgcctcccgactgctgtaattatgggtctgtaaccaccctggactgggtgctcctcactgacggacttgtctgaacctctctttgtctccagcgcccagcactgggcctggcaaaacctgagacgcccggtacatgttggccaaatgaatgaaccagattcagaccggcaggggcgctgtggtttaggaggggcctggggtttctcccaggaggtttttgggcttgcgctggagggctctggactcccgtttgcgccagtggcctgcatcctggtcctgtcttcctcatgtttgaatttctttgctttcctagtctggggagcagggaggagccctgtgccctgtcccaggatccatgggtaggaacaccatggacagggagagcaaacggggccatctgtcaccaggggcttagggaaggccgagccagcctgggtcaaagaagtcaaaggggctgcctggaggaggcagcctgtcagctggtgcatcaggttagggaggctgggaaggccttttggggatgggggtgatttgtccaacggctgggggaggtgggaatggggaggtgagcaaggcagcagctctcagggcctggctgttgcgggtggtggtggcaggggctggaggctctaagcctagaataaggagaggcccaggtccagggaactgtgttcaattacatggatttgacacttggcagccctgagtgttttggggagagggaaggcaggcgggcagatgggggtcagagagcttagagggatggcagcccacctgggaaggcaggtgcgggtggagcccccaggcacgtgcagtgggtctctggctcacccagggcgaggagctgcccttagccaggcgtggcctcacattcagcttcctttgcttctcccagaggctgtggccaggccagctgggctcggggagcgccagcctgagaggagcgcgtgagcgtcgcgggagcctcgggcaccatgagcgacgtggctattgtgaaggagggttggctgcacaaacgaggggagtacatcaagacctggcggccacgctacttcctcctcaagaatgatggcaccttcattggctacaaggagcggccgcaggatgtggaccaacgtgaggctcccctcaacaacttctctgtggcgcagtgccagctgatgaagacggagcggccccggcccaacaccttcatcatccgctgcctgcagtggaccactgtcatcgaacgcaccttccatgtggagactcctgaggagcgggaggagtggacaaccgccatccagactgtggctgacggcctcaagaagcaggaggaggaggagatggacttccggtcgggctcacccagtgacaactcaggggctgaagagatggaggtgtccctggccaagcccaagcaccgcgtgaccatgaacgagtttgagtacctgaagctgctgggcaagggcactttcggcaaggtgatcctggtgaaggagaaggccacaggccgctactacgccatgaagatcctcaagaaggaagtcatcgtggccaaggacgaggtggcccacacactcaccgagaaccgcgtcctgcagaactccaggcaccccttcctcacagccctgaagtactctttccagacccacgaccgcctctgctttgtcatggagtacgccaacgggggcgagctgttcttccacctgtcccgggagcgtgtgttctccgaggaccgggcccgcttctatggcgctgagattgtgtcagccctggactacctgcactcggagaagaacgtggtgtaccgggacctcaagctggagaacctcatgctggacaaggacgggcacattaagatcacagacttcgggctgtgcaaggaggggatcaaggacggtgccaccatgaagaccttttgcggcacacctgagtacctggcccccgaggtgctggaggacaatgactacggccgtgcagtggactggtgggggctgggcgtggtcatgtacgagatgatgtgcggtcgcctgcccttctacaaccaggaccatgagaagctttttgagctcatcctcatggaggagatccgcttcccgcgcacgcttggtcccgaggccaagtccttgctttcagggctgctcaagaaggaccccaagcagaggcttggcgggggctccgaggacgccaaggagatcatgcagcatcgcttctttgccggtatcgtgtggcagcacgtgtacgagaagaagctcagcccacccttcaagccccaggtcacgtcggagactgacaccaggtattttgatgaggagttcacggcccagatgatcaccatcacaccacctgaccaagatgacagcatggagtgtgtggacagcgagcgcaggccccacttcccccagttctcctactcggccagcggcacggcctgaggcggcggtggactgcgctggacgatagcttggagggatggagaggcggcctcgtgccatgatctgtatttaatggtttttatttctcgggtgcatttgagagaagccacgctgtcctctcgagcccagatggaaagacgtttttgtgctgtgggcagcaccctcccccgcagcggggtagggaagaaaactatcctgcgggttttaatttatttcatccagtttgttctccgggtgtggcctcagccctcagaacaatccgattcacgtagggaaatgttaaggacttctgcagctatgcgcaatgtggcattggggggccgggcaggtcctgcccatgtgtcccctcactctgtcagccagccgccctgggctgtctgtcaccagctatctgtcatctctctggggccctgggcctcagttcaacctggtggcaccagatgcaacctcactatggtatgctggccagcaccctctcctgggggtggcaggcacacagcagccccccagcactaaggccgtgtctctgaggacgtcatcggaggctgggcccctgggatgggaccagggatgggggatgggccagggtttacccagtgggacagaggagcaaggtttaaatttgttattgtgtattatgttgttcaaatgcattttgggggtttttaatctttgtgacaggaaagccctcccccttccccttctgtgtcacagttcttggtgactgtcccaccgggagcctccccctcagatgatctctccacggtagcacttgaccttttcgacgcttaacctttccgctgtcgccccaggccctccctgactccctgtgggggtggccatccctgggcccctccacgcctcctggccagacgctgccgctgccgctgcaccacggcgtttttttacaacattcaactttagtatttttactattataatataatatggaaccttccctccaaattcttcaataaaagttgcttttcaaa

SEQ ID NO: 229 - DNA, 1595 bp, Homo sapiens
agtcctgcggtgccttcctcgagtctggcctgctttccatcctgctaagtacttggggcatttccctctttggaggctgtggccaggccagctgggctcggggagcgccagcctgagaggagcgcgtgagcgtcgcgggagcctcgggcaccatgagcgacgtggctattgtgaaggagggttggctgcacaaacgaggggagtacatcaagacctggcggccacgctacttcctcctcaagaatgatggcaccttcattggctacaaggagcggccgcaggatgtggaccaacgtgaggctcccctcaacaacttctctgtggcgcagtgccagctgatgaagacggagcggccccggcccaacaccttcatcatccgctgcctgcagtggaccactgtcatcgaacgcaccttccatgtggagactcctgaggagcgggaggagtggacaaccgccatccagactgtggctgacggcctcaagaagcaggaggaggaggagatggacttccggtcgggctcacccagtgacaactcaggggctgaagagatggaggtgtccctggccaagcccaagcaccgcgtgaccatgaacgagtttgagtacctgaagctgctgggcaagggcactttcggcaaggtgatcctggtgaaggagaaggccacaggccgctactacgccatgaagatcctcaagaaggaagtcatcgtggccaaggacgaggtggcccacacactcaccgagaaccgcgtcctgcagaactccaggcaccccttcctcacagccctgaagtactctttccagacccacgaccgcctctgctttgtcatggagtacgccaacgggggcgagctgttcttccacctgtcccgggagcgtgtgttctccgaggaccgggcccgcttctatggcgctgagattgtgtcagccctggactacctgcactcggagaagaacgtggtgtaccgggacctcaagctggagaacctcatgctggacaaggacgggcacattaagatcacagacttcgggctgtgcaaggaggggatcaaggacggtgccaccatgaagaccttttgcggcacacctgagtacctggcccccgaggtgctggaggacaatgactacggccgtgcagtggactggtgggggctgggcgtggtcatgtacgagatgatgtgcggtcgcctgcccttctacaaccaggaccatgagaagctttttgagctcatcctcatggaggagatccgcttcccgcgcacgcttggtcccgaggccaagtccttgctttcagggctgctcaagaaggaccccaagcagaggcttggcgggggctccgaggacgccaaggagatcatgcagcatcgcttctttgccggtatcgtgtggcagcacgtgtacgagaagaagctcagcccacccttcaagccccaggtcacgtcggagactgacaccaggtattttgatgaggagttcacggcccagatgatcaccatcacaccacctgaccaagatgacagcatggagtgtgtggacagcgagcgcaggccccacttcccccagttctcctactcggccagcggcacggcctga

SEQ ID NO: 230 - DNA, 3066 bp, Homo sapiens
atggataaagtgtgctcaggtgagggttggctggtgggccgctgcagggcgggggcctgtccagtgctcccccacttacttgctgcctcccgactgctgtaattatgggtctgtaaccaccctggactgggtgctcctcactgacggacttgtctgaacctctctttgtctccagcgcccagcactgggcctggcaaaacctgagacgcccggtacatgttggccaaatgaatgaaccagattcagaccggcaggggcgctgtggtttaggaggggcctggggtttctcccaggaggtttttgggcttgcgctggagggctctggactcccgtttgcgccagtggcctgcatcctggtcctgtcttcctcatgtttgaatttctttgctttcctagtctggggagcagggaggagccctgtgccctgtcccaggatccatgggtaggaacaccatggacagggagagcaaacggggccatctgtcaccaggggcttagggaaggccgagccagcctgggtcaaagaagtcaaaggggctgcctggaggaggcagcctgtcagctggtgcatcagaggctgtggccaggccagctgggctcggggagcgccagcctgagaggagcgcgtgagcgtcgcgggagcctcgggcaccatgagcgacgtggctattgtgaaggagggttggctgcacaaacgaggggagtacatcaagacctggcggccacgctacttcctcctcaagaatgatggcaccttcattggctacaaggagcggccgcaggatgtggaccaacgtgaggctcccctcaacaacttctctgtggcgcagtgccagctgatgaagacggagcggccccggcccaacaccttcatcatccgctgcctgcagtggaccactgtcatcgaacgcaccttccatgtggagactcctgaggagcgggaggagtggacaaccgccatccagactgtggctgacggcctcaagaagcaggaggaggaggagatggacttccggtcgggctcacccagtgacaactcaggggctgaagagatggaggtgtccctggccaagcccaagcaccgcgtgaccatgaacgagtttgagtacctgaagctgctgggcaagggcactttcggcaaggtgatcctggtgaaggagaaggccacaggccgctactacgccatgaagatcctcaagaaggaagtcatcgtggccaaggacgaggtggcccacacactcaccgagaaccgcgtcctgcagaactccaggcaccccttcctcacagccctgaagtactctttccagacccacgaccgcctctgctttgtcatggagtacgccaacgggggcgagctgttcttccacctgtcccgggagcgtgtgttctccgaggaccgggcccgcttctatggcgctgagattgtgtcagccctggactacctgcactcggagaagaacgtggtgtaccgggacctcaagctggagaacctcatgctggacaaggacgggcacattaagatcacagacttcgggctgtgcaaggaggggatcaaggacggtgccaccatgaagaccttttgcggcacacctgagtacctggcccccgaggtgctggaggacaatgactacggccgtgcagtggactggtgggggctgggcgtggtcatgtacgagatgatgtgcggtcgcctgcccttctacaaccaggaccatgagaagctttttgagctcatcctcatggaggagatccgcttcccgcgcacgcttggtcccgaggccaagtccttgctttcagggctgctcaagaaggaccccaagcagaggcttggcgggggctccgaggacgccaaggagatcatgcagcatcgcttctttgccggtatcgtgtggcagcacgtgtacgagaagaagctcagcccacccttcaagccccaggtcacgtcggagactgacaccaggtattttgatgaggagttcacggcccagatgatcaccatcacaccacctgaccaagatgacagcatggagtgtgtggacagcgagcgcaggccccacttcccccagttctcctactcggccagcggcacggcctgaggcggcggtggactgcgctggacgatagcttggagggatggagaggcggcctcgtgccatgatctgtatttaatggtttttatttctcgggtgcatttgagagaagccacgctgtcctctcgagcccagatggaaagacgtttttgtgctgtgggcagcaccctcccccgcagcggggtagggaagaaaactatcctgcgggttttaatttatttcatccagtttgttctccgggtgtggcctcagccctcagaacaatccgattcacgtagggaaatgttaaggacttctgcagctatgcgcaatgtggcattggggggccgggcaggtcctgcccatgtgtcccctcactctgtcagccagccgccctgggctgtctgtcaccagctatctgtcatctctctggggccctgggcctcagttcaacctggtggcaccagatgcaacctcactatggtatgctggccagcaccctctcctgggggtggcaggcacacagcagccccccagcactaaggccgtgtctctgaggacgtcatcggaggctgggcccctgggatgggaccagggatgggggatgggccagggtttacccagtgggacagaggagcaaggtttaaatttgttattgtgtattatgttgttcaaatgcattttgggggtttttaatctttgtgacaggaaagccctcccccttccccttctgtgtcacagttcttggtgactgtcccaccgggagcctccccctcagatgatctctccacggtagcacttgaccttttcgacgcttaacctttccgctgtcgccccaggccctccctgactccctgtgggggtggccatccctgggcccctccacgcctcctggccagacgctgccgctgccgctgcaccacggcgtttttttacaacattcaactttagtatttttactattataatataatatggaaccttccctccaaattct

SEQ ID NO: 231 - DNA, 553 bp, Homo sapiens
gcgcccggacgcggcggcccgtctggggagcagggaggagccctgtgccctgtcccaggatccatgggtaggaacaccatggacagggagagcaaacggggccatctgtcaccaggggcttagggaaggccgagccagcctgggtcaaagaagtcaaaggggctgcctggaggaggcagcctgtcagctggtgcatcagaggctgtggccaggccagctgggctcggggagcgccagcctgagaggagcgcgtgagcgtcgcgggagcctcgggcaccatgagcgacgtggctattgtgaaggagggttggctgcacaaacgaggggagtacatcaagacctggcggccacgctacttcctcctcaagaatgatggcaccttcattggctacaaggagcggccgcaggatgtggaccaacgtgaggctcccctcaacaacttctctgtggcgcagtgccagctgatgaagacggagcggccccggcccaacaccttcatcatccgctgcctgcagtggaccactgtcatcgaacgcaccttccatgtggagac

SEQ ID NO: 232 - DNA, 1338 bp, Homo sapiens
aagggggagctgcgggccaggcggcggccccctagcgtcgcgcagggtcggggactgcgcggcggtgccaggccgggcgtgggcgagagcacgaacgggctgcctgcgggctgagagcgtcgagctgtcaccatgggtgatcacgcttggagcttcctaaaggacttcctggccgggggcgtcgccgctgccgtctccaagaccgcggtcgcccccatcgagagggtcaaactgctgctgcaggtccagcatgccagcaaacagatcagtgctgagaagcagtacaaagggatcattgattgtgtggtgagaatccctaaggagcagggcttcctctccttctggaggggtaacctggccaacgtgatccgttacttccccacccaagctctcaacttcgccttcaaggacaagtacaagcagctcttcttagggggtgtggatcggcataagcagttctggcgctactttgctggtaacctggcgtccggtggggccgctggggccacctccctttgctttgtctacccgctggactttgctaggaccaggttggctgctgatgtgggcaagggcgccgcccagcgtgagttccatggtctgggcgactgtatcatcaagatcttcaagtctgatggcctgagggggctctaccagggtttcaacgtctctgtccaaggcatcattatctatagagctgcctacttcggagtctatgatactgccaaggggatgctgcctgaccccaagaacgtgcacatttttgtgagctggatgattgcccagagtgtgacggcagtcgcagggctggtgtcctacccctttgacactgttcgtcgtagaatgatgatgcagtccggccggaaaggggccgatattatgtacacggggacagttgactgctggaggaagattgcaaaagacgaaggagccaaggccttcttcaaaggtgcctggtccaatgtgctgagaggcatgggcggtgcttttgtattggtgttgtatgatgagatcaaaaaatatgtctaatgtaattaaaacacaagttcacagatttacagtgaacttgatctacaagttcacagatccattgtgtggtttaatagactattcctaggggaagtaaaaagatctgggataaaaccagactgaaaggaatacctcagaagagatgcttcattgagtgttcattaaaccacacatgtattttgtatttattttacatttaaattcccacagcaaatagaaaataatttatcatacttgtacaattaactgaagaattgataataactgaatgtgaaacatcaataaagaccacttaatgcacgctttcta

SEQ ID NO: 233 - DNA, 4539 bp, Homo sapiens
aagaagaggtagcgagtggacgtgactgctctatcccgggcaaaagggatagaaccagaggtggggagtctgggcagtcggcgacccgcgaagacttgaggtgccgcagcggcatccggagtagcgccgggctccctccggggtgcagccgccgtcgggggaagggcgccacaggccgggaagacctcctccctttgtgtccagtagtggggtccaccggagggcggcccgtgggccgggcctcaccgcggcgctccgggactgtggggtcaggctgcgttgggtggacgcccacctcgccaaccttcggaggtccctgggggtcttcgtgcgccccggggctgcagagatccaggggaggcgcctgtgaggcccggacctgccccggggcgaagggtatgtggcgagacagagccctgcacccctaattcccggtggaaaactcctgttgccgtttccctccaccggcctggagtctcccagtcttgtcccggcagtgccgccctccccactaagacctaggcgcaaaggcttggctcatggttgacagctcagagagagaaagatctgagggaagatggatgcaaaagctcgaaattgtttgcttcaacatagagaagctctggaaaaggacatcaagacatcctacatcatggatcacatgattagtgatggatttttaacaatatcagaagaggaaaaagtaagaaatgagcccactcaacagcaaagagcagctatgctgattaaaatgatacttaaaaaagataatgattcctacgtatcattctacaatgctctactacatgaaggatataaagatcttgctgcccttctccatgatggcattcctgttgtctcttcttccagtggtaaagattcagttagtggaataacttcgtatgtaaggacagtcctgtgtgaaggtggagtaccacagaggccagttgtttttgtcacaaggaagaagctggtgaatgcaattcagcagaagctctccaaattgaaaggtgaaccaggatgggtcaccatacatggaatggcaggctgtgggaagtctgtattagctgcagaagctgttagagatcattcccttttagaaggttgtttcccagggggagtgcattgggtttcagttgggaaacaagacaaatctgggcttctgatgaaactgcagaatctttgcacacggttggatcaggatgagagtttttcccagaggcttccacttaatattgaagaggctaaagaccgtctccgcattctgatgcttcgcaaacacccaaggtctctcttgatcttggatgatgtttgggactcttgggtgttgaaagcttttgacagtcagtgtcagattcttcttacaaccagagacaagagtgttacagattcagtaatgggtcctaaatatgtagtccctgtggagagttccttaggaaaggaaaaaggacttgaaattttatccctttttgttaatatgaagaaggcagatttgccagaacaagctcatagtattataaaagaatgtaaagtggtggaacgttgtcactggggaatcctcacagaccttctacacaaatggaaccaatcttaagaaaatacacgtgtcccctgacttcaaaacatatgtgactgtggataatcttggtattttatatattttacagactttagaataaaatagttaagcattaatgtagttgaactttttaaatttttgaattggaaaaaaattctaatgaaaccctgatatcaactttttataaagctcttaattgttgtgcagtattgcattcattacaaaagtgtttgtggttggatgaataatattaatgtagctttttcccaaatgaacatacctttaatcttgtttttcatgatcatcattaacagtttgtccttaggatgcaaatgaaaatgtgaatacataccttgttgtactgttggtaaaattctgtcttgatgcattcaaaatggttgacataattaatgagaagaatttggaagaaattggtattttaatactgtctgtatttattactgttatgcaggctgtgcctcagggtagcagtggcctgctttttgaaccacacttaccccaagggggttttgttctcctaaatacaatcttagaggttttttgcactctttaaatttgctttaaaaatattgtgtctgtgtgcatagtctgcagcatttcctttaattgactcaataagtgagtcttggatttagcaggcccccccaccttttttttttgtttttggagacagagtcttgctttgttgccaggctggagtgcagtggcgcgatctcggctcaccacaatcgctgcctcctgggttcaagcaattctcctgcctcagcctcccgagtagctgggactacaggtgtgcgcacatgccaggctaatttttgtatttttagtagagacggggtttcaccatgttggccgggatggtctcgatctcttgacctcatgatctacccgccttggcctcccaaagtgctgagattacaggcgtgagccaccgtgcctggccaggccccttctcttttaatggagacagggtcttgcactatcacccaggctggagtgcagtggcataatcatacctcattgcagcctcagactcctgggttcaagcaatcctcctgcctcagcctcccaagtagctgagactacaggcacgagccaccacacccagctaatttttaagttttcttgtagagacagggtctcactatgttgtctaggctggtcttgaactcttggcctcaagtaatcctcctgcctcagcctcccaaagtgttgggattgcagatatgagccactggcctggccttcagcagttctttttgtgaagtaaaacttgtatgttggaaagagtagattttattggtctacccttttctcactgtagctgctggcagccctgtgccatatctggactctagttgtcagtatctgagttggacactattcctgctccctcttgtttcttacatatcagacttcttacttgaatgaaacctgatctttcctaatcctcacttttttcttttttaaaaagcagtttctccactgctaaatgttagtcattgaggtggggccaattttaatcataagccttaataagatttttctaagaaatgtgaaatagaacaattttcatctaattccatttacttttagatgaatggcattgtgaatgccattcttttaatgaatttcaagagaattctctggttttctgtgtaattccagatgagtcactgtaactctagaagattaaccttccagccaacctattttcctttcccttgtctctctcatcctcttttccttccttctttcctttctcttcttttatctccaaggttaatcaggaaaaatagcttttgacaggggaaaaaactcaataactagctatttttgacctcctgatcaggaactttagttgaagcgtaaatctaaagaaacattttctctgaaatatattattaagggcaatggagataaattaatagtagatgtggttcccagaaaatataatcaaaattcaaagattttttttgtttctgtaactggaactaaatcaaatgattactagtgttaatagtagataacttgtttttattgttggtgcatattagtataactgtggggtaggtcggggagagggtaagggaatagatcactcagatgtattttagataagctatttagcctttgatggaatcataaatacagtgaatacaatcctttgcattgttaaggaggttttttgtttttaaatggtgggtcaaggagctagtttacaggcttactgtgatttaagcaaatgtgaaaagtgaaaccttaattttatcaaaagaaatttctgtaaatggtatgtctccttagaatacccaaatcataattttatttgtacacactgttaggggctcatctcatgtaggcagagtataaagtattaccttttggaattaaaagccactgactgttataaagtataacaacacacatcaggttttaaaaagccttgaatggcccttgtcttaaaaagaaattaggagccaggtgcggtggcacgtgcctgtaatcccagctccttgggaggctaagacaggaggattccttgagccctggagtttgagtccagcctgggtgacatagcaagaccctgtcttaaaagaaaaatgggaagaaagacaaggtaacatgaagaaagaagagatacctagtatgatggagctgcaaatttcatggcagttcatgcagtcggtcaagaggaggattttgttttgtagtttgcagatgagcatttctaaagcattttcccttgctgtatttttttgtattataaattacattggacttcatatatataatttttttttacattatatgtctcttgtatgttttgaaactcttgtatttatgatatagcttatatgatttttttgccttggtatacattttaaaatatgaatttaaaaaatttttgtaaaaataaaattcacaaaattgttttg

SEQ ID NO: 234 - DNA, 6929 bp, Homo sapiens
aagaagaggtagcgagtggacgtgactgctctatcccgggcaaaagggatagaaccagaggtggggagtctgggcagtcggcgacccgcgaagacttgaggtgccgcagcggcatccggagtagcgccgggctccctccggggtgcagccgccgtcgggggaagggcgccacaggccgggaagacctcctccctttgtgtccagtagtggggtccaccggagggcggcccgtgggccgggcctcaccgcggcgctccgggactgtggggtcaggctgcgttgggtggacgcccacctcgccaaccttcggaggtccctgggggtcttcgtgcgccccggggctgcagagatccaggggaggcgcctgtgaggcccggacctgccccggggcgaagggtatgtggcgagacagagccctgcacccctaattcccggtggaaaactcctgttgccgtttccctccaccggcctggagtctcccagtcttgtcccggcagtgccgccctccccactaagacctaggcgcaaaggcttggctcatggttgacagctcagagagagaaagatctgagggaagatggatgcaaaagctcgaaattgtttgcttcaacatagagaagctctggaaaaggacatcaagacatcctacatcatggatcacatgattagtgatggatttttaacaatatcagaagaggaaaaagtaagaaatgagcccactcaacagcaaagagcagctatgctgattaaaatgatacttaaaaaagataatgattcctacgtatcattctacaatgctctactacatgaaggatataaagatcttgctgcccttctccatgatggcattcctgttgtctcttcttccagtggtaaagattcagttagtggaataacttcgtatgtaaggacagtcctgtgtgaaggtggagtaccacagaggccagttgtttttgtcacaaggaagaagctggtgaatgcaattcagcagaagctctccaaattgaaaggtgaaccaggatgggtcaccatacatggaatggcaggctgtgggaagtctgtattagctgcagaagctgttagagatcattcccttttagaaggttgtttcccagggggagtgcattgggtttcagttgggaaacaagacaaatctgggcttctgatgaaactgcagaatctttgcacacggttggatcaggatgagagtttttcccagaggcttccacttaatattgaagaggctaaagaccgtctccgcattctgatgcttcgcaaacacccaaggtctctcttgatcttggatgatgtttgggactcttgggtgttgaaagcttttgacagtcagtgtcagattcttcttacaaccagagacaagagtgttacagattcagtaatgggtcctaaatatgtagtccctgtggagagttccttaggaaaggaaaaaggacttgaaattttatccctttttgttaatatgaagaaggcagatttgccagaacaagctcatagtattataaaagaatgtaaaggctctccccttgtagtatctttaattggtgcacttttacgtgattttcccaatcgctgggagtactacctcaaacagcttcagaataagcagtttaagagaataaggaaatcttcgtcttatgattatgaggctctagatgaagccatgtctataagtgttgaaatgctcagagaagacatcaaagattattacacagatctttccatccttcagaaggacgttaaggtgcctacaaaggtgttatgtattctctgggacatggaaactgaagaagttgaagacatactgcaggagtttgtaaataagtctcttttattctgtgatcggaatggaaagtcgtttcgttattatttacatgatcttcaagtagattttcttacagagaagaattgcagccagcttcaggatctacataagaagataatcactcagtttcagagatatcaccagccgcatactctttcaccagatcaggaagactgtatgtattggtacaactttctggcctatcacatggccagtgccaagatgcacaaggaactttgtgctttaatgttttccctggattggattaaagcaaaaacagaacttgtaggccctgctcatctgattcatgaatttgtggaatacagacatatactagatgaaaaggattgtgcagtcagtgagaattttcaggagtttttatctttaaatggacaccttcttggacgacagccatttcctaatattgtacaactgggtctctgtgagccggaaacttcagaagtttatcagcaagctaagctgcaggccaagcaggaggtcgataatggaatgctttacctggaatggataaacaaaaaaaacatcacgaatctttcccgcttagttgtccgcccccacacagatgctgtttaccatgcctgcttttctgaggatggtcagagaatagcttcttgtggagctgataaaaccttacaggtgttcaaagctgaaacaggagagaaacttctagaaatcaaggctcatgaggatgaagtgctttgttgtgcattctctacagatgacagatttatagcaacctgctcagtggataaaaaagtgaagatttggaattctatgactggggaactagtacacacctatgatgagcactcagagcaagtcaattgctgccatttcaccaacagtagtcatcatcttctcttagccactgggtcaagtgactgcttcctcaaactttgggatttgaatcaaaaagaatgtcgaaataccatgtttggtcatacaaattcagtcaatcactgcagattttcaccagatgataagcttttggctagttgttcagctgatggaaccttaaagctttgggatgcgacatcagcaaatgagaggaaaagcattaatgtgaaacagttcttcctaaatttggaggaccctcaagaggatatggaagtgatagtgaagtgttgttcgtggtctgctgatggtgcaaggataatggtggcagcaaaaaataaaatctttttgtggaatacagactcacgttcaaaggtggctgattgcagaggacatttaagttgggttcatggtgtgatgttttctcctgatggatcatcatttttgacatcttctgatgaccagacaatcaggctctgggagacaaagaaagtatgtaagaactctgctgtaatgttaaagcaagaagtagatgttgtgtttcaagaaaatgaagtgatggtccttgcagttgaccatataagacgtctgcaactcattaatggaagaacaggtcagattgattatctgactgaagctcaagttagctgctgttgcttaagtccacatcttcagtacattgcatttggagatgaaaatggagccattgagattttagaacttgtaaacaatagaatcttccagtccaggtttcagcacaagaaaactgtatggcacatccagttcacagccgatgagaagactcttatttcaagttctgatgatgctgaaattcaggtatggaattggcaattggacaaatgtatctttctacgaggccatcaggaaacagtgaaagactttagactcttgaaaaattcaagactgctttcttggtcatttgatggaacagtgaaggtatggaatattattactggaaataaagaaaaagactttgtctgtcaccagggtacagtactttcttgtgacatttctcacgatgctaccaagttttcatctacctctgctgacaagactgcaaagatatggaatgtctcaaacggtgagcttcttcatttgtgtgctccgctttcagaagaaggagctgctacccatggaggctgggtgactgacctttgcttttctccagatggcaaaatgcttatctctgctggaggatatattaagtggtggaacgttgtcactggggaatcctcacagaccttctacacaaatggaaccaatcttaagaaaatacacgtgtcccctgacttcaaaacatatgtgactgtggataatcttggtattttatatattttacagactttagaataaaatagttaagcattaatgtagttgaactttttaaatttttgaattggaaaaaaattctaatgaaaccctgatatcaactttttataaagctcttaattgttgtgcagtattgcattcattacaaaagtgtttgtggttggatgaataatattaatgtagctttttcccaaatgaacatacctttaatcttgtttttcatgatcatcattaacagtttgtccttaggatgcaaatgaaaatgtgaatacataccttgttgtactgttggtaaaattctgtcttgatgcattcaaaatggttgacataattaatgagaagaatttggaagaaattggtattttaatactgtctgtatttattactgttatgcaggctgtgcctcagggtagcagtggcctgctttttgaaccacacttaccccaagggggttttgttctcctaaatacaatcttagaggttttttgcactctttaaatttgctttaaaaatattgtgtctgtgtgcatagtctgcagcatttcctttaattgactcaataagtgagtcttggatttagcaggcccccccaccttttttttttgtttttggagacagagtcttgctttgttgccaggctggagtgcagtggcgcgatctcggctcaccacaatcgctgcctcctgggttcaagcaattctcctgcctcagcctcccgagtagctgggactacaggtgtgcgcacatgccaggctaatttttgtatttttagtagagacggggtttcaccatgttggccgggatggtctcgatctcttgacctcatgatctacccgccttggcctcccaaagtgctgagattacaggcgtgagccaccgtgcctggccaggccccttctcttttaatggagacagggtcttgcactatcacccaggctggagtgcagtggcataatcatacctcattgcagcctcagactcctgggttcaagcaatcctcctgcctcagcctcccaagtagctgagactacaggcacgagccaccacacccagctaatttttaagttttcttgtagagacagggtctcactatgttgtctaggctggtcttgaactcttggcctcaagtaatcctcctgcctcagcctcccaaagtgttgggattgcagatatgagccactggcctggccttcagcagttctttttgtgaagtaaaacttgtatgttggaaagagtagattttattggtctacccttttctcactgtagctgctggcagccctgtgccatatctggactctagttgtcagtatctgagttggacactattcctgctccctcttgtttcttacatatcagacttcttacttgaatgaaacctgatctttcctaatcctcacttttttcttttttaaaaagcagtttctccactgctaaatgttagtcattgaggtggggccaattttaatcataagccttaataagatttttctaagaaatgtgaaatagaacaattttcatctaattccatttacttttagatgaatggcattgtgaatgccattcttttaatgaatttcaagagaattctctggttttctgtgtaattccagatgagtcactgtaactctagaagattaaccttccagccaacctattttcctttcccttgtctctctcatcctcttttccttccttctttcctttctcttcttttatctccaaggttaatcaggaaaaatagcttttgacaggggaaaaaactcaataactagctatttttgacctcctgatcaggaactttagttgaagcgtaaatctaaagaaacattttctctgaaatatattattaagggcaatggagataaattaatagtagatgtggttcccagaaaatataatcaaaattcaaagattttttttgtttctgtaactggaactaaatcaaatgattactagtgttaatagtagataacttgtttttattgttggtgcatattagtataactgtggggtaggtcggggagagggtaagggaatagatcactcagatgtattttagataagctatttagcctttgatggaatcataaatacagtgaatacaatcctttgcattgttaaggaggttttttgtttttaaatggtgggtcaaggagctagtttacaggcttactgtgatttaagcaaatgtgaaaagtgaaaccttaattttatcaaaagaaatttctgtaaatggtatgtctccttagaatacccaaatcataattttatttgtacacactgttaggggctcatctcatgtaggcagagtataaagtattaccttttggaattaaaagccactgactgttataaagtataacaacacacatcaggttttaaaaagccttgaatggcccttgtcttaaaaagaaattaggagccaggtgcggtggcacgtgcctgtaatcccagctccttgggaggctaagacaggaggattccttgagccctggagtttgagtccagcctgggtgacatagcaagaccctgtcttaaaagaaaaatgggaagaaagacaaggtaacatgaagaaagaagagatacctagtatgatggagctgcaaatttcatggcagttcatgcagtcggtcaagaggaggattttgttttgtagtttgcagatgagcatttctaaagcattttcccttgctgtatttttttgtattataaattacattggacttcatatatataatttttttttacattatatgtctcttgtatgttttgaaactcttgtatttatgatatagcttatatgatttttttgccttggtatacattttaaaatatgaatttaaaaaatttttgtaaaaataaaattcacaaaattgttttg

SEQ ID NO: 235 - DNA, 7055 bp, Homo sapiens
aagaagaggtagcgagtggacgtgactgctctatcccgggcaaaagggatagaaccagaggtggggagtctgggcagtcggcgacccgcgaagacttgaggtgccgcagcggcatccggagtagcgccgggctccctccggggtgcagccgccgtcgggggaagggcgccacaggccgggaagacctcctccctttgtgtccagtagtggggtccaccggagggcggcccgtgggccgggcctcaccgcggcgctccgggactgtggggtcaggctgcgttgggtggacgcccacctcgccaaccttcggaggtccctgggggtcttcgtgcgccccggggctgcagagatccaggggaggcgcctgtgaggcccggacctgccccggggcgaagggtatgtggcgagacagagccctgcacccctaattcccggtggaaaactcctgttgccgtttccctccaccggcctggagtctcccagtcttgtcccggcagtgccgccctccccactaagacctaggcgcaaaggcttggctcatggttgacagctcagagagagaaagatctgagggaagatggatgcaaaagctcgaaattgtttgcttcaacatagagaagctctggaaaaggacatcaagacatcctacatcatggatcacatgattagtgatggatttttaacaatatcagaagaggaaaaagtaagaaatgagcccactcaacagcaaagagcagctatgctgattaaaatgatacttaaaaaagataatgattcctacgtatcattctacaatgctctactacatgaaggatataaagatcttgctgcccttctccatgatggcattcctgttgtctcttcttccagtggtaaagattcagttagtggaataacttcgtatgtaaggacagtcctgtgtgaaggtggagtaccacagaggccagttgtttttgtcacaaggaagaagctggtgaatgcaattcagcagaagctctccaaattgaaaggtgaaccaggatgggtcaccatacatggaatggcaggctgtgggaagtctgtattagctgcagaagctgttagagatcattcccttttagaaggttgtttcccagggggagtgcattgggtttcagttgggaaacaagacaaatctgggcttctgatgaaactgcagaatctttgcacacggttggatcaggatgagagtttttcccagaggcttccacttaatattgaagaggctaaagaccgtctccgcattctgatgcttcgcaaacacccaaggtctctcttgatcttggatgatgtttgggactcttgggtgttgaaagcttttgacagtcagtgtcagattcttcttacaaccagagacaagagtgttacagattcagtaatgggtcctaaatatgtagtccctgtggagagttccttaggaaaggaaaaaggacttgaaattttatccctttttgttaatatgaagaaggcagatttgccagaacaagctcatagtattataaaagaatgtaaaggctctccccttgtagtatctttaattggtgcacttttacgtgattttcccaatcgctgggagtactacctcaaacagcttcagaataagcagtttaagagaataaggaaatcttcgtcttatgattatgaggctctagatgaagccatgtctataagtgttgaaatgctcagagaagacatcaaagattattacacagatctttccatccttcagaaggacgttaaggtgcctacaaaggtgttatgtattctctgggacatggaaactgaagaagttgaagacatactgcaggagtttgtaaataagtctcttttattctgtgatcggaatggaaagtcgtttcgttattatttacatgatcttcaagtagattttcttacagagaagaattgcagccagcttcaggatctacataagaagataatcactcagtttcagagatatcaccagccgcatactctttcaccagatcaggaagactgtatgtattggtacaactttctggcctatcacatggccagtgccaagatgcacaaggaactttgtgctttaatgttttccctggattggattaaagcaaaaacagaacttgtaggccctgctcatctgattcatgaatttgtggaatacagacatatactagatgaaaaggattgtgcagtcagtgagaattttcaggagtttttatctttaaatggacaccttcttggacgacagccatttcctaatattgtacaactgggtctctgtgagccggaaacttcagaagtttatcagcaagctaagctgcaggccaagcaggaggtcgataatggaatgctttacctggaatggataaacaaaaaaaacatcacgaatctttcccgcttagttgtccgcccccacacagatgctgtttaccatgcctgcttttctgaggatggtcagagaatagcttcttgtggagctgataaaaccttacaggtgttcaaagctgaaacaggagagaaacttctagaaatcaaggctcatgaggatgaagtgctttgttgtgcattctctacagatgacagatttatagcaacctgctcagtggataaaaaagtgaagatttggaattctatgactggggaactagtacacacctatgatgagcactcagagcaagtcaattgctgccatttcaccaacagtagtcatcatcttctcttagccactgggtcaagtgactgcttcctcaaactttgggatttgaatcaaaaagaatgtcgaaataccatgtttggtcatacaaattcagtcaatcactgcagattttcaccagatgataagcttttggctagttgttcagctgatggaaccttaaagctttgggatgcgacatcagcaaatgagaggaaaagcattaatgtgaaacagttcttcctaaatttggaggaccctcaagaggatatggaagtgatagtgaagtgttgttcgtggtctgctgatggtgcaaggataatggtggcagcaaaaaataaaatctttttgtggaatacagactcacgttcaaaggtggctgattgcagaggacatttaagttgggttcatggtgtgatgttttctcctgatggatcatcatttttgacatcttctgatgaccagacaatcaggctctgggagacaaagaaagtatgtaagaactctgctgtaatgttaaagcaagaagtagatgttgtgtttcaagaaaatgaagtgatggtccttgcagttgaccatataagacgtctgcaactcattaatggaagaacaggtcagattgattatctgactgaagctcaagttagctgctgttgcttaagtccacatcttcagtacattgcatttggagatgaaaatggagccattgagattttagaacttgtaaacaatagaatcttccagtccaggtttcagcacaagaaaactgtatggcacatccagttcacagccgatgagaagactcttatttcaagttctgatgatgctgaaattcaggtatggaattggcaattggacaaatgtatctttctacgaggccatcaggaaacagtgaaagactttagactcttgaaaaattcaagactgctttcttggtcatttgatggaacagtgaaggtatggaatattattactggaaataaagaaaaagactttgtctgtcaccagggtacagtactttcttgtgacatttctcacgatgctaccaagttttcatctacctctgctgacaagactgcaaagatctggagttttgatctccttttgccacttcatgaattgaggggccacaacggctgtgtgcgctgctctgccttctctgtggacagtaccctgctggcaacgggagatgacaatggagaaatcaggatatggaatgtctcaaacggtgagcttcttcatttgtgtgctccgctttcagaagaaggagctgctacccatggaggctgggtgactgacctttgcttttctccagatggcaaaatgcttatctctgctggaggatatattaagtggtggaacgttgtcactggggaatcctcacagaccttctacacaaatggaaccaatcttaagaaaatacacgtgtcccctgacttcaaaacatatgtgactgtggataatcttggtattttatatattttacagactttagaataaaatagttaagcattaatgtagttgaactttttaaatttttgaattggaaaaaaattctaatgaaaccctgatatcaactttttataaagctcttaattgttgtgcagtattgcattcattacaaaagtgtttgtggttggatgaataatattaatgtagctttttcccaaatgaacatacctttaatcttgtttttcatgatcatcattaacagtttgtccttaggatgcaaatgaaaatgtgaatacataccttgttgtactgttggtaaaattctgtcttgatgcattcaaaatggttgacataattaatgagaagaatttggaagaaattggtattttaatactgtctgtatttattactgttatgcaggctgtgcctcagggtagcagtggcctgctttttgaaccacacttaccccaagggggttttgttctcctaaatacaatcttagaggttttttgcactctttaaatttgctttaaaaatattgtgtctgtgtgcatagtctgcagcatttcctttaattgactcaataagtgagtcttggatttagcaggcccccccaccttttttttttgtttttggagacagagtcttgctttgttgccaggctggagtgcagtggcgcgatctcggctcaccacaatcgctgcctcctgggttcaagcaattctcctgcctcagcctcccgagtagctgggactacaggtgtgcgcacatgccaggctaatttttgtatttttagtagagacggggtttcaccatgttggccgggatggtctcgatctcttgacctcatgatctacccgccttggcctcccaaagtgctgagattacaggcgtgagccaccgtgcctggccaggccccttctcttttaatggagacagggtcttgcactatcacccaggctggagtgcagtggcataatcatacctcattgcagcctcagactcctgggttcaagcaatcctcctgcctcagcctcccaagtagctgagactacaggcacgagccaccacacccagctaatttttaagttttcttgtagagacagggtctcactatgttgtctaggctggtcttgaactcttggcctcaagtaatcctcctgcctcagcctcccaaagtgttgggattgcagatatgagccactggcctggccttcagcagttctttttgtgaagtaaaacttgtatgttggaaagagtagattttattggtctacccttttctcactgtagctgctggcagccctgtgccatatctggactctagttgtcagtatctgagttggacactattcctgctccctcttgtttcttacatatcagacttcttacttgaatgaaacctgatctttcctaatcctcacttttttcttttttaaaaagcagtttctccactgctaaatgttagtcattgaggtggggccaattttaatcataagccttaataagatttttctaagaaatgtgaaatagaacaattttcatctaattccatttacttttagatgaatggcattgtgaatgccattcttttaatgaatttcaagagaattctctggttttctgtgtaattccagatgagtcactgtaactctagaagattaaccttccagccaacctattttcctttcccttgtctctctcatcctcttttccttccttctttcctttctcttcttttatctccaaggttaatcaggaaaaatagcttttgacaggggaaaaaactcaataactagctatttttgacctcctgatcaggaactttagttgaagcgtaaatctaaagaaacattttctctgaaatatattattaagggcaatggagataaattaatagtagatgtggttcccagaaaatataatcaaaattcaaagattttttttgtttctgtaactggaactaaatcaaatgattactagtgttaatagtagataacttgtttttattgttggtgcatattagtataactgtggggtaggtcggggagagggtaagggaatagatcactcagatgtattttagataagctatttagcctttgatggaatcataaatacagtgaatacaatcctttgcattgttaaggaggttttttgtttttaaatggtgggtcaaggagctagtttacaggcttactgtgatttaagcaaatgtgaaaagtgaaaccttaattttatcaaaagaaatttctgtaaatggtatgtctccttagaatacccaaatcataattttatttgtacacactgttaggggctcatctcatgtaggcagagtataaagtattaccttttggaattaaaagccactgactgttataaagtataacaacacacatcaggttttaaaaagccttgaatggcccttgtcttaaaaagaaattaggagccaggtgcggtggcacgtgcctgtaatcccagctccttgggaggctaagacaggaggattccttgagccctggagtttgagtccagcctgggtgacatagcaagaccctgtcttaaaagaaaaatgggaagaaagacaaggtaacatgaagaaagaagagatacctagtatgatggagctgcaaatttcatggcagttcatgcagtcggtcaagaggaggattttgttttgtagtttgcagatgagcatttctaaagcattttcccttgctgtatttttttgtattataaattacattggacttcatatatataatttttttttacattatatgtctcttgtatgttttgaaactcttgtatttatgatatagcttatatgatttttttgccttggtatacattttaaaatatgaatttaaaaaatttttgtaaaaataaaattcacaaaattgttttg

SEQ ID NO: 236 - DNA, 7022 bp, Homo sapiens
aagaagaggtagcgagtggacgtgactgctctatcccgggcaaaagggatagaaccagaggtggggagtctgggcagtcggcgacccgcgaagacttgaggtgccgcagcggcatccggagtagcgccgggctccctccggggtgcagccgccgtcgggggaagggcgccacaggccgggaagacctcctccctttgtgtccagtagtggggtccaccggagggcggcccgtgggccgggcctcaccgcggcgctccgggactgtggggtcaggctgcgttgggtggacgcccacctcgccaaccttcggaggtccctgggggtcttcgtgcgccccggggctgcagagatccaggggaggcgcctgtgaggcccggacctgccccggggcgaagggtatgtggcgagacagagccctgcacccctaattcccggtggaaaactcctgttgccgtttccctccaccggcctggagtctcccagtcttgtcccggcagtgccgccctccccactaagacctaggcgcaaaggcttggctcatggttgacagctcagagagagaaagatctgagggaagatggatgcaaaagctcgaaattgtttgcttcaacatagagaagctctggaaaaggacatcaagacatcctacatcatggatcacatgattagtgatggatttttaacaatatcagaagaggaaaaagtaagaaatgagcccactcaacagcaaagagcagctatgctgattaaaatgatacttaaaaaagataatgattcctacgtatcattctacaatgctctactacatgaaggatataaagatcttgctgcccttctccatgatggcattcctgttgtctcttcttccagtgtaaggacagtcctgtgtgaaggtggagtaccacagaggccagttgtttttgtcacaaggaagaagctggtgaatgcaattcagcagaagctctccaaattgaaaggtgaaccaggatgggtcaccatacatggaatggcaggctgtgggaagtctgtattagctgcagaagctgttagagatcattcccttttagaaggttgtttcccagggggagtgcattgggtttcagttgggaaacaagacaaatctgggcttctgatgaaactgcagaatctttgcacacggttggatcaggatgagagtttttcccagaggcttccacttaatattgaagaggctaaagaccgtctccgcattctgatgcttcgcaaacacccaaggtctctcttgatcttggatgatgtttgggactcttgggtgttgaaagcttttgacagtcagtgtcagattcttcttacaaccagagacaagagtgttacagattcagtaatgggtcctaaatatgtagtccctgtggagagttccttaggaaaggaaaaaggacttgaaattttatccctttttgttaatatgaagaaggcagatttgccagaacaagctcatagtattataaaagaatgtaaaggctctccccttgtagtatctttaattggtgcacttttacgtgattttcccaatcgctgggagtactacctcaaacagcttcagaataagcagtttaagagaataaggaaatcttcgtcttatgattatgaggctctagatgaagccatgtctataagtgttgaaatgctcagagaagacatcaaagattattacacagatctttccatccttcagaaggacgttaaggtgcctacaaaggtgttatgtattctctgggacatggaaactgaagaagttgaagacatactgcaggagtttgtaaataagtctcttttattctgtgatcggaatggaaagtcgtttcgttattatttacatgatcttcaagtagattttcttacagagaagaattgcagccagcttcaggatctacataagaagataatcactcagtttcagagatatcaccagccgcatactctttcaccagatcaggaagactgtatgtattggtacaactttctggcctatcacatggccagtgccaagatgcacaaggaactttgtgctttaatgttttccctggattggattaaagcaaaaacagaacttgtaggccctgctcatctgattcatgaatttgtggaatacagacatatactagatgaaaaggattgtgcagtcagtgagaattttcaggagtttttatctttaaatggacaccttcttggacgacagccatttcctaatattgtacaactgggtctctgtgagccggaaacttcagaagtttatcagcaagctaagctgcaggccaagcaggaggtcgataatggaatgctttacctggaatggataaacaaaaaaaacatcacgaatctttcccgcttagttgtccgcccccacacagatgctgtttaccatgcctgcttttctgaggatggtcagagaatagcttcttgtggagctgataaaaccttacaggtgttcaaagctgaaacaggagagaaacttctagaaatcaaggctcatgaggatgaagtgctttgttgtgcattctctacagatgacagatttatagcaacctgctcagtggataaaaaagtgaagatttggaattctatgactggggaactagtacacacctatgatgagcactcagagcaagtcaattgctgccatttcaccaacagtagtcatcatcttctcttagccactgggtcaagtgactgcttcctcaaactttgggatttgaatcaaaaagaatgtcgaaataccatgtttggtcatacaaattcagtcaatcactgcagattttcaccagatgataagcttttggctagttgttcagctgatggaaccttaaagctttgggatgcgacatcagcaaatgagaggaaaagcattaatgtgaaacagttcttcctaaatttggaggaccctcaagaggatatggaagtgatagtgaagtgttgttcgtggtctgctgatggtgcaaggataatggtggcagcaaaaaataaaatctttttgtggaatacagactcacgttcaaaggtggctgattgcagaggacatttaagttgggttcatggtgtgatgttttctcctgatggatcatcatttttgacatcttctgatgaccagacaatcaggctctgggagacaaagaaagtatgtaagaactctgctgtaatgttaaagcaagaagtagatgttgtgtttcaagaaaatgaagtgatggtccttgcagttgaccatataagacgtctgcaactcattaatggaagaacaggtcagattgattatctgactgaagctcaagttagctgctgttgcttaagtccacatcttcagtacattgcatttggagatgaaaatggagccattgagattttagaacttgtaaacaatagaatcttccagtccaggtttcagcacaagaaaactgtatggcacatccagttcacagccgatgagaagactcttatttcaagttctgatgatgctgaaattcaggtatggaattggcaattggacaaatgtatctttctacgaggccatcaggaaacagtgaaagactttagactcttgaaaaattcaagactgctttcttggtcatttgatggaacagtgaaggtatggaatattattactggaaataaagaaaaagactttgtctgtcaccagggtacagtactttcttgtgacatttctcacgatgctaccaagttttcatctacctctgctgacaagactgcaaagatctggagttttgatctccttttgccacttcatgaattgaggggccacaacggctgtgtgcgctgctctgccttctctgtggacagtaccctgctggcaacgggagatgacaatggagaaatcaggatatggaatgtctcaaacggtgagcttcttcatttgtgtgctccgctttcagaagaaggagctgctacccatggaggctgggtgactgacctttgcttttctccagatggcaaaatgcttatctctgctggaggatatattaagtggtggaacgttgtcactggggaatcctcacagaccttctacacaaatggaaccaatcttaagaaaatacacgtgtcccctgacttcaaaacatatgtgactgtggataatcttggtattttatatattttacagactttagaataaaatagttaagcattaatgtagttgaactttttaaatttttgaattggaaaaaaattctaatgaaaccctgatatcaactttttataaagctcttaattgttgtgcagtattgcattcattacaaaagtgtttgtggttggatgaataatattaatgtagctttttcccaaatgaacatacctttaatcttgtttttcatgatcatcattaacagtttgtccttaggatgcaaatgaaaatgtgaatacataccttgttgtactgttggtaaaattctgtcttgatgcattcaaaatggttgacataattaatgagaagaatttggaagaaattggtattttaatactgtctgtatttattactgttatgcaggctgtgcctcagggtagcagtggcctgctttttgaaccacacttaccccaagggggttttgttctcctaaatacaatcttagaggttttttgcactctttaaatttgctttaaaaatattgtgtctgtgtgcatagtctgcagcatttcctttaattgactcaataagtgagtcttggatttagcaggcccccccaccttttttttttgtttttggagacagagtcttgctttgttgccaggctggagtgcagtggcgcgatctcggctcaccacaatcgctgcctcctgggttcaagcaattctcctgcctcagcctcccgagtagctgggactacaggtgtgcgcacatgccaggctaatttttgtatttttagtagagacggggtttcaccatgttggccgggatggtctcgatctcttgacctcatgatctacccgccttggcctcccaaagtgctgagattacaggcgtgagccaccgtgcctggccaggccccttctcttttaatggagacagggtcttgcactatcacccaggctggagtgcagtggcataatcatacctcattgcagcctcagactcctgggttcaagcaatcctcctgcctcagcctcccaagtagctgagactacaggcacgagccaccacacccagctaatttttaagttttcttgtagagacagggtctcactatgttgtctaggctggtcttgaactcttggcctcaagtaatcctcctgcctcagcctcccaaagtgttgggattgcagatatgagccactggcctggccttcagcagttctttttgtgaagtaaaacttgtatgttggaaagagtagattttattggtctacccttttctcactgtagctgctggcagccctgtgccatatctggactctagttgtcagtatctgagttggacactattcctgctccctcttgtttcttacatatcagacttcttacttgaatgaaacctgatctttcctaatcctcacttttttcttttttaaaaagcagtttctccactgctaaatgttagtcattgaggtggggccaattttaatcataagccttaataagatttttctaagaaatgtgaaatagaacaattttcatctaattccatttacttttagatgaatggcattgtgaatgccattcttttaatgaatttcaagagaattctctggttttctgtgtaattccagatgagtcactgtaactctagaagattaaccttccagccaacctattttcctttcccttgtctctctcatcctcttttccttccttctttcctttctcttcttttatctccaaggttaatcaggaaaaatagcttttgacaggggaaaaaactcaataactagctatttttgacctcctgatcaggaactttagttgaagcgtaaatctaaagaaacattttctctgaaatatattattaagggcaatggagataaattaatagtagatgtggttcccagaaaatataatcaaaattcaaagattttttttgtttctgtaactggaactaaatcaaatgattactagtgttaatagtagataacttgtttttattgttggtgcatattagtataactgtggggtaggtcggggagagggtaagggaatagatcactcagatgtattttagataagctatttagcctttgatggaatcataaatacagtgaatacaatcctttgcattgttaaggaggttttttgtttttaaatggtgggtcaaggagctagtttacaggcttactgtgatttaagcaaatgtgaaaagtgaaaccttaattttatcaaaagaaatttctgtaaatggtatgtctccttagaatacccaaatcataattttatttgtacacactgttaggggctcatctcatgtaggcagagtataaagtattaccttttggaattaaaagccactgactgttataaagtataacaacacacatcaggttttaaaaagccttgaatggcccttgtcttaaaaagaaattaggagccaggtgcggtggcacgtgcctgtaatcccagctccttgggaggctaagacaggaggattccttgagccctggagtttgagtccagcctgggtgacatagcaagaccctgtcttaaaagaaaaatgggaagaaagacaaggtaacatgaagaaagaagagatacctagtatgatggagctgcaaatttcatggcagttcatgcagtcggtcaagaggaggattttgttttgtagtttgcagatgagcatttctaaagcattttcccttgctgtatttttttgtattataaattacattggacttcatatatataatttttttttacattatatgtctcttgtatgttttgaaactcttgtatttatgatatagcttatatgatttttttgccttggtatacattttaaaatatgaatttaaaaaatttttgtaaaaataaaattcacaaaattgttttg

SEQ ID NO: 237 - DNA, 3744 bp, Homo sapiens
ggaagatggatgcaaaagctcgaaattgtttgcttcaacatagagaagctctggaaaaggacatcaagacatcctacatcatggatcacatgattagtgatggatttttaacaatatcagaagaggaaaaagtaagaaatgagcccactcaacagcaaagagcagctatgctgattaaaatgatacttaaaaaagataatgattcctacgtatcattctacaatgctctactacatgaaggatataaagatcttgctgcccttctccatgatggcattcctgttgtctcttcttccagtggtaaagattcagttagtggaataacttcgtatgtaaggacagtcctgtgtgaaggtggagtaccacagaggccagttgtttttgtcacaaggaagaagctggtgaatgcaattcagcagaagctctccaaattgaaaggtgaaccaggatgggtcaccatacatggaatggcaggctgtgggaagtctgtattagctgcagaagctgttagagatcattcccttttagaaggttgtttcccagggggagtgcattgggtttcagttgggaaacaagacaaatctgggcttctgatgaaactgcagaatctttgcacacggttggatcaggatgagagtttttcccagaggcttccacttaatattgaagaggctaaagaccgtctccgcattctgatgcttcgcaaacacccaaggtctctcttgatcttggatgatgtttgggactcttgggtgttgaaagcttttgacagtcagtgtcagattcttcttacaaccagagacaagagtgttacagattcagtaatgggtcctaaatatgtagtccctgtggagagttccttaggaaaggaaaaaggacttgaaattttatccctttttgttaatatgaagaaggcagatttgccagaacaagctcatagtattataaaagaatgtaaaggctctccccttgtagtatctttaattggtgcacttttacgtgattttcccaatcgctgggagtactacctcaaacagcttcagaataagcagtttaagagaataaggaaatcttcgtcttatgattatgaggctctagatgaagccatgtctataagtgttgaaatgctcagagaagacatcaaagattattacacagatctttccatccttcagaaggacgttaaggtgcctacaaaggtgttatgtattctctgggacatggaaactgaagaagttgaagacatactgcaggagtttgtaaataagtctcttttattctgtgatcggaatggaaagtcgtttcgttattatttacatgatcttcaagtagattttcttacagagaagaattgcagccagcttcaggatctacataagaagataatcactcagtttcagagatatcaccagccgcatactctttcaccagatcaggaagactgtatgtattggtacaactttctggcctatcacatggccagtgccaagatgcacaaggaactttgtgctttaatgttttccctggattggattaaagcaaaaacagaacttgtaggccctgctcatctgattcatgaatttgtggaatacagacatatactagatgaaaaggattgtgcagtcagtgagaattttcaggagtttttatctttaaatggacaccttcttggacgacagccatttcctaatattgtacaactgggtctctgtgagccggaaacttcagaagtttatcagcaagctaagctgcaggccaagcaggaggtcgataatggaatgctttacctggaatggataaacaaaaaaaacatcacgaatctttcccgcttagttgtccgcccccacacagatgctgtttaccatgcctgcttttctgaggatggtcagagaatagcttcttgtggagctgataaaaccttacaggtgttcaaagctgaaacaggagagaaacttctagaaatcaaggctcatgaggatgaagtgctttgttgtgcattctctacagatgacagatttatagcaacctgctcagtggataaaaaagtgaagatttggaattctatgactggggaactagtacacacctatgatgagcactcagagcaagtcaattgctgccatttcaccaacagtagtcatcatcttctcttagccactgggtcaagtgactgcttcctcaaactttgggatttgaatcaaaaagaatgtcgaaataccatgtttggtcatacaaattcagtcaatcactgcagattttcaccagatgataagcttttggctagttgttcagctgatggaaccttaaagctttgggatgcgacatcagcaaatgagaggaaaagcattaatgtgaaacagttcttcctaaatttggaggaccctcaagaggatatggaagtgatagtgaagtgttgttcgtggtctgctgatggtgcaaggataatggtggcagcaaaaaataaaatctttttgtggaatacagactcacgttcaaaggtggctgattgcagaggacatttaagttgggttcatggtgtgatgttttctcctgatggatcatcatttttgacatcttctgatgaccagacaatcaggctctgggagacaaagaaagtatgtaagaactctgctgtaatgttaaagcaagaagtagatgttgtgtttcaagaaaatgaagtgatggtccttgcagttgaccatataagacgtctgcaactcattaatggaagaacaggtcagattgattatctgactgaagctcaagttagctgctgttgcttaagtccacatcttcagtacattgcatttggagatgaaaatggagccattgagattttagaacttgtaaacaatagaatcttccagtccaggtttcagcacaagaaaactgtatggcacatccagttcacagccgatgagaagactcttatttcaagttctgatgatgctgaaattcaggtatggaattggcaattggacaaatgtatctttctacgaggccatcaggaaacagtgaaagactttagactcttgaaaaattcaagactgctttcttggtcatttgatggaacagtgaaggtatggaatattattactggaaataaagaaaaagactttgtctgtcaccagggtacagtactttcttgtgacatttctcacgatgctaccaagttttcatctacctctgctgacaagactgcaaagatctggagttttgatctccttttgccacttcatgaattgaggggccacaacggctgtgtgcgctgctctgccttctctgtggacagtaccctgctggcaacgggagatgacaatggagaaatcaggatatggaatgtctcaaacggtgagcttcttcatttgtgtgctccgctttcagaagaaggagctgctacccatggaggctgggtgactgacctttgcttttctccagatggcaaaatgcttatctctgctggaggatatattaagtggtggaacgttgtcactggggaatcctcacagaccttctacacaaatggaaccaatcttaagaaaatacacgtgtcccctgacttcaaaacatatgtgactgtggataatcttggtattttatatattttacagactttagaataaaatagttaagcattaatgtagttgaactttttaaatttttgaattggaaaaaaattctaatgaaaccctgatatcaactttttataaagctcttaattgttgtgcagtattgcattcatta

SEQ ID NO: 238 - DNA, 3492 bp, Homo sapiens
atggatgcaaaagctcgaaattgtttgcttcaacatagagaagctctggaaaaggacatcaagacatcctacatcatggatcacatgattagtgatggatttttaacaatatcagaagaggaaaaagtaagaaatgagcccactcaacagcaaagagcagctatgctgattaaaatgatacttaaaaaagataatgattcctacgtatcattctacaatgctctactacatgaaggatataaagatcttgctgcccttctccatgatggcattcctgttgtctcttcttccagtggtaaagattcagttagtggaataacttcgtatgtaaggacagtcctgtgtgaaggtggagtaccacagaggccagttgtttttgtcacaaggaagaagctggtgaatgcaattcagcagaagctctccaaattgaaaggtgaaccaggatgggtcaccatacatggaatggcaggctgtgggaagtctgtattagctgcagaagctgttagagatcattcccttttagaaggttgtttcccagggggagtgcattgggtttcagttgggaaacaagacaaatctgggcttctgatgaaactgcagaatctttgcacacggttggatcaggatgagagtttttcccagaggcttccacttaatattgaagaggctaaagaccgtctccgcattctgatgcttcgcaaacacccaaggtctctcttgatcttggatgatgtttgggactcttgggtgttgaaagcttttgacagtcagtgtcagattcttcttacaaccagagacaagagtgttacagattcagtaatgggtcctaaatatgtagtccctgtggagagttccttaggaaaggaaaaaggacttgaaattttatccctttttgttaatatgaagaaggcagatttgccagaacaagctcatagtattataaaagaatgtaaaggctctccccttgtagtatctttaattggtgcacttttacgtgattttcccaatcgctgggagtactacctcaaacagcttcagaataagcagtttaagagaataaggaaatcttcgtcttatgattatgaggctctagatgaagccatgtctataagtgttgaaatgctcagagaagacatcaaagattattacacagatctttccatccttcagaaggacgttaaggtgcctacaaaggtgttatgtattctctgggacatggaaactgaagaagttgaagacatactgcaggagtttgtaaataagtctcttttattctgtgatcggaatggaaagtcgtttcgttattatttacatgatcttcaagtagattttcttacagagaagaattgcagccagcttcaggatctacataagaagataatcactcagtttcagagatatcaccagccgcatactctttcaccagatcaggaagactgtatgtattggtacaactttctggcctatcacatggccagtgccaagatgcacaaggaactttgtgctttaatgttttccctggattggattaaagcaaaaacagaacttgtaggccctgctcatctgattcatgaatttgtggaatacagacatatactagatgaaaaggattgtgcagtcagtgagaattttcaggagtttttatctttaaatggacaccttcttggacgacagccatttcctaatattgtacaactgggtctctgtgagccggaaacttcagaagtttatcagcaagctaagctgcaggccaagcaggaggtcgataatggaatgctttacctggaatggataaacaaaaaaaacatcacgaatctttcccgcttagttgtccgcccccacacagatgctgtttaccatgcctgcttttctgaggatggtcagagaatagcttcttgtggagctgataaaaccttacaggtgttcaaagctgaaacaggagagaaacttctagaaatcaaggctcatgaggatgaagtgctttgttgtgcattctctacagatgacagatttatagcaacctgctcagtggataaaaaagtgaagatttggaattctatgactggggaactagtacacacctatgatgagcactcagagcaagtcaattgctgccatttcaccaacagtagtcatcatcttctcttagccactgggtcaagtgactgcttcctcaaactttgggatttgaatcaaaaagaatgtcgaaataccatgtttggtcatacaaattcagtcaatcactgcagattttcaccagatgataagcttttggctagttgttcagctgatggaaccttaaagctttgggatgcgacatcagcaaatgagaggaaaagcattaatgtgaaacagttcttcctaaatttggaggaccctcaagaggatatggaagtgatagtgaagtgttgttcgtggtctgctgatggtgcaaggataatggtggcagcaaaaaataaaatctttttgtggaatacagactcacgttcaaaggtggctgattgcagaggacatttaagttgggttcatggtgtgatgttttctcctgatggatcatcatttttgacatcttctgatgaccagacaatcaggctctgggagacaaagaaagtatgtaagaactctgctgtaatgttaaagcaagaagtagatgttgtgtttcaagaaaatgaagtgatggtccttgcagttgaccatataagacgtctgcaactcattaatggaagaacaggtcagattgattatctgactgaagctcaagttagctgctgttgcttaagtccacatcttcagtacattgcatttggagatgaaaatggagccattgagattttagaacttgtaaacaatagaatcttccagtccaggtttcagcacaagaaaactgtatggcacatccagttcacagccgatgagaagactcttatttcaagttctgatgatgctgaaattcaggtatggaattggcaattggacaaatgtatctttctacgaggccatcaggaaacagtgaaagactttagactcttgaaaaattcaagactgctttcttggtcatttgatggaacagtgaaggtatggaatattattactggaaataaagaaaaagactttgtctgtcaccagggtacagtactttcttgtgacatttctcacgatgctaccaagttttcatctacctctgctgacaagactgcaaagatatggaatgtctcaaacggtgagcttcttcatttgtgtgctccgctttcagaagaaggagctgctacccatggaggctgggtgactgacctttgcttttctccagatggcaaaatgcttatctctgctggaggatatattaagtggtggaacgttgtcactggggaatcctcacagaccttctacacaaatggaaccaatcttaagaaaatacacgtgtcccctgacttcaaaacatatgtgactgtggataatcttggtattttatatattttacagactttagaataa

SEQ ID NO: 239 - DNA, 6581 bp, Homo sapiens
agggaagatggatgcaaaagctcgaaattgtttgcttcaacatagagaagctctggaaaaggacatcaagacatcctacatcatggatcacatgattagtgatggatttttaacaatatcagaagaggaaaaagtaagaaatgagcccactcaacagcaaagagcagctatgctgattaaaatgatacttaaaaaagataatgattcctacgtatcattctacaatgctctactacatgaaggatataaagatcttgctgcccttctccatgatggcattcctgttgtctcttcttccagtgtaaggacagtcctgtgtgaaggtggagtaccacagaggccagttgtttttgtcacaaggaagaagctggtgaatgcaattcagcagaagctctccaaattgaaaggtgaaccaggatgggtcaccatacatggaatggcaggctgtgggaagtctgtattagctgcagaagctgttagagatcattcccttttagaaggttgtttcccagggggagtgcattgggtttcagttgggaaacaagacaaatctgggcttctgatgaaactgcagaatctttgcacacggttggatcaggatgagagtttttcccagaggcttccacttaatattgaagaggctaaagaccgtctccgcattctgatgcttcgcaaacacccaaggtctctcttgatcttggatgatgtttgggactcttgggtgttgaaagcttttgacagtcagtgtcagattcttcttacaaccagagacaagagtgttacagattcagtaatgggtcctaaatatgtagtccctgtggagagttccttaggaaaggaaaaaggacttgaaattttatccctttttgttaatatgaagaaggcagatttgccagaacaagctcatagtattataaaagaatgtaaaggctctccccttgtagtatctttaattggtgcacttttacgtgattttcccaatcgctgggagtactacctcaaacagcttcagaataagcagtttaagagaataaggaaatcttcgtcttatgattatgaggctctagatgaagccatgtctataagtgttgaaatgctcagagaagacatcaaagattattacacagatctttccatccttcagaaggacgttaaggtgcctacaaaggtgttatgtattctctgggacatggaaactgaagaagttgaagacatactgcaggagtttgtaaataagtctcttttattctgtgatcggaatggaaagtcgtttcgttattatttacatgatcttcaagtagattttcttacagagaagaattgcagccagcttcaggatctacataagaagataatcactcagtttcagagatatcaccagccgcatactctttcaccagatcaggaagactgtatgtattggtacaactttctggcctatcacatggccagtgccaagatgcacaaggaactttgtgctttaatgttttccctggattggattaaagcaaaaacagaacttgtaggccctgctcatctgattcatgaatttgtggaatacagacatatactagatgaaaaggattgtgcagtcagtgagaattttcaggagtttttatctttaaatggacaccttcttggacgacagccatttcctaatattgtacaactgggtctctgtgagccggaaacttcagaagtttatcagcaagctaagctgcaggccaagcaggaggtcgataatggaatgctttacctggaatggataaacaaaaaaaacatcacgaatctttcccgcttagttgtccgcccccacacagatgctgtttaccatgcctgcttttctgaggatggtcagagaatagcttcttgtggagctgataaaaccttacaggtgttcaaagctgaaacaggagagaaacttctagaaatcaaggctcatgaggatgaagtgctttgttgtgcattctctacagatgacagatttatagcaacctgctcagtggataaaaaagtgaagatttggaattctatgactggggaactagtacacacctatgatgagcactcagagcaagtcaattgctgccatttcaccaacagtagtcatcatcttctcttagccactgggtcaagtgactgcttcctcaaactttgggatttgaatcaaaaagaatgtcgaaataccatgtttggtcatacaaattcagtcaatcactgcagattttcaccagatgataagcttttggctagttgttcagctgatggaaccttaaagctttgggatgcgacatcagcaaatgagaggaaaagcattaatgtgaaacagttcttcctaaatttggaggaccctcaagaggatatggaagtgatagtgaagtgttgttcgtggtctgctgatggtgcaaggataatggtggcagcaaaaaataaaatctttctttttgacattcatactagtggcctattgggagaaatccacacgggccatcacagcaccatccagtactgtgacttctccccacaaaaccatttggcagtggttgctttgtcccagtactgtgtagagttgtggaatacagactcacgttcaaaggtggctgattgcagaggacatttaagttgggttcatggtgtgatgttttctcctgatggatcatcatttttgacatcttctgatgaccagacaatcaggctctgggagacaaagaaagtatgtaagaactctgctgtaatgttaaagcaagaagtagatgttgtgtttcaagaaaatgaagtgatggtccttgcagttgaccatataagacgtctgcaactcattaatggaagaacaggtcagattgattatctgactgaagctcaagttagctgctgttgcttaagtccacatcttcagtacattgcatttggagatgaaaatggagccattgagattttagaacttgtaaacaatagaatcttccagtccaggtttcagcacaagaaaactgtatggcacatccagttcacagccgatgagaagactcttatttcaagttctgatgatgctgaaattcaggtatggaattggcaattggacaaatgtatctttctacgaggccatcaggaaacagtgaaagactttagactcttgaaaaattcaagactgctttcttggtcatttgatggaacagtgaaggtatggaatattattactggaaataaagaaaaagactttgtctgtcaccagggtacagtactttcttgtgacatttctcacgatgctaccaagttttcatctacctctgctgacaagactgcaaagatctggagttttgatctccttttgccacttcatgaattgaggggccacaacggctgtgtgcgctgctctgccttctctgtggacagtaccctgctggcaacgggagatgacaatggagaaatcaggatatggaatgtctcaaacggtgagcttcttcatttgtgtgctccgctttcagaagaaggagctgctacccatggaggctgggtgactgacctttgcttttctccagatggcaaaatgcttatctctgctggaggatatattaagtggtggaacgttgtcactggggaatcctcacagaccttctacacaaatggaaccaatcttaagaaaatacacgtgtcccctgacttcaaaacatatgtgactgtggataatcttggtattttatatattttacagactttagaataaaatagttaagcattaatgtagttgaactttttaaatttttgaattggaaaaaaattctaatgaaaccctgatatcaactttttataaagctcttaattgttgtgcagtattgcattcattacaaaagtgtttgtggttggatgaataatattaatgtagctttttcccaaatgaacatacctttaatcttgtttttcatgatcatcattaacagtttgtccttaggatgcaaatgaaaatgtgaatacataccttgttgtactgttggtaaaattctgtcttgatgcattcaaaatggttgacataattaatgagaagaatttggaagaaattggtattttaatactgtctgtatttattactgttatgcaggctgtgcctcagggtagcagtggcctgctttttgaaccacacttaccccaagggggttttgttctcctaaatacaatcttagaggttttttgcactctttaaatttgctttaaaaatattgtgtctgtgtgcatagtctgcagcatttcctttaattgactcaataagtgagtcttggatttagcaggcccccccaccttttttttttgtttttggagacagagtcttgctttgttgccaggctggagtgcagtggcgcgatctcggctcaccacaatcgctgcctcctgggttcaagcaattctcctgcctcagcctcccgagtagctgggactacaggtgtgcgcacatgccaggctaatttttgtatttttagtagagacggggtttcaccatgttggccgggatggtctcgatctcttgacctcatgatctacccgccttggcctcccaaagtgctgagattacaggcgtgagccaccgtgcctggccaggccccttctcttttaatggagacagggtcttgcactatcacccaggctggagtgcagtggcataatcatacctcattgcagcctcagactcctgggttcaagcaatcctcctgcctcagcctcccaagtagctgagactacaggcacgagccaccacacccagctaatttttaagttttcttgtagagacagggtctcactatgttgtctaggctggtcttgaactcttggcctcaagtaatcctcctgcctcagcctcccaaagtgttgggattgcagatatgagccactggcctggccttcagcagttctttttgtgaagtaaaacttgtatgttggaaagagtagattttattggtctacccttttctcactgtagctgctggcagccctgtgccatatctggactctagttgtcagtatctgagttggacactattcctgctccctcttgtttcttacatatcagacttcttacttgaatgaaacctgatctttcctaatcctcacttttttcttttttaaaaagcagtttctccactgctaaatgttagtcattgaggtggggccaattttaatcataagccttaataagatttttctaagaaatgtgaaatagaacaattttcatctaattccatttacttttagatgaatggcattgtgaatgccattcttttaatgaatttcaagagaattctctggttttctgtgtaattccagatgagtcactgtaactctagaagattaaccttccagccaacctattttcctttcccttgtctctctcatcctcttttccttccttctttcctttctcttcttttatctccaaggttaatcaggaaaaatagcttttgacaggggaaaaaactcaataactagctatttttgacctcctgatcaggaactttagttgaagcgtaaatctaaagaaacattttctctgaaatatattattaagggcaatggagataaattaatagtagatgtggttcccagaaaatataatcaaaattcaaagattttttttgtttctgtaactggaactaaatcaaatgattactagtgttaatagtagataacttgtttttattgttggtgcatattagtataactgtggggtaggtcggggagagggtaagggaatagatcactcagatgtattttagataagctatttagcctttgatggaatcataaatacagtgaatacaatcctttgcattgttaaggaggttttttgtttttaaatggtgggtcaaggagctagtttacaggcttactgtgatttaagcaaatgtgaaaagtgaaaccttaattttatcaaaagaaatttctgtaaatggtatgtctccttagaatacccaaatcataattttatttgtacacactgttaggggctcatctcatgtaggcagagtataaagtattaccttttggaattaaaagccactgactgttataaagtataacaacacacatcaggttttaaaaagccttgaatggcccttgtcttaaaaagaaattaggagccaggtgcggtggcacgtgcctgtaatcccagctccttgggaggctaagacaggaggattccttgagccctggagtttgagtccagcctgggtgacatagcaagaccctgtcttaaaagaaaaatgggaagaaagacaaggtaacatgaagaaagaagagatacctagtatgatggagctgcaaatttcatggcagttcatgcagtcggtcaagaggaggattttgttttgtagtttgcagatgagcatttctaaagcattttcccttgctgtatttttttgtattataaattacattggacttcatatatataatttttttttacattatatgtctcttgtatgttttgaaactcttgtatttatgatatagcttatatgatttttttgccttggtatacattttaaaatatgaatttaaaaaatttttgtaaaaataaaattcacaaaattgttttg

SEQ ID NO: 240 - DNA, 5444 bp, Homo sapiens
acttctacgcgcgcgggcatgagccgtggcaggagtgcgcggcggcagcggtggccgccccttggggcttggggtgtgtttatttgcataagcgggcgcgcgccgtccgggctgggtggatccggcgggatttgactgctccgctgtccagaggcggagaagaagaggtagcgagtggacgtgactgctctatcccgggcaaaagggatagaaccagaggtggggagtctgggcagtcggcgacccgcgaagacttgaggtgccgcagcggcatccggagtagcgccgggctccctccggggtgcagccgccgtcgggggaagggcgccacaggccgggaagacctcctccctttgtgtccagtagtggggtccaccggagggcggcccgtgggccgggcctcaccgcggcgctccgggactgtggggtcaggctgcgttgggtggacgcccacctcgccaaccttcggaggtccctgggggtcttcgtgcgccccggggctgcagagatccaggggaggcgcctgtgaggcccggacctgccccggggcgaagggtatgtggcgagacagagccctgcacccctaattcccggtggaaaactcctgttgccgtttccctccaccggcctggagtctcccagtcttgtcccggcagtgccgccctccccactaagacctaggcgcaaaggcttggctcatggttgacagctcagagagagaaagatctgagggaagatggatgcaaaagctcgaaattgtttgcttcaacatagagaagctctggaaaaggacatcaagacatcctacatcatggatcacatgattagtgatggatttttaacaatatcagaagaggaaaaagtaagaaatgagcccactcaacagcaaagagcagctatgctgattaaaatgatacttaaaaaagataatgattcctacgtatcattctacaatgctctactacatgaaggatataaagatcttgctgcccttctccatgatggcattcctgttgtctcttcttccagtggtaaagattcagttagtggaataacttcgtatgtaaggacagtcctgtgtgaaggtggagtaccacagaggccagttgtttttgtcacaaggaagaagctggtgaatgcaattcagcagaagctctccaaattgaaaggtgaaccaggatgggtcaccatacatggaatggcaggctgtgggaagtctgtattagctgcagaagctgttagagatcattcccttttagaaggttgtttcccagggggagtgcattgggtttcagttgggaaacaagacaaatctgggcttctgatgaaactgcagaatctttgcacacggttggatcaggatgagagtttttcccagaggcttccacttaatattgaagaggctaaagaccgtctccgcattctgatgcttcgcaaacacccaaggtctctcttgatcttggatgatgtttgggactcttgggtgttgaaagcttttgacagtcagtgtcagattcttcttacaaccagagacaagagtgttacagattcagtaatgggtcctaaatatgtagtccctgtggagagttccttaggaaaggaaaaaggacttgaaattttatccctttttgttaatatgaagaaggcagatttgccagaacaagctcatagtattataaaagaatgtaaaggctctccccttgtagtatctttaattggtgcacttttacgtgattttcccaatcgctgggagtactacctcaaacagcttcagaataagcagtttaagagaataaggaaatcttcgtcttatgattatgaggctctagatgaagccatgtctataagtgttgaaatgctcagagaagacatcaaagattattacacagatctttccatccttcagaaggacgttaaggtgcctacaaaggtgttatgtattctctgggacatggaaactgaagaagttgaagacatactgcaggagtttgtaaataagtctcttttattctgtgatcggaatggaaagtcgtttcgttattatttacatgatcttcaagtagattttcttacagagaagaattgcagccagcttcaggatctacataagaagataatcactcagtttcagagatatcaccagccgcatactctttcaccagatcaggaagactgtatgtattggtacaactttctggcctatcacatggccagtgccaagatgcacaaggaactttgtgctttaatgttttccctggattggattaaagcaaaaacagaacttgtaggccctgctcatctgattcatgaatttgtggaatacagacatatactagatgaaaaggattgtgcagtcagtgagaattttcaggagtttttatctttaaatggacaccttcttggacgacagccatttcctaatattgtacaactgggtctctgtgagccggaaacttcagaagtttatcagcaagctaagctgcaggccaagcaggaggtcgataatggaatgctttacctggaatggataaacaaaaaaaacatcacgaatctttcccgcttagttgtccgcccccacacagatgctgtttaccatgcctgcttttctgaggatggtcagagaatagcttcttgtggagctgataaaaccttacaggtgttcaaagctgaaacaggagagaaacttctagaaatcaaggctcatgaggatgaagtgctttgttgtgcattctctacagatgacagatttatagcaacctgctcagtggataaaaaagtgaagatttggaattctatgactggggaactagtacacacctatgatgagcactcagagcaagtcaattgctgccatttcaccaacagtagtcatcatcttctcttagccactgggtcaagtgactgcttcctcaaactttgggatttgaatcaaaaagaatgtcgaaataccatgtttggtcatacaaattcagtcaatcactgcagattttcaccagatgataagcttttggctagttgttcagctgatggaaccttaaagctttgggatgcgacatcagcaaatgagaggaaaagcattaatgtgaaacagttcttcctaaatttggaggaccctcaagaggatatggaagtgatagtgaagtgttgttcgtggtctgctgatggtgcaaggataatggtggcagcaaaaaataaaatctttctttttgacattcatactagtggcctattgggagaaatccacacgggccatcacagcaccatccagtactgtgacttctccccacaaaaccatttggcagtggttgctttgtcccagtactgtgtagagttgtggaatacagactcacgttcaaaggtggctgattgcagaggacatttaagttgggttcatggtgtgatgttttctcctgatggatcatcatttttgacatcttctgatgaccagacaatcaggctctgggagacaaagaaagtatgtaagaactctgctgtaatgttaaagcaagaagtagatgttgtgtttcaagaaaatgaagtgatggtccttgcagttgaccatataagacgtctgcaactcattaatggaagaacaggtcagattgattatctgactgaagctcaagttagctgctgttgcttaagtccacatcttcagtacattgcatttggagatgaaaatggagccattgagattttagaacttgtaaacaatagaatcttccagtccaggtttcagcacaagaaaactgtatggcacatccagttcacagccgatgagaagactcttatttcaagttctgatgatgctgaaattcaggtatggaattggcaattggacaaatgtatctttctacgaggccatcaggaaacagtgaaagactttagactcttgaaaaattcaagactgctttcttggtcatttgatggaacagtgaaggtatggaatattattactggaaataaagaaaaagactttgtctgtcaccagggtacagtactttcttgtgacatttctcacgatgctaccaagttttcatctacctctgctgacaagactgcaaagatctggagttttgatctccttttgccacttcatgaattgaggggccacaacggctgtgtgcgctgctctgccttctctgtggacagtaccctgctggcaacgggagatgacaatggagaaatcaggatatggaatgtctcaaacggtgagcttcttcatttgtgtgctccgctttcagaagaaggagctgctacccatggaggctgggtgactgacctttgcttttctccagatggcaaaatgcttatctctgctggaggatatattaagtggtggaacgttgtcactggggaatcctcacagaccttctacacaaatggaaccaatcttaagaaaatacacgtgtcccctgacttcaaaacatatgtgactgtggataatcttggtattttatatattttacagactttagaataaaatagttaagcattaatgtagttgaactttttaaatttttgaattggaaaaaaattctaatgaaaccctgatatcaactttttataaagctcttaattgttgtgcagtattgcattcattacaaaagtgtttgtggttggatgaataatattaatgtagctttttcccaaatgaacatacctttaatcttgtttttcatgatcatcattaacagtttgtccttaggatgcaaatgaaaatgtgaatacataccttgttgtactgttggtaaaattctgtcttgatgcattcaaaatggttgacataattaatgagaagaatttggaagaaattggtattttaatactgtctgtatttattactgttatgcaggctgtgcctcagggtagcagtggcctgctttttgaaccacacttaccccaagggggttttgttctcctaaatacaatcttagaggttttttgcactctttaaatttgctttaaaaatattgtgtctgtgtgcatagtctgcagcatttcctttaattgactcaataagtgagtcttggatttagcaggcccccccaccttttttttttgtttttggagacagagtcttgctttgttgccaggctggagtgcagtggcgcgatctcggctcaccacaatcgctgcctcctgggttcaagcaattctcctgcctcagcctcccgagtagctgggactacaggtgtgcgcacatgccaggctaatttttgtatttttagtagagacggggtttcaccatgttggccgggatggtctcgatctcttgacctcatgatctacccgccttggcctcccaaagtgctgagattacaggcgtgagccaccgtgcctggccaggccccttctcttttaatggagacagggtcttgcactatcacccaggctggagtgcagtggcataatcatacctcattgcagcctcagactcctgg

SEQ ID NO: 241 - DNA, 1143 bp, Homo sapiens
tagctcatggttgacagctcagagagagaaagatctgagggaagatggatgcaaaagctcgaaattgtttgcttcaacatagagaagctctggaaaaggacatcaagacatcctacatcatggatcacatgattagtgatggatttttaacaatatcagaagaggaaaaagtaagaaatgagcccactcaacagcaaagagcagctatgctgattaaaatgatacttaaaaaagataatgattcctacgtatcattctacaatgctctactacatgaaggatataaagatcttgctgcccttctccatgatggcattcctgttgtctcttcttccagtggtaaagattcagttagtggaataacttcgtatgtaaggacagtcctgtgtgaaggtggagtaccacagaggccagttgtttttgtcacaaggaagaagctggtgaatgcaattcagcagaagctctccaaattgaaaggtgaaccaggatgggtcaccatacatggaatggcaggctgtgggaagtctgtattagctgcagaagctgttagagatcattcccttttagaaggttgtttcccagggggagtgcattgggtttcagttgggaaacaagacaaatctgggcttctgatgaaactgcagaatctttgcacacggttggatcaggatgagagtttttcccagaggcttccacttaatattgaagaggctaaagaccgtctccgcattctgatgcttcgcaaacacccaaggtctctcttgatcttggatgatgtttgggactcttgggtgttgaaagcttttgacagtcagtgtcagattcttcttacaaccagagacaagagtgttacagattcagtaatgggtcctaaatatgtagtccctgtggagagttccttaggaaaggaaaaaggacttgaaattttatccctttttgttaatatgaagaaggcagatttgccagaacaagctcatagtattataaaagaatgtaaagtggtggaacgttgtcactggggaatcctcacagaccttctacacaaatggaaccaatcttaagaaaatacacgtgtcccctgacttcaaaacatatgtgactgtggataatcttggtattttatatattttacagactttagaa

SEQ ID NO: 242 - DNA, 1971 bp, Homo sapiens
ccgagggtcttccaccctcgccctgaccctggacactgcccagcttggccccccatcctgctcctggcacaatgccctctagccagccaaccttccctcccccaaccctggggccgccccagggttcctgcgcactgcctgttcctcctgggtgtcactggcagccctgtccttcctagagggactggaacctaattctcctgaggctgagggagggtggagggtctcaaggcaacgctggccccacgacggagtgccaggagcactaacagtacccttagcttgctttcctcctccctcctttttattttcaagttcctttttatttctccttgcgtaacaaccttcttcccttctgcaccactgcccgtacccttacccgccccgccacctccttgctaccccactcttgaaaccacagctgttggcagggtccccagctcatgccagcctcatctcctttcttgctagcccccaaagggcctccaggcaacatggggggcccagtcagagagccggcactctcagttgccctctggttgagttggggggcagctctgggggccgtggcttgtgccatggctctgctgacccaacaaacagagctgcagagcctcaggagagaggtgagccggctgcaggggacaggaggcccctcccagaatggggaagggtatccctggcagagtctcccggagcagagttccgatgccctggaagcctgggagaatggggagagatcccggaaaaggagagcagtgctcacccaaaaacagaagaagcagcactctgtcctgcacctggttcccattaacgccacctccaaggatgactccgatgtgacagaggtgatgtggcaaccagctcttaggcgtgggagaggcctacaggcccaaggatatggtgtccgaatccaggatgctggagtttatctgctgtatagccaggtcctgtttcaagacgtgactttcaccatgggtcaggtggtgtctcgagaaggccaaggaaggcaggagactctattccgatgtataagaagtatgccctcccacccggaccgggcctacaacagctgctatagcgcaggtgtcttccatttacaccaaggggatattctgagtgtcataattccccgggcaagggcgaaacttaacctctctccacatggaaccttcctggggtttgtgaaactgtgattgtgttataaaaagtggctcccagcttggaagaccagggtgggtacatactggagacagccaagagctgagtatataaaggagagggaatgtgcaggaacagaggcgtcttcctgggtttggctccccgttcctcacttttcccttttcattcccaccccctagactttgattttacggatatcttgcttctgttccccatggagctccgaattcttgcgtgtgtgtagatgaggggcgggggacgggcgccaggcattgtccagacctggtcggggcccactggaagcatccagaacagcaccaccatctagcggccgctcgagggaagcacccgccggttggccgaagtccacgaagccgccctctgctagggaaaacccctggttctccatgccacacctctctccaggtgccctctgcctcttcaccccacaagaagccttatcctacgtccttctctccatctatcggaccccagtttccatcactatctccagagatgtagctattatgcgcccgtctacagggggtgcccgacgatgacggtgccttcgcagtcaaattactcttcgggtcccaaggtttggctttcacgcgctccattgccccggcgtggcaggccattccaagcccttccgggctggaactggtgtcggaggagcctcgggtgtatcgtacgccctggtgttggtgttgcctcactcctctgagctcttctttctgatcaagccctgcttaaagttaaataaaatagaatgaatgataccccggc

SEQ ID NO: 243 - DNA, 2036 bp, Homo sapiens
agaactcagccagtttcttgcttccgtgcccctggttctcctccccatcgagcccacccctcctttcccaccttcagtcacccctagtgaactgccccagcgatctctgctgtgcttgaccccgagggtcttccaccctcgccctgaccctggacactgcccagcttggccccccatcctgctcctggcacaatgccctctagccagccaaccttccctcccccaaccctggggccgccccagggttcctgcgcactgcctgttcctcctgggtgtcactggcagccctgtccttcctagagggactggaacctaattctcctgaggctgagggagggtggagggtctcaaggcaacgctggccccacgacggagtgccaggagcactaacagtacccttagcttgctttcctcctccctcctttttattttcaagttcctttttatttctccttgcgtaacaaccttcttcccttctgcaccactgcccgtacccttacccgccccgccacctccttgctaccccactcttgaaaccacagctgttggcagggtccccagctcatgccagcctcatctcctttcttgctagcccccaaagggcctccaggcaacatggggggcccagtcagagagccggcactctcagttgccctctggttgagttggggggcagctctgggggccgtggcttgtgccatggctctgctgacccaacaaacagagctgcagagcctcaggagagaggtgagccggctgcaggggacaggaggcccctcccagaatggggaagggtatccctggcagagtctcccggagcagagttccgatgccctggaagcctgggagaatggggagagatcccggaaaaggagagcagtgctcacccaaaaacagaagaatgactccgatgtgacagaggtgatgtggcaaccagctcttaggcgtgggagaggcctacaggcccaaggatatggtgtccgaatccaggatgctggagtttatctgctgtatagccaggtcctgtttcaagacgtgactttcaccatgggtcaggtggtgtctcgagaaggccaaggaaggcaggagactctattccgatgtataagaagtatgccctcccacccggaccgggcctacaacagctgctatagcgcaggtgtcttccatttacaccaaggggatattctgagtgtcataattccccgggcaagggcgaaacttaacctctctccacatggaaccttcctggggtttgtgaaactgtgattgtgttataaaaagtggctcccagcttggaagaccagggtgggtacatactggagacagccaagagctgagtatataaaggagagggaatgtgcaggaacagaggcgtcttcctgggtttggctccccgttcctcacttttcccttttcattcccaccccctagactttgattttacggatatcttgcttctgttccccatggagctccgaattcttgcgtgtgtgtagatgaggggcgggggacgggcgccaggcattgtccagacctggtcggggcccactggaagcatccagaacagcaccaccatctagcggccgctcgagggaagcacccgccggttggccgaagtccacgaagccgccctctgctagggaaaacccctggttctccatgccacacctctctccaggtgccctctgcctcttcaccccacaagaagccttatcctacgtccttctctccatctatcggaccccagtttccatcactatctccagagatgtagctattatgcgcccgtctacagggggtgcccgacgatgacggtgccttcgcagtcaaattactcttcgggtcccaaggtttggctttcacgcgctccattgccccggcgtggcaggccattccaagcccttccgggctggaactggtgtcggaggagcctcgggtgtatcgtacgccctggtgttggtgttgcctcactcctctgagctcttctttctgatcaagccctgcttaaagttaaataaaatagaatgaatgat

SEQ ID NO: 244 - DNA, 1184 bp, Homo sapiens
agccctgtccttcctagagggactggaacctaattctcctgaggctgagggagggtggagggtctcaaggcaacgctggccccacgacggagtgccaggagcactaacagtacccttagcttgctttcctcctccctcctttttattttcaagttcctttttatttctccttgcgtaacaaccttcttcccttctgcaccactgcccgtacccttacccgccccgccacctccttgctaccccactcttgaaaccacagctgttggcagggtccccagctcatgccagcctcatctcctttcttgctagcccccaaagggcctccaggcaacatggggggcccagtcagagagccggcactctcagttgccctctggttgagttggggggcagctctgggggccgtggcttgtgccatggctctgctgacccaacaaacagagctgcagagcctcaggagagaggtgagccggctgcaggggacaggaggcccctcccagaatggggaagggtatccctggcagagtctcccggagcagcactctgtcctgcacctggttcccattaacgccacctccaaggatgactccgatgtgacagaggtgatgtggcaaccagctcttaggcgtgggagaggcctacaggcccaaggatatggtgtccgaatccaggatgctggagtttatctgctgtatagccaggtcctgtttcaagacgtgactttcaccatgggtcaggtggtgtctcgagaaggccaaggaaggcaggagactctattccgatgtataagaagtatgccctcccacccggaccgggcctacaacagctgctatagcgcaggtgtcttccatttacaccaaggggatattctgagtgtcataattccccgggcaagggcgaaacttaacctctctccacatggaaccttcctggggtttgtgaaactgtgattgtgttataaaaagtggctcccagcttggaagaccagggtgggtacatactggagacagccaagagctgagtatataaaggagagggaatgtgcaggaacagaggcgtcttcctgggtttggctccccgttcctcacttttcccttttcattcccaccccctagactttgattttacggatatcttgcttctgttccccatggagctccgaattcttgcgtgtgtgtagatga

SEQ ID NO: 245 - DNA, 1593 bp, Homo sapiens
cctaattctcctgaggctgagggagggtggagggtctcaaggcaacgctggccccacgacggagtgccaggagcactaacagtacccttagcttgctttcctcctccctcctttttattttcaagttcctttttatttctccttgcgtaacaaccttcttcccttctgcaccactgcccgtacccttacccgccccgccacctccttgctaccccactcttgaaaccacagctgttggcagggtccccagctcatgccagcctcatctcctttcttgctagcccccaaagggcctccaggcaacatggggggcccagtcagagagccggcactctcagttgccctctggttgagttggggggcagctctgggggccgtggcttgtgccatggctctgctgacccaacaaacagagctgcagagcctcaggagagaggtgagccggctgcaggggacaggaggcccctcccagaatggggaagggtatccctggcagagtctcccggagcagagttccgatgccctggaagcctgggagaatggggagagatcccggaaaaggagagcagtgctcacccaaaaacagaagaagcagcactctgtcctgcacctggttcccattaacgccacctccaaggatgactccgatgtgacagaggtgatgtggcaaccagctcttaggcgtgggagaggcctacaggcccaaggatatggtgtccgaatccaggatgctggagtttatctgctgtatagccaggtcctgtttcaagacgtgactttcaccatgggtcaggtggtgtctcgagaaggccaaggaaggcaggagactctattccgatgtataagaagtatgccctcccacccggaccgggcctacaacagctgctatagcgcaggtgtcttccatttacaccaaggggatattctgagtgtcataattccccgggcaagggcgaaacttaacctctctccacatggaaccttcctgggactttgattttacggatatcttgcttctgttccccatggagctccgaattcttgcgtgtgtgtagatgaggggcgggggacgggcgccaggcattgtccagacctggtcggggcccactggaagcatccagaacagcaccaccatctagcggccgctcgagggaagcacccgccggttggccgaagtccacgaagccgccctctgctagggaaaacccctggttctccatgccacacctctctccaggtgccctctgcctcttcaccccacaagaagccttatcctacgtccttctctccatctatcggaccccagtttccatcactatctccagagatgtagctattatgcgcccgtctacagggggtgcccgacgatgacggtgccttcgcagtcaaattactcttcgggtcccaaggtttggctttcacgcgctccattgccccggcgtggcaggccattccaagcccttccgggctggaactggtgtcggaggagcctcgggtgtatcgtacgccctggtgttggtgttgcctcactcctctgagctcttctttctgatcaagccctgcttaaagttaaataaaatagaatgaatgata

SEQ ID NO: 246 - DNA, 942 bp, Homo sapiens
aatcaatgacaatttaatggagcttttgatcatgattaatgcctgcaagattgcttcagccagccgggttactgcagtcatcccatgcttcccttatgcccggcaggataagaaagataagggcttttttgatatcccagtagacaatttgtatgcagagccggctgtcctaaagtggataagggagaatatctctgagtggaggaactgcactattgtctcacctgatgctggtggagctaagagagtgacctccattgcagacaggctgaatgtggactttgccttgattcacaaagaacggaagaaggccaatgaagtggaccgcatggtgcttgtgggagatgtgaaggatcgggtggccatccttgtggatgacatggctgacacttgtggcacaatctgccatgcagctgacaaacttctctcagctggcgccaccagagtttatgccatcttgactcatggaatcttctccggtcctgctatttctcgcatcaacaacgcatgctttgaggcagtagtagtcaccaataccatacctcaggaggacaagatgaagcattgctccaaaatacaggtgattgacatctctatgatccttgcagaagccatcaggagaactcacaatggagaatccgtttcttacctattcagccatgtccctttataatagagtaacttctgaggctttttgagaataaaatccaccccacccttgtttccccttggtatttgatgacaaattcagcagaagacccggcttgctccagtgtagctttctacatcccacatcaggtatattagagcttatccgaactggggaaagacggattgagattaactgctgggacctcctacctgcattatctcattctggcttccttgataattctgtgggccttgcagctttaactatagctcagctgctgcaagatttca

SEQ ID NO: 247 - DNA, 628 bp, Homo sapiens
caacgcaaagcgcttggtattgagtctgtggccgacttcggttccggtctctgcagcagccgtgatcgcttagtggagtgcttagggtagttggccaggatgccgaatatcaaaatcttcagcggcagctcccaccaggacttatctcagaaaattgctgaccgcctgggcctggagctaggcaaggtggtgactaagaaattcagcaaccaggagacctgtgtggaaattggtgaaagtgtacgtggagaggatgtctacattgttcagagtggttgtggcgaaatcaatgacaatttaatggagcttttgatcatgattaatgcctgcaagattgcttcagccagccgggttactgcagtcatcccatgcttcccttatgcccggcaggataagaaagataagagccgggcgccaatctcagccaagcttgttgcaaatatgctatctgtagcaggtgcagatcatattatcaccatggacctacatgcttctcaaattcaggtatcagtggaagctaaatattggtgtttgaaaggtgggaggaaaggactgatgatgctgaagactgcagagaagccaaaaattatgcccaagtacatctgaaataaactagatatcaacaaca

SEQ ID NO: 248 - DNA, 1218 bp, Homo sapiens
aagatggcggagtagcaacgcaaagcgcttggtattgagtctgatgccgaatatcaaaatcttcagcggcagctcccaccaggacttatctcagaaaattgctgaccgcctgggcctggagctaggcaaggtggtgactaagaaattcagcaaccaggagacctgtgtggaaattggtgaaagtgtacgtggagaggatgtctacattgttcagagtggttgtggcgaaatcaatgacaatttaatggagcttttgatcatgattaatgcctgcaagattgcttcagccagccgggttactgcagtcatcccatgcttcccttatgcccggcaggataagaaagataagagccgggcgccaatctcagccaagcttgttgcaaatatgctatctgtagcaggtgcagatcatattatcaccatggacctacatgcttctcaaattcagggcttttttgatatcccagtagacaatttgtatgcagagccggctgtcctaaagtggataagggagaatatctctgagtggaggaactgcactattgtctcacctgatgctggtggagctaagagagtgacctccattgcagacaggctgaatgtggactttgccttgattcacaaagaacggaagaaggccaatgaagtggaccgcatggtgcttgtgggagatgtgaaggatcgggtggccatccttgtggatgacatggctgacacttgtggcacaatctgccatgcagctgacaaacttctctcagctggcgccaccagagtttatgccatcttgactcatggaatcttctccggtcctgctatttctcgcatcaacaacgcatgctttgaggcagtagtagtcaccaataccatacctcaggaggacaagatgaagcattgctccaaaatacaggtgattgacatctctatgatccttgcagaagccatcaggagaactcacaatggagaatccgtttcttacctattcagccatgtccctttataatagagtaacttctgaggctttttgagaataaaatccaccccacccttgtttccccttggtatttgatgacaaattcagcagaagacccggcttgctccagtgtagctttctacatcccacatcaggtatattagagcttatccgaactggggaaagacggattgagattaactgctgggacctcctacctgcattatctcattctggcttccttgata

SEQ ID NO: 249 - DNA, 2073 bp, Homo sapiens
gggaatgtaagatggcggagtagcaacgcaaagcgcttggtattgagtctgtggccgacttcggttccggtctctgcagcagccgtgatcgcttagtggagtgcttagggtagttggccaggatgccgaatatcaaaatcttcagcggcagctcccaccaggacttatctcagaaaattgctgaccgcctgggcctggagctaggcaaggtggtgactaagaaattcagcaaccaggagacctgtgtggaaattggtgaaagtgtacgtggagaggatgtctacattgttcagagtggttgtggcgaaatcaatgacaatttaatggagcttttgatcatgattaatgcctgcaagattgcttcagccagccgggttactgcagtcatcccatgcttcccttatgcccggcaggataagaaagataagagccgggcgccaatctcagccaagcttgttgcaaatatgctatctgtagcaggtgcagatcatattatcaccatggacctacatgcttctcaaattcagggcttttttgatatcccagtagacaatttgtatgcagagccggctgtcctaaagtggataagggagaatatctctgagtggaggaactgcactattgtctcacctgatgctggtggagctaagagagtgacctccattgcagacaggctgaatgtggactttgccttgattcacaaagaacggaagaaggccaatgaagtggaccgcatggtgcttgtgggagatgtgaaggatcgggtggccatccttgtggatgacatggctgacacttgtggcacaatctgccatgcagctgacaaacttctctcagctggcgccaccagagtttatgccatcttgactcatggaatcttctccggtcctgctatttctcgcatcaacaacgcatgctttgaggcagtagtagtcaccaataccatacctcaggaggacaagatgaagcattgctccaaaatacaggtgattgacatctctatgatccttgcagaagccatcaggagaactcacaatggagaatccgtttcttacctattcagccatgtccctttataatagagtaacttctgaggctttttgagaataaaatccaccccacccttgtttccccttggtatttgatgacaaattcagcagaagacccggcttgctccagtgtagctttctacatcccacatcaggtatattagagcttatccgaactggggaaagacggattgagattaactgctgggacctcctacctgcattatctcattctggcttccttgataattctgtgggccttgcagctttaactatagctcagctgctgcaagatttcagacttttgaggatgttgtgtgagggtgtttgactgtgactggggaagctcagactactttgtatgtgaatgcttcagggttttctttgttgagaacaactagcaacaaaggcaacccatgtgtgaccagttctccccaaggtctatgctaaattatagcaagagccctgggcaaccccaaacctagtcctggtagctgagcaccctgtaaggcaggagcaggcagctcagcttgagcagacattgggtggggggtggggggtggttgaggggggaggcagcacagtgcagcaaatgtttcttgggaggaagaagcctgatccatcaccatctgcttgactatgtagcttggattctcctttgtacctatccctttcgatttggctttaccttcatctatcttgatcctttcctggccaaatatcctcttgggcccaaatgaacattgtaccatagtcttctggaaagcaaacatgcttcctgctatgtaattgctaacattcatattagatgatgtgctgtagcttgatcttccttagcctactgccactgaggcagtaggttttaggtggtatcgtagtgccttttgattaatttaagtatttaattttcatcttccttctttggatctatttggcctctcaaatgaactgagattcctgttaaaaaagattgatgttattgtctcttgtagaggaaactaataaagtgtgtgtacctgtgtga

SEQ ID NO: 250 - DNA, 1199 bp, Homo sapiens
gacttcggttccggtctctgcagcagccgtgatcgcttagtggagtgcttagggtagttggccaggatgccgaatatcaaaatcttcagcggcagctcccaccaggacttatctcagaaaattgctgaccgcctgggcctggagctaggcaaggtggtgactaagaaattcagcaaccaggagacctgtgtggaaattggtgaaagtgtacgtggagaggatgtctacattgttcagagtggttgtggcgaaatcaatgacaatttaatggagcttttgatcatgattaatgcctgcaagattgcttcagccagccgggttactgcagtcatcccatgcttcccttatgcccggcaggataagaaagataagagccgggcgccaatctcagccaagcttgttgcaaatatgctatctgtagcaggtgcagatcatattatcaccatggacctacatgcttctcaaattcagggcttttttgatatcccagtagacaatttgtatgcagagccggctgtcctaaagtggataagggagaatatctctgagtggaggaactgcactattgtctcacctgatgctggtggagctaagagagtgacctccattgcagacaggctgaatgtggactttgccttgattcacaaagaacggaagaaggccaatgaagtggaccgcatggtgcttgtgggagatgtgaaggatcgggtggccatccttgtggatgacatggctgacacttgtggcacaatctgccatgcagctgacaaacttctctcagctggcgccaccagagtttatgccatcttgactcatggaatcttctccggtcctgctatttctcgcatcaacaacgcatgctttgaggcagtagtagtcaccaataccatacctcaggaggacaagatgaagcattgctccaaaatacaggtgattgacatctctatgatccttgcagaagccatcaggagaactcacaatggagaatccgtttcttacctattcagccatgtccctttataatagagtaaggtatttgatgacaaattcagcagaagacccggcttgctccagtgtagctttctacatcccacatcaggtatattagagcttatccgaactggggaaagacggattgagattaactgctgggacctcctacctgcattatctcattctggcttccttgataattctgt

SEQ ID NO: 251 - DNA, 2999 bp, Homo sapiens
ggtacctcaagtctattgtagagacaattttaatatataagcattttgtgaaactgaccacagaacagcctgtggccaagcaagaacttgtggacttttggatggatttcctggtcgaggccacaaagacagatgttactgtggttaggtttccagtattaatattagaaccaaccaaaatctatcaaccttcttatttgtctatcaacaatgaagttgaggaaaagacaatctctatttggcacgtgcttcctgatgacaagaaaggtatacatgagtggaattttagtgcctcttctgtcaggggagtgagtatttctaaatttgaagaaagatgctgctttctttatgtgcttcacaattctgatgatttccaaatctatttctgtacagaacttcattgtaaaaagttttttgagatggtgaacaccattaccgaagagaaggggagaagcacagaggaaggagactgtgaaagtgacttgctggagatactctcagcccctgcatgaagaaatagcattgcataaacacctgaagcacaaaaatattgtccagtatctgggctctttcagtgagaatggtttcattaaaatcttcatggagcaggtccctggaggaagtctttctgctctccttcgttccaaatggggtccattaaaagacaatgagcaaacaattggcttttatacaaagcaaatactggaaggattaaaatatctccatgacaatcagatagttcaccgggacataaagggtgacaatgtgttgattaatacctacagtggtgttctcaagatctctgacttcggaacatcaaagaggcttgctggcataaacccctgtactgaaacttttactggtaccctccagtatatggcaccagaaataatagataaaggaccaagaggctacggaaaagcagcagacatctggtctctgggctgtacaatcattgaaatggccacaggaaaacccccattttatgaactgggagaaccacaagcagctatgttcaaggtgggaatgtttaaagtccaccctgagatcccagagtccatgtctgcagaggccaaggcattcatactgaaatgttttgaaccagatcctgacaagagagcctgtgctaacgacttgcttgttgatgagtttttaaaagtttcaagcaaaaagaaaaagacacaacctaagctttcagctctttcagctggatcaaatgaatatctcaggagtatatccttgccggtacctgtgctggtggaggacaccagcagcagcagtgagtacggctcagtttcacccgacacggagttgaaagtggaccccttctctttcaaaacaagagccaagtcctgcggagaaagagatgtcaagggaattcggacactctttttgggcattccagatgagaattttgaagatcacagtgctcctccttcccctgaagaaaaagattctggattcttcatgctgaggaaggacagtgagaggcgagctacccttcacaggatcctgacggaagaccaagacaaaattgtgagaaacctaatggaatctttagctcagggggctgaagaaccgaaactaaaatgggaacacatcacaaccctcattgcaagcctcagagaatttgtgagatccactgaccgaaaaatcatagccaccacactgtcaaagctgaaactggagctggacttcgacagccatggcattagccaagtccaggtggtactctttggttttcaagatgctgtcaataaagttcttcggaatcataacatcaagccgcactggatgtttgccttagacagtatcattcggaaggcggtacagacagccattaccatcctggttccagaactaaggccacatttcagccttgcatctgagagtgatactgctgatcaagaagacttggatgtagaagatgaccatgaggaacagccttcaaatcaaactgtccgaagacctcaggctgtcattgaagatgctgtggctacctcaggcgtgagcacgctcagttctactgtgtctcatgattcccagagtgctcaccggtcactgaatgtacagcttggaaggatgaaaatagaaaccaatagattactggaagaattggttcggaaagagaaagaattacaagcactccttcatcgagctattgaagaaaaagaccaagaaattaaacacctgaagcttaagtcccaacccatagaaattcctgaattgcctgtatttcatctaaattcttctggcacaaatactgaagattctgaacttaccgactggctgagagtgaatggagctgatgaagacactataagccggtttttggctgaagattatacactattggatgttctctactatgttacacgtgatgacttaaaatgcttgagactaaggggagggatgctgtgcacactgtggaaggctatcattgactttcgaaacaaacagacttgactgttgctcaatctaatcttcgatggaaattctaaaaattaatacagagctgatcttcttgggggtgggaaaatcgaagggagaggagaaaggcgctgcactttaaatccagtatttgtttactcatgttaaaaaaaaaaaaaacagacaaaacacactgaaatttcctaactacatctatttctataatttttaaggactcttcataaggactcttaaaataatcctgaacattagaaccctaatgttcaggaagattttaatctaagcatttttatggaaatatttttaatgcagcagctattgcacttcagccaaatgtttatttcacacaaaacggatgtaacatttcatgtgatcgtgcaccactggaacaaaaccaaaatgtgaccataactgtttaggcttctgtgtgtttgtaatatgctctaataatctgagtagaaatgcgtaatttcaattactgtataaagtttatgtttttttaagtgtgcagaatctgagagcaatggtttttacttctctgtgttaat

SEQ ID NO: 252 - DNA, 5197 bp, Homo sapiens
cgagcgcggcgcccttgagctgcaccgcggcgcaggtttgcgagccgacttgtcagccggccaagaaaaggaagctccgtcccttcccgctcacccggcttccccaccccttgtactctaaactctgcagagggcgagcggcgcggccacggaggcgccgaggaggagcgagccgccgccgggcagcggcgtgccctcgggggagagggcgccggagaggaggcggcggcgcggcggcgagggcgcggcgcgcgatggcagctgcttagcccggcgggcgcggagcagccccgagctgtggctggccaggcggtgcggctgggcgggggacgccgccgccgttgctgcccggcccggagagatgagcacggaggcggacgagggcatcactttctctgtgccacccttcgccccctcgggcttctgcaccatccccgagggcggcatctgcaggaggggaggagcggcggcggtgggcgagggcgaggagcaccagctgccaccgccgccgccgggcagcttctggaacgtggagagcgccgctgcccctggcatcggttgtccggcggccacctcctcgagcagtgccacccgaggccggggcagctctgttggcgggggcagccgacggaccacggtggcatatgtgatcaacgaagcgagccaagggcaactggtggtggccgagagcgaggccctgcagagcttgcgggaggcgtgcgagacagtgggcgccaccctggaaaccctgcattttgggaaactcgactttggagaaaccaccgtgctggaccgcttttacaatgcagatattgcggtggtggagatgagcgatgccttccggcagccgtccttgttttaccaccttggggtgagagaaagtttcagcatggccaacaacatcatcctctactgtgatactaactcggactctctgcagtcactgaaggaaataatttgccagaagaatactatgtgcactgggaactacacctttgttccttacatgataactccacataacaaagtctactgctgtgacagcagcttcatgaaggggttgacagagctcatgcaaccgaacttcgagctgcttcttggacccatctgcttacctcttgtggatcgttttattcaacttttgaaggtggcacaagcaagttctagccagtacttccgggaatctatactcaatgacatcaggaaagctcgtaatttatacactggtaaagaattggcagctgagttggcaagaattcggcagcgagtagataatatcgaagtcttgacagcagatattgtcataaatctgttactttcctacagagatatccaggactatgattctattgtgaagctggtagagactttagaaaaactgccaacctttgatttggcctcccatcaccatgtgaagtttcattatgcatttgcactgaataggagaaatctccctggtgacagagcaaaagctcttgatattatgattcccatggtgcaaagcgaaggacaagttgcttcagatatgtattgcctagttggtcgaatctacaaagatatgtttttggactctaatttcacggacactgaaagcagagaccatggagcttcttggttcaaaaaggcatttgaatctgagccaacactacagtcaggaattaattatgcggtcctcctcctggcagctggacaccagtttgaatcttcctttgagctccggaaagttggggtgaagctaagtagtcttcttggtaaaaagggaaacttggaaaaactccagagctactgggaagttggattttttctgggggccagcgtcctagccaatgaccacatgagagtcattcaagcatctgaaaagctttttaaactgaagacaccagcatggtacctcaagtctattgtagagacaattttaatatataagcattttgtgaaactgaccacagaacagcctgtggccaagcaagaacttgtggacttttggatggatttcctggtcgaggccacaaagacagatgttactgtggttaggtttccagtattaatattagaaccaaccaaaatctatcaaccttcttatttgtctatcaacaatgaagttgaggaaaagacaatctctatttggcacgtgcttcctgatgacaagaaaggtatacatgagtggaattttagtgcctcttctgtcaggggagtgagtatttctaaatttgaagaaagatgctgctttctttatgtgcttcacaattctgatgatttccaaatctatttctgtacagaacttcattgtaaaaagttttttgagatggtgaacaccattaccgaagagaaggggagaagcacagaggaaggagactgtgaaagtgacttgctggagtatgactatgaatatgatgaaaatggtgacagagtcgttttaggaaaaggcacttatgggatagtctacgcaggtcgggacttgagcaaccaagtcagaattgctattaaggaaatcccagagagagacagcagatactctcagcccctgcatgaagaaatagcattgcataaacacctgaagcacaaaaatattgtccagtatctgggctctttcagtgagaatggtttcattaaaatcttcatggagcaggtccctggaggaagtctttctgctctccttcgttccaaatggggtccattaaaagacaatgagcaaacaattggcttttatacaaagcaaatactggaaggattaaaatatctccatgacaatcagatagttcaccgggacataaagggtgacaatgtgttgattaatacctacagtggtgttctcaagatctctgacttcggaacatcaaagaggcttgctggcataaacccctgtactgaaacttttactggtaccctccagtatatggcaccagaaataatagataaaggaccaagaggctacggaaaagcagcagacatctggtctctgggctgtacaatcattgaaatggccacaggaaaacccccattttatgaactgggagaaccacaagcagctatgttcaaggtgggaatgtttaaagtccaccctgagatcccagagtccatgtctgcagaggccaaggcattcatactgaaatgttttgaaccagatcctgacaagagagcctgtgctaacgacttgcttgttgatgagtttttaaaagtttcaagcaaaaagaaaaagacacaacctaagctttcagctctttcagctggatcaaatgaatatctcaggagtatatccttgccggtacctgtgctggtggaggacaccagcagcagcagtgagtacggctcagtttcacccgacacggagttgaaagtggaccccttctctttcaaaacaagagccaagtcctgcggagaaagagatgtcaagggaattcggacactctttttgggcattccagatgagaattttgaagatcacagtgctcctccttcccctgaagaaaaagattctggattcttcatgctgaggaaggacagtgagaggcgagctacccttcacaggatcctgacggaagaccaagacaaaattgtgagaaacctaatggaatctttagctcagggggctgaagaaccgaaactaaaatgggaacacatcacaaccctcattgcaagcctcagagaatttgtgagatccactgaccgaaaaatcatagccaccacactgtcaaagctgaaactggagctggacttcgacagccatggcattagccaagtccaggtggtactctttggttttcaagatgctgtcaataaagttcttcggaatcataacatcaagccgcactggatgtttgccttagacagtatcattcggaaggcggtacagacagccattaccatcctggttccagaactaaggccacatttcagccttgcatctgagagtgatactgctgatcaagaagacttggatgtagaagatgaccatgaggaacagccttcaaatcaaactgtccgaagacctcaggctgtcattgaagatgctgtggctacctcaggcgtgagcacgctcagttctactgtgtctcatgattcccagagtgctcaccggtcactgaatgtacagcttggaaggatgaaaatagaaaccaatagattactggaagaattggttcggaaagagaaagaattacaagcactccttcatcgagctattgaagaaaaagaccaagaaattaaacacctgaagcttaagtcccaacccatagaaattcctgaattgcctgtatttcatctaaattcttctggcacaaatactgaagattctgaacttaccgactggctgagagtgaatggagctgatgaagacactataagccggtttttggctgaagattatacactattggatgttctctactatgttacacgtgatgacttaaaatgcttgagactaaggggagggatgctgtgcacactgtggaaggctatcattgactttcgaaacaaacagacttgactgttgctcaatctaatcttcgatggaaattctaaaaattaatacagagctgatcttcttgggggtgggaaaatcgaagggagaggagaaaggcgctgcactttaaatccagtatttgtttactcatgttaaaaaaaaaaaaaacagacaaaacacactgaaatttcctaactacatctatttctataatttttaaggactcttcataaggactcttaaaataatcctgaacattagaaccctaatgttcaggaagattttaatctaagcatttttatggaaatatttttaatgcagcagctattgcacttcagccaaatgtttatttcacacaaaacggatgtaacatttcatgtgatcgtgcaccactggaacaaaaccaaaatgtgaccataactgtttaggcttctgtgtgtttgtaatatgctctaataatctgagtagaaatgcgtaatttcaattactgtataaagtttatgtttttttaagtgtgcagaatctgagagcaatggtttttacttctctgtgttaattgtaatattgactctattttgtaacttaagtttctgacctgtcgtacatttgtttgagtcgtttatgtactactgaactgtaccagttgcacatgcttgaactgtagtaatgttagcttgttctaaagctatccattgtgtcatatttactctaaaaattaaagagactctcaacata

SEQ ID NO: 253 - DNA, 3889 bp, Homo sapiens
cgagcgcggcgcccttgagctgcaccgcggcgcaggtttgcgagccgacttgtcagccggccaagaaaaggaagctccgtcccttcccgctcacccggcttccccaccccttgtactctaaactctgcagagggcgagcggcgcggccacggaggcgccgaggaggagcgagccgccgccgggcagcggcgtgccctcgggggagagggcgccggagaggaggcggcggcgcggcggcgagggcgcggcgcgcgatggcagctgcttagcccggcgggcgcggagcagccccgagctgtggctggccaggcggtgcggctgggcgggggacgccgccgccgttgctgcccggcccggagagatgagcacggaggcggacgagggcatcactttctctgtgccacccttcgccccctcgggcttctgcaccatccccgagggcggcatctgcaggaggggaggagcggcggcggtgggcgagggcgaggagcaccagctgccaccgccgccgccgggcagcttctggaacgtggagagcgccgctgcccctggcatcggttgtccggcggccacctcctcgagcagtgccacccgaggccggggcagctctgttggcgggggcagccgacggaccacggtggcatatgtgatcaacgaagcgagccaagggcaactggtggtggccgagagcgaggccctgcagagcttgcgggaggcgtgcgagacagtgggcgccaccctggaaaccctgcattttgggaaactcgactttggagaaaccaccgtgctggaccgcttttacaatgcagatattgcggtggtggagatgagcgatgccttccggcagccgtccttgttttaccaccttggggtgagagaaagtttcagcatggccaacaacatcatcctctactgtgatactaactcggactctctgcagtcactgaaggaaataatttgccagaagaatactatgtgcactgggaactacacctttgttccttacatgataactccacataacaaagtctactgctgtgacagcagcttcatgaaggggttgacagagctcatgcaaccgaacttcgagctgcttcttggacccatctgcttacctcttgtggatcgttttattcaacttttgaaggtggcacaagcaagttctagccagtacttccgggaatctatactcaatgacatcaggaaagctcgtaatttatacactggtaaagaattggcagctgagttggcaagaattcggcagcgagtagataatatcgaagtcttgacagcagatattgtcataaatctgttactttcctacagagatatccaggactatgattctattgtgaagctggtagagactttagaaaaactgccaacctttgatttggcctcccatcaccatgtgaagtttcattatgcatttgcactgaataggagaaatctccctggtgacagagcaaaagctcttgatattatgattcccatggtgcaaagcgaaggacaagttgcttcagatatgtattgcctagttggtcgaatctacaaagatatgtttttggactctaatttcacggacactgaaagcagagaccatggagcttcttggttcaaaaaggcatttgaatctgagccaacactacagtcaggaattaattatgcggtcctcctcctggcagctggacaccagtttgaatcttcctttgagctccggaaagttggggtgaagctaagtagtcttcttggtaaaaagggaaacttggaaaaactccagagctactgggaagttggattttttctgggggccagcgtcctagccaatgaccacatgagagtcattcaagcatctgaaaagctttttaaactgaagacaccagcatggtacctcaagtctattgtagagacaattttaatatataagcattttgtgaaactgaccacagaacagcctgtggccaagcaagaacttgtggacttttggatggatttcctggtcgaggccacaaagacagatgttactgtggttaggtttccagtattaatattagaaccaaccaaaatctatcaaccttcttatttgtctatcaacaatgaagttgaggaaaagacaatctctatttggcacgtgcttcctgatgacaagaaaggtatacatgagtggaattttagtgcctcttctgtcaggggagtgagtatttctaaatttgaagaaagatgctgctttctttatgtgcttcacaattctgatgatttccaaatctatttctgtacagaacttcattgtaaaaagttttttgagatggtgaacaccattaccgaagagaaggggagaagcacagaggaaggagactgtgaaagtgacttgctggagtatgactatgaatatgatgaaaatggtgacagagtcgttttaggaaaaggcacttatgggatagtctacgcaggtcgggacttgagcaaccaagtcagaattgctattaaggaaatcccagagagagacagcagatactctcagcccctgcatgaagaaatagcattgcataaacacctgaagcacaaaaatattgtccagtatctgggctctttcagtgagaatggtttcattaaaatcttcatggagcaggtccctggaggaagtctttctgctctccttcgttccaaatggggtccattaaaagacaatgagcaaacaattggcttttatacaaagcaaatactggaaggattaaaatatctccatgacaatcagatagttcaccgggacataaagggtgacaatgtgttgattaatacctacagtggtgttctcaagatctctgacttcggaacatcaaagaggcttgctggcataaacccctgtactgaaacttttactggtaccctccagtatatggcaccagaaataatagataaaggaccaagaggctacggaaaagcagcagacatctggtctctgggctgtacaatcattgaaatggccacaggaaaacccccattttatgaactgggagaaccacaagcagctatgttcaaggtgggaatgtttaaagtccaccctgagatcccagagtccatgtctgcagaggccaaggcattcatactgaaatgttttgaaccagatcctgacaagagagcctgtgctaacgacttgcttgttgatgagtttttaaaagtttcaagcaaaaagaaaaagacacaacctaagctttcagatctgtccatagcacaagcagaatatctcaggagtatatccttgccggtacctgtgctggtggaggacaccagcagcagcagtgagtacggctcagtttcacccgacacggagttgaaagtggaccccttctctttcaaaacaagagccaagtcctgcggagaaagagatgtcaagggaattcggacactctttttgggcattccagatgagaattttgaagatcacagtgctcctccttcccctgaagaaaaagattctggattcttcatgctgaggaaggacagtgagaggcgagctacccttcacaggatcctgacggaagaccaagacaaaattgtgagaaacctaatggaatctttagctcagggggctgaagaaccgaaactaaaatgggaacacatcacaaccctcattgcaagcctcagagaatttgtgagatccactgaccgaaaaatcatagccaccacactgtcaaagctgaaactggagctggacttcgacagccatggcattagccaagtccaggtggtactctttggttttcaagatgctgtcaataaagttcttcggaatcataacatcaagccgcactggatgtttgccttagacagtatcattcggaaggcggtacagacagccattaccatcctggttccaggaataaagccc

SEQ ID NO: 254 - DNA, 929 bp, Homo sapiens
cggcaggcccgggtcaggggcctcgagatcgggcttgggcccagagcatgttccagatcccagagtttgagccgagtgagcaggaagactccagctctgcagagaggggcctgggccccagccccgcaggggacgggccctcaggctccggcaagcatcatcgccaggccccaggcctcctgtgggacgccagtcaccagcaggagcagccaaccagcagcagccatcatggaggcgctggggctgtggagatccggagtcgccacagctcctaccccgcggggacggaggacgacgaagggatgggggaggagcccagcccctttcggggccgctcgcgctcggcgccccccaacctctgggcagcacagcgctatggccgcgagctccggaggatgagtgacgagtttgtggactcctttaagaagggacttcctcgcccgaagagcgcgggcacagcaacgcagatgcggcaaagctccagctggacgcgagtcttccagtcctggtgggatcggaacttgggcaggggaagctccgccccctcccagtgaccttcgctccacatcccgaaactccacccgttcccactgccctgggcagccatcttgaatatgggcggaagtacttccctcaggcctatgcaaaaagaggatccgtgctgtctcctttggagggagggctgacccagattcccttccggtgcgtgtgaagccacggaaggcttggtcccatcggaagttttgggttttccgcccacagccgccggaagtggctccgtggccccgccctcaggctccgggctttcccccaggcgcctgcgctaagtcgcgagccaggtttaaccgttgcgtcaccgggacccgagcccccgcgatgccctgggggccgtgctcactaccaaatgttaataaagcccgcgtctgtgc

SEQ ID NO: 255 - DNA, 1157 bp, Homo sapiens
gggcttggggtgagacctgtgcgccgtcaccacgggcggggcggggcctgggtccaccggggttctgaggggagactgaggtcctgagccgacagcctcagctccctgccaggccagacccggcagacagatgagggcccaggaggcctggcgggcctgggggcgctacggtgggagaggaagccaggggtacctgcctctgccttccagggccaccgttggccccagctgtgccttgactacgtaacatcttgtcctcacagcccagagcatgttccagatcccagagtttgagccgagtgagcaggaagactccagctctgcagagaggggcctgggccccagccccgcaggggacgggccctcaggctccggcaagcatcatcgccaggccccaggcctcctgtgggacgccagtcaccagcaggagcagccaaccagcagcagccatcatggaggcgctggggctgtggagatccggagtcgccacagctcctaccccgcggggacggaggacgacgaagggatgggggaggagcccagcccctttcggggccgctcgcgctcggcgccccccaacctctgggcagcacagcgctatggccgcgagctccggaggatgagtgacgagtttgtggactcctttaagaagggacttcctcgcccgaagagcgcgggcacagcaacgcagatgcggcaaagctccagctggacgcgagtcttccagtcctggtgggatcggaacttgggcaggggaagctccgccccctcccagtgaccttcgctccacatcccgaaactccacccgttcccactgccctgggcagccatcttgaatatgggcggaagtacttccctcaggcctatgcaaaaagaggatccgtgctgtctcctttggagggagggctgacccagattcccttccggtgcgtgtgaagccacggaaggcttggtcccatcggaagttttgggttttccgcccacagccgccggaagtggctccgtggccccgccctcaggctccgggctttcccccaggcgcctgcgctaagtcgcgagccaggtttaaccgttgcgtcaccgggacccgagcccccgcgatgccctgggggccgtgctcactaccaaatgttaataaagcccgcgtctgtgccgcc

SEQ ID NO: 256 - DNA, 634 bp, Homo sapiens
actagggcccggagcccggggtgctggagggaggcggcaggcccgggtcaggggcctcgagatcgggcttgggcccagagcatgttccagatcccagagtttgagccgagtgagcaggaagactccagctctgcagagaggggcctgggccccagccccgcaggggacgggccctcaggctccggcaagcatcatcgccaggccccaggcctcctgtgggacgccagtcaccagcaggagcagccaaccagcagcagccatcatggaggcgctggggctgtggagatccggagtcgccacagctcctaccccgcggggacggaggacgacgaagggatgggggaggagcccagcccctttcggggccgctcgcgctcggcgccccccaacctctgggcagcacagcgctatggccgcgagctccggaggatgagtgacgagtttgtggactcctttaagaagggacttcctcgcccgaagagcgcgggcacagcaacgcagatgcggcaaagctccaggcgcctgcgctaagtcgcgagccaggtttaaccgttgcgtcaccgggacccgagcccccgcgatgccctgggggccgtgctcactaccaaatgttaataaagcccgcgtctgtgcc

SEQ ID NO: 257 - DNA, 1135 bp, Homo sapiens
aggggtagagatgcagaaaggcagaaaggagaaaattcaggataactctcctgaggggtgagccaagccctgccatgtagtgcacgcaggacatcaacaaacacagataacaggaaatgatccattccctgtggtcacttattctaaaggccccaaccttcaaagttcaagtagtgatatggatgactccacagaaagggagcagtcacgccttacttcttgccttaagaaaagagaagaaatgaaactgaaggagtgtgtttccatcctcccacggaaggaaagcccctctgtccgatcctccaaagacggaaagctgctggctgcaaccttgctgctggcactgctgtcttgctgcctcacggtggtgtctttctaccaggtggccgccctgcaaggggacctggccagcctccgggcagagctgcagggccaccacgcggagaagctgccagcaggagcaggagcccccaaggccggcctggaggaagctccagctgtcaccgcgggactgaaaatctttgaaccaccagctccaggagaaggcaactccagtcagaacagcagaaataagcgtgccgttcagggtccagaagaaacagtcactcaagactgcttgcaactgattgcagacagtgaaacaccaactatacaaaaaggatcttacacatttgttccatggcttctcagctttaaaaggggaagtgccctagaagaaaaagagaataaaatattggtcaaagaaactggttacttttttatatatggtcaggttttatatactgataagacctacgccatgggacatctaattcagaggaagaaggtccatgtctttggggatgaattgagtctggtgactttgtttcgatgtattcaaaatatgcctgaaacactacccaataattcctgctattcagctggcattgcaaaactggaagaaggagatgaactccaacttgcaataccaagagaaaatgcacaaatatcactggatggagatgtcacattttttggtgcattgaaactgctgtgacctacttacaccatgtctgtagctattttcctccctttctctgtacctctaagaagaaagaatctaactgaaaataccaaaaaaaaaaaaaaaaaaaaa

SEQ ID NO: 258 - DNA, 1147 bp, Homo sapiens
gaaattcttacaaaaactgaaagtgaaatgaggaagacagattgagcaatccaatcggagggtaaatgccagcaaacctactgtacagtaggggtagagatgcagaaaggcagaaaggagaaaattcaggataactctcctgaggggtgagccaagccctgccatgtagtgcacgcaggacatcaacaaacacagataacaggaaatgatccattccctgtggtcacttattctaaaggccccaaccttcaaagttcaagtagtgatatggatgactccacagaaagggagcagtcacgccttacttcttgccttaagaaaagagaagaaatgaaactgaaggagtgtgtttccatcctcccacggaaggaaagcccctctgtccgatcctccaaagacggaaagctgctggctgcaaccttgctgctggcactgctgtcttgctgcctcacggtggtgtctttctaccaggtggccgccctgcaaggggacctggccagcctccgggcagagctgcagggccaccacgcggagaagctgccagcaggagcaggagcccccaaggccggcctggaggaagctccagctgtcaccgcgggactgaaaatctttgaaccaccagctccaggagaaggcaactccagtcagaacagcagaaataagcgtgccgttcagggtccagaagaaacaggatcttacacatttgttccatggcttctcagctttaaaaggggaagtgccctagaagaaaaagagaataaaatattggtcaaagaaactggttacttttttatatatggtcaggttttatatactgataagacctacgccatgggacatctaattcagaggaagaaggtccatgtctttggggatgaattgagtctggtgactttgtttcgatgtattcaaaatatgcctgaaacactacccaataattcctgctattcagctggcattgcaaaactggaagaaggagatgaactccaacttgcaataccaagagaaaatgcacaaatatcactggatggagatgtcacattttttggtgcattgaaactgctgtgacctacttacaccatgtctgtagctattttcctccctttctctgtacctctaagaagaaagaatctaactgaaaatacca

SEQ ID NO: 259 - DNA, 495 bp, Homo sapiens
atggatgactccacagaaagggagcagtcacgccttacttcttgccttaagaaaagagaagaaatgaaactgaaggagtgtgtttccatcctcccacggaaggaaagcccctctgtccgatcctccaaagacggaaagctgctggctgcaaccttgctgctggcactgctgtcttgctgcctcacggtggtgtctttctaccaggtggccgccctgcaaggggacctggccagcctccgggcagagctgcagggccaccacgcggagaagctgccagcaggagcaggagcccccaaggccggcctggaggaagctccagctgtcaccgcgggactgaaaatctttgaaccaccagctccaggagaaggcaactccagtcagaacagcagaaataagcgtgccgttcagggtccagaagaaacagtcactcaagactgcttgcaactgattgcagacagtgaaacaccaactatacaaaaaggttttatatactga

SEQ ID NO: 260 - DNA, 1321 bp, Homo sapiens
atgatcactggagtctcgcgggtccctcgggctgcacagggacaagtaaaggctacatccagatgccgggaatgcactgacgcccattcctggaaactgggctcccactcagcccctgggagcagcagccgccagcccctcgggacctccatctccaccctgctgagccacccgggttgggccaggatcccggcagacttcactgggacccatgctggagtaagaataaaaagtcccagaggaggccaggcacggtggctcacacctgtaatcccagcactgtggatggccgaggcagactcacgaggctgatcccgtcctccactgagacctgaaaaatggcttcggggcaaggcccaggtcctcccaggcaggagtgcggagagcctgccctgccctctgcttctgaggagcaggtagcccaggacacagaggaggttttccgcagctacgttttttaccgccatcagcaggaacaggaggctgaaggggtggctgcccctgccgacccagagatggtcaccttacctctgcaacctagcagcaccatggggcaggtgggacggcagctcgccatcatcggggacgacatcaaccgacgctatgactcagagttccagaccatgttgcagcacctgcagcccacggcagagaatgcctatgagtacttcaccaagattgccaccagcctgtttgagagtggcatcaattggggccgtgtggtggctcttctgggcttcggctaccgtctggccctacacgtctaccagcatggcctgactggcttcctaggccaggtgacccgcttcgtggtcgacttcatgctgcatcactgcattgcccggtggattgcacagaggggtggctgggtggcagccctgaacttgggcaatggtcccatcctgaacgtgctggtggttctgggtgtggttctgttgggccagtttgtggtacgaagattcttcaaatcatgactcccaagggtgccctttggggtcccggttcagacccctgcctggacttaagcgaagtctttgccttctctgttcccttgcaggggtcccccctcaagagtacagaagctttagcaagtgtgcactccagcttcggagggcccctgcgtgggggccagtcaggctgcagaggcacctcaacattgcatggtgctagtgggccctctctctgggcccaggggctgtggccgtctcctccctcagctctctgggacctccttagccctgtctgctaggcgctggggagactgataacttggggaggcaagagactgggagccacttctccccagaaagtgtttaacggt

SEQ ID NO: 261 - DNA, 2132 bp, Homo sapiens
gtctgcatccggtggccacagagcaacttcctctagagggagctgattggagccgggtgccgctggcacctctatgatcactggagtctcgcgggtccctcgggctgcacagggacaagtaaaggctacatccagatgccgggaatgcactgacgcccattcctggaaactgggctcccactcagcccctgggagcagcagccgccagcccctcgggacctccatctccaccctgctgagccacccgggttgggccaggatcccggcaggctgatcccgtcctccactgagacctgaaaaatggcttcggggcaaggcccaggtcctcccaggcaggagtgcggagagcctgccctgccctctgcttctgaggagcaggtagcccaggacacagaggaggttttccgcagctacgttttttaccgccatcagcagcaacctagcagcaccatggggcaggtgggacggcagctcgccatcatcggggacgacatcaaccgacgctatgactcagagttccagaccatgttgcagcacctgcagcccacggcagagaatgcctatgagtacttcaccaagattgccaccagcctgtttgagagtggcatcaattggggccgtgtggtggctcttctgggcttcggctaccgtctggccctacacgtctaccagcatggcctgactggcttcctaggccaggtgacccgcttcgtggtcgacttcatgctgcatcactgcattgcccggtggattgcacagaggggtggctgggtggcagccctgaacttgggcaatggtcccatcctgaacgtgctggtggttctgggtgtggttctgttgggccagtttgtggtacgaagattcttcaaatcatgactcccaagggtgccctttggggtcccggttcagacccctgcctggacttaagcgaagtctttgccttctctgttcccttgcaggggtcccccctcaagagtacagaagctttagcaagtgtgcactccagcttcggagggcccctgcgtgggggccagtcaggctgcagaggcacctcaacattgcatggtgctagtgggccctctctctgggcccaggggctgtggccgtctcctccctcagctctctgggacctccttagccctgtctgctaggcgctggggagactgataacttggggaggcaagagactgggagccacttctccccagaaagtgtttaacggttttagctttttataatacccttgtgagagcccattcccaccattctacctgaggccaggacgtctggggtgtggggattggtgggtctatgttccccaggattcagctattctggaagatcagcaccctaagagatgggactaggacctgagcctggtcctggccgtccctaagcatgtgtcccaggagcaggacctactaggagaggggggccaaggtcctgctcaactctacccctgctcccattcctccctccggccatactgcctttgcagttggactctcagggattctgggcttggggtgtggggtggggtggagtcgcagaccagagctgtctgaactcacgtgtcagaagcctccaagcctgcctcccaaggtcctctcagttctctcccttcctctctccttatagacacttgctcccaacccattcactacaggtgaaggctctcacccccatccctgggggccttgggtgagtggcctgctaaggctcctccttgcccagactacagggcttaggacttggtttgttatatcagggaaaaggagtagggagttcatctggagggttctaagtgggagaaggactatcaacaccactaggaatcccagaggtgggatcctccctcatggctctggcacagtgtaatccaggggtgtagatgggggaactgtgaatacttgaactctgttcccccaccctccatgctcctcacctgtctaggtctcctcagggtggggggtgacagtgccttctctattgggcacagcctagggtcttgggggtcaggggggagaagttcttgattcagccaaatgcagggaggggaggcagatggagcccataggccaccccctatcctctgagtgtttggaaataaactgtgcaatcccctcaccctg

SEQ ID NO: 262 - DNA, 2136 bp, Homo sapiens
gccgggtgccgctggcacctctatgatcactggagtctcgcgggtccctcgggctgcacagggacaagtaaaggctacatccagatgccgggaatgcactgacgcccattcctggaaactgggctcccactcagcccctgggagcagcagccgccagcccctcgggacctccatctccaccctgctgagccacccgggttgggccaggatcccggcaggctgatcccgtcctccactgagacctgaaaaatggcttcggggcaaggcccaggtcctcccaggcaggagtgcggagagcctgccctgccctctgcttctgaggagcaggtagcccaggacacagaggaggttttccgcagctacgttttttaccgccatcagcaggaacaggaggctgaaggggtggctgcccctgccgacccagagatggtcaccttacctctgcaacctagcagcaccatggggcaggtgggacggcagctcgccatcatcggggacgacatcaaccgacgctatgactcagagttccagaccatgttgcagcacctgcagcccacggcagagaatgcctatgagtacttcaccaagattgccaccagcctgtttgagagtggcatcaattggggccgtgtggtggctcttctgggcttcggctaccgtctggccctacacgtctaccagcatggcctgactggcttcctaggccaggtgacccgcttcgtggtcgacttcatgctgcatcactgcattgcccggtggattgcacagaggggtggctgggtggcagccctgaacttgggcaatggtcccatcctgaacgtgctggtggttctgggtgtggttctgttgggccagtttgtggtacgaagattcttcaaatcatgactcccaagggtgccctttggggtcccggttcagacccctgcctggacttaagcgaagtctttgccttctctgttcccttgcaggggtcccccctcaagagtacagaagctttagcaagtgtgcactccagcttcggagggcccctgcgtgggggccagtcaggctgcagaggcacctcaacattgcatggtgctagtgggccctctctctgggcccaggggctgtggccgtctcctccctcagctctctgggacctccttagccctgtctgctaggcgctggggagactgataacttggggaggcaagagactgggagccacttctccccagaaagtgtttaacggttttagctttttataatacccttgtgagagcccattcccaccattctacctgaggccaggacgtctggggtgtggggattggtgggtctatgttccccaggattcagctattctggaagatcagcaccctaagagatgggactaggacctgagcctggtcctggccgtccctaagcatgtgtcccaggagcaggacctactaggagaggggggccaaggtcctgctcaactctacccctgctcccattcctccctccggccatactgcctttgcagttggactctcagggattctgggcttggggtgtggggtggggtggagtcgcagaccagagctgtctgaactcacgtgtcagaagcctccaagcctgcctcccaaggtcctctcagttctctcccttcctctctccttatagacacttgctcccaacccattcactacaggtgaaggctctcacccccatccctgggggccttgggtgagtggcctgctaaggctcctccttgcccagactacagggcttaggacttggtttgttatatcagggaaaaggagtagggagttcatctggagggttctaagtgggagaaggactatcaacaccactaggaatcccagaggtgggatcctccctcatggctctggcacagtgtaatccaggggtgtagatgggggaactgtgaatacttgaactctgttcccccaccctccatgctcctcacctgtctaggtctcctcagggtggggggtgacagtgccttctctattgggcacagcctagggtcttgggggtcaggggggagaagttcttgattcagccaaatgcagggaggggaggcagatggagcccataggccaccccctatcctctgagtgtttggaaataaactgtgcaatcccctca

SEQ ID NO: 263 - DNA, 2117 bp, Homo sapiens
cgcgggtccctcgggctgcacagggacaagtaaaggctacatccagatgccgggaatgcactgacgcccattcctggaaactgggctcccactcagcccctgggagcagcagccgccagcccctcgggacctccatctccaccctgctgagccacccgggttgggccaggatcccggcaggctgatcccgtcctccactgagacctgaaaaatggcttcggggcaaggcccaggtcctcccaggcaggagtgcggagagcctgccctgccctctgcttctgaggagcaggtagcccaggacacagaggaggttttccgcagctacgttttttaccgccatcagcaggaacaggaggctgaaggggtggctgcccctgccgacccagagatggtcaccttacctctgcaacctagcagcaccatggggcaggtgggacggcagctcgccatcatcggggacgacatcaaccgacgctatgactcagagttccagaccatgttgcagcacctgcagcccacggcagagaatgcctatgagtacttcaccaagattgccaccaggccagcagcaacacccacagcctgtttgagagtggcatcaattggggccgtgtggtggctcttctgggcttcggctaccgtctggccctacacgtctaccagcatggcctgactggcttcctaggccaggtgacccgcttcgtggtcgacttcatgctgcatcactgcattgcccggtggattgcacagaggggtggctgggtggcagccctgaacttgggcaatggtcccatcctgaacgtgctggtggttctgggtgtggttctgttgggccagtttgtggtacgaagattcttcaaatcatgactcccaagggtgccctttggggtcccggttcagacccctgcctggacttaagcgaagtctttgccttctctgttcccttgcaggggtcccccctcaagagtacagaagctttagcaagtgtgcactccagcttcggagggcccctgcgtgggggccagtcaggctgcagaggcacctcaacattgcatggtgctagtgggccctctctctgggcccaggggctgtggccgtctcctccctcagctctctgggacctccttagccctgtctgctaggcgctggggagactgataacttggggaggcaagagactgggagccacttctccccagaaagtgtttaacggttttagctttttataatacccttgtgagagcccattcccaccattctacctgaggccaggacgtctggggtgtggggattggtgggtctatgttccccaggattcagctattctggaagatcagcaccctaagagatgggactaggacctgagcctggtcctggccgtccctaagcatgtgtcccaggagcaggacctactaggagaggggggccaaggtcctgctcaactctacccctgctcccattcctccctccggccatactgcctttgcagttggactctcagggattctgggcttggggtgtggggtggggtggagtcgcagaccagagctgtctgaactcacgtgtcagaagcctccaagcctgcctcccaaggtcctctcagttctctcccttcctctctccttatagacacttgctcccaacccattcactacaggtgaaggctctcacccccatccctgggggccttgggtgagtggcctgctaaggctcctccttgcccagactacagggcttaggacttggtttgttatatcagggaaaaggagtagggagttcatctggagggttctaagtgggagaaggactatcaacaccactaggaatcccagaggtgggatcctccctcatggctctggcacagtgtaatccaggggtgtagatgggggaactgtgaatacttgaactctgttcccccaccctccatgctcctcacctgtctaggtctcctcagggtggggggtgacagtgccttctctattgggcacagcctagggtcttgggggtcaggggggagaagttcttgattcagccaaatgcagggaggggaggcagatggagcccataggccaccccctatcctctgagtgtttggaaataaactgtgcaatcccctc

SEQ ID NO: 264 - DNA, 1358 bp, Homo sapiens
atggacgggtccggggagcagcccagaggcggggggcccaccagctctgagcagatcatgaagacaggggcccttttgcttcagggtttcatccaggatcgagcagggcgaatggggggggaggcacccgagctggccctggacccggtgcctcaggatgcgtccaccaagaagctgagcgagtgtctcaagcgcatcggggacgaactggacagtaacatggagctgcagaggatgattgccgccgtggacacagactccccccgagaggtctttttccgagtggcagctgacatgttttctgacggcaacttcaactggggccgggttgtcgcccttttctactttgccagcaaactggtgctcaaggccctgtgcaccaaggtgccggaactgatcagaaccatcatgggctggacattggacttcctccgggagcggctgttgggctggatccaagaccagggtggttgggtgagactcctcaagcctcctcacccccaccaccgcgccctcaccaccgcccctgccccaccgtccctgccccccgccactcctctgggaccctgggccttctggagcaggtcacagtggtgccctctccccatcttcagatcatcagatgtggtctataatgcgttttccttacgtgtctgatcaatccccgattcatctaccctgctgacctcccagtgacccctgacctcactgtgaccttgacttgattagtgccttctgccctccctggagcctccactgcctctggaattgctcaagttcattgatgaccctctgaccctagctctttcctttttttttttttccccactgagaaggggtctcgctatgttgcccaggttggtctcgaactcctggcctcaagcgatcctcccgcctcagcctctcaaagtgctgggattacaggtgtgagccaccatgcctggcctgagtccagctctttaatgcccgttcatctcagtcccctgcccgcaatcctgccttctggcctcctccgtccctgatcccgcctctgcctgcccaggggctgcccctggccgagtcactgaagcgactgatgtccctgtctccaggacggcctcctctcctactttgggacgcccacgtggcagaccgtgaccatctttgtggcgggagtgctcaccgcctcactcaccatctggaagaagatgggctgaggcccccagctgccttggactgtgtttttcctccataaattatggcatttttctgggaggggtggggattgggggacgtgggcatttttcttacttttgtaattattggggggtgtggggaagagtggtcttgagggggtaataaacctccttcgggacaca

SEQ ID NO: 265 - DNA, 793 bp, Homo sapiens
gctgcggccgcccgcgcggacccggcgagaggcggcggcgggagcggcggtgatggacgggtccggggagcagcccagaggcggggggcccaccagctctgagcagatcatgaagacaggggcccttttgcttcagggtttcatccaggatcgagcagggcgaatggggggggaggcacccgagctggccctggacccggtgcctcaggatgcgtccaccaagaagctgagcgagtgtctcaagcgcatcggggacgaactggacagtaacatggagctgcagaggatgattgccgccgtggacacagactccccccgagaggtctttttccgagtggcagctgacatgttttctgacggcaacttcaactggggccgggttgtcgcccttttctactttgccagcaaactggtgctcaaggccctgtgcaccaaggtgccggaactgatcagaaccatcatgggctggacattggacttcctccgggagcggctgttgggctggatccaagaccagggtggttgggacggcctcctctcctactttgggacgcccacgtggcagaccgtgaccatctttgtggcgggagtgctcaccgcctcactcaccatctggaagaagatgggctgaggcccccagctgccttggactgtgtttttcctccataaattatggcatttttctgggaggggtggggattgggggacgtgggcatttttcttacttttgtaattattggggggtgtggggaagagtggtcttgagggggtaataaacctccttcgggacaca

SEQ ID NO: 266 - DNA, 433 bp, Homo sapiens
atggacgggtccggggagcagcccagaggcggggggcccaccagctctgagcagatcatgaagacaggggcccttttgcttcaggggatgattgccgccgtggacacagactccccccgagaggtctttttccgagtggcagctgacatgttttctgacggcaacttcaactggggccgggttgtcgcccttttctactttgccagcaaactggtgctcaaggccctgtgcaccaaggtgccggaactgatcagaaccatcatgggctggacattggacttcctccgggagcggctgttgggctggatccaagaccagggtggttgggacggcctcctctcctactttgggacgcccacgtggcagaccgtgaccatctttgtggcgggagtgctcaccgcctcactcaccatctggaagaagatgggctgag

SEQ ID NO: 267 - DNA, 735 bp, Homo sapiens
gcggccgcccgcgcggacccggcgagaggcggcggcgggagcggcggtgatggacgggtccggggagcagcccagaggcggggtttcatccaggatcgagcagggcgaatggggggggaggcacccgagctggccctggacccggtgcctcaggatgcgtccaccaagaagctgagcgagtgtctcaagcgcatcggggacgaactggacagtaacatggagctgcagaggatgattgccgccgtggacacagactccccccgagaggtctttttccgagtggcagctgacatgttttctgacggcaacttcaactggggccgggttgtcgcccttttctactttgccagcaaactggtgctcaaggccctgtgcaccaaggtgccggaactgatcagaaccatcatgggctggacattggacttcctccgggagcggctgttgggctggatccaagaccagggtggttgggacggcctcctctcctactttgggacgcccacgtggcagaccgtgaccatctttgtggcgggagtgctcaccgcctcactcaccatctggaagaagatgggctgaggcccccagctgccttggactgtgtttttcctccataaattatggcatttttctgggaggggtggggattgggggacgtgggcatttttcttacttttgtaattattggggggtgtggggaagagtggtcttgagggggtaataaacctccttcgggac

SEQ ID NO: 268 - DNA, 540 bp, Homo sapiens
atggacgggtccggggagcagcccagaggcggggggcccaccagctctgagcagatcatgaagacaggggcccttttgcttcagggtttcatccaggatcgagcagggcgaatggggggggaggcacccgagctggccctggacccggtgcctcaggatgcgtccaccaagaagctgagcgagtgtctcaagcgcatcggggacgaactggacagtaacatggagctgcagaggatgattgccgccgtggacacagactccccccgagaggtctttttccgagtggcagctgacatgttttctgacggcaacttcaactggggccgggttgtcgcccttttctactttgccagcaaactggtgctcaaggccctgtgcaccaaggtgccggaactgatcagaaccatcatgggctggacattggacttcctccgggagcggctgttgggctggatccaagaccagggtggttggaccgtgaccatctttgtggcgggagtgctcaccgcctcactcaccatctggaagaagatgggctga

SEQ ID NO: 269 - DNA, 866 bp, Homo sapiens
tcacgtgacccgggcgcgctgcggccgcccgcgcggacccggcgagaggcggcggcgggagcggcggtgatggacgggtccggggagcagcccagaggcggggggcccaccagctctgagcagatcatgaagacaggggcccttttgcttcagggtttcatccaggatcgagcagggcgaatggggggggaggcacccgagctggccctggacccggtgcctcaggatgcgtccaccaagaagctgagcgagtgtctcaagcgcatcggggacgaactggacagtaacatggagctgcagaggatgattgccgccgtggacacagactccccccgagaggtctttttccgagtggcagctgacatgttttctgacggcaacttcaactggggccgggttgtcgcccttttctactttgccagcaaactggtgctcaaggctggcgtgaaatggcgtgatctgggctcactgcaacctctgcctcctgggttcaagcgattcacctgcctcagcatcccaaggagctgggattacaggccctgtgcaccaaggtgccggaactgatcagaaccatcatgggctggacattggacttcctccgggagcggctgttgggctggatccaagaccagggtggttggaccgtgaccatctttgtggcgggagtgctcaccgcctcactcaccatctggaagaagatgggctgaggcccccagctgccttggactgtgtttttcctccataaattatggcatttttctgggaggggtggggattgggggacgtgggcatttttcttacttttgtaattattggggggtgtggggaagagtggtcttgagggggtaataaacctccttcgggac

SEQ ID NO: 270 - DNA, 6492 bp, Homo sapiens
tttctgtgaagcagaagtctgggaatcgatctggaaatcctcctaatttttactccctctccccgcgactcctgattcattgggaagtttcaaatcagctataactggagagtgctgaagattgatgggatcgttgccttatgcatttgttttggttttacaaaaaggaaacttgacagaggatcatgctgtacttaaaaaatacaacatcacagaggaagtagactgatattaacaatacttactaataataacgtgcctcatgaaataaagatccgaaaggaattggaataaaaatttcctgcatctcatgccaagggggaaacaccagaatcaagtgttccgcgtgattgaagacaccccctcgtccaagaatgcaaagcacatccaataaaatagctggattataactcctcttctttctctgggggccgtggggtgggagctggggcgagaggtgccgttggcccccgttgcttttcctctgggaaggatggcgcacgctgggagaacagggtacgataaccgggagatagtgatgaagtacatccattataagctgtcgcagaggggctacgagtgggatgcgggagatgtgggcgccgcgcccccgggggccgcccccgcaccgggcatcttctcctcccagcccgggcacacgccccatccagccgcatcccgggacccggtcgccaggacctcgccgctgcagaccccggctgcccccggcgccgccgcggggcctgcgctcagcccggtgccacctgtggtccacctgaccctccgccaggccggcgacgacttctcccgccgctaccgccgcgacttcgccgagatgtccagccagctgcacctgacgcccttcaccgcgcggggacgctttgccacggtggtggaggagctcttcagggacggggtgaactgggggaggattgtggccttctttgagttcggtggggtcatgtgtgtggagagcgtcaaccgggagatgtcgcccctggtggacaacatcgccctgtggatgactgagtacctgaaccggcacctgcacacctggatccaggataacggaggctgggatgcctttgtggaactgtacggccccagcatgcggcctctgtttgatttctcctggctgtctctgaagactctgctcagtttggccctggtgggagcttgcatcaccctgggtgcctatctgggccacaagtgaagtcaacatgcctgccccaaacaaatatgcaaaaggttcactaaagcagtagaaataatatgcattgtcagtgatgtaccatgaaacaaagctgcaggctgtttaagaaaaaataacacacatataaacatcacacacacagacagacacacacacacacaacaattaacagtcttcaggcaaaacgtcgaatcagctatttactgccaaagggaaatatcatttattttttacattattaagaaaaaaagatttatttatttaagacagtcccatcaaaactcctgtctttggaaatccgaccactaattgccaagcaccgcttcgtgtggctccacctggatgttctgtgcctgtaaacatagattcgctttccatgttgttggccggatcaccatctgaagagcagacggatggaaaaaggacctgatcattggggaagctggctttctggctgctggaggctggggagaaggtgttcattcacttgcatttctttgccctgggggctgtgatattaacagagggagggttcctgtggggggaagtccatgcctccctggcctgaagaagagactctttgcatatgactcacatgatgcatacctggtgggaggaaaagagttgggaacttcagatggacctagtacccactgagatttccacgccgaaggacagcgatgggaaaaatgcccttaaatcataggaaagtatttttttaagctaccaattgtgccgagaaaagcattttagcaatttatacaatatcatccagtaccttaagccctgattgtgtatattcatatattttggatacgcaccccccaactcccaatactggctctgtctgagtaagaaacagaatcctctggaacttgaggaagtgaacatttcggtgacttccgcatcaggaaggctagagttacccagagcatcaggccgccacaagtgcctgcttttaggagaccgaagtccgcagaacctgcctgtgtcccagcttggaggcctggtcctggaactgagccggggccctcactggcctcctccagggatgatcaacagggcagtgtggtctccgaatgtctggaagctgatggagctcagaattccactgtcaagaaagagcagtagaggggtgtggctgggcctgtcaccctggggccctccaggtaggcccgttttcacgtggagcatgggagccacgacccttcttaagacatgtatcactgtagagggaaggaacagaggccctgggcccttcctatcagaaggacatggtgaaggctgggaacgtgaggagaggcaatggccacggcccattttggctgtagcacatggcacgttggctgtgtggccttggcccacctgtgagtttaaagcaaggctttaaatgactttggagagggtcacaaatcctaaaagaagcattgaagtgaggtgtcatggattaattgacccctgtctatggaattacatgtaaaacattatcttgtcactgtagtttggttttatttgaaaacctgacaaaaaaaaagttccaggtgtggaatatgggggttatctgtacatcctggggcattaaaaaaaaaatcaatggtggggaactataaagaagtaacaaaagaagtgacatcttcagcaaataaactaggaaatttttttttcttccagtttagaatcagccttgaaacattgatggaataactctgtggcattattgcattatataccatttatctgtattaactttggaatgtactctgttcaatgtttaatgctgtggttgatatttcgaaagctgctttaaaaaaatacatgcatctcagcgtttttttgtttttaattgtatttagttatggcctatacactatttgtgagcaaaggtgatcgttttctgtttgagatttttatctcttgattcttcaaaagcattctgagaaggtgagataagccctgagtctcagctacctaagaaaaacctggatgtcactggccactgaggagctttgtttcaaccaagtcatgtgcatttccacgtcaacagaattgtttattgtgacagttatatctgttgtccctttgaccttgtttcttgaaggtttcctcgtccctgggcaattccgcatttaattcatggtattcaggattacatgcatgtttggttaaacccatgagattcattcagttaaaaatccagatggcaaatgaccagcagattcaaatctatggtggtttgacctttagagagttgctttacgtggcctgtttcaacacagacccacccagagccctcctgccctccttccgcgggggctttctcatggctgtccttcagggtcttcctgaaatgcagtggtgcttacgctccaccaagaaagcaggaaacctgtggtatgaagccagacctccccggcgggcctcagggaacagaatgatcagacctttgaatgattctaatttttaagcaaaatattattttatgaaaggtttacattgtcaaagtgatgaatatggaatatccaatcctgtgctgctatcctgccaaaatcattttaatggagtcagtttgcagtatgctccacgtggtaagatcctccaagctgctttagaagtaacaatgaagaacgtggacgtttttaatataaagcctgttttgtcttttgttgttgttcaaacgggattcacagagtatttgaaaaatgtatatatattaagaggtcacgggggctaattgctggctggctgccttttgctgtggggttttgttacctggttttaataacagtaaatgtgcccagcctcttggccccagaactgtacagtattgtggctgcacttgctctaagagtagttgatgttgcattttccttattgttaaaaacatgttagaagcaatgaatgtatataaaagcctcaactagtcatttttttctcctcttcttttttttcattatatctaattattttgcagttgggcaacagagaaccatccctattttgtattgaagagggattcacatctgcatcttaactgctctttatgaatgaaaaaacagtcctctgtatgtactcctctttacactggccagggtcagagttaaatagagtatatgcactttccaaattggggacaagggctctaaaaaaagccccaaaaggagaagaacatctgagaacctcctcggccctcccagtccctcgctgcacaaatactccgcaagagaggccagaatgacagctgacagggtctatggccatcgggtcgtctccgaagatttggcaggggcagaaaactctggcaggcttaagatttggaataaagtcacagaattaaggaagcacctcaatttagttcaaacaagacgccaacattctctccacagctcacttacctctctgtgttcagatgtggccttccatttatatgtgatctttgttttattagtaaatgcttatcatctaaagatgtagctctggcccagtgggaaaaattaggaagtgattataaatcgagaggagttataataatcaagattaaatgtaaataatcagggcaatcccaacacatgtctagctttcacctccaggatctattgagtgaacagaattgcaaatagtctctatttgtaattgaacttatcctaaaacaaatagtttataaatgtgaacttaaactctaattaattccaactgtacttttaaggcagtggctgtttttagactttcttatcacttatagttagtaatgtacacctactctatcagagaaaaacaggaaaggctcgaaatacaagccattctaaggaaattagggagtcagttgaaattctattctgatcttattctgtggtgtcttttgcagcccagacaaatgtggttacacactttttaagaaatacaattctacattgtcaagcttatgaaggttccaatcagatctttattgttattcaatttggatctttcagggattttttttttaaattattatgggacaaaggacatttgttggaggggtgggagggaggaagaatttttaaatgtaaaacattcccaagtttggatcagggagttggaagttttcagaataaccagaactaagggtatgaaggacctgtattggggtcgatgtgatgcctctgcgaagaaccttgtgtgacaaatgagaaacattttgaagtttgtggtacgacctttagattccagagacatcagcatggctcaaagtgcagctccgtttggcagtgcaatggtataaatttcaagctggatatgtctaatgggtatttaaacaataaatgtgcagttttaactaacaggatatttaatgacaaccttctggttggtagggacatctgtttctaaatgtttattatgtacaatacagaaaaaaattttataaaattaagcaatgtgaaactgaattggagagtgataatacaagtcctttagtcttacccagtgaatcattctgttccatgtctttggacaaccatgaccttggacaatcatgaaatatgcatctcactggatgcaaagaaaatcagatggagcatgaatggtactgtaccggttcatctggactgccccagaaaaataacttcaagcaaacatcctatcaacaacaaggttgttctgcataccaagctgagcacagaagatgggaacactggtggaggatggaaaggctcgctcaatcaagaaaattctgagactattaataaataagactgtagtgtagatactgagtaaatccatgcacctaaaccttttggaaaatctgccgtgggccctccagatagctcatttcattaagtttttccctccaaggtagaatttgcaagagtgacagtggattgcatttcttttggggaagctttcttttggtggttttgtttattataccttcttaagttttcaaccaaggtttgcttttgttttgagttactggggttatttttgttttaaataaaaataagtgtacaataagtgtttttgtattgaaagcttttgttatcaagattttcatacttttaccttccatggctctttttaagattgatacttttaagaggtggctgatattctgcaacactgtacacataaaaaatacggtaaggatactttacatggttaaggtaaagtaagtctccagttggccaccattagctataatggcactttgtttgtgttgttggaaaaagtcacattgccattaaactttccttgtctgtctagttaatattgtgaagaaaaataaagtacagtgtgagatactg

SEQ ID NO: 271 - DNA, 7461 bp, Homo sapiens
gcgcccgcccctccgcgccgcctgcccgcccgcccgccgcgctcccgcccgccgctctccgtggccccgccgcgctgccgccgccgccgctgccagcgaaggtgccggggctccgggccctccctgccggcggccgtcagcgctcggagcgggctgcgcggcgggagctccgggaggcggccgtagccagcgccgccgcgcaggaccaggaggaggagaaagggtgcgcagcccggaggcggggtgcgccggtggggtgcagcggaagagggggtccaggggggagaacttcgtagcagtcatcctttttaggaaaagagggaaaaaataaaaccctcccccaccacctccttctccccacccctcgccgcaccacacacagcgcgggcttctagcgctcggcaccggcgggccaggcgcgtcctgccttcatttatccagcagcttttcggaaaatgcatttgctgttcggagtttaatcagaagaggattcctgcctccgtccccggctccttcatcgtcccctctcccctgtctctctcctggggaggcgtgaagcggtcccgtggatagagattcatgcctgtgcccgcgcgtgtgtgcgcgcgtgtaaattgccgagaaggggaaaacatcacaggacttctgcgaataccggactgaaaattgtaattcatctgccgccgccgctgccttttttttttctcgagctcttgagatctccggttgggattcctgcggattgacatttctgtgaagcagaagtctgggaatcgatctggaaatcctcctaatttttactccctctccccgcgactcctgattcattgggaagtttcaaatcagctataactggagagtgctgaagattgatgggatcgttgccttatgcatttgttttggttttacaaaaaggaaacttgacagaggatcatgctgtacttaaaaaatacaagtaagttctctgcacaggaaattggtttaatgtaactttcaatggaaacctttgagattttttacttaaagtgcattcgagtaaatttaatttccaggcagcttaatacattctttttagccgtgttacttgtagtgtgtatgccctgctttcactcagtgtgtacagggaaacgcacctgattttttacttattagtttgttttttctttaacctttcagcatcacagaggaagtagactgatattaacaatacttactaataataacgtgcctcatgaaataaagatccgaaaggaattggaataaaaatttcctgcatctcatgccaagggggaaacaccagaatcaagtgttccgcgtgattgaagacaccccctcgtccaagaatgcaaagcacatccaataaaatagctggattataactcctcttctttctctgggggccgtggggtgggagctggggcgagaggtgccgttggcccccgttgcttttcctctgggaaggatggcgcacgctgggagaacagggtacgataaccgggagatagtgatgaagtacatccattataagctgtcgcagaggggctacgagtgggatgcgggagatgtgggcgccgcgcccccgggggccgcccccgcaccgggcatcttctcctcccagcccgggcacacgccccatccagccgcatcccgggacccggtcgccaggacctcgccgctgcagaccccggctgcccccggcgccgccgcggggcctgcgctcagcccggtgccacctgtggtccacctgaccctccgccaggccggcgacgacttctcccgccgctaccgccgcgacttcgccgagatgtccagccagctgcacctgacgcccttcaccgcgcggggacgctttgccacggtggtggaggagctcttcagggacggggtgaactgggggaggattgtggccttctttgagttcggtggggtcatgtgtgtggagagcgtcaaccgggagatgtcgcccctggtggacaacatcgccctgtggatgactgagtacctgaaccggcacctgcacacctggatccaggataacggaggctgggatgcctttgtggaactgtacggccccagcatgcggcctctgtttgatttctcctggctgtctctgaagactctgctcagtttggccctggtgggagcttgcatcaccctgggtgcctatctgggccacaagtgaagtcaacatgcctgccccaaacaaatatgcaaaaggttcactaaagcagtagaaataatatgcattgtcagtgatgtaccatgaaacaaagctgcaggctgtttaagaaaaaataacacacatataaacatcacacacacagacagacacacacacacacaacaattaacagtcttcaggcaaaacgtcgaatcagctatttactgccaaagggaaatatcatttattttttacattattaagaaaaaaagatttatttatttaagacagtcccatcaaaactcctgtctttggaaatccgaccactaattgccaagcaccgcttcgtgtggctccacctggatgttctgtgcctgtaaacatagattcgctttccatgttgttggccggatcaccatctgaagagcagacggatggaaaaaggacctgatcattggggaagctggctttctggctgctggaggctggggagaaggtgttcattcacttgcatttctttgccctgggggctgtgatattaacagagggagggttcctgtggggggaagtccatgcctccctggcctgaagaagagactctttgcatatgactcacatgatgcatacctggtgggaggaaaagagttgggaacttcagatggacctagtacccactgagatttccacgccgaaggacagcgatgggaaaaatgcccttaaatcataggaaagtatttttttaagctaccaattgtgccgagaaaagcattttagcaatttatacaatatcatccagtaccttaagccctgattgtgtatattcatatattttggatacgcaccccccaactcccaatactggctctgtctgagtaagaaacagaatcctctggaacttgaggaagtgaacatttcggtgacttccgcatcaggaaggctagagttacccagagcatcaggccgccacaagtgcctgcttttaggagaccgaagtccgcagaacctgcctgtgtcccagcttggaggcctggtcctggaactgagccggggccctcactggcctcctccagggatgatcaacagggcagtgtggtctccgaatgtctggaagctgatggagctcagaattccactgtcaagaaagagcagtagaggggtgtggctgggcctgtcaccctggggccctccaggtaggcccgttttcacgtggagcatgggagccacgacccttcttaagacatgtatcactgtagagggaaggaacagaggccctgggcccttcctatcagaaggacatggtgaaggctgggaacgtgaggagaggcaatggccacggcccattttggctgtagcacatggcacgttggctgtgtggccttggcccacctgtgagtttaaagcaaggctttaaatgactttggagagggtcacaaatcctaaaagaagcattgaagtgaggtgtcatggattaattgacccctgtctatggaattacatgtaaaacattatcttgtcactgtagtttggttttatttgaaaacctgacaaaaaaaaagttccaggtgtggaatatgggggttatctgtacatcctggggcattaaaaaaaaaatcaatggtggggaactataaagaagtaacaaaagaagtgacatcttcagcaaataaactaggaaatttttttttcttccagtttagaatcagccttgaaacattgatggaataactctgtggcattattgcattatataccatttatctgtattaactttggaatgtactctgttcaatgtttaatgctgtggttgatatttcgaaagctgctttaaaaaaatacatgcatctcagcgtttttttgtttttaattgtatttagttatggcctatacactatttgtgagcaaaggtgatcgttttctgtttgagatttttatctcttgattcttcaaaagcattctgagaaggtgagataagccctgagtctcagctacctaagaaaaacctggatgtcactggccactgaggagctttgtttcaaccaagtcatgtgcatttccacgtcaacagaattgtttattgtgacagttatatctgttgtccctttgaccttgtttcttgaaggtttcctcgtccctgggcaattccgcatttaattcatggtattcaggattacatgcatgtttggttaaacccatgagattcattcagttaaaaatccagatggcaaatgaccagcagattcaaatctatggtggtttgacctttagagagttgctttacgtggcctgtttcaacacagacccacccagagccctcctgccctccttccgcgggggctttctcatggctgtccttcagggtcttcctgaaatgcagtggtgcttacgctccaccaagaaagcaggaaacctgtggtatgaagccagacctccccggcgggcctcagggaacagaatgatcagacctttgaatgattctaatttttaagcaaaatattattttatgaaaggtttacattgtcaaagtgatgaatatggaatatccaatcctgtgctgctatcctgccaaaatcattttaatggagtcagtttgcagtatgctccacgtggtaagatcctccaagctgctttagaagtaacaatgaagaacgtggacgtttttaatataaagcctgttttgtcttttgttgttgttcaaacgggattcacagagtatttgaaaaatgtatatatattaagaggtcacgggggctaattgctggctggctgccttttgctgtggggttttgttacctggttttaataacagtaaatgtgcccagcctcttggccccagaactgtacagtattgtggctgcacttgctctaagagtagttgatgttgcattttccttattgttaaaaacatgttagaagcaatgaatgtatataaaagcctcaactagtcatttttttctcctcttcttttttttcattatatctaattattttgcagttgggcaacagagaaccatccctattttgtattgaagagggattcacatctgcatcttaactgctctttatgaatgaaaaaacagtcctctgtatgtactcctctttacactggccagggtcagagttaaatagagtatatgcactttccaaattggggacaagggctctaaaaaaagccccaaaaggagaagaacatctgagaacctcctcggccctcccagtccctcgctgcacaaatactccgcaagagaggccagaatgacagctgacagggtctatggccatcgggtcgtctccgaagatttggcaggggcagaaaactctggcaggcttaagatttggaataaagtcacagaattaaggaagcacctcaatttagttcaaacaagacgccaacattctctccacagctcacttacctctctgtgttcagatgtggccttccatttatatgtgatctttgttttattagtaaatgcttatcatctaaagatgtagctctggcccagtgggaaaaattaggaagtgattataaatcgagaggagttataataatcaagattaaatgtaaataatcagggcaatcccaacacatgtctagctttcacctccaggatctattgagtgaacagaattgcaaatagtctctatttgtaattgaacttatcctaaaacaaatagtttataaatgtgaacttaaactctaattaattccaactgtacttttaaggcagtggctgtttttagactttcttatcacttatagttagtaatgtacacctactctatcagagaaaaacaggaaaggctcgaaatacaagccattctaaggaaattagggagtcagttgaaattctattctgatcttattctgtggtgtcttttgcagcccagacaaatgtggttacacactttttaagaaatacaattctacattgtcaagcttatgaaggttccaatcagatctttattgttattcaatttggatctttcagggattttttttttaaattattatgggacaaaggacatttgttggaggggtgggagggaggaagaatttttaaatgtaaaacattcccaagtttggatcagggagttggaagttttcagaataaccagaactaagggtatgaaggacctgtattggggtcgatgtgatgcctctgcgaagaaccttgtgtgacaaatgagaaacattttgaagtttgtggtacgacctttagattccagagacatcagcatggctcaaagtgcagctccgtttggcagtgcaatggtataaatttcaagctggatatgtctaatgggtatttaaacaataaatgtgcagttttaactaacaggatatttaatgacaaccttctggttggtagggacatctgtttctaaatgtttattatgtacaatacagaaaaaaattttataaaattaagcaatgtgaaactgaattggagagtgataatacaagtcctttagtcttacccagtgaatcattctgttccatgtctttggacaaccatgaccttggacaatcatgaaatatgcatctcactggatgcaaagaaaatcagatggagcatgaatggtactgtaccggttcatctggactgccccagaaaaataacttcaagcaaacatcctatcaacaacaaggttgttctgcataccaagctgagcacagaagatgggaacactggtggaggatggaaaggctcgctcaatcaagaaaattctgagactattaataaataagactgtagtgtagatactgagtaaatccatgcacctaaaccttttggaaaatctgccgtgggccctccagatagctcatttcattaagtttttccctccaaggtagaatttgcaagagtgacagtggattgcatttcttttggggaagctttcttttggtggttttgtttattataccttcttaagttttcaaccaaggtttgcttttgttttgagttactggggttatttttgttttaaataaaaataagtgtacaataagtgtttttgtattgaaagcttttgttatcaagattttcatacttttaccttccatggctctttttaagattgatacttttaagaggtggctgatattctgcaacactgtacacataaaaaatacggtaaggatactttacatggttaaggtaaagtaagtctccagttggccaccattagctataatggcactttgtttgtgttgttggaaaaagtcacattgccattaaactttccttgtctgtctagttaatattgtgaagaaaaataaagtacagtgtgagatactg

SEQ ID NO: 272 - DNA, 1206 bp, Homo sapiens
tttctgtgaagcagaagtctgggaatcgatctggaaatcctcctaatttttactccctctccccgcgactcctgattcattgggaagtttcaaatcagctataactggagagtgctgaagattgatgggatcgttgccttatgcatttgttttggttttacaaaaaggaaacttgacagaggatcatgctgtacttaaaaaatacaacatcacagaggaagtagactgatattaacaatacttactaataataacgtgcctcatgaaataaagatccgaaaggaattggaataaaaatttcctgcatctcatgccaagggggaaacaccagaatcaagtgttccgcgtgattgaagacaccccctcgtccaagaatgcaaagcacatccaataaaatagctggattataactcctcttctttctctgggggccgtggggtgggagctggggcgagaggtgccgttggcccccgttgcttttcctctgggaaggatggcgcacgctgggagaacagggtacgataaccgggagatagtgatgaagtacatccattataagctgtcgcagaggggctacgagtgggatgcgggagatgtgggcgccgcgcccccgggggccgcccccgcaccgggcatcttctcctcccagcccgggcacacgccccatccagccgcatcccgggacccggtcgccaggacctcgccgctgcagaccccggctgcccccggcgccgccgcggggcctgcgctcagcccggtgccacctgtggtccacctgaccctccgccaggccggcgacgacttctcccgccgctaccgccgcgacttcgccgagatgtccagccagctgcacctgacgcccttcaccgcgcggggacgctttgccacggtggtggaggagctcttcagggacggggtgaactgggggaggattgtggccttctttgagttcggtggggtcatgtgtgtggagagcgtcaaccgggagatgtcgcccctggtggacaacatcgccctgtggatgactgagtacctgaaccggcacctgcacacctggatccaggataacggaggctgggtaggtgcacttggtgatgtgagtctgggctgaggccacaggtccgagatgcgggggttggagtgcgggtgggctcctggggcaatgggaggctgtggagccggcgaaataaaatcagagttgttgct

SEQ ID NO: 273 - DNA, 1249 bp, Homo sapiens
cgggccaagaaaaccagcgaaggcccggccccccagcagaggccggaccatggttgaccagttgcgggagcgcaccaccatggccgacccgctgcgggagcgcaccgagctgttgctggccgactacctggggtactgcgcccgggaacccggcacccccgagccggcgccatccacgcccgaggccgccgtgctgcgctccgcggccgccaggttacggcagattcaccggtcctttttctccgcctacctcggctaccccgggaaccgcttcgagctggtggcgctgatggcggattccgtgctctccgacagccccggccccacctggggcagagtggtgacgctcgtgaccttcgcagggacgctgctggagagagggccgctggtgaccgcccggtggaagaagtggggcttccagccgcggctaaaggagcaggagggcgacgtcgcccgggactgccagcgcctggtggccttgctgagctcgcggctcatggggcagcaccgcgcctggctgcaggctcagggcggctgggatggcttttgtcacttcttcaggaccccctttccactggctttttggagaaaacagctggtccaggcttttctgtcatgcttgttaacaacagccttcatttatctctggacacgattattatgagttttaaaacttttaacccgcttctacctgcccaactgtgaccaactaaatgacagatgtgtgagaacaagaactgagggaaagcaccttcccccaccccagacgtttttatctgaatgcatacaaggagtcctgaggtggtgatttggccagtgttttaacttgtgacaagtactcaggtgtgaggacaagaatgcaaatggctcttccttgagtgaaagaaatggggagtctagagcctctttatgccaaagaaccgcagaagaaactgcattccattaaatgggaaatacagtgctatttgctaaaacttggataagagtgcgaacctctcatctctccacaacttcatgtgctgctgactaattttaaacatggccacagctggggcaaaataatccccaaagtagaaaaagtcccagtttaacaaagaatgtaatgttaaaatcacttataaggaattctttgaaaccaaatcctttgaaatctaattcctgggacttctaggtttttatagttaacatactaatttcttcaataattgttaactgcaaagttttaataaatttgtacctttaaaaaaaa

SEQ ID NO: 274 - DNA, 3605 bp, Homo sapiens
atcacccggcgccgggccctccctctgcccccccctttctcctccctccttccttccctcccttcctccctctctccctccctcccagctcctgcaccaggaaacggcccggatcccggcagcggcctgacccggctccacgctggccaggaggatgaaaggccccagctgggggctccttgccaccagtgctgtgtcttaagagctgccatcccggctggccgcccggatggcgaccccagcctcggccccagacacacgggctctggtggcagactttgtaggttataagctgaggcagaagggttatgtctgtggagctggccccggggagggcccagcagctgacccgctgcaccaagccatgcgggcagctggagatgagttcgagacccgcttccggcgcaccttctctgatctggcggctcagctgcatgtgaccccaggctcagcccaacaacgcttcacccaggtctccgatgaactttttcaagggggccccaactggggccgccttgtagccttctttgtctttggggctgcactgtgtgctgagagtgtcaacaaggagatggaaccactggtgggacaagtgcaggagtggatggtggcctacctggagacgcagctggctgactggatccacagcagtgggggctgggcggagttcacagctctatacggggacggggccctggaggaggcgcggcgtctgcgggaggggaactgggcatcagtgaggacagtgctgacgggggccgtggcactgggggccctggtaactgtaggggccttttttgctagcaagtgaaagtccagggccaggtggggctaggtgtggctgggggccaggagagcaggaacagaacagagaaatgcccttggaagaagtggagttggtggatgggtgggcatggaacaggatgggcagagaaagggtagtgtgtgagggagctgagtaggccaggtaggcgattggaagagtgagcaggacacagaggggaggggaatgttttggcaagtttaggggcacaggagatgtagtcgttccagggctgggggaggtgggagggatcacgcctataggtgtgggcacatgaaacgacctggaacttgcttcacagccctgaggaaggtggacttacataagcagctgtattccattagatgagtgggatttagggaacgcagaaggcacatccctttggaatggaagcttaggggttctcaggtgatagggagaggtggctgttaacagtgggctgcttggacacgcgtgtgcatgtgcacgcatgctggtgtgcatgctgggctgcctggcaaatctggtggtgatgggattcctcaaggagaaaacattccctcttgcaatggcaagaactaggggcagttctctgtccctcctcccaacccctcctttcccctgcccttgtcctgatgcctcaaggcttagagagaaacattgtatccagaccgagggctctgctgcttctttccagaaagtgattggcaaggctttggagagaagagcagttctgcagctggccttgttccttcatcatcccccttccttgtgcattatgcacttgctgctgcctcctgggctctgatagaagggcagggctgttgagcctggatgggtggaggcttaggtagccggacctgcctgccaccctcctctcccactcaggcacaatggtgcctaaagtgtttccaatctctgggacctctgtacccaaactgaaactctaaattggggccctaactaattttccttttgaggttgtgggcataagtgctgatctagaatacagtctgggtcccacactgtgtctcagtgagactgttgatgccttgagatgaccatttcagatctgaatcccatgggtgtgagggtgatgggtactccaggactggcctatgctgtgttgtgggctttggttcggctttatcaggggccaggcatatgggttctagagtacctaccatgacctagaagcatttatgatttatttgaagccacactgtttgcatgggtgttacttgtctgtacctcagagtctgaggatgttaactttggaactcgcagtcctctagaacagcttcagattatggctttttcttttgaggaagaaattattcactccagatgcatgccctgagccagacctcactgctgcactttccaaggtgctaagattgctgctctccaatgctaactttctgacacagtgctctagaaccctgcctgtggtcctgagcactgatcaccttagctagaccatggttgactcttcttggagattttcacttggtcctagaatgtggcaacgtagttgtgctcgccagaacgtgggaccaaattggcctcaggtgttgagtccagacttctgcttttgagagagggctgcactttttcatggtatttctaggggaggtggtaggctgcatgtgccacttggtcttgttgtgagtatgctgacaccagaaactcagagccagcttgtggcaagcagttggggtggggggtctctgacttgctcaggacaaactaggccagtggttttcaaactgcttggcagagccctgaagtttcctaggggttgcctcaggagtccttggggagatgaagggggtggggagctgagcaggctgggcaatttgccctcaaacagaacagctccccttgtagctgtcttacatattggggttcagggtaagattttatttgcattaaggggtttgctgctgaaaaaaagttggaaaaccactgactagaccatcggctccaaattggagtctgtgcttccttccccaggtatggagcacactcttcaccctaccctctaccacaggacacatatccctgttagcattccccgggacctttagccaagaggagctgcagggaccatggccaggttaccaaaatgccctgctctgaagccttgacacctgggtggaaagagaggctgttttctgaaagggtaaagggcttggtctggattcccagaagcatagcttagatgggaccacagtgggcaattttgacctgtcctgcccttcttagcttgaagggaaaccccagagactcttctgtcagggaaaactagggactctcttctagagccatatagttccttgggattagctcttggccaagaaggctgagtatggttcccaatttttaaatccatttcattttttaaaaaataagggaaataaatgtaattgccatttttcaaagattaagtaggaggagaggggtttcttgctctccagagcccaaagggacaaatagggactttgtttaggccaaggaaggagcggaagtagggcaactcggtcctgcgattattaatcccactccccacttattctagggcacacaaacactattttacttttttaaaatcataaaacggcagaacagatttggttagtttagaagaaaagaaagctctataaatataaatctatattcctgtatttttatttaataatttataaataccaagttcatttgacttttatttttgtgtaatatgtaatgatcgtattaaaaacaataaataaagcccagaagtttaatgagaaggactgaa

SEQ ID NO: 275 - DNA, 545 bp, Homo sapiens
agctgggcctttgggctgcactagggggaaccgggaatagagatggtgtcggcaggaagcccttggccttgggtttcccgggaggacagtcattaaacatggattcggccacacagctggtagagcgttgggggcaggggcctaggcccagagctgcaaccctagcccttcccaggccagaacctgatccctggccttcccctcctggttctgatctccccctcccctttccagggctccacgctggccaggaggatgaaaggccccagctgggggctccttgccaccagtgctgtgtcttaagagctgccatcccggctggccgcccggatggcgaccccagcctcggccccagacacacgggctctggtggcagactttgtaggttataagctgaggcagaagggttatgtctgtggagctggccccggggagggcccagcagctgacccgctgcaccaagccatgcgggcagctggagatgagttcgagacccgcttccggcgcaccttctctgatctggcggctcagctgcatgtgacccc

SEQ ID NO: 276 - DNA, 631 bp, Homo sapiens
aggaaacggcccggatcccggcagcggcctgacccgtgagatccctaacctggcaggcgggcggggttggagactggctgaggtggggggctccacgctggccaggaggatgaaaggccccagctgggggctccttgccaccagtgctgtgtcttaagagctgccatcccggctggccgcccggatggcgaccccagcctcggccccagacacacgggctctggtggcagactttgtaggttataagctgaggcagaagggttatgtctgtggagctggccccggggagggcccagcagctgacccgctgcaccaagccatgcgggcagctggagatgagttcgagacccgcttccggcgcaccttctctgatctggcggctcagctgcatgtgaccccaggctcagcccaacaacgcttcacccaggtctccgatgaactttttcaagggggccccaactggggccgccttgtagccttctttgtctttggggctgcactgtgtgctgagagtgtcaacaaggagatggaaccactggtgggacaagtgcaggagtggatggtggcctacctggagacgcagctggctgactggatccacagcagtgggggctgggcggagttcacagct

SEQ ID NO: 277 - DNA, 596 bp, Homo sapiens
atcccggcagcggcctgacccgtgagatccctaacctggcaggcgggcggggttggagactggctgagggctccacgctggccaggaggatgaaaggccccagctgggggctccttgccaccagtgctgtgtcttaagagctgccatcccggctggccgcccggatggcgaccccagcctcggccccagacacacgggctctggtggcagactttgtaggttataagctgaggcagaagggttatgtctgtggagctggccccggggagggcccagcagctgacccgctgcaccaagccatgcgggcagctggagatgagttcgagacccgcttccggcgcaccttctctgatctggcggctcagctgcatgtgaccccaggctcagcccaacaacgcttcacccaggtctccgatgaactttttcaagggggccccaactggggccgccttgtagccttctttgtctttggggctgcactgtgtgctgagagtgtcaacaaggagatggaaccactggtgggacaagtgcaggagtggatggtggcctacctggagacgcagctggctgactggatccacagcagtgggggctgg

SEQ ID NO: 278 - DNA, 2610 bp, Homo sapiens
gcaggaggccgcggctgcggagcggccgccctcgatccgggcgatggaggaggaagcaagcgagggggctggttcctgagcttcgcaattcctgtgtcgccttctgggctcccagcctgccgggtcgcatgatccctccggccggagctggtttttttgccagccaccgcgaggccggctgagttaccggcatccccgcagccacctcctctcccgacctgtgatacaaaagatcttccgggggctgcacctgcctgcctttgcctaaggcggatttgaatctctttctctcccttcagaatcttatcttggctttggatcttagaagagaatcactaaccagagacgagactcagtgagtgagcaggtgttttggacaatggactggttgagcccatccctattataaaaatgtctcagagcaaccgggagctggtggttgactttctctcctacaagctttcccagaaaggatacagctggagtcagtttagtgatgtggaagagaacaggactgaggccccagaagggactgaatcggagatggagacccccagtgccatcaatggcaacccatcctggcacctggcagacagccccgcggtgaatggagccactggccacagcagcagtttggatgcccgggaggtgatccccatggcagcagtaaagcaagcgctgagggaggcaggcgacgagtttgaactgcggtaccggcgggcattcagtgacctgacatcccagctccacatcaccccagggacagcatatcagagctttgaacaggtagtgaatgaactcttccgggatggggtaaactggggtcgcattgtggcctttttctccttcggcggggcactgtgcgtggaaagcgtagacaaggagatgcaggtattggtgagtcggatcgcagcttggatggccacttacctgaatgaccacctagagccttggatccaggagaacggcggctgggatacttttgtggaactctatgggaacaatgcagcagccgagagccgaaagggccaggaacgcttcaaccgctggttcctgacgggcatgactgtggccggcgtggttctgctgggctcactcttcagtcggaaatgaccagacactgaccatccactctaccctcccacccccttctctgctccaccacatcctccgtccagccgccattgccaccaggagaaccactacatgcagcccatgcccacctgcccatcacagggttgggcccagatctggtcccttgcagctagttttctagaatttatcacacttctgtgagacccccacacctcagttcccttggcctcagaattcacaaaatttccacaaaatctgtccaaaggaggctggcaggtatggaagggtttgtggctgggggcaggagggccctacctgattggtgcaacccttaccccttagcctccctgaaaatgtttttctgccagggagcttgaaagttttcagaacctcttccccagaaaggagactagattgcctttgttttgatgtttgtggcctcagaattgatcattttccccccactctccccacactaacctgggttccctttccttccatccctaccccctaagagccatttaggggccacttttgactagggattcaggctgcttgggataaagatgcaaggaccaggactccctcctcacctctggactggctagagtcctcactcccagtccaaatgtcctccagaagcctctggctagaggccagccccacccaggagggagggggctatagctacaggaagcaccccatgccaaagctagggtggcccttgcagttcagcaccaccctagtcccttcccctccctggctcccatgaccatactgagggaccaactgggcccaagacagatgccccagagctgtttatggcctcagctgcctcacttcctacaagagcagcctgtggcatctttgccttgggctgctcctcatggtgggttcaggggactcagccctgaggtgaaagggagctatcaggaacagctatgggagccccagggtcttccctacctcaggcaggaagggcaggaaggagagcctgctgcatggggtggggtagggctgactagaagggccagtcctgcctggccaggcagatctgtgccccatgcctgtccagcctgggcagccaggctgccaaggccagagtggcctggccaggagctcttcaggcctccctctctcttctgctccacccttggcctgtctcatccccaggggtcccagccaccccgggctctctgctgtacatatttgagactagtttttattccttgtgaagatgatatactatttttgttaagcgtgtctgtatttatgtgtgaggagctgctggcttgcagtgcgcgtgcacgtggagagctggtgcccggagattggacggcctgatgctccctcccctgccctggtccagggaagctggccgagggtcctggctcctgaggggcatctgcccctcccccaacccccaccccacacttgttccagctctttgaaatagtctgtgtgaaggtgaaagtgcagttcagtaataaactgtgtttactcagtgaacaaaga

SEQ ID NO: 279 - DNA, 2383 bp, Homo sapiens
gggcgatggaggaggaagcaagcgagggggctggttcctgagcttcgcaattcctgtgtcgccttctgggctcccagcctgccgggtcgcatgatccctccggccggagctggtttttttgccagccaccgcgaggccggctgagttaccggcatccccgcagccacctcctctcccgacctgtgatacaaaagatcttccgggggctgcacctgcctgcctttgcctaaggcggatttgaatctctttctctcccttcagaatcttatcttggctttggatcttagaagagaatcactaaccagagacgagactcagtgagtgagcaggtgttttggacaatggactggttgagcccatccctattataaaaatgtctcagagcaaccgggagctggtggttgactttctctcctacaagctttcccagaaaggatacagctggagtcagtttagtgatgtggaagagaacaggactgaggccccagaagggactgaatcggagatggagacccccagtgccatcaatggcaacccatcctggcacctggcagacagccccgcggtgaatggagccactggccacagcagcagtttggatgcccgggaggtgatccccatggcagcagtaaagcaagcgctgagggaggcaggcgacgagtttgaactgcggtaccggcgggcattcagtgacctgacatcccagctccacatcaccccagggacagcatatcagagctttgaacaggatacttttgtggaactctatgggaacaatgcagcagccgagagccgaaagggccaggaacgcttcaaccgctggttcctgacgggcatgactgtggccggcgtggttctgctgggctcactcttcagtcggaaatgaccagacactgaccatccactctaccctcccacccccttctctgctccaccacatcctccgtccagccgccattgccaccaggagaaccactacatgcagcccatgcccacctgcccatcacagggttgggcccagatctggtcccttgcagctagttttctagaatttatcacacttctgtgagacccccacacctcagttcccttggcctcagaattcacaaaatttccacaaaatctgtccaaaggaggctggcaggtatggaagggtttgtggctgggggcaggagggccctacctgattggtgcaacccttaccccttagcctccctgaaaatgtttttctgccagggagcttgaaagttttcagaacctcttccccagaaaggagactagattgcctttgttttgatgtttgtggcctcagaattgatcattttccccccactctccccacactaacctgggttccctttccttccatccctaccccctaagagccatttaggggccacttttgactagggattcaggctgcttgggataaagatgcaaggaccaggactccctcctcacctctggactggctagagtcctcactcccagtccaaatgtcctccagaagcctctggctagaggccagccccacccaggagggagggggctatagctacaggaagcaccccatgccaaagctagggtggcccttgcagttcagcaccaccctagtcccttcccctccctggctcccatgaccatactgagggaccaactgggcccaagacagatgccccagagctgtttatggcctcagctgcctcacttcctacaagagcagcctgtggcatctttgccttgggctgctcctcatggtgggttcaggggactcagccctgaggtgaaagggagctatcaggaacagctatgggagccccagggtcttccctacctcaggcaggaagggcaggaaggagagcctgctgcatggggtggggtagggctgactagaagggccagtcctgcctggccaggcagatctgtgccccatgcctgtccagcctgggcagccaggctgccaaggccagagtggcctggccaggagctcttcaggcctccctctctcttctgctccacccttggcctgtctcatccccaggggtcccagccaccccgggctctctgctgtacatatttgagactagtttttattccttgtgaagatgatatactatttttgttaagcgtgtctgtatttatgtgtgaggagctgctggcttgcagtgcgcgtgcacgtggagagctggtgcccggagattggacggcctgatgctccctcccctgccctggtccagggaagctggccgagggtcctggctcctgaggggcatctgcccctcccccaacccccaccccacacttgttccagctctttgaaatagtctgtgtgaaggtgaaagtgcagttcagtaataaactgtgtttactcagtgaacaaaga

SEQ ID NO: 280 - DNA, 2578 bp, Homo sapiens
ggagtggggcgggggggactgcccagggagtgactttccgaggaaggcatttcggagaagacgggggtagaaaaggctggtgggagattcagagtccactggtgctttcgatttgacttaagtgaagtatcttggaacctagacccagaccttcgtaagacccacaaagaaaccagttctggtacctggagggggaatggaatttttagggtaaatggcatgcatattaattatttttttttcctgaagctctttctctcccttcagaatcttatcttggctttggatcttagaagagaatcactaaccagagacgagactcagtgagtgagcaggtgttttggacaatggactggttgagcccatccctattataaaaatgtctcagagcaaccgggagctggtggttgactttctctcctacaagctttcccagaaaggatacagctggagtcagtttagtgatgtggaagagaacaggactgaggccccagaagggactgaatcggagatggagacccccagtgccatcaatggcaacccatcctggcacctggcagacagccccgcggtgaatggagccactggccacagcagcagtttggatgcccgggaggtgatccccatggcagcagtaaagcaagcgctgagggaggcaggcgacgagtttgaactgcggtaccggcgggcattcagtgacctgacatcccagctccacatcaccccagggacagcatatcagagctttgaacaggtagtgaatgaactcttccgggatggggtaaactggggtcgcattgtggcctttttctccttcggcggggcactgtgcgtggaaagcgtagacaaggagatgcaggtattggtgagtcggatcgcagcttggatggccacttacctgaatgaccacctagagccttggatccaggagaacggcggctgggatacttttgtggaactctatgggaacaatgcagcagccgagagccgaaagggccaggaacgcttcaaccgctggttcctgacgggcatgactgtggccggcgtggttctgctgggctcactcttcagtcggaaatgaccagacactgaccatccactctaccctcccacccccttctctgctccaccacatcctccgtccagccgccattgccaccaggagaaccactacatgcagcccatgcccacctgcccatcacagggttgggcccagatctggtcccttgcagctagttttctagaatttatcacacttctgtgagacccccacacctcagttcccttggcctcagaattcacaaaatttccacaaaatctgtccaaaggaggctggcaggtatggaagggtttgtggctgggggcaggagggccctacctgattggtgcaacccttaccccttagcctccctgaaaatgtttttctgccagggagcttgaaagttttcagaacctcttccccagaaaggagactagattgcctttgttttgatgtttgtggcctcagaattgatcattttccccccactctccccacactaacctgggttccctttccttccatccctaccccctaagagccatttaggggccacttttgactagggattcaggctgcttgggataaagatgcaaggaccaggactccctcctcacctctggactggctagagtcctcactcccagtccaaatgtcctccagaagcctctggctagaggccagccccacccaggagggagggggctatagctacaggaagcaccccatgccaaagctagggtggcccttgcagttcagcaccaccctagtcccttcccctccctggctcccatgaccatactgagggaccaactgggcccaagacagatgccccagagctgtttatggcctcagctgcctcacttcctacaagagcagcctgtggcatctttgccttgggctgctcctcatggtgggttcaggggactcagccctgaggtgaaagggagctatcaggaacagctatgggagccccagggtcttccctacctcaggcaggaagggcaggaaggagagcctgctgcatggggtggggtagggctgactagaagggccagtcctgcctggccaggcagatctgtgccccatgcctgtccagcctgggcagccaggctgccaaggccagagtggcctggccaggagctcttcaggcctccctctctcttctgctccacccttggcctgtctcatccccaggggtcccagccaccccgggctctctgctgtacatatttgagactagtttttattccttgtgaagatgatatactatttttgttaagcgtgtctgtatttatgtgtgaggagctgctggcttgcagtgcgcgtgcacgtggagagctggtgcccggagattggacggcctgatgctccctcccctgccctggtccagggaagctggccgagggtcctggctcctgaggggcatctgcccctcccccaacccccaccccacacttgttccagctctttgaaatagtctgtgtgaaggtgaaagtgcagttcagtaataaactgtgtttactcagtgaacaaaga

SEQ ID NO: 281 - DNA, 820 bp, Homo sapiens
ctttgcgtctcgggctcgcgcgcgttgccgcggcaccggaagtgactgagcttgcaagttcccctgtctcttcaggggaaactgaggccggcttgttcgggagagacggcgcgagcagtcagccagctctttctctcccttcagaatcttatcttggctttggatcttagaagagaatcactaaccagagacgagactcagtgagtgagcaggtgttttggacaatggactggttgagcccatccctattataaaaatgtctcagagcaaccgggagctggtggttgactttctctcctacaagctttcccagaaaggatacagctggagtcagtttagtgatgtggaagagaacaggactgaggccccagaagggactgaatcggagatggagacccccagtgccatcaatggcaacccatcctggcacctggcagacagccccgcggtgaatggagccactggccacagcagcagtttggatgcccgggaggtgatccccatggcagcagtaaagcaagcgctgagggaggcaggcgacgagtttgaactgcggtaccggcgggcattcagtgacctgacatcccagctccacatcaccccagggacagcatatcagagctttgaacaggtagtgaatgaactcttccgggatggggtaaactggggtcgcattgtggcctttttctccttcggcggggcactgtgcgtggaaagcgtagacaaggagatgcaggtattggtgagtcggatcgcagcttggatggccacttacctgaatgaccacctagagccttggatccaggagaacggcggctgg

SEQ ID NO: 282 - DNA, 2588 bp, Homo sapiens
ggtggcaggaggccgcggctgcggagcggccgccctcgatccgggcgatggaggaggaagcaagcgagggggctggttcctgagcttcgcaattcctgtgtcgccttctgggctcccagcctgccgggtcgcatgatccctccggccggagctggtttttttgccagccaccgcgaggccggctgagttaccggcatccccgcagccacctcctctcccgacctgtgatacaaaagatcttccgggggctgcacctgcctgcctttgcctaaggcggatttgaataatcttatcttggctttggatcttagaagagaatcactaaccagagacgagactcagtgagtgagcaggtgttttggacaatggactggttgagcccatccctattataaaaatgtctcagagcaaccgggagctggtggttgactttctctcctacaagctttcccagaaaggatacagctggagtcagtttagtgatgtggaagagaacaggactgaggccccagaagggactgaatcggagatggagacccccagtgccatcaatggcaacccatcctggcacctggcagacagccccgcggtgaatggagccactggccacagcagcagtttggatgcccgggaggtgatccccatggcagcagtaaagcaagcgctgagggaggcaggcgacgagtttgaactgcggtaccggcgggcattcagtgacctgacatcccagctccacatcaccccagggacagcatatcagagctttgaacaggtagtgaatgaactcttccgggatggggtaaactggggtcgcattgtggcctttttctccttcggcggggcactgtgcgtggaaagcgtagacaaggagatgcaggtattggtgagtcggatcgcagcttggatggccacttacctgaatgaccacctagagccttggatccaggagaacggcggctgggatacttttgtggaactctatgggaacaatgcagcagccgagagccgaaagggccaggaacgcttcaaccgctggttcctgacgggcatgactgtggccggcgtggttctgctgggctcactcttcagtcggaaatgaccagacactgaccatccactctaccctcccacccccttctctgctccaccacatcctccgtccagccgccattgccaccaggagaaccactacatgcagcccatgcccacctgcccatcacagggttgggcccagatctggtcccttgcagctagttttctagaatttatcacacttctgtgagacccccacacctcagttcccttggcctcagaattcacaaaatttccacaaaatctgtccaaaggaggctggcaggtatggaagggtttgtggctgggggcaggagggccctacctgattggtgcaacccttaccccttagcctccctgaaaatgtttttctgccagggagcttgaaagttttcagaacctcttccccagaaaggagactagattgcctttgttttgatgtttgtggcctcagaattgatcattttccccccactctccccacactaacctgggttccctttccttccatccctaccccctaagagccatttaggggccacttttgactagggattcaggctgcttgggataaagatgcaaggaccaggactccctcctcacctctggactggctagagtcctcactcccagtccaaatgtcctccagaagcctctggctagaggccagccccacccaggagggagggggctatagctacaggaagcaccccatgccaaagctagggtggcccttgcagttcagcaccaccctagtcccttcccctccctggctcccatgaccatactgagggaccaactgggcccaagacagatgccccagagctgtttatggcctcagctgcctcacttcctacaagagcagcctgtggcatctttgccttgggctgctcctcatggtgggttcaggggactcagccctgaggtgaaagggagctatcaggaacagctatgggagccccagggtcttccctacctcaggcaggaagggcaggaaggagagcctgctgcatggggtggggtagggctgactagaagggccagtcctgcctggccaggcagatctgtgccccatgcctgtccagcctgggcagccaggctgccaaggccagagtggcctggccaggagctcttcaggcctccctctctcttctgctccacccttggcctgtctcatccccaggggtcccagccaccccgggctctctgctgtacatatttgagactagtttttattccttgtgaagatgatatactatttttgttaagcgtgtctgtatttatgtgtgaggagctgctggcttgcagtgcgcgtgcacgtggagagctggtgcccggagattggacggcctgatgctccctcccctgccctggtccagggaagctggccgagggtcctggctcctgaggggcatctgcccctcccccaacccccaccccacacttgttccagctctttgaaatagtctgtgtgaaggtgaaagtgcagttcagtaataaactgtgtttactcagtg

SEQ ID NO: 283 - DNA, 1157 bp, Homo sapiens
gaaaccttgaaccccattgagaagtccctttagggtttcggacgcctccacctcaccctgggctggtgcttaaatagaaaaaagaaaaacaaaaaccaactaaatccataccagccacctccgggagagtactcctggctcccagtaggaggcggagagccaaggggcgtgcaagagagagggggctgggctcccgggtggcaggaggccgcggctgcggagcggccgccctcgatccgggcgatggaggaggaagcaagcgagggggctggttcctgagcttcgcaattcctgtgtcgccttctgggctcccagcctgccgggtcgcatgatccctccggccggagctggtttttttgccagccaccgcgaggccggctgagttaccggcatccccgcagccacctcctctcccgacctgtgatacaaaagatcttccgggggctgcacctgcctgcctttgcctaaggcggatttgaataatcttatcttggctttggatcttagaagagaatcactaaccagagacgagactcagtgagtgagcaggtgttttggacaatggactggttgagcccatccctattataaaaatgtctcagagcaaccgggagctggtggttgactttctctcctacaagctttcccagaaaggatacagctggagtcagtttagtgatgtggaagagaacaggactgaggccccagaagggactgaatcggagatggagacccccagtgccatcaatggcaacccatcctggcacctggcagacagccccgcggtgaatggagccactggccacagcagcagtttggatgcccgggaggtgatccccatggcagcagtaaagcaagcgctgagggaggcaggcgacgagtttgaactgcggtaccggcgggcattcagtgacctgacatcccagctccacatcaccccagggacagcatatcagagctttgaacaggtagtgaatgaactcttccgggatggggtaaactggggtcgcattgtggcctttttctccttcggcggggcactgtgcgtggaaagcgtagacaaggagatgcaggtattggtgagtcggatcgcagcttggatggccacttacctgaatgaccacctagagccttggatccaggagaacggcggctgg

SEQ ID NO: 284 - DNA, 781 bp, Homo sapiens
ctttgcgtctcgggctcgcgcgcgttgccgcggcaccggaagtgactgagcttgcaagttcccctgtctcttcaggggaaactgaggccggcttgttcgggagagacggcgcgagcagtcagccagaatcttatcttggctttggatcttagaagagaatcactaaccagagacgagactcagtgagtgagcaggtgttttggacaatggactggttgagcccatccctattataaaaatgtctcagagcaaccgggagctggtggttgactttctctcctacaagctttcccagaaaggatacagctggagtcagtttagtgatgtggaagagaacaggactgaggccccagaagggactgaatcggagatggagacccccagtgccatcaatggcaacccatcctggcacctggcagacagccccgcggtgaatggagccactggccacagcagcagtttggatgcccgggaggtgatccccatggcagcagtaaagcaagcgctgagggaggcaggcgacgagtttgaactgcggtaccggcgggcattcagtgacctgacatcccagctccacatcaccccagggacagcatatcagagctttgaacaggtagtgaatgaactcttccgggatggggtaaactggggtcgcattgtggcctttttctccttcggcggggcactgtgcgtggaaagcgtagacaaggagatgcaggtattggtgagtcggatcgcagcttggatggccacttacctgaatgaccacctagagccttgg

SEQ ID NO: 285 - DNA, 894 bp, Homo sapiens
ggcttgttcgggagagacggcgcgagcagtcagccaggtaggccggcagccaggtaggccggcccgggtccgcggcgcggaactcggccgcgaagagctcttgcgtctggaagctaccgggccgatgaagggggatgtggccccccacggctcgcggggctcgcagaatcttatcttggctttggatcttagaagagaatcactaaccagagacgagactcagtgagtgagcaggtgttttggacaatggactggttgagcccatccctattataaaaatgtctcagagcaaccgggagctggtggttgactttctctcctacaagctttcccagaaaggatacagctggagtcagtttagtgatgtggaagagaacaggactgaggccccagaagggactgaatcggagatggagacccccagtgccatcaatggcaacccatcctggcacctggcagacagccccgcggtgaatggagccactggccacagcagcagtttggatgcccgggaggtgatccccatggcagcagtaaagcaagcgctgagggaggcaggcgacgagtttgaactgcggtaccggcgggcattcagtgacctgacatcccagctccacatcaccccagggacagcatatcagagctttgaacaggtagtgaatgaactcttccgggatggggtaaactggggtcgcattgtggcctttttctccttcggcggggcactgtgcgtggaaagcgtagacaaggagatgcaggtattggtgagtcggatcgcagcttggatggccacttacctgaatgaccacctagagccttggatccaggagaacggcggctgggatacttttgtggaactctatgggaacaatgcagcagccgagagccgaaagg

SEQ ID NO: 286 - DNA, 914 bp, Homo sapiens
ccggaagtgactgagcttgcaagttcccctgtctcttcaggggaaactgaggccggcttgttcgggagagacggcgcgagcagtcagccaggtaggccggcagccaggtaggccggcccgggtccgcggcgcggaactcggccgcgaagagctcttgcgtctggaagctaccgggccgatgaagggggatgtggccccccacggctcgcggggctcgcagctctttctctcccttcagaatcttatcttggctttggatcttagaagagaatcactaaccagagacgagactcagtgagtgagcaggtgttttggacaatggactggttgagcccatccctattataaaaatgtctcagagcaaccgggagctggtggttgactttctctcctacaagctttcccagaaaggatacagctggagtcagtttagtgatgtggaagagaacaggactgaggccccagaagggactgaatcggagatggagacccccagtgccatcaatggcaacccatcctggcacctggcagacagccccgcggtgaatggagccactggccacagcagcagtttggatgcccgggaggtgatccccatggcagcagtaaagcaagcgctgagggaggcaggcgacgagtttgaactgcggtaccggcgggcattcagtgacctgacatcccagctccacatcaccccagggacagcatatcagagctttgaacaggtagtgaatgaactcttccgggatggggtaaactggggtcgcattgtggcctttttctccttcggcggggcactgtgcgtggaaagcgtagacaaggagatgcaggtattggtgagtcggatcgcagcttggatggccacttacctgaatgaccacctagagccttggatccaggagaacggcggctgg

SEQ ID NO: 287 - DNA, 994 bp, Homo sapiens
aagactcaaacttagaaacttgaattagatgtggtattcaaatccttagctgccgcgaagacacagacagcccccgtaagaacccacgaagcaggcgaagttcattgttctcaacattctagctgctcttgctgcatttgctctggaattcttgtagagatattacttgtccttccaggctgttctttctgtagctcccttgttttctttttgtgatcatgttgcagatggctgggcagtgctcccaaaatgaatattttgacagtttgttgcatgcttgcataccttgtcaacttcgatgttcttctaatactcctcctctaacatgtcagcgttattgtaatgcaagtgtgaccaattcagtgaaaggaacgaatgcgattctctggacctgtttgggactgagcttaataatttctttggcagttttcgtgctaatgtttttgctaaggaagataaactctgaaccattaaaggacgagtttaaaaacacaggatcaggtctcctgggcatggctaacattgacctggaaaagagcaggactggtgatgaaattattcttccgagaggcctcgagtacacggtggaagaatgcacctgtgaagactgcatcaagagcaaaccgaaggtcgactctgaccattgctttccactcccagctatggaggaaggcgcaaccattcttgtcaccacgaaaacgaatgactattgcaagagcctgccagctgctttgagtgctacggagatagagaaatcaatttctgctaggtaattaaccatttcgactcgagcagtgccactttaaaaatcttttgtcagaatagatgatgtgtcagatctctttaggatgactgtatttttcagttgccgatacagctttttgtcctctaactgtggaaactctttatgttagatatatttctctaggttactgttgggagcttaatggtagaaacttccttggtttcatgattaaactcttttttttcctga

SEQ ID NO: 288 - DNA, 621 bp, Homo sapiens
ttctagctgctcttgctgcatttgctctggaattcttgtagagatattacttgtccttccaggctgttctttctgtagctcccttgttttctttttgtgatcatgttgcagatggctgggcagtgctcccaaaatgaatattttgacagtttgttgcatgcttgcataccttgtcaacttcgatgttcttctaatactcctcctctaacatgtcagcgttattgtaatgcaagatcaggtctcctgggcatggctaacattgacctggaaaagagcaggactggtgatgaaattattcttccgagaggcctcgagtacacggtggaagaatgcacctgtgaagactgcatcaagagcaaaccgaaggtcgactctgaccattgctttccactcccagctatggaggaaggcgcaaccattcttgtcaccacgaaaacgaatgactattgcaagagcctgccagctgctttgagtgctacggagatagagaaatcaatttctgctaggtaattaaccatttcgactcgagcagtgccactttaaaaatcttttgtcagaatagatgatgtgtcagatctctttaggatgactgtatttttcagttgccgatacagctttttg

SEQ ID NO: 289 - DNA, 1118 bp, Homo sapiens
aagactcaaacttagaaacttgaattagatgtggtattcaaatccttagctgccgcgaagacacagacagcccccgtaagaacccacgaagcaggcgaagttcattgttctcaacattctagctgctcttgctgcatttgctctggaattcttgtagagatattacttgtccttccaggctgttctttctgtagctcccttgttttctttttgtgatcatgttgcagatggctgggcagtgctcccaaaatgaatattttgacagtttgttgcatgcttgcataccttgtcaacttcgatgttcttctaatactcctcctctaacatgtcagcgttattgtaatgcaagtgtgaccaattcagtgaaaggaacgaatgcgattctctggacctgtttgggactgagcttaataatttctttggcagttttcgtgctaatgtttttgctaaggaagataaactctgaaccattaaaggacgagtttaaaaacacagagatggagtctcgctctgtggcccaggctggagtgcagtggcgtgatctcaactcactgcagcctctgcctcttgggttcaaacaattctcccatctcagcctcctgagtaactgggactataggatcaggtctcctgggcatggctaacattgacctggaaaagagcaggactggtgatgaaattattcttccgagaggcctcgagtacacggtggaagaatgcacctgtgaagactgcatcaagagcaaaccgaaggtcgactctgaccattgctttccactcccagctatggaggaaggcgcaaccattcttgtcaccacgaaaacgaatgactattgcaagagcctgccagctgctttgagtgctacggagatagagaaatcaatttctgctaggtaattaaccatttcgactcgagcagtgccactttaaaaatcttttgtcagaatagatgatgtgtcagatctctttaggatgactgtatttttcagttgccgatacagctttttgtcctctaactgtggaaactctttatgttagatatatttctctaggttactgttgggagcttaatggtagaaacttccttggtttcatgattaaactcttttttttcctga

SEQ ID NO: 290 - DNA, 1033 bp, Homo sapiens
gcaatctacaaggattctaatttctccacatcctgcatttaagacttgcaaagctgaattaatcacaggatgaggaagtggcttctctgaaacattttcctctttcacattttaaactttctctttcatacatgacatgaaacacagcctacgcacgaaagtgactaggaggaaggatattataaagtgatgcaaacagaaattccaccagcctccatgtatcatcatgtgtcataactcagtcaagctcagtgagcattctcagcacattgcctcaacagcttcaaggtgagccagctcaagactttgctctccaccaggcagaagatgacagactgtgaatttggatatatttacaggctggctcaggactatctgcagtgcgtcctacagataccacaacctggatcaggtccaagcaaaacgtccagagtgctacaaaatgttgcgttctcagtccaaaaagaagtggaaaagaatctgaagtcatgcttggacaatgttaatgttgtgtccgtagacactgccagaacactattcaaccaagtgatggaaaaggagtttgaagacggcatcattaactggggaagaattgtaaccatatttgcatttgaaggtattctcatcaagaaacttctacgacagcaaattgccccggatgtggatacctataaggagatttcatattttgttgcggagttcataatgaataacacaggagaatggataaggcaaaacggaggctgggaaaatggctttgtaaagaagtttgaacctaaatctggctggatgacttttctagaagttacaggaaagatctgtgaaatgctatctctcctgaagcaatactgttgaccagaaaggacactccatattgtgaaaccggcctaatttttctgactgatatggaaacgattgccaacacatacttctacttttaaataaacaactttgatgatgtaacttgaccttccagagttatggaaattttgtccccatgtaatgaataaattgtatgtatttttctctatat

SEQ ID NO: 291 - DNA, 809 bp, Homo sapiens
acagcttcaaggtgagccagctcaagactttgctctccaccaggcagaagatgacagactgtgaatttggatatatttacaggctggctcaggactatctgcagtgcgtcctacagataccacaacctggatcaggtccaagcaaaacgtccagagtgctacaaaatgttgcgttctcagtccaaaaagaagtggaaaagaatctgaagtcatgcttggacaatgttaatgttgtgtccgtagacactgccagaacactattcaaccaagtgatggaaaaggagtttgaagacggcatcattaactggggaagaattgtaaccatatttgcatttgaaggtattctcatcaagaaacttctacgacagcaaattgccccggatgtggatacctataaggagatttcatattttgttgcggagttcataatgaataacacaggagaatggataaggcaaaacggaggctgggggaaatggcacaatcacacacctatgctggtagagtcagtggcccacaagaagaggaaaatggctttgtaaagaagtttgaacctaaatctggctggatgacttttctagaagttacaggaaagatctgtgaaatgctatctctcctgaagcaatactgttgaccagaaaggacactccatattgtgaaaccggcctaatttttctgactgatatggaaacgattgccaacacatacttctacttttaaataaacaactttgatgatgtaacttgaccttccagagttatggaaattttgtccccatgtaatgaataaattgtatgtatttttctcta

SEQ ID NO: 292 - DNA, 2493 bp, Homo sapiens
gagaaaacccgcgggcctggccgggtgcaggccacccttgccggcggatcggaatccccgcccacaccgtggtctttccagcaccgcagacacctgccggctcctcccgagcggagctcagggctgacaaagcgcggtcagagcggccgcttactggggctcgcccgctccttagagcactggcaatgatgtgcggatcctcgctgctgctgctgggaaactgttgagtggctgaatgaccccaggggaccctgggagagctctgaagccctcagccaccaagtggctgggctggcaagggttcattcattcattcaacaaatacgaatgtgcagcggtgctggggtcatgatggctcggtgggcagcgaggggccgggccggctggaggagcacagtgcggattctgtcgccactgggacactgtgaaccaggagtgagtcggagctgccgcgctgcccaggccatggactgtgaggtcaacaacggttccagcctcagggatgagtgcatcacaaacctactggtgtttggcttcctccaaagctgttctgacaacagcttccgcagagagctggacgcactgggccacgagctgccagtgctggctccccagtgggagggctacgatgagctgcagactgatggcaaccgcagcagccactcccgcttgggaagaatagaggcagattctgaaagtcaagaagacatcatccggaatattgccaggcacctcgcccaggtcggggacagcatggaccgtagcatccctccgggcctggtgaacggcctggccctgcagctcaggaacaccagccggtcggaggaggaccggaacagggacctggccactgccctggagcagctgctgcaggcctaccctagagacatggagaaggagaagaccatgctggtgctggccctgctgctggccaagaaggtggccagtcacacgccgtccttgctccgtgatgtctttcacacaacagtgaattttattaaccagaacctacgcacctacgtgaggagcttagccagaaatgggatggactgaacggacagttccagaagtgtgactggctaaagctcgatgtggtcacagctgtatagctgcttccagtgtagacggagccctggcatgtcaacagcgttcctagagaagacaggctggaagatagctgtgacttctattttaaagacaatgttaaacttataacccactttaaaatatctacattaatatacttgaatgaaaatgtccatttacacgtatttgaatggccttcatatcatccacacatgaatctgcacatctgtaaatctacacacggtgcctttatttccactgtgcaggttcccacttaaaaattaaattggaaagcaggtttcaaggaagtagaaacaaaatacaatttttttggtaaaaaaaaattactgtttattaaagtacaaccatagaggatggtcttacagcaggcagtatcctgtttgaggaaagcaagaatcagagaaggaacataccccttacaaatgaaaaattccactcaaaatagggactatctatcttaatactaaggaaccaacaatcttcctgtttaaaaaaccacatggcacagagattctgaactaaagtgctgcactcaaatgatgggaagtccggccccagtacacaggggcttgactttttcaacttcgtttcctttgttggagtcaaaaagaaccacttgtggttctaaaaggtgtgaaggtgatttaagggcccaggtcagccactgtttgtttacaaaatcaggtaactaactgcatacactttttctctttccatgacatcaagactttgctaaagacatgaagccacgggtgccagaagctactgcgatgccccgggagttagccccctggtaatagctgtaaacttccaatttctagccatacgctcagctcatccatgcctcagaagtgcatctggagagaacaggtttctaagcataaaagatgaaagagcagttggactttttaaaaattcagcaaagtggttccctctcttagggacagtcaaaaccaagtcacttaggtagtaccaaaataaataaggaaaagcttagctttagaaacagtgcaacactggtctgctgttccagtggtaagctatgtcccaggaatcagtttaaaagcacgacagtggatgctgggtccatatcacacacattgctgtgaacaggaaactcctgtgaccacaacatgaggccactggagacgcatatgagtaagggcactgacggactcatgatttcttcttaccagatgctttcctgttctttaagagtttaaaatcatcagaaaggaaaaacaaactctatattgttcagcatgcaatacataccacgctagggctggctcaattgaaagtgggcaaaagcttacaaatactaaaaagaagtgctgccgcgcagtgtggaggccactgtttggaaataaatcttcctaacactac

SEQ ID NO: 293 - DNA, 854 bp, Homo sapiens
ggacgcgcccgcgcccccgcggctggagggtggtcgccactgggacactgtgaaccaggagtgagtcggagctgccgcgctgcccaggccatggactgtgaggtcaacaacggttccagcctcagggatgagtgcatcacaaacctactggtgtttggcttcctccaaagctgttctgacaacagcttccgcagagagctggacgcactgggccacgagctgccagtgctggctccccagtgggagggctacgatgagctgcagactgatggcaaccgcagcagccactcccgcttgggaagaatagaggcaggggcgtcagacaataacacagcaagtgctgaggaagaaacggaggcggcagggagcgtggcagttgagcgtggccttcatggagctgcgacagtgattctgaaagtcaagaagacatcatccggaatattgccaggcacctcgcccaggtcggggacagcatggaccgtagcatccctccgggcctggtgaacggcctggccctgcagctcaggaacaccagccggtcggaggaggaccggaacagggacctggccactgccctggagcagctgctgcaggcctaccctagagacatggagaaggagaagaccatgctggtgctggccctgctgctggccaagaaggtggccagtcacacgccgtccttgctccgtgatgtctttcacacaacagtgaattttattaaccagaacctacgcacctacgtgaggagcttagccagaaatgggatggactgaacggacagttccagaagtgtgactggctaaagctcgatgtggtcacagctgtatagctgcttccagtgtagacggagccct

SEQ ID NO: 294 - DNA, 1879 bp, Homo sapiens
ggaagcgcgcggggcgccataaggaggaagcgggtagtcgaccgtgtccgcgcgcctgggagacgctgcctcggcccggacgcgcccgcgcccccgcggctggagggtgattctgaaagtcaagaagacatcatccggaatattgccaggcacctcgcccaggtcggggacagcatggaccgtagcatccctccgggcctggtgaacggcctggccctgcagctcaggaacaccagccggtcggaggaggaccggaacagggacctggccactgccctggagcagctgctgcaggcctaccctagagacatggagaaggagaagaccatgctggtgctggccctgctgctggccaagaaggtggccagtcacacgccgtccttgctccgtgatgtctttcacacaacagtgaattttattaaccagaacctacgcacctacgtgaggagcttagccagaaatgggatggactgaacggacagttccagaagtgtgactggctaaagctcgatgtggtcacagctgtatagctgcttccagtgtagacggagccctggcatgtcaacagcgttcctagagaagacaggctggaagatagctgtgacttctattttaaagacaatgttaaacttataacccactttaaaatatctacattaatatacttgaatgaaaatgtccatttacacgtatttgaatggccttcatatcatccacacatgaatctgcacatctgtaaatctacacacggtgcctttatttccactgtgcaggttcccacttaaaaattaaattggaaagcaggtttcaaggaagtagaaacaaaatacaatttttttggtaaaaaaaaattactgtttattaaagtacaaccatagaggatggtcttacagcaggcagtatcctgtttgaggaaagcaagaatcagagaaggaacataccccttacaaatgaaaaattccactcaaaatagggactatctatcttaatactaaggaaccaacaatcttcctgtttaaaaaaccacatggcacagagattctgaactaaagtgctgcactcaaatgatgggaagtccggccccagtacacaggggcttgactttttcaacttcgtttcctttgttggagtcaaaaagaaccacttgtggttctaaaaggtgtgaaggtgatttaagggcccaggtcagccactgtttgtttacaaaatcaggtaactaactgcatacactttttctctttccatgacatcaagactttgctaaagacatgaagccacgggtgccagaagctactgcgatgccccgggagttagccccctggtaatagctgtaaacttccaatttctagccatacgctcagctcatccatgcctcagaagtgcatctggagagaacaggtttctaagcataaaagatgaaagagcagttggactttttaaaaattcagcaaagtggttccctctcttagggacagtcaaaaccaagtcacttaggtagtaccaaaataaataaggaaaagcttagctttagaaacagtgcaacactggtctgctgttccagtggtaagctatgtcccaggaatcagtttaaaagcacgacagtggatgctgggtccatatcacacacattgctgtgaacaggaaactcctgtgaccacaacatgaggccactggagacgcatatgagtaagggcactgacggactcatgatttcttcttaccagatgctttcctgttctttaagagtttaaaatcatcagaaaggaaaaacaaactctatattgttcagcatgcaatacataccacgctagggctggctcaattgaaagtgggcaaaagcttacaaatactaaaaagaagtgctgccgcgcagtgtgga

SEQ ID NO: 295 - DNA, 2126 bp, Homo sapiens
ggaggaagcgcgcggggcgccataaggaggaagcgggtagtcgaccgtgtccgcgcgcctgggagacgctgcctcggcccggacgcgcccgcgcccccgcggctggagggtggtcaacaacggttccagcctcagggatgagtgcatcacaaacctactggtgtttggcttcctccaaagctgttctgacaacagcttccgcagagagctggacgcactgggccacgagctgccagtgctggctccccagtgggagggctacgatgagctgcagactgatggcaaccgcagcagccactcccgcttgggaagaatagaggcagattctgaaagtcaagaagacatcatccggaatattgccaggcacctcgcccaggtcggggacagcatggaccgtagcatccctccgggcctggtgaacggcctggccctgcagctcaggaacaccagccggtcggaggaggaccggaacagggacctggccactgccctggagcagctgctgcaggcctaccctagagacatggagaaggagaagaccatgctggtgctggccctgctgctggccaagaaggtggccagtcacacgccgtccttgctccgtgatgtctttcacacaacagtgaattttattaaccagaacctacgcacctacgtgaggagcttagccagaaatgggatggactgaacggacagttccagaagtgtgactggctaaagctcgatgtggtcacagctgtatagctgcttccagtgtagacggagccctggcatgtcaacagcgttcctagagaagacaggctggaagatagctgtgacttctattttaaagacaatgttaaacttataacccactttaaaatatctacattaatatacttgaatgaaaatgtccatttacacgtatttgaatggccttcatatcatccacacatgaatctgcacatctgtaaatctacacacggtgcctttatttccactgtgcaggttcccacttaaaaattaaattggaaagcaggtttcaaggaagtagaaacaaaatacaatttttttggtaaaaaaaaattactgtttattaaagtacaaccatagaggatggtcttacagcaggcagtatcctgtttgaggaaagcaagaatcagagaaggaacataccccttacaaatgaaaaattccactcaaaatagggactatctatcttaatactaaggaaccaacaatcttcctgtttaaaaaaccacatggcacagagattctgaactaaagtgctgcactcaaatgatgggaagtccggccccagtacacaggggcttgactttttcaacttcgtttcctttgttggagtcaaaaagaaccacttgtggttctaaaaggtgtgaaggtgatttaagggcccaggtcagccactgtttgtttacaaaatcaggtaactaactgcatacactttttctctttccatgacatcaagactttgctaaagacatgaagccacgggtgccagaagctactgcgatgccccgggagttagccccctggtaatagctgtaaacttccaatttctagccatacgctcagctcatccatgcctcagaagtgcatctggagagaacaggtttctaagcataaaagatgaaagagcagttggactttttaaaaattcagcaaagtggttccctctcttagggacagtcaaaaccaagtcacttaggtagtaccaaaataaataaggaaaagcttagctttagaaacagtgcaacactggtctgctgttccagtggtaagctatgtcccaggaatcagtttaaaagcacgacagtggatgctgggtccatatcacacacattgctgtgaacaggaaactcctgtgaccacaacatgaggccactggagacgcatatgagtaagggcactgacggactcatgatttcttcttaccagatgctttcctgttctttaagagtttaaaatcatcagaaaggaaaaacaaactctatattgttcagcatgcaatacataccacgctagggctggctcaattgaaagtgggcaaaagcttacaaatactaaaaagaagtgctgccgcgcagtgtggaggccactgtttggaaataaatcttcctaacact

SEQ ID NO: 296 - DNA, 2167 bp, Homo sapiens
ggaggaagcgcgcggggcgccataaggaggaagcgggtagtcgaccgtgtccgcgcgcctgggagacgctgcctcggcccggacgcgcccgcgcccccgcggctggagggtggtcgccactgggacactgtgaaccaggagtgagtcggagctgccgcgctgcccaggccatggactgtgaggtcaacaacggttccagcctcagggatgagtgcatcacaaacctactggtgtttggcttcctccaaagctgttctgacaacagcttccgcagagagctggacgcactgggccacgagctgccagtgctggctccccagtgggagggctacgatgagctgcagactgatggcaaccgcagcagccactcccgcttgggaagaatagaggcagattctgaaagtcaagaagacatcatccggaatattgccaggcacctcgcccaggtcggggacagcatggaccgtagcatccctccgggcctggtgaacggcctggccctgcagctcaggaacaccagccggtcggaggaggaccggaacagggacctggccactgccctggagcagctgctgcaggcctaccctagagacatggagaaggagaagaccatgctggtgctggccctgctgctggccaagaaggtggccagtcacacgccgtccttgctccgtgatgtctttcacacaacagtgaattttattaaccagaacctacgcacctacgtgaggagcttagccagaaatgggatggactgaacggacagttccagaagtgtgactggctaaagctcgatgtggtcacagctgtatagctgcttccagtgtagacggagccctggcatgtcaacagcgttcctagagaagacaggctggaagatagctgtgacttctattttaaagacaatgttaaacttataacccactttaaaatatctacattaatatacttgaatgaaaatgtccatttacacgtatttgaatggccttcatatcatccacacatgaatctgcacatctgtaaatctacacacggtgcctttatttccactgtgcaggttcccacttaaaaattaaattggaaagcaggtttcaaggaagtagaaacaaaatacaatttttttggtaaaaaaaaattactgtttattaaagtacaaccatagaggatggtcttacagcaggcagtatcctgtttgaggaaagcaagaatcagagaaggaacataccccttacaaatgaaaaattccactcaaaatagggactatctatcttaatactaaggaaccaacaatcttcctgtttaaaaaaccacatggcacagagattctgaactaaagtgctgcactcaaatgatgggaagtccggccccagtacacaggggcttgactttttcaacttcgtttcctttgttggagtcaaaaagaaccacttgtggttctaaaaggtgtgaaggtgatttaagggcccaggtcagccactgtttgtttacaaaatcaggtaactaactgcatacactttttctctttccatgacatcaagactttgctaaagacatgaagccacgggtgccagaagctactgcgatgccccgggagttagccccctggtaatagctgtaaacttccaatttctagccatacgctcagctcatccatgcctcagaagtgcatctggagagaacaggtttctaagcataaaagatgaaagagcagttggactttttaaaaattcagcaaagtggttccctctcttagggacagtcaaaaccaagtcacttaggtagtaccaaaataaataaggaaaagcttagctttagaaacagtgcaacactggtctgctgttccagtggtaagctatgtcccaggaatcagtttaaaagcacgacagtggatgctgggtccatatcacacacattgctgtgaacaggaaactcctgtgaccacaacatgaggccactggagacgcatatgagtaagggcactgacggactcatgatttcttcttaccagatgctttcctgttctttaagagtttaaaatcatcagaaaggaaaaacaaactctatattgttcagcatgcaatacataccacgctagggctggctcaattgaaagtgggcaaaagcttacaaatactaaaaagaagtgctgccgcgcagtgtggaggcc

SEQ ID NO: 297 - DNA, 700 bp, Homo sapiens
cactgtctgaaacagtcgcgtaaggggtcgccactgggacactgtgaaccaggagtgagtcggagctgccgcgctgcccaggccatggactgtgaggtcaacaacggttccagcctcagggatgagtgcatcacaaacctactggtgtttggcttcctccaaagctgttctgacaacagcttccgcagagagctggacgcactgggccacgagctgccagtgctggctccccagtgggagggctacgatgagctgcagactgatggcaaccgcagcagccactcccgcttgggaagaatagaggcagattctgaaagtcaagaagacatcatccggaatattgccaggcacctcgcccaggtcggggacagcatggaccgtagcatccctccgggcctggtgaacggcctggccctgcagctcaggaacaccagccggtcggaggaggaccggaacagggacctggccactgccctggagcagctgctgcaggcctaccctagagacatggagaaggagaagaccatgctggtgctggccctgctgctggccaagaaggtggccagtcacacgccgtccttgctccgtgatgtctttcacacaacagtgaattttattaaccagaacctacgcacctacgtgaggagcttagccagaaatgggatggactgaacggacagttccagaagtgtgactggct

SEQ ID NO: 298 - DNA, 953 bp, Homo sapiens
gcagacacgaagcctcccgggtggcttacagacgctgccagcatcgccgccgccagaggagaaatgtctgaagtaagacccctctccagagacatcttgatggagaccctcctgtatgagcagctcctggaacccccgaccatggaggttcttggcatgactgactctgaagaggacctggaccctatggaggacttcgattctttggaatgcatggagggcagtgacgcattggccctgcggctggcctgcatcggggacgagatggacgtgagcctcagggccccgcgcctggcccagctctccgaggtggccatgcacagcctgggtctggctttcatctacgaccagactgaggacatcagggatgttcttagaagtttcatggacggtttcaccacacttaaggagaacataatgaggttctggagatccccgaaccccgggtcctgggtgtcctgcgaacaggtgctgctggcgctgctgctgctgctggcgctgctgctgccgctgctcagcgggggcctgcacctgctgctcaagtgaggccccggcggctcagggcggggctggccccacccccatgaccactgccctggaggtggcggcctgctgctgttatctttttaactgttttctcatgatgcctttttatatttaaaccccgagatagtgctggaacactgctgaggttttatactcaggttttttgttttttttttattccagttttcgttttttctaaaagatgaattcctatggctctgcaattgtcaccggttaactgtggcctgtgcccaggaagagccattcactcctgcccctgcccacacggcaggtagcagggggagtgctggtcacacccctgtgtgatatgtgatgccctcggcaaagaatctactggaatagattccgaggagcaggagtgctcaataaaatgttggtttccagca

SEQ ID NO: 299 - DNA, 1522 bp, Homo sapiens
acttcgctccgcgcagccgcctggtctgcagtttgttggagctctgcgtccagcgccgctgccgctgccgccgccgccgccgccgccgccgccgccgccgccgccgccactaccaccacttgattcttgcagccaccctgcgaaccctgccacactgcgatcgcatcatcgcggtattcggttcgctgcgttcccgccgccaccgcctcggcgccctttcttggcccttgttcccccaaatgtctgactctgactctcggactgagaaacgcaagaaaaaaagaccaaatggcaaagcaaccttctgatgtaagttctgagtgtgaccgagaaggtagacaattgcagcctgcggagaggcctccccagctcagacctggggcccctacctccctacagacagagccacaagacaggagcccagcacccatgagttgtgacaaatcaacacaaaccccaagtcctccttgccaggccttcaaccactatctcagtgcaatggcttccatgaggcaggctgaacctgcagatatgcgcccagagatatggatcgcccaagagttgcggcgtattggagacgagtttaacgcttactatgcaaggagggtatttttgaataattaccaagcagccgaagaccacccacgaatggttatcttacgactgttacgttacattgtccgcctggtgtggagaatgcattgacaggttctttgcggagccgagataccatgcagacattttgcttgttcaaaccaacaagacccagcaccgcggtctcctggtgccattattatgcagccagcggttctcttgtggagggggcaggtgacgtttcagaagacaccgagctggatgggactacctttctgttcatcaccacacagcagaatttctaatggaagtttgttgtgaatgtaaaggagggagcattctttgctttttaatatacaaaccatggttttttggagcaggattttgtgtaagaatggtgtttacatgcagtgtgttttccccctcaccttcaataaggtttttcaaaaaggaaatggaaactttttaaccaatttgtgaataacttttgtattaaaattttaagaacctacggcctattctcagaggattatgtaacccctgcagtggaaactgagccagctaacttaaaaagctgccttagtttatttttagagattacagaatttttaaacagggagacgtgtgatatactccctcccttccctactattgcctctctgacctttttaaattatttttaataccaaaagagttcttttgaaatggaactgattaaaagggcagagggtctgttgccagcctgcattgatataccagtcccatttgtaaatatttacgtacctttataaattcagttgcatctgtggcaaaatttcagactatttttgcgtctttcctcatcactttttgtgatgcaactccagtctggactcagatgcatagatttggtccagtgtattttcatgataaagtgaaattgagtcag

SEQ ID NO: 300 - DNA, 722 bp, Homo sapiens
acttcgctccgcgcagccgcctggtctgcagtttgttggagctctgcgtccagcgccgctgccgctgccgccgccgccgccgccgccgccgccgccgccgccgccgccactaccaccacttgattcttgcagccaccctgcgaaccctgccacactgcgatcgcatcatcgcggtattcggttcgctgcgttcccgccgccaccgcctcggcgccctttcttggcccttgttcccccaaatgtctgactctgactctcggactgagaaacgcaagaaaaaaagaccaaatggcaaagcaaccttctgatgtaagttctgagtgtgaccgagaaggtagacaattgcagcctgcggagaggcctccccagctcagacctggggcccctacctccctacagacagagccacaagacaggagcccagcacccatgagttgtgacaaatcaacacaaaccccaagtcctccttgccaggccttcaaccactatctcagtgcaatggtagtcatcctagaggatataggtgatctttcactgtgctttggatttatatttactggcttagatttgtatggccaccaccatagtcaagatacagaacaactcaaccacaaggatttctcatgatacctttttatagccacagccacctctctccctcttccttgagcattttgtcatatggtcattggtgattaaataaaatgtattttaatattgac

SEQ ID NO: 301 - DNA, 807 bp, Homo sapiens
acttcgctccgcgcagccgcctggtctgcagtttgttggagctctgcgtccagcgccgctgccgctgccgccgccgccgccgccgccgccgccgccgccgccgccgccactaccaccacttgattcttgcagccaccctgcgaaccctgccacactgcgatcgcatcatcgcggtattcggttcgctgcgttcccgccgccaccgcctcggcgccctttcttggcccttgttcccccaaatgtctgactctgactctcggactgagaaacgcaagaaaaaaagaccaaatggcaaagcaaccttctgatgtaagttctgagtgtgaccgagaaggtagacaattgcagcctgcggagaggcctccccagctcagacctggggcccctacctccctacagacagagccacaaggtaatcctgaaggcaatcacggaggtgaaggggacagctgcccccacggcagccctcagggcccgctggccccacctgccagccctggcccttttgctaccagatccccgcttttcatctttatgagaagatcctccctgctgtctcgatcctccagtgggtatttctcttttgacacagacaggagcccagcacccatgagttgtgacaaatcaacacaaaccccaagtcctccttgccaggccttcaaccactatctcagtgcaatggcttccatgaggcaggctgaacctgcagatatgcgcccagagatatggatcgcccaagagttgcggcgtattggagacgagtttaacgcttactatgcaaggaggatgcctcttccacctgattaa

SEQ ID NO: 302 - DNA, 482 bp, Homo sapiens
gcggccggggcagcgcgggccagaggcgcggcgtgcggagccctcggctgcccggcggagcgcggcggcgggctggcgggaaggcgcgggctttgcgctgcgccggggactctgaacccgagtcccgggctttgtctcctgcgctgctttcgtggtgacggtcagggggcgcccggtcggcgaagggcgcgggccggacgccgcggggcttggtccctggcccggacgctgcgctctgaagggaaggcgcggacaaaaaaagaccaaatggcaaagcaaccttctgatgtaagttctgagtgtgaccgagaaggtagacaattgcagcctgcggagaggcctccccagctcagacctggggcccctacctccctacagacagagccacaaggtaatcctgaaggcaatcacggaggtgaaggggacagctgcccccacggcagccctcagggcccgctggccccacctgccagccctggccc

SEQ ID NO: 303 - DNA, 546 bp, Homo sapiens
acttcgctccgcgcagccgcctggtctgcagtttgttggagctctgcgtccagcgccgctgccgctgccgccgccgccgccgccgccgccgccgccgccgccgccgccactaccaccacttgattcttgcagccaccctgcgaaccctgccacactgcgatcgcatcatcgcggtattcggttcgctgcgttcccgccgccaccgcctcggcgccctttcttggcccttgttcccccaaatgtctgactctgactctcggactgagaaacgcaagaaaaaaagaccaaatggcaaagcaaccttctgatgtaagttctgagtgtgaccgagaaggtagacaattgcagcctgcggagaggcctccccagctcagacctggggcccctacctccctacagacagagccacaagcttccatgaggcaggctgaacctgcagatatgcgcccagagatatggatcgcccaagagttgcggcgtattggagacgagtttaacgcttactatgcaaggaggctggcaaaactcctggcatcctccacctga

SEQ ID NO: 304 - DNA, 3649 bp, Homo sapiens
gccgcctggtctgcagtttgttggagctctgcgtccagcgccgctgccgctgccgccgccgccgccgccgccgccgccgccgccgccgccgccactaccaccacttgattcttgcagccaccctgcgaaccctgccacactgcgatcgcatcatcgcggtattcggttcgctgcgttcccgccgccaccgcctcggcgccctttcttggcccttgttcccccaaatgtctgactctgactctcggactgagaaacgcaagaaaaaaagaccaaatggcaaagcaaccttctgatgtaagttctgagtgtgaccgagaaggtagacaattgcagcctgcggagaggcctccccagctcagacctggggcccctacctccctacagacagagccacaaggtaatcctgaaggcaatcacggaggtgaaggggacagctgcccccacggcagccctcagggcccgctggccccacctgccagccctggcccttttgctaccagatccccgcttttcatctttatgagaagatcctccctgctgtctcgatcctccagtgggtatttctcttttgacacagacaggagcccagcacccatgagttgtgacaaatcaacacaaaccccaagtcctccttgccaggccttcaaccactatctcagtgcaatggcttccatgaggcaggctgaacctgcagatatgcgcccagagatatggatcgcccaagagttgcggcgtattggagacgagtttaacgcttactatgcaaggagggtatttttgaataattaccaagcagccgaagaccacccacgaatggttatcttacgactgttacgttacattgtccgcctggtgtggagaatgcattgacaggttctttgcggagccgagataccatgcagacattttgcttgttcaaaccaacaagacccagcaccgcggtctcctggtgccattattatgcagccagcggttctcttgtggagggggcaggtgacgtttcagaagacaccgagctggatgggactacctttctgttcatcaccacacagcagaatttctaatggaagtttgttgtgaatgtaaaggagggagcattctttgctttttaatatacaaaccatggttttttggagcaggattttgtgtaagaatggtgtttacatgcagtgtgttttccccctcaccttcaataaggtttttcaaaaaggaaatggaaactttttaaccaatttgtgaataacttttgtattaaaattttaagaacctacggcctattctcagaggattatgtaacccctgcagtggaaactgagccagctaacttaaaaagctgccttagtttatttttagagattacagaatttttaaacagggagacgtgtgatatactccctcccttccctactattgcctctctgacctttttaaattatttttaataccaaaagagttcttttgaaatggaactgattaaaagggcagagggtctgttgccagcctgcattgatataccagtcccatttgtaaatatttacgtacctttataaattcagttgcatctgtggcaaaatttcagactatttttgcgtctttcctcatcactttttgtgatgcaactccagtctggactcagatgcatagatttggtccagtgtattttcatgataaagtgaaattgagtcagaacaagagttaatatctgcctgtatcttgcacagttcgagcgatctgttattaactgggaagcatttggtgttggttttcattccatttcgacgagcatgttattgggaagtattctgaagaggcaatagcagtaataacaacagacttaagtgctacgcccctttgtgctgctggcttttctggttgcaggctttcccatggtcacaggatgcactgtcagcatcaggtcccagagggccaccgtgtccattacagcagagtccagctgcagcatccagctcacgccctcatgggaattggcacaggcctggggcagggcttctgatggccatttgcttggcctcctgcattttagtccaactcacagtccactagcttcactcctttaaattcactttgaaacaggcctcatcccacttccaccagcaccatagaagaataattctgggcagaagtctgttttttttcatttttccaggacagttggatattgtcaggccacttgtgaccccagccatgtagtgagggtgctctttctctgtgcctgctccttatgagtgcagtggaaggaagccacacactggtcagtcatttcagaggcagcagatgcccagggagacccaagaaagagtcaggttagggagcagtgaaagtgaggagggaagacaattctgtgaactctgtaactcttaaaatttttgaaaactccatcgttaaacaacttttaaaagaaataactaaattttcaaatgagtaagcagtgccaccaactagtgttttgcccgatagaagagccagcatgttcacgttatttaaattaggtggaaaaatctaaacatttttatcttcataatttaaaaaatatatatgtatatattgcatattcactttttcctttaggtagagatgatttcaatccaaatactcttactttaaaaaatttcctttccccaagaatctccttgggactttgacttatttttaaagctgtgttggagctcatcttgttccctgatgtgtctcgagcccattggtagggtcatacaaagcccacggttacaagcagtggtaggattgcagccgtgggcctgctggacacacacatacaccaaagatgtatttggatctgggcaccccctcccaggatccctgtactcacgtgccagtctcctgactagagcactttactctgtttcctcagccctgcagcccctgggagcacacactgggtgcagccctgggccaggcacgggaggccctgccctgtgctgcccaggggctgtgtgcaccacatgagcacatttccctctggcctggcggcctccaggctggctgtggaaacagttcctgaggaaattagagattctatgaattgtaggagtattaaagaccaggctgttggcaccagaacttaaagcgatgactggatgtctctgtactgtatgtatctggttatcaagatgcctctgtgcagaaagtatgcctcccgtgggtatacgtttttaccttttttaaaaaacatttttgtagaaaaaataattaaatcccctttttggaaacttactgcaggttttgtgccttgacaacctctccctatgtgaggtttgtaaaaagtgtcctgtgacttaacacagaaacgcaataaacacacacaaaatagtttcatgagtgattcttcagatgcccttcccaactggttagttgatcaagaattttgggggtgggggttgcggagaaatcaagtttaaaattccttctgattaaaaaaatatagtggaatacaattgtctgccgtttccccttcttaatgtatatattgtgagtatttattagattcgtaggtcatattacttatcaactgagccaaatgtctgtgtgcaattgtgtttcctttaccttgtaaaattttgtacagcataaataagtaaaaaaatcactgtttttctcaactttttcaaaa

SEQ ID NO: 305 - DNA, 572 bp, Homo sapiens
gacgcgcgtcctccagcgactccgggaacccaaggcctccttcacctcgctcaaaattcacccgaaaatgcgctgagactttggcatggggctgcgctgtgtcccactgacgttacagaagcgcttatgaatttaaaaactgctccaggcggccggacggcgggacaacgcctcctcacttgctcctctacgaaaaaaagaccaaatggcaaagcaaccttctgatgtaagttctgagtgtgaccgagaaggtagacaattgcagcctgcggagaggcctccccagctcagacctggggcccctacctccctacagacagagccacaaggtaatcctgaaggcaatcacggaggtgaaggggacagctgcccccacggcagccctcagggcccgctggccccacctgccagccctggcccttttgctaccagatccccgcttttcatctttatgagaagatcctccctgctgtctcgatcctccagtgggtatttctcttttgacacagacaggagcccagcacccatgagttgtgacaaatcaacacaaaccccaagtcctccttgccagg

SEQ ID NO: 306 - DNA, 2030 bp, Homo sapiens
gtgagatgggcttgcctctagagacttatctttggaactttcccagtgatctgtggaccacaatgtgatttttgttttgttttgttctgatgcagcttccatgaggcaggctgaacctgcagatatgcgcccagagatatggatcgcccaagagttgcggcgtattggagacgagtttaacgcttactatgcaaggagggtaatgatgttttctttacccgcttttctgctcacaccctccccttccacactatatttttttaaaaagacagtgacttcttgtaactacatgctaattctggaaatgattactgttgcctagttgtgacctttcattgtttctcctttcccatttttcatttgttttatgactaagtaatggcacttaaataaaataatacagtaggaggcagcaaaggaattttatgagcacagactttaaaacaatgctaaaaaagggattatttatagactttgagatagtctagaaatactattaacataggtttcaatccatgtagtgtgtttctgtactccccttgtgcattttaggtcaaagttaaaggtaatttttaaacaacatcttttgtcacttagcgcatgggagcgatgccagcactcatgtaaaagactctcctgcaatttgcagggtggcccgaggaagcagggagccattgcccttgcagagcccattgctgtctttggacatttaattgttgaaatgtattaggaggccgctaatcaatagcctgtaatttgggctgtaaaaactttatattatagataattgccacttattttgagctatgttcttgattttttaaaaattttagcctatgtcatcttctgtagttagtagaagcggtgttttttgtttgttttacctgggggcaatgtaggtgaccatttggacacctttttcacatgggacacttttgtttgtttgtttgtttgtttgtgtgtgtgtttgtttttgagacggagtcttgctctgtcaccaggctgaaagattgcaccattgcactctagcctccacaagagcgaaactccatctaaaaaaaaaaatagttcaaaacactggatgatgctgtggatagtgacaccgtgatcttcaaagccacagacacccgtcttgatacttgttagattaaaaacagtccattgtctggaatcacacttaatggtccattgttaaatattgggggcagaaatctgggaaggtaatgggaggccgttttgggaaataatgaattcaaattacctgctgtcttcacaagggaattatcctctcttggcaagcgagtgtatctcactgtgctgctttaggatggatattaaccttttaaatgttgagtgtctttatttgcttaatgctattacaatgccttgtctaaagtgttagtcttttattgccacgagccttgcaaagcctgacaggatattttcccgtttttccagttagagaaatagaggaagttgtcgtgtagttgtcatgtattcagtccacttaagggcagtggggaagcgtttgagacggagctgtggaggctgaatccttgaaggaggaggtgagagaggcacaggtgagcgcaaagtcccagtgcatgtcccctcttctctcccgatgcagtgtcattcccaggtgaacctgccgggctgaacggcctggcccctctattcagtcggagttttactactccagtggattttggtaacttcatttggaaataatttcagacttacaaaaatgttgcaagaatgacacaaagaaccacccttttatatctgccccacttgttttcatgttttccctctttgcacacatgtacaatttatttcagaaaaaactacagacatgatactgcttttcctacactaaaaatacttcagtgtatatttcccaaaaataggagtaatcccttatgtaaccacagtgtaattatcaaaattcacaaatagtgttacaaaactattatctgatctatggaccttattcagattttaccacttgtcccaacaatgcccttctc

SEQ ID NO: 307 - DNA, 4288 bp, Homo sapiens
atggagccatctcagtgtgtggaggagctggaggatgatgtgttccaaccagaggatggggagccggtgacccaacccgggagcttgctctctgctgacctgtttgcccagagcctactggactgccccctcagccgacttcagctcttccctctcacccactgctgtggccctggccttcgacccaccagccaggaagacaaagctacccagactctcagcccagcctcccccagccaaggtgtcatgctgccttgtggggtgactgaggaaccccagcgactcttttatgcaccagcagaaccaaaatcgtgtgtggtggcagatcctcctcttcctgcacaaccttgctttgaatggagaagagaacaggaacggggcaggccctaggtgagggtgggctgccctcttcacatggggcaccaggaacaccgtctggaacaggaaggacatcgggcaggactgacactgtgtcttgtgaaattgtttttttgttgttattttgtgttttaattttttttaatttctctctgagtgtacatacaacatactcaagcgggaccttctttctctgtcaggcccttgacctggaatgggggcctttgtcaaacactgttgaaggagaggctgatgtgtctgtgatggtgagaattcccaagggctctgacaagtagattcttcgactgaggaatctaccagttgtcgaagatgatccgttagtgatgttctctgggaagtggactgtggtttttccagaggaactcagttaagaaatcgagagtggattagactcccagttccaccaaacctatgagccttccactgtggatgggggccgtgatcctgatggtcacattgctttaacccagcagggcttcggccaggggctttccacttgaggatagcagcttcactaggctggccggccagctccacatctgactgggttcttacttctcagccagtacctgccccatgggctcaaggattcctggccagctcctgccacctccagcagacctcagggagggttgagtttctctaaggacccctcaaacatgtcgcaaaatgaaccaaacttctggctaggcctcaaaactgacttggtcccacttggaggccccaggattggtcctgaggtacagagccactgccaccactggcggcctgggaccagctgggtgtcagccacggatgagccgaatagccagtcagcatgttgctgctggcagcctgtgcctttgtcagctcttctttcaaaagaccccaccgacagaccgcattccacccccaacatcggcactgagggacatcgggggcaagtttgcagtggggccggaaaatatggtggccaccctaccatgagagtcagccgtaggggaccccagaccccttggtttccttggaaacaacatacctcttcccccttatccccagtcctttttcatacctagtgggatacagaagaagccaggacagtggctttgccagctaagtgacttttagagtaacagataacgattagagtggggaaccgtcaaagctgggtacacatttcctatcttcctccagcttccagctaggccagaagggcatgctctggaacccagcaggatcacagctgcctgtgcacgtcttcccttctctccctgctgcggcacttatggagaggatctaaagcagccggtgtggcagctccgatagcaggcacagggaatctgttaaccagacgctagaaactaaattataacttttgcatatgtgagaaaagacaacattggtgctaacagtgaagtaaggcccaaaggaaagacggcttccctggacaaagaagacctcagggctacccaaggaaataggaggagtctagagtagactcacaaatctgaacaagcccaagtcttccagttctgaggagaggaggtcttcagtactattgaaggagacattgatcttctggatgtacagttgtgcaggttgttcactgcacaagggcacctgcagctaatggaggctggaattcagcttgtgttctgctcactaagctgtgtgcgtgccctggtgtggggctacttctcccaagaagaaggggtgcctttcctaatttgcaaaggtgccatatgggctcacagcaccctggaggagaagggcctcaaactgtgcatgtaagcctttgttttgttctgctcagatattctggatattacctcttcttggtcagaattctattctcagggtgtgtaccatgatttgtctgctaagaagacgggttcctgctttgcagagaaggagccggggaccagcttgaagactggctctgggacacactgaccattgtgaaattcagccttccctgtgggtctccataccattttatgatgtgtatgggacatacgttgttctcccctctctggatcaaggtggtgacaggcagcctgctgccgtatgcttcagtggcacacaccaaaaaaccgggattatttacagcagccactattcaccccttttggcagactctccacctgagttcagtgagagagaaaatgatttagatcttggtgctggggcaaggccatcagcttcagagaccttgccaggcccaggctgggtgccctgtggcctgagaactgagcccagactttgacaaacccacctcaacatcaagcctggggcaggtggaaggtggtctgactgcactgtctccatcttatgcaaagccaggaactcactcactgtcttaagtgagccagggcaaaatttacacccctcacgtttccctctcccttcttccccaccaacaaaacccaggaggtagctggcagagtagctgtcaggaaggagaaaggttctttctggctggttgtttttaattggcttagtgatctaaactggccccttcctcctctgcctggtgagttggcctaaacattcctcaagtctagcctcaggagacctgcccctcccccccgacctccaccccctcagactccatcccccacccccaggagcctggctgtctctagcgaggggtggagaatcagatttagagggagggagagtctgacctggatcctgacctgtaaccagctgaagacggtggaggctttgtggcttgctgagggtgggggttgggagagggactggaaaccttcctcctcgggaaagaaatgcctgggaggaagggaagcctgatattcagggtcaaaacagcccttctaattcacaaccccaaagcaggggtttctagaagttggtcaacagatctggtgagggaagtccccaggccagacgctggactcctgcaatgagggtggaggactcagcctggcctctgcctggcctgtttcaaagtctgggccactggcagccttctcttgctcaatccgaggtggaaaaagatcacctcccagtgacctccctcagcccccaggggagtaggtctgtgtccaaagctatgtggcaggcttgtttgaaggacccagaggggcccagctgacctgtctcactgctcctggcagcccagccccatcggcaggtggcccctgcctgggggttattcgggatggttcagccagggcctcccaggaagagtgctgtggagccacggtgactgtcctggacagcaaggagcatgctaccccagtgagcacttctttttgagggacttgatggggaggtggggtaggcagaagggacgtggcagaagcgggaagactttggtcaccatggctctgcaggccttctgcaaatcagtgctggcctgggctggaaacagctctgtgtgtgaaggtgaggactcttggaagcaggccatcctggccagacaccctagcaggaaggggctcacctgtcacccttaggcagcctgagggctggtggggacttttgagtcttgaggggatagcggaaaaagctgagctcataggtgcccagccagcctcccagctaaaggtgctcagagccccactgccccctctctctgtgcaggtggccagtgcccctccctgctctgggagcattgctagccttctaccccatccctggatccacaggggctatcgaggagacccagtgagaatgtagcattttgttcatccccagggtagctgccctggggtctgggcactctgcctctgggagagaggaagaagaaaggggccccattttttaaaaaactgtacagagcctttggctttatgtgtttatgttcttcacatgcatatgtgtgtatgtgtgtatatctttccccccatcaattggtacaatttttaataaaatcatttaaagc

SEQ ID NO: 308 - DNA, 4687 bp, Homo sapiens
ggaaacaataccgcaccgtgcggagtggcctcctcccgccccggcctgtgcccgccgccgccgccgcccctgcctgcgcctcccgcctcctgccgcagcccgctgggctttttccctccttcccaatcgagtctgggcgtccagcccccgagtgctcgtcacgctggaccctggcgcggagccctggcatcacgactcggaggccgagactctctcctggagtcacccaggagagatggagccatctcagtgtgtggaggagctggaggatgatgtgttccaaccagaggatggggagccggtgacccaacccgggagcttgctctctgctgacctgtttgcccagagcctactggactgccccctcagccgacttcagctcttccctctcacccactgctgtggccctggccttcgacccaccagccaggaagacaaagctacccagactctcagcccagcctcccccagccaaggtgtcatgctgccttgtggggtgactgaggaaccccagcgactcttttatggcaatgctggctatcggcttcctctccctgccagtttcccagcagtcttgcccattggggagcagccccccgaagggcagtggcaacatcaagcagaggtacagattgcccgaaagcttcagtgcattgcagaccagttccaccggcttcatgtgcagcaacaccagcagaaccaaaatcgtgtgtggtggcagatcctcctcttcctgcacaaccttgctttgaatggagaagagaacaggaacggggcaggccctaggtgagggtgggctgccctcttcacatggggcaccaggaacaccgtctggaacaggaaggacatcgggcaggactgacactgtgtcttgtgaaattgtttttttgttgttattttgtgttttaattttttttaatttctctctgagtgtacatacaacatactcaagcgggaccttctttctctgtcaggcccttgacctggaatgggggcctttgtcaaacactgttgaaggagaggctgatgtgtctgtgatggtgagaattcccaagggctctgacaagtagattcttcgactgaggaatctaccagttgtcgaagatgatccgttagtgatgttctctgggaagtggactgtggtttttccagaggaactcagttaagaaatcgagagtggattagactcccagttccaccaaacctatgagccttccactgtggatgggggccgtgatcctgatggtcacattgctttaacccagcagggcttcggccaggggctttccacttgaggatagcagcttcactaggctggccggccagctccacatctgactgggttcttacttctcagccagtacctgccccatgggctcaaggattcctggccagctcctgccacctccagcagacctcagggagggttgagtttctctaaggacccctcaaacatgtcgcaaaatgaaccaaacttctggctaggcctcaaaactgacttggtcccacttggaggccccaggattggtcctgaggtacagagccactgccaccactggcggcctgggaccagctgggtgtcagccacggatgagccgaatagccagtcagcatgttgctgctggcagcctgtgcctttgtcagctcttctttcaaaagaccccaccgacagaccgcattccacccccaacatcggcactgagggacatcgggggcaagtttgcagtggggccggaaaatatggtggccaccctaccatgagagtcagccgtaggggaccccagaccccttggtttccttggaaacaacatacctcttcccccttatccccagtcctttttcatacctagtgggatacagaagaagccaggacagtggctttgccagctaagtgacttttagagtaacagataacgattagagtggggaaccgtcaaagctgggtacacatttcctatcttcctccagcttccagctaggccagaagggcatgctctggaacccagcaggatcacagctgcctgtgcacgtcttcccttctctccctgctgcggcacttatggagaggatctaaagcagccggtgtggcagctccgatagcaggcacagggaatctgttaaccagacgctagaaactaaattataacttttgcatatgtgagaaaagacaacattggtgctaacagtgaagtaaggcccaaaggaaagacggcttccctggacaaagaagacctcagggctacccaaggaaataggaggagtctagagtagactcacaaatctgaacaagcccaagtcttccagttctgaggagaggaggtcttcagtactattgaaggagacattgatcttctggatgtacagttgtgcaggttgttcactgcacaagggcacctgcagctaatggaggctggaattcagcttgtgttctgctcactaagctgtgtgcgtgccctggtgtggggctacttctcccaagaagaaggggtgcctttcctaatttgcaaaggtgccatatgggctcacagcaccctggaggagaagggcctcaaactgtgcatgtaagcctttgttttgttctgctcagatattctggatattacctcttcttggtcagaattctattctcagggtgtgtaccatgatttgtctgctaagaagacgggttcctgctttgcagagaaggagccggggaccagcttgaagactggctctgggacacactgaccattgtgaaattcagccttccctgtgggtctccataccattttatgatgtgtatgggacatacgttgttctcccctctctggatcaaggtggtgacaggcagcctgctgccgtatgcttcagtggcacacaccaaaaaaccgggattatttacagcagccactattcaccccttttggcagactctccacctgagttcagtgagagagaaaatgatttagatcttggtgctggggcaaggccatcagcttcagagaccttgccaggcccaggctgggtgccctgtggcctgagaactgagcccagactttgacaaacccacctcaacatcaagcctggggcaggtggaaggtggtctgactgcactgtctccatcttatgcaaagccaggaactcactcactgtcttaagtgagccagggcaaaatttacacccctcacgtttccctctcccttcttccccaccaacaaaacccaggaggtagctggcagagtagctgtcaggaaggagaaaggttctttctggctggttgtttttaattggcttagtgatctaaactggccccttcctcctctgcctggtgagttggcctaaacattcctcaagtctagcctcaggagacctgcccctcccccccgacctccaccccctcagactccatcccccacccccaggagcctggctgtctctagcgaggggtggagaatcagatttagagggagggagagtctgacctggatcctgacctgtaaccagctgaagacggtggaggctttgtggcttgctgagggtgggggttgggagagggactggaaaccttcctcctcgggaaagaaatgcctgggaggaagggaagcctgatattcagggtcaaaacagcccttctaattcacaaccccaaagcaggggtttctagaagttggtcaacagatctggtgagggaagtccccaggccagacgctggactcctgcaatgagggtggaggactcagcctggcctctgcctggcctgtttcaaagtctgggccactggcagccttctcttgctcaatccgaggtggaaaaagatcacctcccagtgacctccctcagcccccaggggagtaggtctgtgtccaaagctatgtggcaggcttgtttgaaggacccagaggggcccagctgacctgtctcactgctcctggcagcccagccccatcggcaggtggcccctgcctgggggttattcgggatggttcagccagggcctcccaggaagagtgctgtggagccacggtgactgtcctggacagcaaggagcatgctaccccagtgagcacttctttttgagggacttgatggggaggtggggtaggcagaagggacgtggcagaagcgggaagactttggtcaccatggctctgcaggccttctgcaaatcagtgctggcctgggctggaaacagctctgtgtgtgaaggtgaggactcttggaagcaggccatcctggccagacaccctagcaggaaggggctcacctgtcacccttaggcagcctgagggctggtggggacttttgagtcttgaggggatagcggaaaaagctgagctcataggtgcccagccagcctcccagctaaaggtgctcagagccccactgccccctctctctgtgcaggtggccagtgcccctccctgctctgggagcattgctagccttctaccccatccctggatccacaggggctatcgaggagacccagtgagaatgtagcattttgttcatccccagggtagctgccctggggtctgggcactctgcctctgggagagaggaagaagaaaggggccccattttttaaaaaactgtacagagcctttggctttatgtgtttatgttcttcacatgcatatgtgtgtatgtgtgtatatctttccccccatcaattggtacaatttttaataaaatcatttaaagcaaa

SEQ ID NO: 309 - DNA, 4545 bp, Homo sapiens
attttcccaggtaccctgcatgcatatagctgctgattctactcctgctattgctcacaaccctcagagtcaaactttgtgaccggcctaggagagatggagccatctcagtgtgtggaggagctggaggatgatgtgttccaaccagaggatggggagccggtgacccaacccgggagcttgctctctgctgacctgtttgcccagagcctactggactgccccctcagccgacttcagctcttccctctcacccactgctgtggccctggccttcgacccaccagccaggaagacaaagctacccagactctcagcccagcctcccccagccaaggtgtcatgctgccttgtggggtgactgaggaaccccagcgactcttttatggcaatgctggctatcggcttcctctccctgccagtttcccagcagtcttgcccattggggagcagccccccgaagggcagtggcaacatcaagcagaggtacagattgcccgaaagcttcagtgcattgcagaccagttccaccggcttcatgtgcagcaacaccagcagaaccaaaatcgtgtgtggtggcagatcctcctcttcctgcacaaccttgctttgaatggagaagagaacaggaacggggcaggccctaggtgagggtgggctgccctcttcacatggggcaccaggaacaccgtctggaacaggaaggacatcgggcaggactgacactgtgtcttgtgaaattgtttttttgttgttattttgtgttttaattttttttaatttctctctgagtgtacatacaacatactcaagcgggaccttctttctctgtcaggcccttgacctggaatgggggcctttgtcaaacactgttgaaggagaggctgatgtgtctgtgatggtgagaattcccaagggctctgacaagtagattcttcgactgaggaatctaccagttgtcgaagatgatccgttagtgatgttctctgggaagtggactgtggtttttccagaggaactcagttaagaaatcgagagtggattagactcccagttccaccaaacctatgagccttccactgtggatgggggccgtgatcctgatggtcacattgctttaacccagcagggcttcggccaggggctttccacttgaggatagcagcttcactaggctggccggccagctccacatctgactgggttcttacttctcagccagtacctgccccatgggctcaaggattcctggccagctcctgccacctccagcagacctcagggagggttgagtttctctaaggacccctcaaacatgtcgcaaaatgaaccaaacttctggctaggcctcaaaactgacttggtcccacttggaggccccaggattggtcctgaggtacagagccactgccaccactggcggcctgggaccagctgggtgtcagccacggatgagccgaatagccagtcagcatgttgctgctggcagcctgtgcctttgtcagctcttctttcaaaagaccccaccgacagaccgcattccacccccaacatcggcactgagggacatcgggggcaagtttgcagtggggccggaaaatatggtggccaccctaccatgagagtcagccgtaggggaccccagaccccttggtttccttggaaacaacatacctcttcccccttatccccagtcctttttcatacctagtgggatacagaagaagccaggacagtggctttgccagctaagtgacttttagagtaacagataacgattagagtggggaaccgtcaaagctgggtacacatttcctatcttcctccagcttccagctaggccagaagggcatgctctggaacccagcaggatcacagctgcctgtgcacgtcttcccttctctccctgctgcggcacttatggagaggatctaaagcagccggtgtggcagctccgatagcaggcacagggaatctgttaaccagacgctagaaactaaattataacttttgcatatgtgagaaaagacaacattggtgctaacagtgaagtaaggcccaaaggaaagacggcttccctggacaaagaagacctcagggctacccaaggaaataggaggagtctagagtagactcacaaatctgaacaagcccaagtcttccagttctgaggagaggaggtcttcagtactattgaaggagacattgatcttctggatgtacagttgtgcaggttgttcactgcacaagggcacctgcagctaatggaggctggaattcagcttgtgttctgctcactaagctgtgtgcgtgccctggtgtggggctacttctcccaagaagaaggggtgcctttcctaatttgcaaaggtgccatatgggctcacagcaccctggaggagaagggcctcaaactgtgcatgtaagcctttgttttgttctgctcagatattctggatattacctcttcttggtcagaattctattctcagggtgtgtaccatgatttgtctgctaagaagacgggttcctgctttgcagagaaggagccggggaccagcttgaagactggctctgggacacactgaccattgtgaaattcagccttccctgtgggtctccataccattttatgatgtgtatgggacatacgttgttctcccctctctggatcaaggtggtgacaggcagcctgctgccgtatgcttcagtggcacacaccaaaaaaccgggattatttacagcagccactattcaccccttttggcagactctccacctgagttcagtgagagagaaaatgatttagatcttggtgctggggcaaggccatcagcttcagagaccttgccaggcccaggctgggtgccctgtggcctgagaactgagcccagactttgacaaacccacctcaacatcaagcctggggcaggtggaaggtggtctgactgcactgtctccatcttatgcaaagccaggaactcactcactgtcttaagtgagccagggcaaaatttacacccctcacgtttccctctcccttcttccccaccaacaaaacccaggaggtagctggcagagtagctgtcaggaaggagaaaggttctttctggctggttgtttttaattggcttagtgatctaaactggccccttcctcctctgcctggtgagttggcctaaacattcctcaagtctagcctcaggagacctgcccctcccccccgacctccaccccctcagactccatcccccacccccaggagcctggctgtctctagcgaggggtggagaatcagatttagagggagggagagtctgacctggatcctgacctgtaaccagctgaagacggtggaggctttgtggcttgctgagggtgggggttgggagagggactggaaaccttcctcctcgggaaagaaatgcctgggaggaagggaagcctgatattcagggtcaaaacagcccttctaattcacaaccccaaagcaggggtttctagaagttggtcaacagatctggtgagggaagtccccaggccagacgctggactcctgcaatgagggtggaggactcagcctggcctctgcctggcctgtttcaaagtctgggccactggcagccttctcttgctcaatccgaggtggaaaaagatcacctcccagtgacctccctcagcccccaggggagtaggtctgtgtccaaagctatgtggcaggcttgtttgaaggacccagaggggcccagctgacctgtctcactgctcctggcagcccagccccatcggcaggtggcccctgcctgggggttattcgggatggttcagccagggcctcccaggaagagtgctgtggagccacggtgactgtcctggacagcaaggagcatgctaccccagtgagcacttctttttgagggacttgatggggaggtggggtaggcagaagggacgtggcagaagcgggaagactttggtcaccatggctctgcaggccttctgcaaatcagtgctggcctgggctggaaacagctctgtgtgtgaaggtgaggactcttggaagcaggccatcctggccagacaccctagcaggaaggggctcacctgtcacccttaggcagcctgagggctggtggggacttttgagtcttgaggggatagcggaaaaagctgagctcataggtgcccagccagcctcccagctaaaggtgctcagagccccactgccccctctctctgtgcaggtggccagtgcccctccctgctctgggagcattgctagccttctaccccatccctggatccacaggggctatcgaggagacccagtgagaatgtagcattttgttcatccccagggtagctgccctggggtctgggcactctgcctctgggagagaggaagaagaaaggggccccattttttaaaaaactgtacagagcctttggctttatgtgtttatgttcttcacatgcatatgtgtgtatgtgtgtatatctttccccccatcaattggtacaatttttaataaaatcatttaaagc

SEQ ID NO: 310 - DNA, 492 bp, Homo sapiens
atggagccatctcagtgtgtggaggagctggaggatgatgtgttccaaccagaggatggggagccggtgacccaacccgggagcttgctctctgctgacctgtttgcccagagcctactggactgccccctcagccgacttcagctcttccctctcacccactgctgtggccctggccttcgacccaccagccaggaagacaaagctacccagactctcagcccagcctcccccagccaaggtgtcatgctgccttgtggggtgactgaggaaccccagcgactcttttatggcaatgctggctatcggcttcctctccctgccagtttcccagcagtcttgcccattggggagcagccccccgaagggcagtggcaacatcaagcagagcaccagcagaaccaaaatcgtgtgtggtggcagatcctcctcttcctgcacaaccttgctttgaatggagaagagaacaggaacggggcaggccctaggtga

SEQ ID NO: 311 - DNA, 630 bp, Homo sapiens
attttggaaacaataccgcaccgtgcggagtggcctcctcccgccccggcctgtgcccgccgccgccgccgcccctgcctgcgcctcccgcctcctgccgcagcccgctgggctttttccctccttcccaatcgagtctgggcgtccagcccccgagtgctcgtcacgctggaccctggcgcggagccctggcatcacgactcggaggccgagactctctcctggagtcacccaggagagatggagccatctcagtgtgtggaggagctggaggatgatgtgttccaaccagaggatggggagccggtgacccaacccgggagcttgctctctgctgacctgtttgcccagagcctactggactgccccctcagccgacttcagctcttccctctcacccactgctgtggccctggccttcgacccaccagccaggaagacaaagctacccagactctcagcccagcctcccccagccaaggtgtcatgctgccttgtggggtgactgaggaaccccagcgactcttttatgcaccagcagaaccaaaatcgtgtgtggtggcagatcctcctcttcctgcacaaccttgctttgaatggagaagagaacaggaacggggcaggccctag

SEQ ID NO: 312 - DNA, 747 bp, Homo sapiens
tagctgctgattctactcctgctattgctcacaaccctcagagtcaaactttgtgaccggcctaggtcagaaaacgtgatcaagaaaaagggtggttccaggcgggcccagggaagaggagagatggagccatctcagtgtgtggaggagctggaggatgatgtgttccaaccagaggatggggagccggtgacccaacccgggagcttgctctctgctgacctgtttgcccagagcctactggactgccccctcagccgacttcagctcttccctctcacccactgctgtggccctggccttcgacccaccagccaggaagacaaagctacccagactctcagcccagcctcccccagccaaggtgtcatgctgccttgtggggtgactgaggaaccccagcgactcttttatggcaatgctggctatcggcttcctctccctgccagtttcccagcagtcttgcccattggggagcagccccccgaagggcagtggcaacatcaagcagaggtacagattgcccgaaagcttcagtgcattgcagaccagttccaccggcttcatgtgcagcaacaccagcagaaccaaaatcgtgtgtggtggcagatcctcctcttcctgcacaaccttgctttgaatggagaagagaacaggaacggggcaggccctaggtgagggtgggctgccctcttcacatggggcaccaggaacaccgtctggaacaggaaggacatcgggcaggac

SEQ ID NO: 313 - DNA, 735 bp, Homo sapiens
gctgtcctaggattgctggcttttgtttttgctgctgagcctggagctcagctcagactgagaggagagatggagccatctcagtgtgtggaggagctggaggatgatgtgttccaaccagaggatggggagccggtgacccaacccgggagcttgctctctgctgacctgtttgcccagagcctactggactgccccctcagccgacttcagctcttccctctcacccactgctgtggccctggccttcgacccaccagccaggaagacaaagctacccagactctcagcccagcctcccccagccaaggtgtcatgctgccttgtggggtgactgaggaaccccagcgactcttttatggcaatgctggctatcggcttcctctccctgccagtttcccagcagtcttgcccattggggagcagccccccgaagggcagtggcaacatcaagcagaggtacagattgcccgaaagcttcagtgcattgcagaccagttccaccggcttcatgtgcagcaacaccagcagaaccaaaatcgtgtgtggtggcagatcctcctcttcctgcacaaccttgctttgaatggagaagagaacaggaacggggcaggccctaggtgagggtgggctgccctcttcacatggggcaccaggaacaccgtctggaacaggaaggacatcgggcaggactgacactgtgtcttgtgaaattgtttttttgttgttattttg

SEQ ID NO: 314 - DNA, 1681 bp, Homo sapiens
gggtacctgtaccccacgtagtcgccggttaccgatcggactaagttccagaagcaagagataaagtaataatgggtactgtggggaaaaacacagaagaacaattcggtaatatagtggtgatttacaagtcaagttaaaatgtccccagaagtggccttgaaccgaatatctccaatgctctcccctttcatatctagcgtggtccggaatggaaaagtgggactggatgctacaaactgtttgaggataactgacttaaaatctggctgcacatcattgactcctgggcccaactgtgaccgatttaaactgcacataccatatgctggagagacattaaagtgggatatcattttcaatgcccaatacccagaactgcctcccgattttatctttggagaagatgctgaattcctgccagacccctcagctttgcagaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagagaacatggaaatttatgctgggaaaaaaaacaactggactggtgaattttcagctcgtttccttttgaagctgcccgtagatttcagcaatatccccacataccttctcaaggatgtaaatgaagaccctggagaagatgtggccctcctctctgttagttttgaggacactgaagccacccaggtgtaccccaagctgtacttgtcacctcgaattgagcatgcacttggaggctcctcagctcttcatatcccagcttttccaggaggaggatgtctcattgattacgttcctcaagtatgccacctgctcaccaacaaggtgcagtacgtgattcaagggtatcacaaaagaagagagtatattgctgcttttctcagtcactttggcacaggtgtcgtggaatatgatgcagaaggctttacaaaactcactctgctgctgatgtggaaagatttttgttttcttgtacacattgacctgcctctgtttttccctcgagaccagccaactctcacatttcagtccgtttatcactttaccaacagtggacagctttactcccaggcccaaaaaaattatccgtacagccccagatgggatggaaatgaaatggccaaaagagcaaaggcttatttcaaaacctttgtccctcagttccaggaggcagcatttgccaatggaaagctctaggaaacaccagtcttgagaggtggccagccagactgcctgtccacatgcgtgtcagcacatacagccgcttcctggaagccgcctggaatgtcttcacggcagcgttttgctcacacagcagcttttgcacgccccaggcagccccgactgctgaaatccaacttgagctggctggtggtccctggatcctagagcccttcacttcgggttactccctctttcttgcctctatttcttagttggaagaaataaactcacaaattatggtgcagtaattttccggggaaagtaaagcctcaggaatgcccacgcctttcttccaaagcctttgtctctgagacctcttaagttctaagattaaatgcccctcgctgttcttcctctgaaa

SEQ ID NO: 315 - DNA, 1852 bp, Homo sapiens
gagtgcgcacgcatcctgcccgcggcgcgcgcgcaggtcggtgcgtctgtcgggggcgcgctcgggtacctgtaccccacgtagtcgccggttaccgatcggactaagttccagtggtgatttacaagtcaagttaaaatgtccccagaagtggccttgaaccgaatatctccaatgctctcccctttcatatctagcgtggtccggaatggaaaagtgggactggatgctacaaactgtttgaggataactgacttaaaatctggctgcacatcattgactcctgggcccaactgtgaccgatttaaactgcacataccatatgctggagagacattaaagtgggatatcattttcaatgcccaatacccagaactgcctcccgattttatctttggagaagatgctgaattcctgccagacccctcagctttgcagaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagagaacatggaaatttatgctgggaaaaaaaacaactggactggtgaattttcagctcgtttccttttgaagctgcccgtagatttcagcaatatccccacataccttctcaaggatgtaaatgaagaccctggagaagatgtggccctcctctctgttagttttgaggacactgaagccacccaggtgtaccccaagctgtacttgtcacctcgaattgagcatgcacttggaggctcctcagctcttcatatcccagcttttccaggaggaggatgtctcattgattacgttcctcaagtatgccacctgctcaccaacaaggtgcagtacgtgattcaagggtatcacaaaagaagagagtatattgctgcttttctcagtcactttggcacaggtgtcgtggaatatgatgcagaaggctttacaaaactcactctgctgctgatgtggaaagatttttgttttcttgtacacattgacctgcctctgtttttccctcgagaccagccaactctcacatttcagtccgtttatcactttaccaacagtggacagctttactcccaggcccaaaaaaattatccgtacagccccagatgggatggaaatgaaatggccaaaagagcaaagggatgccaagggagcagagatgcctgcagcccgtgggagcaagtcctggcctttgcagttgcaaaaactggctgcaagctgctccagccccagaggaactggccaagctccagagggcctccttggagggcctcagagggagagagaactgctcagtaattttgatcactttgggcttatttcaaaacctttgtccctcagttccaggaggcagcatttgccaatggaaagctctaggaaacaccagtcttgagaggtggccagccagactgcctgtccacatgcgtgtcagcacatacagccgcttcctggaagccgcctggaatgtcttcacggcagcgttttgctcacacagcagcttttgcacgccccaggcagccccgactgctgaaatccaacttgagctggctggtggtccctggatcctagagcccttcacttcgggttactccctctttcttgcctctatttcttagttggaagaaataaactcacaaattatggtgcagtaattttccggggaaagtaaagcctcaggaatgcccacgcctttcttccaaagcctttgtctctgagacctcttaagttctaagattaaatgcccctcgctgttcttcctctgaaa

SEQ ID NO: 316 - DNA, 1686 bp, Homo sapiens
ggtacctgtaccccacgtagtcgccggttaccgatcggactaagttccagtggtgatttacaagtcaagttaaaatgtccccagaagtggccttgaaccgaatatctccaatgctctcccctttcatatctagcgtggtccggaatggaaaagtgggactggatgctacaaactgtttgaggataactgacttaaaatctggctgcacatcattgactcctgggcccaactgtgaccgatttaaactgcacataccatatgctggagagacattaaagtgggatatcattttcaatgcccaatacccagaactgcctcccgattttatctttggagaagatgctgaattcctgccagacccctcagctttgcagaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagagaacatggaaatttatgctgggaaaaaaaacaactggactggtgaattttcagctcgtttccttttgaagctgcccgtagatttcagcaatatccccacataccttctcaaggatgtaaatgaagaccctggagaagatgtggccctcctctctgttagttttgaggacactgaagccacccaggtgtaccccaagctgtacttgtcacctcgaattgagcatgcacttggaggctcctcagctcttcatatcccagcttttccaggaggaggatgtctcattgattacgttcctcaagtatgccacctgctcaccaacaaggtgcagtacgtgattcaagggtatcacaaaagaagagagtatattgctgcttttctcagtcactttggcacaggtgtcgtggaatatgatgcagaaggctttacaaaactcactctgctgctgatgtggaaagatttttgttttcttgtacacattgacctgcctctgtttttccctcgagaccagccaactctcacatttcagtccgtttatcactttaccaacagtggacagctttactcccaggcccaaaaaaattatccgtacagccccagatgggatggaaatgaaatggccaaaagagcaaaaagagagagcaacagagatggggaggaatccagctctgcctgacatccaggcatcctctccaaattgcatagggcttatttcaaaacctttgtccctcagttccaggaggcagcatttgccaatggaaagctctaggaaacaccagtcttgagaggtggccagccagactgcctgtccacatgcgtgtcagcacatacagccgcttcctggaagccgcctggaatgtcttcacggcagcgttttgctcacacagcagcttttgcacgccccaggcagccccgactgctgaaatccaacttgagctggctggtggtccctggatcctagagcccttcacttcgggttactccctctttcttgcctctatttcttagttggaagaaataaactcacaaattatggtgcagtaattttccggggaaagtaaagcctcaggaatgcccacgcctttcttccaaagcctttgtctctgagacctcttaagttctaagattaaatgcccctcgctgttcttcctctgaaa

SEQ ID NO: 317 - DNA, 1243 bp, Homo sapiens
aactggaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagagaacatggaaatttatgctgggaaaaaaaacaactggactggtgaattttcagctcgtttccttttgaagctgcccgtagatttcagcaatatccccacataccttctcaaggatgtaaatgaagaccctggagaagatgtggccctcctctctgttagttttgaggacactgaagccacccaggtgtaccccaagctgtacttgtcacctcgaattgagcatgcacttggaggctcctcagctcttcatatcccagcttttccaggaggaggatgtctcattgattacgttcctcaagtatgccacctgctcaccaacaaggtgcagtacgtgattcaagggtatcacaaaagaagagagtatattgctgcttttctcagtcactttggcacaggtgtcgtggaatatgatgcagaaggctttacaaaactcactctgctgctgatgtggaaagatttttgttttcttgtacacattgacctgcctctgtttttccctcgagaccagccaactctcacatttcagtccgtttatcactttaccaacagtggacagctttactcccaggcccaaaaaaattatccgtacagccccagatgggatggaaatgaaatggccaaaagagcaaaggcttatttcaaaacctttgtccctcagttccaggaggcagcatttgccaatggaaagctctaggaaacaccagtcttgagaggtggccagccagactgcctgtccacatgcgtgtcagcacatacagccgcttcctggaagccgcctggaatgtcttcacggcagcgttttgctcacacagcagcttttgcacgccccaggcagccccgactgctgaaatccaacttgagctggctggtggtccctggatcctagagcccttcacttcgggttactccctctttcttgcctctatttcttagttggaagaaataaactcacaaattatggtgcagtaattttccggggaaagtaaagcctcaggaatgcccacgcctttcttccaaagcctttgtctctgagacctcttaagttctaagattaaatgcccctcgctgttcttcctctg

SEQ ID NO: 318 - DNA, 1657 bp, Homo sapiens
gcggcgcgcgcgcaggtcggtgcgtctgtcgggggcgcgctcgggtacctgtaccccacgtagtcgccggttaccgatcggactaagttccagtggtgatttacaagtcaagttaaaatgtccccagaagtggccttgaaccgaatatctccaatgctctcccctttcatatctagcgtggtccggaatggaaaagtgggactggatgctacaaactgtttgaggataactgacttaaaatctggctgcacatcattgactcctgggcccaactgtgaccgatttaaactgcacataccatatgctggagagacattaaagtgggatatcattttcaatgcccaatacccagaactgcctcccgattttatctttggagaagatgctgaattcctgccagacccctcagctttgcagaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagagaacatggaaatttatgctgggaaaaaaaacaactggactggtgaattttcagctcgtttccttttgaagctgcccgtagatttcagcaatatccccacataccttctcaaggatgtaaatgaagaccctggagaagatgtggccctcctctctgttagttttgaggacactgaagccacccaggtgtaccccaagctgtacttgtcacctcgaattgagcatgcacttggaggctcctcagctcttcatatcccagcttttccaggaggaggatgtctcattgattacgttcctcaagtatgccacctgctcaccaacaaggtgcagtacgtgattcaagggtatcacaaaagaagagagtatattgctgcttttctcagtcactttggcacaggtgtcgtggaatatgatgcagaaggctttacaaaactcactctgctgctgatgtggaaagatttttgttttcttgtacacattgacctgcctctgtttttccctcgagaccagccaactctcacatttcagtccgtttatcactttaccaacagtggacagctttactcccaggcccaaaaaaattatccgtacagccccagatgggatggaaatgaaatggccaaaagagcaaaggcttatttcaaaacctttgtccctcagttccaggaggcagcatttgccaatggaaagctctaggaaacaccagtcttgagaggtggccagccagactgcctgtccacatgcgtgtcagcacatacagccgcttcctggaagccgcctggaatgtcttcacggcagcgttttgctcacacagcagcttttgcacgccccaggcagccccgactgctgaaatccaacttgagctggctggtggtccctggatcctagagcccttcacttcgggttactccctctttcttgcctctatttcttagttggaagaaataaactcacaaattatggtgcagtaattttccggggaaagtaaagcctcaggaatgcccacgcctttcttccaaagcctttgtctctgagacctcttaagttctaagattaaatgcccctcgctgttcttcctctgaaa

SEQ ID NO: 319 - DNA, 1752 bp, Homo sapiens
ggtacctgtaccccacgtagtcgccggttaccgatcggactaagttccagaagcaagagataaagtaataatgggtactgtggggaaaaacacagaagaacaattcggtaatatagtggtgatttacaagtcaagttaaaatgtccccagaagtggccttgaaccgaatatctccaatgctctcccctttcatatctagcgtggtccggaatggaaaagtgggactggatgctacaaactgtttgaggataactgacttaaaatctggctgcacatcattgactcctgggcccaactgtgaccgatttaaactgcacataccatatgctggagagacattaaagtgggatatcattttcaatgcccaatacccagaactgcctcccgattttatctttggagaagatgctgaattcctgccagacccctcagctttgcagaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagagaacatggaaatttatgctgggaaaaaaaacaactggactggtgaattttcagctcgtttccttttgaagctgcccgtagatttcagcaatatccccacataccttctcaaggatgtaaatgaagaccctggagaagatgtggccctcctctctgttagttttgaggacactgaagccacccaggtgtaccccaagctgtacttgtcacctcgaattgagcatgcacttggaggctcctcagctcttcatatcccagcttttccaggaggaggatgtctcattgattacgttcctcaagtatgccacctgctcaccaacaaggtgcagtacgtgattcaagggtatcacaaaagaagagagtatattgctgcttttctcagtcactttggcacaggtgtcgtggaatatgatgcagaaggctttacaaaactcactctgctgctgatgtggaaagatttttgttttcttgtacacattgacctgcctctgtttttccctcgagaccagccaactctcacatttcagtccgtttatcactttaccaacagtggacagctttactcccaggcccaaaaaaattatccgtacagccccagatgggatggaaatgaaatggccaaaagagcaaaaagagagagcaacagagatggggaggaatccagctctgcctgacatccaggcatcctctccaaattgcatagggcttatttcaaaacctttgtccctcagttccaggaggcagcatttgccaatggaaagctctaggaaacaccagtcttgagaggtggccagccagactgcctgtccacatgcgtgtcagcacatacagccgcttcctggaagccgcctggaatgtcttcacggcagcgttttgctcacacagcagcttttgcacgccccaggcagccccgactgctgaaatccaacttgagctggctggtggtccctggatcctagagcccttcacttcgggttactccctctttcttgcctctatttcttagttggaagaaataaactcacaaattatggtgcagtaattttccggggaaagtaaagcctcaggaatgcccacgcctttcttccaaagcctttgtctctgagacctcttaagttctaagattaaatgcccctcgctgttcttcctctgaaa

SEQ ID NO: 320 - DNA, 874 bp, Homo sapiens
ctcagcagccgggccaagaaaggtctttgggggcgcaagtctttggagggcaggtctttggggagcgctttgagtaatattagagctttcactaaaccctggcctattacgtcccctcccctgagatttacctttatatactcaagttctttcatgccaggaaggtaggctgaaggcttcgaaaacctgcagctcatacccaaagctagcactgtctatccctggagacccagcgcccaaaagctccactgggcgcatagcgcacggcacgcctcctcccccgagccgcagactgagtaactggccccggactaacctgaccagaagcaagagataaagtaataatgggtactgtggggaaaaacacagaagaacaattcggtaatatagtggtgatttacaagtcaagttaaaatgtccccagaagtggccttgaaccgaatatctccaatgctctcccctttcatatctagcgtggtccggaatggaaaagtgggactggatgctacaaactgtttgaggataactgacttaaaatctggctgcacatcattgactcctgggcccaactgtgaccgatttaaactgcacataccatatgctggagagacattaaagtgggatatcattttcaatgcccaatacccagaactgcctcccgattttatctttggagaagatgctgaattcctgccagacccctcagctttgcagaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagaga

SEQ ID NO: 321 - DNA, 4519 bp, Homo sapiens
aggagcggcgcggggaggcagaggcgagcgcgggcgatcgcggcggcgggacgtctccggcggccgcggcaccagcggcggcgctctgtgtggagaagcaggggcagcggcagcagcaacagcggcagcggcagcagcagcggcagcagcggcggccgcctctccgccgccggggacgccaaggtgcggctggtggcactgacatcggcggccctgcctctcctccctcgcccccggccttccccatgtgatcggtcttaatcctggccgtgtgtgcgcgcgtggggctccattccgcggtgctgggtctccgtgccggggtgggtgctcgtgtgtgcgcttctcctccccatcccccttcccccaagaataaaagaagaaccgggaggcgtgctcagaaaataaataaataaccaccacacacgcgcagcccggagcgagtcggcggggctggcggcagcggcggaggaggagtgaaggcggcggcggcggaggagggacgcgcggaaaaggcagcaactttaaagccagctcagagcctagacctccagccgagcggtttgcagcgcggcggcggcggcggcggcggcggcgttgagtgtctggcccgccggtccggtcggggtgtgcagtcggacggacgagcagcgcgtcgctgtcctccggcagctggagatgtccgagcccaaggcaattgatcccaagttgtcgacgaccgacagggtggtgaaagctgttccatttcctccaagtcaccggcttacagcaaaagaagtgtttgataatgatggaaaacctcgtgtggatatcttaaaggcgcatcttatgaaggagggaaggctggaagagagtgttgcattgagaataataacagagggtgcatcaattcttcgacaggaaaaaaatttgctggatattgatgcgccagtcactgtttgtggggacattcatggacaattctttgatttgatgaagctctttgaagtcgggggatctcctgccaacactcgctacctcttcttaggggactatgttgacagagggtacttcagtattgaatgtgtgctgtatttgtgggccttgaaaattctctaccccaaaacactgtttttacttcgtggaaatcatgaatgtagacatctaacagagtatttcacatttaaacaagaatgtaaaataaagtattcagaacgcgtatatgatgcctgtatggatgcctttgactgccttcccctggctgccctgatgaaccaacagttcctgtgtgtgcatggtggtttgtctccagagattaacactttagatgatatcagaaaattagaccgattcaaagaaccacctgcatatggacctatgtgtgatatcctgtggtcagaccccctggaagattttggaaatgagaagactcaggaacatttcactcacaacacagtcagggggtgttcatacttctacagttacccggctgtatgtgaattcttacagcacaataacttgttatctatactccgagcccacgaagcccaagatgcagggtaccgcatgtacaggaaaagccaaacaacaggcttcccttctctaattacaattttttcagcaccaaattacttagatgtatacaataacaaagtgactgagatgctggtaaatgtcctcaacatctgctcagatgatgaactagggtcagaagaagatggatttgatggtgcaacagctgcagcccggaaagaggtgataaggaacaagatccgagcaataggcaaaatggccagagtgttctcagtgctcagagaagagagtgagagtgtgctgacgctgaaaggcttgaccccaactggcatgctccccagcggagtactttctggagggaagcaaaccctgcaaagcgctatcaaaggattttcaccacaacataagatcactagcttcgaggaagccaagggcttagaccgaattaatgagaggatgccgcctcgcagagatgccatgccctctgacgccaaccttaactccatcaacaaggctctcacctcagagactaacggcacggacagcaatggcagtaatagcagcaatattcagtgaccacttcctgttcactttttttttttttttttttttttttttttgagctgcggggcatgatggggattgctgcatatcagcagttggatgttcttgcctctgacagtagcttatttgctctgggggccaggaattggattcagtttacactatcattaaaaaagagggagagagataataaactatattttggtggggatggtgattaaacacctcttttgggtatgccttttaaaaatgcttatagagaaaaaaaattttaaaaagaaagctaatgctagtatatactgcaatgttaggggaatgaacatgttttcctactgcattggggacttctagataggttaatgaaaggccttttattctgttactggacatgaaaactttgtctaatttcttactctattgtacgtttacagtcgcagcactaaaaatggatgacatcaaacatttttaacaaaatgatgtacaaactaaggactatttattgataatgttttgctactcttgtcagacaatggctataaactgaattaggcagtcttaaaaaaaaaaaaaaacagaaaaagaaaaaaaagaacgttgcaaatttgttaaaatgccaaaaaggacagtttaattttgtacagattatgcttacctcaggtttctttagtgtgcttgaatgcccttctttccatataacacttatcttcttcttaattcggcaatggaatatcttttaagttttaaaaaaactggaataattatatctatcttttttgccgtttatatttaggggtttttgttgataaaatcaagtcttggttgtggcttgctgaattaaatatttatgagtggtgcatttttaagtatagtgaacaagacaccatattaagtacagtgataaagcatctatattctgtaaaaaaaaaaaaaatctgcctatgcatgttttttaagaaaaaaaaaatggctgtatcggcctgtatgggactgtaatgcgcttagtggtctgacatatactggaaatgtatgtatactggcgtactttatattctctaaaatgcttaatgcctttgaaattttgtaatcaaaaaaaagctttgaaaaaatctaaaggggagagtattctttaaagtttttaacataagcttgtcaatgcacatgtagatggttagcatgtttagcaaaccttgtgaaattataataagtttgtagttacatgtgaaactctaaatgcatggcaactgttaatgtcataacagtttagttattttgttctgttctgtcatgtgccacaaaatatgtacttttttcacttttttccctttgtatatcagttacgggttacaactggttcattctgaaaacaacaacaacaaaagtccattcatattttttaacaattgtataagtgcccaagtaattcactacagcctaaagccttgcctttgtaatttgacttctgacatgttggcaatcaaagcatgcacttgtaacaatgaaaaagaaaaagcattttatattactactcaataaaatgtgcatgaacttacagaattctcatccttccactgagtccgctgaagggatttatgtgcacaaccaccatgtgtcttctaggtgctggcccaccaccacacatcacaggctgatttccacaggcttcttcctaggggcctcgtgatctgaggggtggtgcctacttccactgtaagaaagaatcttggtggatttgtgtctcaaatcagataagagaagcctgtttaaagagcagatgccatcttctggcttcctcaaggagccagttaaaaaaccagagcattcctttttattgaaaaataaaattaatttgttatcaggttgtttcagttgtattggatgccctatctatctgctaaagcaaaaagtactaggctactaagtgcattttcatcacagaaaagagttgcatttgtattaacaagaaatttgtatacccacgcttcagctactatctaatcatcacccgaagatttaagatacaccaaatttcagtttgtttgtaacattgttcatctttagtgcactttgttttatataataaagtatgcctgttatattaaataataagaatatggcaattagcgatatagcatacccaaacaaagatgttctcgatacagtctggcaaagactatcccaaggttattttaatgaattcagacattttttcctgtggatatttctccatcctaaaaaaagtggcaaccaaggaaaatatttagatgcaacttactagagtgatgatgtgaaagaaatggtgattctggtatcatggtgtttattttctttcttataactgcagagaaaatatcctgactaaaaaaaattcatttttttggattcctttcttttacaaattgtgctgaggcaactatggcatagaaataaacatttgacattaaaataa

SEQ ID NO: 322 - DNA, 3604 bp, Homo sapiens
agcagcggcggccgcctctccgccgccggggacgccaaggtgcggctggtggcactgacatcggcggccctgcctctcctccctcgcccccggccttccccatgtgatcggtcttaatcctggccgtgtgtgcgcgcgtggggctccattccgcggtgctgggtctccgtgccggggtgggtgctcgtgtgtgcgcttctcctccccatcccccttcccccaagaataaaagaagaaccgggaggcgtgctcagaaaataaataaataaccaccacacacgcgcagcccggagcgagtcggcggggctggcggcagcggcggaggaggagtgaaggcggcggcggcggaggagggacgcgcggaaaaggcagcaactttaaagccagctcagagcctagacctccagccgagcggtttgcagcgcggcggcggcggcggcggcggcggcgttgagtgtctggcccgccggtccggtcggggtgtgcagtcggacggacgagcagcgcgtcgctgtcctccggcagctggagatgtccgagcccaaggcaattgatcccaagttgtcgacgaccgacagggtggtgaaagctgttccatttcctccaagtcaccggcttacagcaaaagaagtgtttgataatgatggaaaacctcgtgtggatatcttaaaggcgcatcttatgaaggagggaaggctggaagagagtgttgcattgagaataataacagagggtgcatcaattcttcgacaggaaaaaaatttgctggatattgatgcgccagtcactgtttgtggggacattcatggacaattctttgatttgatgaagctctttgaagtcgggggatctcctgccaacactcgctacctcttcttaggggactatgttgacagagggtacttcagtattgaatgtgtgctgtatttgtgggccttgaaaattctctaccccaaaacactgtttttacttcgtggaaatcatgaatgtagacatctaacagagtatttcacatttaaacaagaatgtaaaataaagtattcagaacgcgtatatgatgcctgtatggatgcctttgactgccttcccctggctgccctgatgaaccaacagttcctgtgtgtgcatggtggtttgtctccagagattaacactttagatgatatcagaaaattagaccgattcaaagaaccacctgcatatggacctatgtgtgatatcctgtggtcagaccccctggaagattttggaaatgagaagactcaggaacatttcactcacaacacagtcagggggtgttcatacttctacagttacccggctgtatgtgaattcttacagcacaataacttgttatctatactccgagcccacgaagcccaagatgcagggtaccgcatgtacaggaaaagccaaacaacaggcttcccttctctaattacaattttttcagcaccaaattacttagatgtatacaataacaaagctgcagtattgaagtatgagaacaatgttatgaatatcaggcaattcaactgttctcctcatccatactggcttccaaatttcatggatgtttttacttggtcccttccatttgttggggaaaaagtgactgagatgctggtaaatgtcctcaacatctgctcagatgatgaactagggtcagaagaagatggatttgatggtgcaacagctgcagcccggaaagaggtgataaggaacaagatccgagcaataggcaaaatggccagagtgttctcagtgctcagagaagagagtgagagtgtgctgacgctgaaaggcttgaccccaactggcatgctccccagcggagtactttctggagggaagcaaaccctgcaaagcgctatcaaaggattttcaccacaacataagatcactagcttcgaggaagccaagggcttagaccgaattaatgagaggatgccgcctcgcagagatgccatgccctctgacgccaaccttaactccatcaacaaggctctcacctcagagactaacggcacggacagcaatggcagtaatagcagcaatattcagtgaccacttcctgttcactttttttttttttttttttttttttttttgagctgcggggcatgatggggattgctgcatatcagcagttggatgttcttgcctctgacagtagcttatttgctctgggggccaggaattggattcagtttacactatcattaaaaaagagggagagagataataaactatattttggtggggatggtgattaaacacctcttttgggtatgccttttaaaaatgcttatagagaaaaaaaattttaaaaagaaagctaatgctagtatatactgcaatgttaggggaatgaacatgttttcctactgcattggggacttctagataggttaatgaaaggccttttattctgttactggacatgaaaactttgtctaatttcttactctattgtacgtttacagtcgcagcactaaaaatggatgacatcaaacatttttaacaaaatgatgtacaaactaaggactatttattgataatgttttgctactcttgtcagacaatggctataaactgaattaggcagtcttaaaaaaaaaaaaaaacagaaaaagaaaaaaaagaacgttgcaaatttgttaaaatgccaaaaaggacagtttaattttgtacagattatgcttacctcaggtttctttagtgtgcttgaatgcccttctttccatataacacttatcttcttcttaattcggcaatggaatatcttttaagttttaaaaaaactggaataattatatctatcttttttgccgtttatatttaggggtttttgttgataaaatcaagtcttggttgtggcttgctgaattaaatatttatgagtggtgcatttttaagtatagtgaacaagacaccatattaagtacagtgataaagcatctatattctgtaaaaaaaaaaaaaatctgcctatgcatgttttttaagaaaaaaaaaatggctgtatcggcctgtatgggactgtaatgcgcttagtggtctgacatatactggaaatgtatgtatactggcgtactttatattctctaaaatgcttaatgcctttgaaattttgtaatcaaaaaaaagctttgaaaaaatctaaaggggagagtattctttaaagtttttaacataagcttgtcaatgcacatgtagatggttagcatgtttagcaaaccttgtgaaattataataagtttgtagttacatgtgaaactctaaatgcatggcaactgttaatgtcataacagtttagttattttgttctgttctgtcatgtgccacaaaatatgtacttttttcacttttttccctttgtatatcagttacgggttacaactggttcattctgaaaacaacaacaacaaaagtccattcatattttttaacaattgtataagtgcccaagtaattcactacagcctaaagccttgcctttgtaatttgacttctgacatgttggcaatcaaagcatgcacttgtaacaatgaaaaagaaaaagcattttatattactactcaataaaatgtgcatgaactta

SEQ ID NO: 323 - DNA, 4685 bp, Homo sapiens
ggtgagtggaggagcggcgcggggaggcagaggcgagcgcgggcgatcgcggcggcgggacgtctccggcggccgcggcaccagcggcggcgctctgtgtggagaagcaggggcagcggcagcagcaacagcggcagcggcagcagcagcggcagcagcggcggccgcctctccgccgccggggacgccaaggtgcggctggtggcactgacatcggcggccctgcctctcctccctcgcccccggccttccccatgtgatcggtcttaatcctggccgtgtgtgcgcgcgtggggctccattccgcggtgctgggtctccgtgccggggtgggtgctcgtgtgtgcgcttctcctccccatcccccttcccccaagaataaaagaagaaccgggaggcgtgctcagaaaataaataaataaccaccacacacgcgcagcccggagcgagtcggcggggctggcggcagcggcggaggaggagtgaaggcggcggcggcggaggagggacgcgcggaaaaggcagcaactttaaagccagctcagagcctagacctccagccgagcggtttgcagcgcggcggcggcggcggcggcggcggcgttgagtgtctggcccgccggtccggtcggggtgtgcagtcggacggacgagcagcgcgtcgctgtcctccggcagctggagatgtccgagcccaaggcaattgatcccaagttgtcgacgaccgacagggtggtgaaagctgttccatttcctccaagtcaccggcttacagcaaaagaagtgtttgataatgatggaaaacctcgtgtggatatcttaaaggcgcatcttatgaaggagggaaggctggaagagagtgttgcattgagaataataacagagggtgcatcaattcttcgacaggaaaaaaatttgctggatattgatgcgccagtcactgtttgtggggacattcatggacaattctttgatttgatgaagctctttgaagtcgggggatctcctgccaacactcgctacctcttcttaggggactatgttgacagagggtacttcagtattgaatgtgtgctgtatttgtgggccttgaaaattctctaccccaaaacactgtttttacttcgtggaaatcatgaatgtagacatctaacagagtatttcacatttaaacaagaatgtaaaataaagtattcagaacgcgtatatgatgcctgtatggatgcctttgactgccttcccctggctgccctgatgaaccaacagttcctgtgtgtgcatggtggtttgtctccagagattaacactttagatgatatcagaaaattagaccgattcaaagaaccacctgcatatggacctatgtgtgatatcctgtggtcagaccccctggaagattttggaaatgagaagactcaggaacatttcactcacaacacagtcagggggtgttcatacttctacagttacccggctgtatgtgaattcttacagcacaataacttgttatctatactccgagcccacgaagcccaagatgcagggtaccgcatgtacaggaaaagccaaacaacaggcttcccttctctaattacaattttttcagcaccaaattacttagatgtatacaataacaaagctgcagtattgaagtatgagaacaatgttatgaatatcaggcaattcaactgttctcctcatccatactggcttccaaatttcatggatgtttttacttggtcccttccatttgttggggaaaaagtgactgagatgctggtaaatgtcctcaacatctgctcagatgatgaactagggtcagaagaagatggatttgatggtgcaacagctgcagcccggaaagaggtgataaggaacaagatccgagcaataggcaaaatggccagagtgttctcagtgctcagagaagagagtgagagtgtgctgacgctgaaaggcttgaccccaactggcatgctccccagcggagtactttctggagggaagcaaaccctgcaaagcgctactgttgaggctattgaggctgatgaagctatcaaaggattttcaccacaacataagatcactagcttcgaggaagccaagggcttagaccgaattaatgagaggatgccgcctcgcagagatgccatgccctctgacgccaaccttaactccatcaacaaggctctcacctcagagactaacggcacggacagcaatggcagtaatagcagcaatattcagtgaccacttcctgttcactttttttttttttttttttttttttttttgagctgcggggcatgatggggattgctgcatatcagcagttggatgttcttgcctctgacagtagcttatttgctctgggggccaggaattggattcagtttacactatcattaaaaaagagggagagagataataaactatattttggtggggatggtgattaaacacctcttttgggtatgccttttaaaaatgcttatagagaaaaaaaattttaaaaagaaagctaatgctagtatatactgcaatgttaggggaatgaacatgttttcctactgcattggggacttctagataggttaatgaaaggccttttattctgttactggacatgaaaactttgtctaatttcttactctattgtacgtttacagtcgcagcactaaaaatggatgacatcaaacatttttaacaaaatgatgtacaaactaaggactatttattgataatgttttgctactcttgtcagacaatggctataaactgaattaggcagtcttaaaaaaaaaaaaaaacagaaaaagaaaaaaaagaacgttgcaaatttgttaaaatgccaaaaaggacagtttaattttgtacagattatgcttacctcaggtttctttagtgtgcttgaatgcccttctttccatataacacttatcttcttcttaattcggcaatggaatatcttttaagttttaaaaaaactggaataattatatctatcttttttgccgtttatatttaggggtttttgttgataaaatcaagtcttggttgtggcttgctgaattaaatatttatgagtggtgcatttttaagtatagtgaacaagacaccatattaagtacagtgataaagcatctatattctgtaaaaaaaaaaaaaatctgcctatgcatgttttttaagaaaaaaaaaatggctgtatcggcctgtatgggactgtaatgcgcttagtggtctgacatatactggaaatgtatgtatactggcgtactttatattctctaaaatgcttaatgcctttgaaattttgtaatcaaaaaaaagctttgaaaaaatctaaaggggagagtattctttaaagtttttaacataagcttgtcaatgcacatgtagatggttagcatgtttagcaaaccttgtgaaattataataagtttgtagttacatgtgaaactctaaatgcatggcaactgttaatgtcataacagtttagttattttgttctgttctgtcatgtgccacaaaatatgtacttttttcacttttttccctttgtatatcagttacgggttacaactggttcattctgaaaacaacaacaacaaaagtccattcatattttttaacaattgtataagtgcccaagtaattcactacagcctaaagccttgcctttgtaatttgacttctgacatgttggcaatcaaagcatgcacttgtaacaatgaaaaagaaaaagcattttatattactactcaataaaatgtgcatgaacttacagaattctcatccttccactgagtccgctgaagggatttatgtgcacaaccaccatgtgtcttctaggtgctggcccaccaccacacatcacaggctgatttccacaggcttcttcctaggggcctcgtgatctgaggggtggtgcctacttccactgtaagaaagaatcttggtggatttgtgtctcaaatcagataagagaagcctgtttaaagagcagatgccatcttctggcttcctcaaggagccagttaaaaaaccagagcattcctttttattgaaaaataaaattaatttgttatcaggttgtttcagttgtattggatgccctatctatctgctaaagcaaaaagtactaggctactaagtgcattttcatcacagaaaagagttgcatttgtattaacaagaaatttgtatacccacgcttcagctactatctaatcatcacccgaagatttaagatacaccaaatttcagtttgtttgtaacattgttcatctttagtgcactttgttttatataataaagtatgcctgttatattaaataataagaatatggcaattagcgatatagcatacccaaacaaagatgttctcgatacagtctggcaaagactatcccaaggttattttaatgaattcagacattttttcctgtggatatttctccatcctaaaaaaagtggcaaccaaggaaaatatttagatgcaacttactagagtgatgatgtgaaagaaatggtgattctggtatcatggtgtttattttctttcttataactgcagagaaaatatcctgactaaaaaaaattcatttttttggattcctttcttttacaaattgtgctgaggcaactatggcatagaaataaacatttgacattaaaataag

SEQ ID NO: 324 - DNA, 1958 bp, Homo sapiens
cagtcggacggacgagcagcgcgtcgctgtcctccggcagctggagatgtccgagcccaaggcaattgatcccaagttgtcgacgaccgacagggtggtgaaagtttgtggggacattcatggacaattctttgatttgatgaagctctttgaagtcgggggatctcctgccaacactcgctacctcttcttaggggactatgttgacagagggtacttcagtattgaatgtgtgctgtatttgtgggccttgaaaattctctaccccaaaacactgtttttacttcgtggaaatcatgaatgtagacatctaacagagtatttcacatttaaacaagaatgtaaaataaagtattcagaacgcgtatatgatgcctgtatggatgcctttgactgccttcccctggctgccctgatgaaccaacagttcctgtgtgtgcatggtggtttgtctccagagattaacactttagatgatatcagaaaattagaccgattcaaagaaccacctgcatatggacctatgtgtgatatcctgtggtcagaccccctggaagattttggaaatgagaagactcaggaacatttcactcacaacacagtcagggggtgttcatacttctacagttacccggctgtatgtgaattcttacagcacaataacttgttatctatactccgagcccacgaagcccaagatgcagggtaccgcatgtacaggaaaagccaaacaacaggcttcccttctctaattacaattttttcagcaccaaattacttagatgtatacaataacaaagctgcagtattgaagtatgagaacaatgttatgaatatcaggcaattcaactgttctcctcatccatactggcttccaaatttcatggatgtttttacttggtcccttccatttgttggggaaaaagtgactgagatgctggtaaatgtcctcaacatctgctcagatgatgaactagggtcagaagaagatggatttgatggtgcaacagctgcagcccggaaagaggtgataaggaacaagatccgagcaataggcaaaatggccagagtgttctcagtgctcagagaagagagtgagagtgtgctgacgctgaaaggcttgaccccaactggcatgctccccagcggagtactttctggagggaagcaaaccctgcaaagcgctactgttgaggctattgaggctgatgaagctatcaaaggattttcaccacaacataagatcactagcttcgaggaagccaagggcttagaccgaattaatgagaggatgccgcctcgcagagatgccatgccctctgacgccaaccttaactccatcaacaaggctctcacctcagagactaacggcacggacagcaatggcagtaatagcagcaatattcagtgaccacttcctgttcactttttttttttttttttttttttttttttgagctgcggggcatgatggggattgctgcatatcagcagttggatgttcttgcctctgacagtagcttatttgctctgggggccaggaattggattcagtttacactatcattaaaaaagagggagagagataataaactatattttggtggggatggtgattaaacacctcttttgggtatgccttttaaaaatgcttatagagaaaaaaaattttaaaaagaaagctaatgctagtatatactgcaatgttaggggaatgaacatgttttcctactgcattggggacttctagataggttaatgaaaggccttttattctgttactggacatgaaaactttgtctaatttcttactctattgtacgtttacagtcgcagcactaaaaatggatgacatcaaacatttttaacaaaatgatgtacaaactaaggactatttattgataatgttttgctactcttgtcagacaatggctataaactgaattaggcagtcttaa

SEQ ID NO: 325 - DNA, 4007 bp, Homo sapiens
gagtggaggagcggcgcggggaggcagaggcgagcgcgggcgatcgcggcggcgggacgtctccggcggccgcggcaccagcggcggcgctctgtgtggagaagcaggggcagcggcagcagcaacagcggcagcggcagcagcagcggcagcagcggcggccgcctctccgccgccggggacgccaaggtgcggctggtggcactgacatcggcggccctgcctctcctccctcgcccccggccttccccatgtgatcggtcttaatcctggccgtgtgtgcgcgcgtggggctccattccgcggtgctgggtctccgtgccggggtgggtgctcgtgtgtgcgcttctcctccccatcccccttcccccaagaataaaagaagaaccgggaggcgtgctcagaaaataaataaataaccaccacacacgcgcagcccggagcgagtcggcggggctggcggcagcggcggaggaggagtgaaggcggcggcggcggaggagggacgcgcggaaaaggcagcaactttaaagccagctcagagcctagacctccagccgagcggtttgcagcgcggcggcggcggcggcggcggcggcgttgagtgtctggcccgccggtccggtcggggtgtgcagtcggacggacgagcagcgcgtcgctgtcctccggcagctggagatgtccgagcccaaggcaattgatcccaagttgtcgacgaccgacagggtggtgaaagctgttccatttcctccaagtcaccggcttacagcaaaagaagtgtttgataatgatggaaaacctcgtgtggatatcttaaaggcgcatcttatgaaggagggaaggctggaagagagtgttgcattgagaataataacagagggtgcatcaattcttcgacaggaaaaaaatttgctggatattgatgcgccagtcactgctgcagtattgaagtatgagaacaatgttatgaatatcaggcaattcaactgttctcctcatccatactggcttccaaatttcatggatgtttttacttggtcccttccatttgttggggaaaaagtgactgagatgctggtaaatgtcctcaacatctgctcagatgatgaactagggtcagaagaagatggatttgatggtgcaacagctgcagcccggaaagaggtgataaggaacaagatccgagcaataggcaaaatggccagagtgttctcagtgctcagagaagagagtgagagtgtgctgacgctgaaaggcttgaccccaactggcatgctccccagcggagtactttctggagggaagcaaaccctgcaaagcgctactgttgaggctattgaggctgatgaagctatcaaaggattttcaccacaacataagatcactagcttcgaggaagccaagggcttagaccgaattaatgagaggatgccgcctcgcagagatgccatgccctctgacgccaaccttaactccatcaacaaggctctcacctcagagactaacggcacggacagcaatggcagtaatagcagcaatattcagtgaccacttcctgttcactttttttttttttttttttttttttttttgagctgcggggcatgatggggattgctgcatatcagcagttggatgttcttgcctctgacagtagcttatttgctctgggggccaggaattggattcagtttacactatcattaaaaaagagggagagagataataaactatattttggtggggatggtgattaaacacctcttttgggtatgccttttaaaaatgcttatagagaaaaaaaattttaaaaagaaagctaatgctagtatatactgcaatgttaggggaatgaacatgttttcctactgcattggggacttctagataggttaatgaaaggccttttattctgttactggacatgaaaactttgtctaatttcttactctattgtacgtttacagtcgcagcactaaaaatggatgacatcaaacatttttaacaaaatgatgtacaaactaaggactatttattgataatgttttgctactcttgtcagacaatggctataaactgaattaggcagtcttaaaaaaaaaaaaaaacagaaaaagaaaaaaaagaacgttgcaaatttgttaaaatgccaaaaaggacagtttaattttgtacagattatgcttacctcaggtttctttagtgtgcttgaatgcccttctttccatataacacttatcttcttcttaattcggcaatggaatatcttttaagttttaaaaaaactggaataattatatctatcttttttgccgtttatatttaggggtttttgttgataaaatcaagtcttggttgtggcttgctgaattaaatatttatgagtggtgcatttttaagtatagtgaacaagacaccatattaagtacagtgataaagcatctatattctgtaaaaaaaaaaaaaatctgcctatgcatgttttttaagaaaaaaaaaatggctgtatcggcctgtatgggactgtaatgcgcttagtggtctgacatatactggaaatgtatgtatactggcgtactttatattctctaaaatgcttaatgcctttgaaattttgtaatcaaaaaaaagctttgaaaaaatctaaaggggagagtattctttaaagtttttaacataagcttgtcaatgcacatgtagatggttagcatgtttagcaaaccttgtgaaattataataagtttgtagttacatgtgaaactctaaatgcatggcaactgttaatgtcataacagtttagttattttgttctgttctgtcatgtgccacaaaatatgtacttttttcacttttttccctttgtatatcagttacgggttacaactggttcattctgaaaacaacaacaacaaaagtccattcatattttttaacaattgtataagtgcccaagtaattcactacagcctaaagccttgcctttgtaatttgacttctgacatgttggcaatcaaagcatgcacttgtaacaatgaaaaagaaaaagcattttatattactactcaataaaatgtgcatgaacttacagaattctcatccttccactgagtccgctgaagggatttatgtgcacaaccaccatgtgtcttctaggtgctggcccaccaccacacatcacaggctgatttccacaggcttcttcctaggggcctcgtgatctgaggggtggtgcctacttccactgtaagaaagaatcttggtggatttgtgtctcaaatcagataagagaagcctgtttaaagagcagatgccatcttctggcttcctcaaggagccagttaaaaaaccagagcattcctttttattgaaaaataaaattaatttgttatcaggttgtttcagttgtattggatgccctatctatctgctaaagcaaaaagtactaggctactaagtgcattttcatcacagaaaagagttgcatttgtattaacaagaaatttgtatacccacgcttcagctactatctaatcatcacccgaagatttaagatacaccaaatttcagtttgtttgtaacattgttcatctttagtgcactttgttttatataataaagtatgcctgttatattaaataataagaatatggcaattagcgatatagcatacccaaacaaagatgttctcgatacagtctggcaaagactatcccaaggttattttaatgaattcagacattttttcctgtggatatttctccatcctaaaaaaagtggcaaccaaggaaaatatttagatgcaacttactagagtgatgatgtgaaagaaatggtgattctggtatcatggtgtttattttctttcttataactgcagagaaaatatcctgactaaaaaaaattcatttttttggattcctttcttttacaaattgtgctgaggcaactatggcatagaaataaacatttgacattaaaataagcagttgatgtgagtattgctt

SEQ ID NO: 326 - DNA, 1365 bp, Homo sapiens
atgtccgagcccaaggcaattgatcccaagttgtcgacgaccgacagggtggtgaaagtttgtggggacattcatggacaattctttgatttgatgaagctctttgaagtcgggggatctcctgccaacactcgctacctcttcttaggggactatgttgacagagggtacttcagtattgaatgtgtgctgtatttgtgggccttgaaaattctctaccccaaaacactgtttttacttcgtggaaatcatgaatgtagacatctaacagagtatttcacatttaaacaagaatgtaaaataaagtattcagaacgcgtatatgatgcctgtatggatgcctttgactgccttcccctggctgccctgatgaaccaacagttcctgtgtgtgcatggtggtttgtctccagagattaacactttagatgatatcagaaaattagaccgattcaaagaaccacctgcatatggacctatgtgtgatatcctgtggtcagaccccctggaagattttggaaatgagaagactcaggaacatttcactcacaacacagtcagggggtgttcatacttctacagttacccggctgtatgtgaattcttacagcacaataacttgttatctatactccgagcccacgaagcccaagatgcagggtaccgcatgtacaggaaaagccaaacaacaggcttcccttctctaattacaattttttcagcaccaaattacttagatgtatacaataacaaagctgcagtattgaagtatgagaacaatgttatgaatatcaggcaattcaactgttctcctcatccatactggcttccaaatttcatggatgtttttacttggtcccttccatttgttggggaaaaagtgactgagatgctggtaaatgtcctcaacatctgctcagatgatgaactagggtcagaagaagatggatttgatggtgcaacagctgcagcccggaaagaggtgataaggaacaagatccgagcaataggcaaaatggccagagtgttctcagtgctcagagaagagagtgagagtgtgctgacgctgaaaggcttgaccccaactggcatgctccccagcggagtactttctggagggaagcaaaccctgcaaagcgctactgttgaggctattgaggctgatgaagctatcaaaggattttcaccacaacataagatcactagcttcgaggaagccaagggcttagaccgaattaatgagaggatgccgcctcgcagagatgccatgccctctgacgccaaccttaactccatcaacaaggctctcacctcagagactaacggcacggacagcaatggcagtaatagcagcaatattcagtga

SEQ ID NO: 327 - DNA, 569 bp, Homo sapiens
ggtgttggcggcggcggcggcggcggaggggggtaggttgtgcccgggactgtgtctgccgagctcggcggctgtgccttgctgttccatttcctccaagtcaccggcttacagcaaaagaagtgtttgataatgatggaaaacctcgtgtggatatcttaaaggcgcatcttatgaaggagggaaggctggaagagagtgttgcattgagaataataacagagggtgcatcaattcttcgacaggaaaaaaatttgctggatattgatgcgccagtcactgtttgtggggacattcatggacaattctttgatttgatgaagctctttgaagtcgggggatctcctgccaacactcgctacctcttcttaggggactatgttgacagagggtacttcagtattgaatgtgtgctgtatttgtgggccttgaaaattctctaccccaaaacactgtttttacttcgtggaaatcatgaatgtagacatctaacagagtatttcacatttaaacaagaatgtaaaataaagtattcagaacgcgtatatgatgcctgtatggatgccttt

SEQ ID NO: 328 - DNA, 579 bp, Homo sapiens
aaaaacaaccgtacaccgcatcgcagtcgtagctcttctccgcaagctgttccatttcctccaagtcaccggcttacagcaaaagaagtgtttgataatgatggaaaacctcgtgtggatatcttaaaggcgcatcttatgaaggagggaaggctggaagagagtgttgcattgagaataataacagagggtgcatcaattcttcgacaggaaaaaaatttgctggatattgatgcgccagtcactgtttgtggggacattcatggacaattctttgatttgatgaagctctttgaagtcgggggatctcctgccaacactcgctacctcttcttaggggactatgttgacagagggtacttcagtattgaatgtgtgctgtatttgtgggccttgaaaattctctaccccaaaacactgtttttacttcgtggaaatcatgaatgtagacatctaacagagtatttcacatttaaacaagaatgtaaaataaagtattcagaacgcgtatatgatgcctgtatggatgcctttgactgccttcccctggctgccctgatgaaccaacagttcctgtgt

SEQ ID NO: 329 - DNA, 396 bp, Homo sapiens
gggaggagagaaaagccatggccgacaaggtcctgaaggagaagagaaagctgtttatccgttccatgggtgaagataatgtttcttggagacatcccacaatgggctctgtttttattggaagactcattgaacatatgcaagaatatgcctgttcctgtgatgtggaggaaattttccgcaaggttcgattttcatttgagcagccagatggtagagcgcagatgcccaccactgaaagagtgactttgacaagatgtttctacctcttcccaggacattaaaataaggaaactgtatgaatgtctgtgggcaggaagtgaagagatccttctgtaaaggtttttggaattatgtctgctgaataataaacttttttgaaataataaatctggt

SEQ ID NO: 330 - DNA, 1264 bp, Homo sapiens
atggccgacaaggtcctgaaggagaagagaaagctgtttatccgttccatgggtgaaggtacaataaatggcttactggatgaattattacagacaagggtgctgaacaaggaagagatggagaaagtaaaacgtgaaaatgctacagttatggataagacccgagctttgattgactccgttattccgaaaggggcacaggcatgccaaatttgcatcacatacatttgtgaagaagacagttacctggcagggacgctgggactctcagcagctcctcaggcagtgcaggacaacccagctatgcccacatcctcaggctcagaagggaatgtcaagctttgctccctagaagaagctcaaaggatatggaaacaaaagtcggcagagatttatccaataatggacaagtcaagccgcacacgtcttgctctcattatctgcaatgaagaatttgacagtattcctagaagaactggagctgaggttgacatcacaggcatgacaatgctgctacaaaatctggggtacagcgtagatgtgaaaaaaaatctcactgcttcggacatgactacagagctggaggcatttgcacaccgcccagagcacaagacctctgacagcacgttcctggtgttcatgtctcatggtattcgggaaggcatttgtgggaagaaacactctgagcaagtcccagatatactacaactcaatgcaatctttaacatgttgaataccaagaactgcccaagtttgaaggacaaaccgaaggtgatcatcatccaggcctgccgtggtgacagccctggtgtggtgtggtttaaagattcagtaggagtttctggaaacctatctttaccaactacagaagagtttgaggatgatgctattaagaaagcccacatagagaaggattttatcgctttctgctcttccacaccagataatgtttcttggagacatcccacaatgggctctgtttttattggaagactcattgaacatatgcaagaatatgcctgttcctgtgatgtggaggaaattttccgcaaggttcgattttcatttgagcagccagatggtagagcgcagatgcccaccactgaaagagtgactttgacaagatgtttctacctcttcccaggacattaaaataaggaaactgtatgaatgtctgtgggcaggaagtgaagagatccttctgtaaaggtttttggaattatgtctgctgaataataaacttttttgaaataataaatctggt

SEQ ID NO: 331 - DNA, 396 bp, Homo sapiens; identical to SEQ ID NO: 329

SEQ ID NO: 332 - DNA, 1477 bp, Homo sapiens
ctttaatgggaagaaaaataaagacatgcatatgcatgcacagtgagtatttcccaatacatgtacaggccctgccaaaaaggaaggcgaagcatactttcagtttcagtcacacaagaagggaggagagaaaagccatggccgacaaggtcctgaaggagaagagaaagctgtttatccgttccatgggtgaaggtacaataaatggcttactggatgaattattacagacaagggtgctgaacaaggaagagatggagaaagtaaaacgtgaaaatgctacagttatggataagacccgagctttgattgactccgttattccgaaaggggcacaggcatgccaaatttgcatcacatacatttgtgaagaagacagttacctggcagggacgctgggactctcagcagatcaaacatctggaaattaccttaatatgcaagactctcaaggagtactttcttcctttccagctcctcaggcagtgcaggacaacccagctatgcccacatcctcaggctcagaagggaatgtcaagctttgctccctagaagaagctcaaaggatatggaaacaaaagtcggcagagatttatccaataatggacaagtcaagccgcacacgtcttgctctcattatctgcaatgaagaatttgacagtattcctagaagaactggagctgaggttgacatcacaggcatgacaatgctgctacaaaatctggggtacagcgtagatgtgaaaaaaaatctcactgcttcggacatgactacagagctggaggcatttgcacaccgcccagagcacaagacctctgacagcacgttcctggtgttcatgtctcatggtattcgggaaggcatttgtgggaagaaacactctgagcaagtcccagatatactacaactcaatgcaatctttaacatgttgaataccaagaactgcccaagtttgaaggacaaaccgaaggtgatcatcatccaggcctgccgtggtgacagccctggtgtggtgtggtttaaagattcagtaggagtttctggaaacctatctttaccaactacagaagagtttgaggatgatgctattaagaaagcccacatagagaaggattttatcgctttctgctcttccacaccagataatgtttcttggagacatcccacaatgggctctgtttttattggaagactcattgaacatatgcaagaatatgcctgttcctgtgatgtggaggaaattttccgcaaggttcgattttcatttgagcagccagatggtagagcgcagatgcccaccactgaaagagtgactttgacaagatgtttctacctcttcccaggacattaaaataaggaaactgtatgaatgtctgtgggcaggaagtgaagagatccttctgtaaaggtttttggaattatgtctgctgaataataaacttttttgaaataataaatctggtagaaaaatgaaaa

SEQ ID NO: 333 - DNA, 921 bp, Homo sapiens
gggaggagagaaaagccatggccgacaaggtcctgaaggagaagagaaagctgtttatccgttccatgggtgaagctcctcaggcagtgcaggacaacccagctatgcccacatcctcaggctcagaagggaatgtcaagctttgctccctagaagaagctcaaaggatatggaaacaaaagtcggcagagatttatccaataatggacaagtcaagccgcacacgtcttgctctcattatctgcaatgaagaatttgacagtattcctagaagaactggagctgaggttgacatcacaggcatgacaatgctgctacaaaatctggggtacagcgtagatgtgaaaaaaaatctcactgcttcggacatgactacagagctggaggcatttgcacaccgcccagagcacaagacctctgacagcacgttcctggtgttcatgtctcatggtattcgggaaggcatttgtgggaagaaacactctgagcaagtcccagatatactacaactcaatgcaatctttaacatgttgaataccaagaactgcccaagtttgaaggacaaaccgaaggtgatcatcatccaggcctgccgtggtgataatgtttcttggagacatcccacaatgggctctgtttttattggaagactcattgaacatatgcaagaatatgcctgttcctgtgatgtggaggaaattttccgcaaggttcgattttcatttgagcagccagatggtagagcgcagatgcccaccactgaaagagtgactttgacaagatgtttctacctcttcccaggacattaaaataaggaaactgtatgaatgtctgtgggcaggaagtgaagagatccttctgtaaaggtttttggaattatgtctgctgaataataaacttttttgaaataataaatctggt

SEQ ID NO: 334 - DNA, 1237 bp, Homo sapiens
agtttcagtcacacaagaagggaggagagaaaagccatggccgacaaggtcctgaaggagaagagaaagctgtttatccgttccatgggtgaaggtacaataaatggcttactggatgaattattacagacaagggtgctgaacaaggaagagatggagaaagtaaaacgtgaaaatgctacagttatggataagacccgagctttgattgactccgttattccgaaaggggcacaggcatgccaaatttgcatcacatacatttgtgaagaagacagttacctggcagggacgctgggactctcagcagctcctcaggcagtgcaggacaacccagctatgcccacatcctcaggctcagaagggaatgtcaagctttgctccctagaagaagctcaaaggatatggaaacaaaagtcggcagagatttatccaataatggacaagtcaagccgcacacgtcttgctctcattatctgcaatgaagaatttgacagtattcctagaagaactggagctgaggttgacatcacaggcatgacaatgctgctacaaaatctggggtacagcgtagatgtgaaaaaaaatctcactgcttcggacatgactacagagctggaggcatttgcacaccgcccagagcacaagacctctgacagcacgttcctggtgttcatgtctcatggtattcgggaaggcatttgtgggaagaaacactctgagcaagtcccagatatactacaactcaatgcaatctttaacatgttgaataccaagaactgcccaagtttgaaggacaaaccgaaggtgatcatcatccaggcctgccgtggtgacagccctggtgtggtgtggtttaaagattcagtaggagtttctggaaacctatctttaccaactacagaagagtttgaggatgatgctattaagaaagcccacatagagaaggattttatcgctttctgctcttccacaccagataatgtttcttggagacatcccacaatgggctctgtttttattggaagactcattgaacatatgcaagaatatgcctgttcctgtgatgtggaggaaattttccgcaaggttcgattttcatttgagcagccagatggtagagcgcagatgcccaccactgaaagagtgactttgacaagatgtttctacctcttcccaggacattaaaataaggaaactgtatgaatgtctgtgggcaggtacatgtgtatggtcg

SEQ ID NO: 335 - DNA, 1061 bp, Homo sapiens
atggccgacaaggtcctgaaggagaagagaaagctgtttatccgttccatgggtgaagctcctcaggcagtgcaggacaacccagctatgcccacatcctcaggctcagaagggaatgtcaagctttgctccctagaagaagctcaaaggatatggaaacaaaagtcggcagagatttatccaataatggacaagtcaagccgcacacgtcttgctctcattatctgcaatgaagaatttgacagtattcctagaagaactggagctgaggttgacatcacaggcatgacaatgctgctacaaaatctggggtacagcgtagatgtgaaaaaaaatctcactgcttcggacatgactacagagctggaggcatttgcacaccgcccagagcacaagacctctgacagcacgttcctggtgttcatgtctcatggtattcgggaaggcatttgtgggaagaaacactctgagcaagtcccagatatactacaactcaatgcaatctttaacatgttgaataccaagaactgcccaagtttgaaggacaaaccgaaggtgatcatcatccaggcctgccgtggtgacagccctggtgtggtgtggtttaaagattcagtaggagtttctggaaacctatctttaccaactacagaagagtttgaggatgatgctattaagaaagcccacatagagaaggattttatcgctttctgctcttccacaccagataatgtttcttggagacatcccacaatgggctctgtttttattggaagactcattgaacatatgcaagaatatgcctgttcctgtgatgtggaggaaattttccgcaaggttcgattttcatttgagcagccagatggtagagcgcagatgcccaccactgaaagagtgactttgacaagatgtttctacctcttcccaggacattaaaataaggaaactgtatgaatgtctgtgggcaggaagtgaagagatccttctgtaaaggtttttggaattatgtctgctgaataataaacttttttgaaataataaatctggtagaaaaatgaaaa

SEQ ID NO: 336 - DNA, 1402 bp, Homo sapiens
tttcagtcacacaagaagggaggagagaaaagccatggccgacaagggtgctgaacaaggaagagatggagaaagtaaaacgtgaaaatgctacagttatggataagacccgagctttgattgactccgttattccgaaaggggcacaggcatgccaaatttgcatcacatacatttgtgaagaagacagttacctggcagggacgctgggactctcagcagatcaaacatctggaaattaccttaatatgcaagactctcaaggagtactttcttcctttccagctcctcaggcagtgcaggacaacccagctatgcccacatcctcaggctcagaagggaatgtcaagctttgctccctagaagaagctcaaaggatatggaaacaaaagtcggcagagatttatccaataatggacaagtcaagccgcacacgtcttgctctcattatctgcaatgaagaatttgacagtattcctagaagaactggagctgaggttgacatcacaggcatgacaatgctgctacaaaatctggggtacagcgtagatgtgaaaaaaaatctcactgcttcggacatgactacagagctggaggcatttgcacaccgcccagagcacaagacctctgacagcacgttcctggtgttcatgtctcatggtattcgggaaggcatttgtgggaagaaacactctgagcaagtcccagatatactacaactcaatgcaatctttaacatgttgaataccaagaactgcccaagtttgaaggacaaaccgaaggtgatcatcatccaggcctgccgtggtgacagccctggtgtggtgtggtttaaagattcagtaggagtttctggaaacctatctttaccaactacagaagagtttgaggatgatgctattaagaaagcccacatagagaaggattttatcgctttctgctcttccacaccaggcaagagccagtcttgagatttgaaatgtgctttatccatagataatgtttcttggagacatcccacaatgggctctgtttttattggaagactcattgaacatatgcaagaatatgcctgttcctgtgatgtggaggaaattttccgcaaggtaagatgctagtggatgctattttcactctacttccctgaatgcttggctattgcaattggaagcatagaaagcagatccagacaagtttatcttccaataatgctcttctttccaaaagagttttggagttctttggagagtggacaaacccaggagcctaatccaatctattaagacccacagccttgagaaaacaatcatttagtttcaccccgctcctgccctgcagagacaaatgaatggactctaatttacctgtgtctctcatggctattagatccagcagcagattt

SEQ ID NO: 337 - DNA, 1392 bp, Homo sapiens
tttcagtcacacaagaagggaggagagaaaagccatggccgacaaggtcctgaaggagaagagaaagctgtttatccgttccatgggtgaaggtacaataaatggcttactggatgaattattacagacaagggtgctgaacaaggaagagatggagaaagtaaaacgtgaaaatgctacagttatggataagacccgagctttgattgactccgttattccgaaaggggcacaggcatgccaaatttgcatcacatacatttgtgaagaagacagttacctggcagggacgctgggactctcagcagatttatccaataatggacaagtcaagccgcacacgtcttgctctcattatctgcaatgaagaatttgacagtattcctagaagaactggagctgaggttgacatcacaggcatgacaatgctgctacaaaatctggggtacagcgtagatgtgaaaaaaaatctcactgcttcggacatgactacagagctggaggcatttgcacaccgcccagagcacaagacctctgacagcacgttcctggtgttcatgtctcatggtattcgggaaggcatttgtgggaagaaacactctgagcaagtcccagatatactacaactcaatgcaatctttaacatgttgaataccaagaactgcccaagtttgaaggacaaaccgaaggtgatcatcatccaggcctgccgtggtgacagccctggtgtggtgtggtttaaagattcagtaggagtttctggaaacctatctttaccaactacagaagagtttgaggatgatgctattaagaaagcccacatagagaaggattttatcgctttctgctcttccacaccagataatgtttcttggagacatcccacaatgggctctgtttttattggaagactcattgaacatatgcaagaatatgcctgttcctgtgatgtggaggaaattttccgcaaggtaagatgctagtggatgctattttcactctacttccctgaatgcttggctattgcaattggaagcatagaaagcagatccagacaagtttatcttccaataatgctcttctttccaaaagagttttggagttctttggagagtggacaaacccaggagcctaatccaatctattaagacccacagccttgagaaaacaatcatttagtttcaccccgctcctgccctgcagagacaaatgaatggactctaatttacctgtgtctctcatggctattagatccagcagcagatttaaaatgccctgaggagggtcattcaatgcttacatacatatatggttatacttgttgcagatggaagtactttttgtttttgtcacttattttgctatatttgttgtagttttttggcataactc

SEQ ID NO: 338 - DNA, 300 bp, Homo sapiens
atggccgacaaggtcctgaaggagaagagaaagctgtttatccgttccatgggtgaagataatgtttcttggagacatcccacaatgggctctgtttttattggaagactcattgaacatatgcaagaatatgcctgttcctgtgatgtggaggaaattttccgcaaggttcgattttcatttgagcagccagatggtagagcgcagatgcccaccactgaaagagtgactttgacaagatgtttctacctcttcccaggacattaaaataaggaaactgtatgaatgtctgtgggcagg

SEQ ID NO: 339 - DNA, 2001 bp, Homo sapiens
agtttcagtcacacaagaagggaggagagaaaagccatggccgacaaggtcctgaaggagaagagaaagctgtttatccgttccatgggtgaaggtacaataaatggcttactggatgaattattacagacaagggtgctgaacaaggaagagatggagaaagtaaaacgtgaaaatgctacagttatggataagacccgagctttgattgactccgttattccgaaaggggcacaggcatgccaaatttgcatcacatacatttgtgaagaagacagttacctggcagggacgctgggactctcagcagatcaaacatctggaaattaccttaatatgcaagactctcaaggagtactttcttcctttccagctcctcaggcagtgcaggacaacccagctatgcccacatcctcaggctcagaagggaatgtcaagctttgctccctagaagaagctcaaaggatatggaaacaaaagtcggcagagatttatccaataatggacaagtcaagccgcacacgtcttgctctcattatctgcaatgaagaatttgacagtattcctagaagaactggagctgaggttgacatcacaggcatgacaatgctgctacaaaatctggggtacagcgtagatgtgaaaaaaaatctcactgcttcggacatgactacagagctggaggcatttgcacaccgcccagagcacaagacctctgacagcacgttcctggtgttcatgtctcatggtattcgggaaggcatttgtgggaagaaacactctgagcaagtcccagatatactacaactcaatgcaatctttaacatgttgaataccaagaactgcccaagtttgaaggacaaaccgaaggtgatcatcatccaggcctgccgtggtgacagccctggtgtggtgtggtttaaagattcagtaggagtttctggaaacctatctttaccaactacagaagagtttgaggatgatgctattaagaaagcccacatagagaaggattttatcgctttctgctcttccacaccagataatgtttcttggagacatcccacaatgggctctgtttttattggaagactcattgaacatatgcaagaatatgcctgttcctgtgatgtggaggaaattttccgcaaggttcgattttcatttgagcagccagatggtagagcgcagatgcccaccactgaaagagtgactttgacaagatgtttctacctcttcccaggacattaaaataaggaaactgtatgaatgtctgtgggcaggtacatgtgtatggtcgggagtgtgggaaggttgaggaaagggtactgaaagtccatttgagtcaagaactctaggtttacaggctgagaatccttaatccaaaaatttgaattttgaaatgctctaaaatccaacactgtgtgagcgcccacatgatattcaaaggaaatgtttattgaaacatttcaaattataggtttttggattagggatgctaaaccagtaagtatacagctgaattccaatatacaaaaatatctgaaatttgaaatacttctggtagcatgcattttggataagggataatcaagccatatacagaaaatactgaagtaatgcctttcttctggtcagtgcagagcacgttgctcttctcccaaagtttttcatttagaccccttttgagattcatctgatattggcctagaagtggccgtaagactacaaaccctcacttttggatgtttctctccttcacctcagcagggtatatttaaacatagcatgtggtctttccttttaaaattgtgtatgttcccattggtggtataactttataacttgcatgtctttaaccaaattctttcctatgtttttttttttaattatttctttttctcataggaagtgaagagatccttctgtaaaggtttttggaattatgtctgctgaataataaacttttttgaaataataaatctggtagaaaaatgaaaa

SEQ ID NO: 340 - DNA, 825 bp, Homo sapiens
atggccgacaaggtcctgaaggagaagagaaagctgtttatccgttccatgggtgaagctcctcaggcagtgcaggacaacccagctatgcccacatcctcaggctcagaagggaatgtcaagctttgctccctagaagaagctcaaaggatatggaaacaaaagtcggcagagatttatccaataatggacaagtcaagccgcacacgtcttgctctcattatctgcaatgaagaatttgacagtattcctagaagaactggagctgaggttgacatcacaggcatgacaatgctgctacaaaatctggggtacagcgtagatgtgaaaaaaaatctcactgcttcggacatgactacagagctggaggcatttgcacaccgcccagagcacaagacctctgacagcacgttcctggtgttcatgtctcatggtattcgggaaggcatttgtgggaagaaacactctgagcaagtcccagatatactacaactcaatgcaatctttaacatgttgaataccaagaactgcccaagtttgaaggacaaaccgaaggtgatcatcatccaggcctgccgtggtgataatgtttcttggagacatcccacaatgggctctgtttttattggaagactcattgaacatatgcaagaatatgcctgttcctgtgatgtggaggaaattttccgcaaggttcgattttcatttgagcagccagatggtagagcgcagatgcccaccactgaaagagtgactttgacaagatgtttctacctcttcccaggacattaaaataaggaaactgtatgaatgtctgtgggcagg

SEQ ID NO: 341 - DNA, 2073 bp, Homo sapiens
tgaagattcagttttcacttaaacaaccagcaagtcttgaagtctcttcccaagcaaatgggagcttctttggaccttggagcacacagaggattctactttctttaaaactttgttttcaggcaatttccctgagaaccgtttacttccagaagattggtggagcttgatctgaaggctggccatgaaatctcaaggtcaacattggtattccagttcagataaaaactgtaaagtgagctttcgtgagaagcttctgattattgattcaaacctgggggtccaagatgtggagaacctcaagtttctctgcataggattggtccccaacaagaagctggagaagtccagctcagcctcagatgtttttgaacatctcttggcagaggatctgctgagtgaggaagaccctttcttcctggcagaactcctctatatcatacggcagaagaagctgctgcagcacctcaactgtaccaaagaggaagtggagcgactgctgcccacccgacaaagggtttctctgtttagaaacctgctctacgaactgtcagaaggcattgactcagagaacttaaaggacatgatcttccttctgaaagactcgcttcccaaaactgaaatgacctccctaagtttcctggcatttctagagaaacaaggtaaaatagatgaagataatctgacatgcctggaggacctctgcaaaacagttgtacctaaacttttgagaaacatagagaaatacaaaagagagaaagctatccagatagtgacacctcctgtagacaaggaagccgagtcgtatcaaggagaggaagaactagtttcccaaacagatgttaagacattcttggaagccttaccgcaggagtcctggcaaaataagcatgcaggtagtaatggtaacagagccacaaatggtgcaccaagcctggtctccagggggatgcaaggagcatctgctaacactctaaactctgaaaccagcacaaagagggcagctgtgtacaggatgaatcggaaccacagaggcctctgtgtcattgtcaacaaccacagctttacctccctgaaggacagacaaggaacccataaagatgctgagatcctgagtcatgtgttccagtggcttgggttcacagtgcatatacacaataatgtgacgaaagtggaaatggagatggtcctgcagaagcagaagtgcaatccagcccatgccgacggggactgcttcgtgttctgtattctgacccatgggagatttggagctgtctactcttcggatgaggccctcattcccattcgggagatcatgtctcacttcacagccctgcagtgccctagactggctgaaaaacctaaactctttttcatccaggcctgccaaggtgaagagatacagccttccgtatccatcgaagcagatgctctgaaccctgagcaggcacccacttccctgcaggacagtattcctgccgaggctgacttcctacttggtctggccactgtcccaggctatgtatcctttcggcatgtggaggaaggcagctggtatattcagtctctgtgtaatcatctgaagaaattggtcccaaggatgctgaaatttctggaaaagacaatggaaatcaggggcaggaagagaacagtgtggggtgctaaacagatctcagcaacctccctgcccacggccatctctgcgcagacacctcgaccccccatgcgcaggtggagcagcgtttcctagttctttccagaggcttccttctgcctgccttccagccacatcgcctgagattgacaacgccctacagcaagacggaaacctccctttacagcaccaccttgcgattctgcagccacaaagttgagacttctgaacgtggcactcttctgttcccttactgtttcacgtgtacctgtgtcatctttcttgtttcatcgtaaacatacttctaaaattcccattttctttatttagaaatagaactacaagcggatggttaaacaatttaaacaaatggtccatggggaaaagtgaatttcacactgtcccccaaactttcagtg

SEQ ID NO: 342 - DNA, 5928 bp, Homo sapiens
tccctttttgacttaccaaggaaatggagatccaaaggaaagcctgaagcactttgtggcttccacgggttcgtttctaggaagcttttgctttacctggggaaaccccaagctctacagtgagaaagttgtaaattagcctttaggagacgctgtttgtcaaagttatcttaaccctggaaaaggggagggaaaaaggcagataagcagtgatgacatcagcaggaaactagtatcaggctacccagtcctgaagattcagttttcacttaaacaaccagcaagtcttgaagtctcttcccaagcaaatgggagcttctttggaccttggagcacacagaggattctactttctttaaaactttgttttcaggcaatttccctgagaaccgtttacttccagaagattggtggagcttgatctgaaggctggccatgaaatctcaaggtcaacattggtattccagttcagataaaaactgtaaagtgagctttcgtgagaagcttctgattattgattcaaacctgggggtccaagatgtggagaacctcaagtttctctgcataggattggtccccaacaagaagctggagaagtccagctcagcctcagatgtttttgaacatctcttggcagaggatctgctgagtgaggaagaccctttcttcctggcagaactcctctatatcatacggcagaagaagctgctgcagcacctcaactgtaccaaagaggaagtggagcgactgctgcccacccgacaaagggtttctctgtttagaaacctgctctacgaactgtcagaaggcattgactcagagaacttaaaggacatgatcttccttctgaaagactcgcttcccaaaactgaaatgacctccctaagtttcctggcatttctagagaaacaaggtaaaatagatgaagataatctgacatgcctggaggacctctgcaaaacagttgtacctaaacttttgagaaacatagagaaatacaaaagagagaaagctatccagatagtgacacctcctgtagacaaggaagccgagtcgtatcaaggagaggaagaactagtttcccaaacagatgttaagacattcttggaagccttaccgcaggagtcctggcaaaataagcatgcaggtagtaatggtaacagagccacaaatggtgcaccaagcctggtctccagggggatgcaaggagcatctgctaacactctaaactctgaaaccagcacaaagagggcagctgtgtacaggatgaatcggaaccacagaggcctctgtgtcattgtcaacaaccacagctttacctccctgaaggacagacaaggaacccataaagatgctgagatcctgagtcatgtgttccagtggcttgggttcacagtgcatatacacaataatgtgacgaaagtggaaatggagatggtcctgcagaagcagaagtgcaatccagcccatgccgacggggactgcttcgtgttctgtattctgacccatgggagatttggagctgtctactcttcggatgaggccctcattcccattcgggagatcatgtctcacttcacagccctgcagtgccctagactggctgaaaaacctaaactctttttcatccaggcctgccaaggtgaagagatacagccttccgtatccatcgaagcagatgctctgaaccctgagcaggcacccacttccctgcaggacagtattcctgccgaggctgacttcctacttggtctggccactgtcccaggctatgtatcctttcggcatgtggaggaaggcagctggtatattcagtctctgtgtaatcatctgaagaaattggtcccaagacatgaagacatcttatccatcctcactgctgtcaacgatgatgtgagtcgaagagtggacaaacagggaacaaagaaacagatgccccagcctgctttcacactaaggaaaaaactagtattccctgtgcccctggatgcactttcattatagcagagagtttttgttggttcttagacctcaaacgaatcattggctataacctccagcctcctgcccagcacaggaatcggtggtctccacctgtcattctagaaacaggaaacaccgtgttttctgacacagtcaattctgattttctttttcttttgcaagtctaaatgttagaaaactttcttttttttggagatagtctcattctgtcacccagactggagtgcaggggggcaatcacggctcactgtagtctcgacctcccaggctcaagctgtcctcccgcctcagcttcccaagtagctgggaccacaggtgtgtaccaccgtgcccggattttttttattctttattttttgtagagatggagggatctcactttgttgcacaggctggtttcaaactcctaggcccaagtgatcctcccacctctgtccccaaaatactgggattataggcacgagccaccacacctggccagaaaactttcattattgaagacttggattgtagccttggttttggatgtctattctgaagacagagtaattggctttggtttgtgcaggtactttttctttgagacagagtcactccgtcacctgggctggagtgcagtggtgggatcactgttcactgcagccttgacctcccaggttcaagcgatcctcccacctcagcctcccaagtagctgagactacaggtgtgtgtccatgcacagctaactttttattttttttgtggagatggggtttcactatgttgcctaagctggtctcaaactcctgggctcaagcgatcctcccacctcagcttctcaaagttctgggactacaggcatgaaatactgtgcctggcctggggaccaggtgcattttaaggttccttggtgttcaaaaaccacgttcttagcctagattgagcttagattgcctctctagacaactaccccttagttataattctgtgtcccctctgcatgcccttaaacattggacagtgaggtcacagtccacccaccctctctctgatctcccccttcctaagacttctcttttgcacatctagtgaggtgaaaatttggtctatgccaggcccatttcctgcttttgtgtaaggaaggtgctcacataggaagtttttatttggttagagacaggtttccctgtaggaagatgatggctcatttacactcagctgctctgcaagcagaaactttacaacctgatgtcatattccattttggactgggtgcggtgactcatgcctgtaatcccagtactctgggaagccaaggcaggcagatcacttgaggtcaggagttcgagaccagcctggccaatacggcaaaacctcatcattactaaaaacacaaaaattagccaggtgtggcggcgagcacctgtaatcccagctactcgggaggctgagacaggagaatctcttgaatccaggaggcagaggctgtggtgagccaagatgacacaactgcactccagcttgggcaacagggcgagaccttgtttaaaaaaaaaattcaatattggggttggaacatttcagttgccattgacagaacacccaattcaaattgactgaagcaaagaagggaatttattgcctctttcacattgaaacccaggagtggataacactggcttcaggcaaagcttgaatcaggactcaatctacaggccagcacctttctcttggccggatgtcctcagggctggcagatgcagtagactgcagtggacagtccccaccttgttactgctactacactttgctcctctggcccaaggcatgaggagagaggctgtgtcagaaactgaagctgttctcaggatcactgggctcttcttggcagaggggatgtctggcttgcctgaagggagtggctctgtaaggacgccttgatgctttcttcattaagattttgagcatttttacgtacttgagcttttttttttttttttttcaatttctagaggaactttttctctgttaattcctggaactgtattttgaatccttaaaggtgagccctcatagggagatccaaagtcctgtggttaacgccttcatttatagatgaggcagctgaggcctggggatgtgaacaacctgctcacagtcctcatttactggatttgacttcagccaggtgaactggaatgccttggggcgtggaagggcattaggagtgtttcatttgatatgtgaatgctcataaaaaaatgtcaaggaatgaagaacaacaactctcagtggtgcctgcatttataattatttatgtgaaagtcaaattcatgtacagtaaatttgttataagaatattcacaagaacactgttctgatatctctgattgtcatgtggatttgaatgtagcttgacagagggaatgtctaatctatattgacagggcaggaacaccgtcatcttagacaaacaccgccactttaagttccagttccctttctagcctcatgcatttcaaggaaatcacttcttttctaacagcgagcagccagaaagagaagagagtaaaatacagataagacagctctggcatagagggaggtgggggggtgggggaagtctcttgggtaactgccaaactttgccttcatacaatgggttccaggaaaacaatgagccttaataagcacattcctttcccttcaggtgcactaagtggggaagctaaaagcagactggaggggggtggggtgtacctacagctgcagaaatattgtatgggaacggacacacaactctccctcccagataagcacagcaaagagacatagaagcaatccaagcctctgataaactctcccaccctaaatccttaaaaactcttagtctgtaagtgagtgggctctgacctaactcggccagaagcccctttcaaatttgttttctctaaaataaacctgtccttggctgtcaagccacctttcatgtttctttcctctttctttaattcttacacatgtgtcaggatgatctcccaaaaccgtgttcataacagtcagggccaaaagctagtggtcacagtccttgtccagttggcagaactgacatgtgaaggcaagtgaaggatggtgagatactgaggaaagagcaaaggatctggagatcaaagccctgcatttccattttgtcctgattcctttgctcagagacactaactaaatcaagctagcttttttcagccttgtctgtaaagtagagaaaacattagctgttgggaagacgaaaaagaatgtgtcctatgtgtgcatctatttaaatctaactgtgctgaggtgcatataaatgcctttaggtggtagggtcttccggttgtaactgcaacagaaatagcaggacttaagttcctttgtgcgtaattccagctgactttattagcggcaactcagcactagcattacccctgacatactctgagtaagatctaattcttccctcactggttcgtgatgtctaccgcagcagaaggccagctcttgactctgagttcagttggacaaaatgctgttgataaaacctcctgtcaggcctctgagcccaagctaagccatcatatcccttgtgacctgcacatatatatccagatggcctgaagtaactgaagaatcacaaaagaagtgaaaatggcctgttcctgccttaactgatgacattaccttgtgaaattccttctcctggctcatcctggctcaaaagctcccccagtgagcaccttgtgacccccatccctgccagccagagaacaaccccctttgactgtaattttccactacttacccaaatcctataaaacggccccacccctatctcccttcactgactttcttttcggactcagcccacctgcacccaggtgattaaaaagctttattgctcacacaaa

SEQ ID NO: 343 - DNA, 3926 bp, Homo sapiens
tgaagtctcttcccaagcaaatgggagcttctttggaccttggagcacacagaggattctactttctttaaaactttgttttcaggcaatttccctgagaaccgtttacttccagaagattggtggagcttgatctgaaggctggccatgaaatctcaaggtcaacattggtattccagttcagataaaaactgtaaagtgagctttcgtgagaagcttctgattattgattcaaacctgggggtccaagatgtggagaacctcaagtttctctgcataggattggtccccaacaagaagctggagaagtccagctcagcctcagatgtttttgaacatctcttggcagaggatctgctgagtgaggaagaccctttcttcctggcagaactcctctatatcatacggcagaagaagctgctgcagcacctcaactgtaccaaagaggaagtggagcgactgctgcccacccgacaaagggtttctctgtttagaaacctgctctacgaactgtcagaaggcattgactcagagaacttaaaggacatgatcttccttctgaaagactcgcttcccaaaactgaaatgacctccctaagtttcctggcatttctagagaaacaaggtaaaatagatgaagataatctgacatgcctggaggacctctgcaaaacagttgtacctaaacttttgagaaacatagagaaatacaaaagagagaaagctatccagatagtgacacctcctgtagacaaggaagccgagtcgtatcaaggagaggaagaactagtttcccaaacagatgttaagacattcttggaagccttaccgagggcagctgtgtacaggatgaatcggaaccacagaggcctctgtgtcattgtcaacaaccacagctttacctccctgaaggacagacaaggaacccataaagatgctgagatcctgagtcatgtgttccagtggcttgggttcacagtgcatatacacaataatgtgacgaaagtggaaatggagatggtcctgcagaagcagaagtgcaatccagcccatgccgacggggactgcttcgtgttctgtattctgacccatgggagatttggagctgtctactcttcggatgaggccctcattcccattcgggagatcatgtctcacttcacagccctgcagtgccctagactggctgaaaaacctaaactctttttcatccaggcctgccaaggtgaagagatacagccttccgtatccatcgaagcagatgctctgaaccctgagcaggcacccacttccctgcaggacagtattcctgccgaggctgacttcctacttggtctggccactgtcccaggctatgtatcctttcggcatgtggaggaaggcagctggtatattcagtctctgtgtaatcatctgaagaaattggtcccaagacatgaagacatcttatccatcctcactgctgtcaacgatgatgtgagtcgaagagtggacaaacagggaacaaagaaacagatgccccagcctgctttcacactaaggaaaaaactagtattccctgtgcccctggatgcactttcattatagcagagagtttttgttggttcttagacctcaaacgaatcattggctataacctccagcctcctgcccagcacaggaatcggtggtctccacctgtcattctagaaacaggaaacaccgtgttttctgacacagtcaattctgattttctttttcttttgcaagtctaaatgttagaaaactttcttttttttggagatagtctcattctgtcacccagactggagtgcaggggggcaatcacggctcactgtagtctcgacctcccaggctcaagctgtcctcccgcctcagcttcccaagtagctgggaccacaggtgtgtaccaccgtgcccggattttttttattctttattttttgtagagatggagggatctcactttgttgcacaggctggtttcaaactcctaggcccaagtgatcctcccacctctgtccccaaaatactgggattataggcacgagccaccacacctggccagaaaactttcattattgaagacttggattgtagccttggttttggatgtctattctgaagacagagtaattggctttggtttgtgcaggtactttttctttgagacagagtcactccgtcacctgggctggagtgcagtggtgggatcactgttcactgcagccttgacctcccaggttcaagcgatcctcccacctcagcctcccaagtagctgagactacaggtgtgtgtccatgcacagctaactttttattttttttgtggagatggggtttcactatgttgcctaagctggtctcaaactcctgggctcaagcgatcctcccacctcagcttctcaaagttctgggactacaggcatgaaatactgtgcctggcctggggaccaggtgcattttaaggttccttggtgttcaaaaaccacgttcttagcctagattgagcttagattgcctctctagacaactaccccttagttataattctgtgtcccctctgcatgcccttaaacattggacagtgaggtcacagtccacccaccctctctctgatctcccccttcctaagacttctcttttgcacatctagtgaggtgaaaatttggtctatgccaggcccatttcctgcttttgtgtaaggaaggtgctcacataggaagtttttatttggttagagacaggtttccctgtaggaagatgatggctcatttacactcagctgctctgcaagcagaaactttacaacctgatgtcatattccattttggactgggtgcggtgactcatgcctgtaatcccagtactctgggaagccaaggcaggcagatcacttgaggtcaggagttcgagaccagcctggccaatacggcaaaacctcatcattactaaaaacacaaaaattagccaggtgtggcggcgagcacctgtaatcccagctactcgggaggctgagacaggagaatctcttgaatccaggaggcagaggctgtggtgagccaagatgacacaactgcactccagcttgggcaacagggcgagaccttgtttaaaaaaaaaattcaatattggggttggaacatttcagttgccattgacagaacacccaattcaaattgactgaagcaaagaagggaatttattgcctctttcacattgaaacccaggagtggataacactggcttcaggcaaagcttgaatcaggactcaatctacaggccagcacctttctcttggccggatgtcctcagggctggcagatgcagtagactgcagtggacagtccccaccttgttactgctactacactttgctcctctggcccaaggcatgaggagagaggctgtgtcagaaactgaagctgttctcaggatcactgggctcttcttggcagaggggatgtctggcttgcctgaagggagtggctctgtaaggacgccttgatgctttcttcattaagattttgagcatttttacgtacttgagcttttttttttttttttttcaatttctagaggaactttttctctgttaattcctggaactgtattttgaatccttaaaggtgagccctcatagggagatccaaagtcctgtggttaacgccttcatttatagatgaggcagctgaggcctggggatgtgaacaacctgctcacagtcctcatttactggatttgacttcagccaggtgaactggaatgccttggggcgtggaagggcattaggagtgtttcatttgatatgtgaatgctcataaaaaaatgtcaaggaatgaagaacaacaactctcagtggtgcctgcatttataattatttatgtgaaagtcaaattcatgtacagtaaatttgttataagaat

SEQ ID NO: 344 - DNA, 5814 bp, Homo sapiens
aaggaaatggagatccaaaggaaagcctgaagcactttgtggcttccacgggttcgtttctaggaagcttttgctttacctggggaaaccccaagctctacagtgagaaagttgtaaattagcctttaggagacgctgtttgtcaaagttatcttaaccctggaaaaggggagggaaaaaggcagataagcagtgatgacatcagcaggaaactagtatcaggctacccagtcctgaagattcagttttcacttaaacaaccagcaagtcttgaagtctcttcccaagcaaatgggagcttctttggaccttggagcacacagaggattctactttctttaaaactttgttttcaggcaatttccctgagaaccgtttacttccagaagattggtggagcttgatctgaaggctggccatgaaatctcaaggtcaacattggtattccagttcagataaaaactgtaaagtgagctttcgtgagaagcttctgattattgattcaaacctgggggtccaagatgtggagaacctcaagtttctctgcataggattggtccccaacaagaagctggagaagtccagctcagcctcagatgtttttgaacatctcttggcagaggatctgctgagtgaggaagaccctttcttcctggcagaactcctctatatcatacggcagaagaagctgctgcagcacctcaactgtaccaaagaggaagtggagcgactgctgcccacccgacaaagggtttctctgtttagaaacctgctctacgaactgtcagaaggcattgactcagagaacttaaaggacatgatcttccttctgaaagactcgcttcccaaaactgaaatgacctccctaagtttcctggcatttctagagaaacaaggtaaaatagatgaagataatctgacatgcctggaggacctctgcaaaacagttgtacctaaacttttgagaaacatagagaaatacaaaagagagaaagctatccagatagtgacacctcctgtagacaaggaagccgagtcgtatcaaggagaggaagaactagtttcccaaacagatgttaagacattcttggaagccttaccgcaggagtcctggcaaaataagcatgcaggtagtaatgagggcagctgtgtacaggatgaatcggaaccacagaggcctctgtgtcattgtcaacaaccacagctttacctccctgaaggacagacaaggaacccataaagatgctgagatcctgagtcatgtgttccagtggcttgggttcacagtgcatatacacaataatgtgacgaaagtggaaatggagatggtcctgcagaagcagaagtgcaatccagcccatgccgacggggactgcttcgtgttctgtattctgacccatgggagatttggagctgtctactcttcggatgaggccctcattcccattcgggagatcatgtctcacttcacagccctgcagtgccctagactggctgaaaaacctaaactctttttcatccaggcctgccaaggtgaagagatacagccttccgtatccatcgaagcagatgctctgaaccctgagcaggcacccacttccctgcaggacagtattcctgccgaggctgacttcctacttggtctggccactgtcccaggctatgtatcctttcggcatgtggaggaaggcagctggtatattcagtctctgtgtaatcatctgaagaaattggtcccaagacatgaagacatcttatccatcctcactgctgtcaacgatgatgtgagtcgaagagtggacaaacagggaacaaagaaacagatgccccagcctgctttcacactaaggaaaaaactagtattccctgtgcccctggatgcactttcattatagcagagagtttttgttggttcttagacctcaaacgaatcattggctataacctccagcctcctgcccagcacaggaatcggtggtctccacctgtcattctagaaacaggaaacaccgtgttttctgacacagtcaattctgattttctttttcttttgcaagtctaaatgttagaaaactttcttttttttggagatagtctcattctgtcacccagactggagtgcaggggggcaatcacggctcactgtagtctcgacctcccaggctcaagctgtcctcccgcctcagcttcccaagtagctgggaccacaggtgtgtaccaccgtgcccggattttttttattctttattttttgtagagatggagggatctcactttgttgcacaggctggtttcaaactcctaggcccaagtgatcctcccacctctgtccccaaaatactgggattataggcacgagccaccacacctggccagaaaactttcattattgaagacttggattgtagccttggttttggatgtctattctgaagacagagtaattggctttggtttgtgcaggtactttttctttgagacagagtcactccgtcacctgggctggagtgcagtggtgggatcactgttcactgcagccttgacctcccaggttcaagcgatcctcccacctcagcctcccaagtagctgagactacaggtgtgtgtccatgcacagctaactttttattttttttgtggagatggggtttcactatgttgcctaagctggtctcaaactcctgggctcaagcgatcctcccacctcagcttctcaaagttctgggactacaggcatgaaatactgtgcctggcctggggaccaggtgcattttaaggttccttggtgttcaaaaaccacgttcttagcctagattgagcttagattgcctctctagacaactaccccttagttataattctgtgtcccctctgcatgcccttaaacattggacagtgaggtcacagtccacccaccctctctctgatctcccccttcctaagacttctcttttgcacatctagtgaggtgaaaatttggtctatgccaggcccatttcctgcttttgtgtaaggaaggtgctcacataggaagtttttatttggttagagacaggtttccctgtaggaagatgatggctcatttacactcagctgctctgcaagcagaaactttacaacctgatgtcatattccattttggactgggtgcggtgactcatgcctgtaatcccagtactctgggaagccaaggcaggcagatcacttgaggtcaggagttcgagaccagcctggccaatacggcaaaacctcatcattactaaaaacacaaaaattagccaggtgtggcggcgagcacctgtaatcccagctactcgggaggctgagacaggagaatctcttgaatccaggaggcagaggctgtggtgagccaagatgacacaactgcactccagcttgggcaacagggcgagaccttgtttaaaaaaaaaattcaatattggggttggaacatttcagttgccattgacagaacacccaattcaaattgactgaagcaaagaagggaatttattgcctctttcacattgaaacccaggagtggataacactggcttcaggcaaagcttgaatcaggactcaatctacaggccagcacctttctcttggccggatgtcctcagggctggcagatgcagtagactgcagtggacagtccccaccttgttactgctactacactttgctcctctggcccaaggcatgaggagagaggctgtgtcagaaactgaagctgttctcaggatcactgggctcttcttggcagaggggatgtctggcttgcctgaagggagtggctctgtaaggacgccttgatgctttcttcattaagattttgagcatttttacgtacttgagcttttttttttttttttttcaatttctagaggaactttttctctgttaattcctggaactgtattttgaatccttaaaggtgagccctcatagggagatccaaagtcctgtggttaacgccttcatttatagatgaggcagctgaggcctggggatgtgaacaacctgctcacagtcctcatttactggatttgacttcagccaggtgaactggaatgccttggggcgtggaagggcattaggagtgtttcatttgatatgtgaatgctcataaaaaaatgtcaaggaatgaagaacaacaactctcagtggtgcctgcatttataattatttatgtgaaagtcaaattcatgtacagtaaatttgttataagaatattcacaagaacactgttctgatatctctgattgtcatgtggatttgaatgtagcttgacagagggaatgtctaatctatattgacagggcaggaacaccgtcatcttagacaaacaccgccactttaagttccagttccctttctagcctcatgcatttcaaggaaatcacttcttttctaacagcgagcagccagaaagagaagagagtaaaatacagataagacagctctggcatagagggaggtgggggggtgggggaagtctcttgggtaactgccaaactttgccttcatacaatgggttccaggaaaacaatgagccttaataagcacattcctttcccttcaggtgcactaagtggggaagctaaaagcagactggaggggggtggggtgtacctacagctgcagaaatattgtatgggaacggacacacaactctccctcccagataagcacagcaaagagacatagaagcaatccaagcctctgataaactctcccaccctaaatccttaaaaactcttagtctgtaagtgagtgggctctgacctaactcggccagaagcccctttcaaatttgttttctctaaaataaacctgtccttggctgtcaagccacctttcatgtttctttcctctttctttaattcttacacatgtgtcaggatgatctcccaaaaccgtgttcataacagtcagggccaaaagctagtggtcacagtccttgtccagttggcagaactgacatgtgaaggcaagtgaaggatggtgagatactgaggaaagagcaaaggatctggagatcaaagccctgcatttccattttgtcctgattcctttgctcagagacactaactaaatcaagctagcttttttcagccttgtctgtaaagtagagaaaacattagctgttgggaagacgaaaaagaatgtgtcctatgtgtgcatctatttaaatctaactgtgctgaggtgcatataaatgcctttaggtggtagggtcttccggttgtaactgcaacagaaatagcaggacttaagttcctttgtgcgtaattccagctgactttattagcggcaactcagcactagcattacccctgacatactctgagtaagatctaattcttccctcactggttcgtgatgtctaccgcagcagaaggccagctcttgactctgagttcagttggacaaaatgctgttgataaaacctcctgtcaggcctctgagcccaagctaagccatcatatcccttgtgacctgcacatatatatccagatggcctgaagtaactgaagaatcacaaaagaagtgaaaatggcctgttcctgccttaactgatgacattaccttgtgaaattccttctcctggctcatcctggctcaaaagctcccccagtgagcaccttgtgacccccatccctgccagccagagaacaaccccctttgactgtaattttccactacttacccaaatcctataaaacggccccacccctatctcccttcactgactttcttttcggactcagcccacctgcacccaggtgattaaaaagctttattgctcac

SEQ ID NO: 345 - DNA, 4225 bp, Homo sapiens
cttttgtctgtccgccgagcaccccacttcaccccattggaccgcgcggccgccgctagagctctgcgcctgcgcacgcaccgggccggggactgggtggcctggtgtgtgggcgcggcagggcgcaggcgcaggcgcagtgtgcgtccgcgtctgaggggagggatgtgggggaagcgacggcccccggtttgtttgggctgtgggcggtgcgcagcggagagcccgggaaaagcgggaaatggcggcgccgagcgcggggtcttggtccaccttccagcacaaggagctgatggccgctgacaggggacgcaggatattgggagtgtgtggcatgcatcctcatcatcaggaaactctaaaaaagaaccgagtggtgctagccaaacagctgttgttgagcgaattgttagaacatcttctggagaaggacatcatcaccttggaaatgagggagctcatccaggccaaagtgggcagtttcagccagaatgtggaactcctcaacttgctgcctaagaggggtccccaagcttttgatgccttctgtgaagcactgagggagaccaagcaaggccacctggaggatatgttgctcaccaccctttctgggcttcagcatgtactcccaccgttgagctgtgactacgacttgagtctcccttttccggtgtgtgagtcctgtcccctttacaagaagctccgcctgtcgacagatactgtggaacactccctagacaataaagatggtcctgtctgccttcaggtgaagccttgcactcctgaattttatcaaacacacttccagctggcatataggttgcagtctcggcctcgtggcctagcactggtgttgagcaatgtgcacttcactggagagaaagaactggaatttcgctctggaggggatgtggaccacagtactctagtcaccctcttcaagcttttgggctatgacgtccatgttctatgtgaccagactgcacaggaaatgcaagagaaactgcagaattttgcacagttacctgcacaccgagtcacggactcctgcatcgtggcactcctctcgcatggtgtggagggcgccatctatggtgtggatgggaaactgctccagctccaagaggtttttcagctctttgacaacgccaactgcccaagcctacagaacaaaccaaaaatgttcttcatccaggcctgccgtggagatgagactgatcgtggggttgaccaacaagatggaaagaaccacgcaggatcccctgggtgcgaggagagtgatgccggtaaagaaaagttgccgaagatgagactgcccacgcgctcagacatgatatgcggctatgcctgcctcaaagggactgccgccatgcggaacaccaaacgaggttcctggtacatcgaggctcttgctcaagtgttttctgagcgggcttgtgatatgcacgtggccgacatgctggttaaggtgaacgcacttatcaaggatcgggaaggttatgctcctggcacagaattccaccggtgcaaggagatgtctgaatactgcagcactctgtgccgccacctctacctgttcccaggacaccctcccacatgatgtcacctccccatcatccacgccaagtggaagccactggaccacaggaggtgtgatagagcctttgatcttcaggatgcacggtttctgttctgccccctcagggatgtgggaatctcccagacttgtttcctgtgcccatcatctctgcctttgagtgtgggactccaggccagctccttttctgtgaagccctttgcctgtagagccagccttggttggacctattgccaggaatgtttcagctgcagttgaagagcctgacaagtgaagttgtaaacacagtgtggttatggggagagggcatataaattccccatatttgtgttcagttccagcttttgtagatggcactttagtgattgcttttattacattagttaagatgtctgagagaccatctcctatcttttatttcattcatatcctccgccctttttgtcctagagtgagagtttggaaggtgtccaaatttaatgtagacattatcttttggctctgaagaagcaaacatgactagagacgcaccttgctgcagtgtccagaagcggcctgtgcgttcccttcagtactgcagcgccacccagtggaaggacactcttggctcgtttgggctcaaggcaccgcagcctgtcagccaacattgccttgcatttgtaccttattgatctttgcccatggaagtctcaaagatctttcgttggttgtttctctgagctttgttactgaaatgagcctcgtggggagcatcagagaaggccaggaagaatggtgtgtttccctagactctgtaaccacctctctgtctttttccttcctgagaaacgtccatctctctcccttactattcccactttcattcaatcaacctgcacttcatatctagatttctagaaaagcttcctagcttatctccctgcttcatatctctcccttctttaccttcatttcatcctgttggctgctgccaccaaatctgtctagaatcctgctttacaggatcatgtaaatgctcaaagatgtaatgtagttctttgttcctgctttctctttcagtattaaactctcctttgatattatgtggcttttatttcagtgccatacatgttattgttttcaacctagaaacctttatccctgcttatctgaaacttcccaacttccctgttctttaagactttttttttttttttttttttttttgagacagagtctcgctctgtcgcccaggctggagggcagtggcacgatctcagctcactgcaagctccaactcccgggttcacgccattctcctgcctcagccttccaagtagctgggactacaggtgcccgccaccgtgcccggctaatttttttgtatttttagtagagacagggtttcaccatgttagccgggatggtcttgatctcctgacctcatgatccacccacctcagcctcccaaagtgttgggattacaggcgtgagccactgcgcccgggcaagacctttttttaaaaaaaaaaaaaaaaaaacttccattctttcttcctccagtctgttctcacataacagagtagttttggtttttaattttttttggttgtttgctgttttttgttttttaaggtgagttctcactatgtttctcagactggtctcgaactcctggcctcaagccatcttcccgcctcagcctctcaaatagctgggcttacaggcatgagccaccacacctggccaggatttggttgtttaaatataaatctgatcacccccctgcttagaacccttctgctttctattacccctcatttaaaatgtaaactcttcaccttggtttatgagaactggttcttgccttccccttgaacctcattaaatggtgatttcttgctaagctccagcccgagtggtctcctctcagcttctaattttgtgctctttcctgcccttttcctgggccttctcagctctccacccccaccactcttgactcaggtggtgtccttcttcctcaagtcttgacaattcccgggcccttcagtccctgagcagtctacttctgtgtctgtcaccacatcttgtcttttcccctcattgcatttattgcagtttatatatatgctacttttacttgttcatttctgtctcccctaccaggctgtaaatgagggcagaaaccttgtttgttttattcaccatcatgtaccaagtgcttggcacatagtgggccttcattaaatgtttgttgaataaaagagggaagaaggcaagccaaccttagctacaatcctaccttttgataaaatgttccttttgacaatatacacggattattatttgtactttgtttttccatgtgttttgcttttatccactggcatttttagctccttgaagacatatcatgtgtgagataacttccttcacatctcccatggtccctagcaaaatgctaggcctgtagtagtcaaggtgctcaataaatatttgtttgggtggtttgtgagccttgctgccaagtcctgcctttgggtcgacatagtatggaagtatttgagagagagaacctttccactcccactgccaggattttgtattgccatcgggtgccaaataaatgctcatatttattactga

SEQ ID NO: 346 - DNA, 1146 bp, Homo sapiens
gggaaatggcggcgccgagcgcggggtcttggtccaccttccagcacaaggagctgatggccgctgacaggggacgcaggatattgggagtgtgtggcatgcatcctcatcatcaggaaactctaaaaaagaaccgagtggtgctagccaaacagctgttgttgagcgaattgttagaacatcttctggagaaggacatcatcaccttggaaatgagggagctcatccaggccaaagtgggcagtttcagccagaatgtggaactcctcaacttgctgcctaagaggggtccccaagcttttgatgccttctgtgaagccttgcactcctgaattttatcaaacacacttccagctggcatataggttgcagtctcggcctcgtggcctagcactggtgttgagcaatgtgcacttcactggagagaaagaactggaatttcgctctggaggggatgtggaccacagtactctagtcaccctcttcaagcttttgggctatgacgtccatgttctatgtgaccagactgcacaggaaatgcaagagaaactgcagaattttgcacagttacctgcacaccgagtcacggactcctgcatcgtggcactcctctcgcatggtgtggagggcgccatctatggtgtggatgggaaactgctccagctccaagaggtttttcagctctttgacaacgccaactgcccaagcctacagaacaaaccaaaaatgttcttcatccaggcctgccgtggagatgagactgatcgtggggttgaccaacaagatggaaagaaccacgcaggatcccctgggtgcgaggagagtgatgccggtaaagaaaagttgccgaagatgagactgcccacgcgctcagacatgatatgcggctatgcctgcctcaaagggactgccgccatgcggaacaccaaacgaggttcctggtacatcgaggctcttgctcaagtgttttctgagcgggcttgtgatatgcacgtggccgacatgctggttaaggtgaacgcacttatcaaggatcgggaaggttatgctcctggcacagaattccaccggtgcaaggagatgtctgaatactgcagcactctgtgccgccacctctacctgttcccaggacaccctcccacatga

SEQ ID NO: 347 - DNA, 1048 bp, Homo sapiens
ggaaaagcgggaaatggcggcgccgagcgcggggtcttggtccaccttccagcacaaggagctgatggccgctgacaggggacgcaggatattgggagtgtgtggcatgcatcctcatcatcaggaaactctaaaaaagaaccgagtggtgctagccaaacagctgttgttgagcgaattgttagaacatcttctggagaaggacatcatcaccttggaaatgagggagctcatccaggccaaagtgggcagtttcagccagaatgtggaactcctcaacttgctgcctaagaggggtccccaagcttttgatgccttctgtgaagcactgagggagaccaagcaaggccacctggaggatatgttgctcaccaccctttctgggcttcagcatgtactcccaccgttgagctgtgactacgacttgagtctcccttttccggtgtgtgagtcctgtcccctttacaagaagctccgcctgtcgacagatactgtggaacactccctagacaataaagatggtcctgtctgccttcaggtgaagccttgcactcctgaattttatcaaacacacttccagctggcatataggttgcagtctcggcctcgtggcctagcactggtgttgagcaatgtgcacttcactggagagaaagaactggaatttcgctctggaggggatgtggaccacagtactctagtcaccctcttcaagcttttgggctatgacgtccatgttctatgtgaccagactgcacaggaaatgcaagagaaactgcagaattttgcacagttacctgcacaccgagtcacggactcctgcatcgtggcactcctctcgcatggtgtggagggcgccatctatggtgtggatgggaaactgctccagctccaagaggtttttcagctctttgacaacgccaactgcccaagcctacagaacaaaccaaaaatgttcttcatccaggcctgccgtggagcaggtgctattggatcccttgggcacctccttctgttcactgctgccaccgcctctcttgctctgtaa

SEQ ID NO: 348 - DNA, 2673 bp, Homo sapiens
acatctcccggcggcgggccgcggaagcagtgcagacgcggctcctagcggatgggtgctattgtgaggcggttgtagaagagtttcgtgagtgctcgcagctcatacctgtggctgtgtatccgtggccacagctggttggcgtcgccttgaaatcccaggccgtgaggagttagcgagccctgctcacactcggcgctctggttttcggtgggtgtgccctgcacctgcctcttcccccattctcattaataaaggtatccatggagaacactgaaaactcagtggattcaaaatccattaaaaatttggaaccaaagatcatacatggaagcgaatcaatggactctggaatatccctggacaacagttataaaatggattatcctgagatgggtttatgtataataattaataataagaattttcataaaagcactggaatgacatctcggtctggtacagatgtcgatgcagcaaacctcagggaaacattcagaaacttgaaatatgaagtcaggaataaaaatgatcttacacgtgaagaaattgtggaattgatgcgtgatgtttctaaagaagatcacagcaaaaggagcagttttgtttgtgtgcttctgagccatggtgaagaaggaataatttttggaacaaatggacctgttgacctgaaaaaaataacaaactttttcagaggggatcgttgtagaagtctaactggaaaacccaaacttttcattattcaggcctgccgtggtacagaactggactgtggcattgagacagacagtggtgttgatgatgacatggcgtgtcataaaataccagtggaggccgacttcttgtatgcatactccacagcacctggttattattcttggcgaaattcaaaggatggctcctggttcatccagtcgctttgtgccatgctgaaacagtatgccgacaagcttgaatttatgcacattcttacccgggttaaccgaaaggtggcaacagaatttgagtccttttcctttgacgctacttttcatgcaaagaaacagattccatgtattgtttccatgctcacaaaagaactctatttttatcactaaagaaatggttggttggtggttttttttagtttgtatgccaagtgagaagatggtatatttggtactgtatttccctctcattttgacctactctcatgctgcagagggtactttaagacatactccttccatcaaatagaaccactatgaagctacctcaaacttccagtcaggtagttgcaattgaattaaattaggaataaataaaaatggatactggtgcagtcattatgagaggcaatgattgttaatttacagctttcatgattagcaagttacagtgatgctgtgctatgaattttcaagtaattgtgaaaaagttaaacattgaagtaatgaatttttatgatattccccccacttaagactgtgtattctagttttgtcaaactgtagaaatgatgatgtggaagaacttaggcatctgtgggcatggtcaaaggctcaaacctttattttagaattgatatacacggatgacttaactgcatttttagaccatttatctgggattatggttttgtgatgtttgtcctgaacacttttgttgtaaaaaaataataataatgtttaatattgagaaagaaactaatattttatgtgagagaaagtgtgagcaaactaacttgacttttaaggctaaaacttaacattcatagaggggtggagttttaactgtaaggtgctacaatgcccctggatctaccagcataaatatcttctgatttgtccctatgcatatcagttgagcttcatataccagcaatatatctgaagagctattatataaaaaccccaaactgttgattattagccaggtaatgtgaataaattctataggaacatatgaaaatacaacttaaataataaacagtggaatataaggaaagcaataaatgaatgggctgagctgcctgtaacttgagagtagatggtttgagcctgagcagagacatgactcagcctgttccatgaaggcagagccatggaccacgcaggaagggcctacagcccatttctccatacgcactggtatgtgtggatgatgctgccagggcgccatcgccaagtaagaaagtgaagcaaatcagaaacttgtgaagtggaaatgttctaaaggtggtgaggcaataaaaatcatagtactctttgtagcaaaattcttaagtatgttattttctgttgaagtttacaatcaaaggaaaatagtaatgttttatactgtttactgaaagaaaaagacctatgagcacataggactctagacggcatccagccggaggccagagctgagccctcagcccgggaggcaggctccaggcctcagcaggtgcggagccgtcactgcaccaagtctcactggctgtcagtatgacatttcacgggagatttcttgttgctcaaaaaatgagctcgcatttgtcaatgacagtttcttttttcttactagacctgtaacttttgtaaatacacatagcatgtaatggtatcttaaagtgtgtttctatgtgacaattttgtacaaatttgttattttccatttttatttcaaaatatacattcaaacttaaaatta

SEQ ID NO: 349 - DNA, 2621 bp, Homo sapiens
atccgtggccacagctggttggcgtcgccttgaaatcccaggccgtgaggagttagcgagccctgctcacactcggcgctctggttttcggtgggtgtgccctgcacctgcctcttcccccattctcaatgagatcaccatcctcagaataatttgtaccccgctgggcactagctaatggaggtgatgtcatgctaagcagcacttcagtgagttttgcgggaaccaaagctctgctcccaggagtgtggatttggtgctttcatgtggaaaaagcggatgatgacaagtagagagcaaatgtgcgcatgtctgatgctttaataaaggtatccatggagaacactgaaaactcagtggattcaaaatccattaaaaatttggaaccaaagatcatacatggaagcgaatcaatggactctggaatatccctggacaacagttataaaatggattatcctgagatgggtttatgtataataattaataataagaattttcataaaagcactggaatgacatctcggtctggtacagatgtcgatgcagcaaacctcagggaaacattcagaaacttgaaatatgaagtcaggaataaaaatgatcttacacgtgaagaaattgtggaattgatgcgtgatgtttctaaagaagatcacagcaaaaggagcagttttgtttgtgtgcttctgagccatggtgaagaaggaataatttttggaacaaatggacctgttgacctgaaaaataacaaactttttcagaggggatcgttgtagaagtctaactggaaaacccaaacttttcattattcaggttattattcttggcgaaattcaaaggatggctcctggttcatccagtcgctttgtgccatgctgaaacagtatgccgacaagcttgaatttatgcacattcttacccgggttaaccgaaaggtggcaacagaatttgagtccttttcctttgacgctacttttcatgcaaagaaacagattccatgtattgtttccatgctcacaaaagaactctatttttatcactaaagaaatggttggttggtggttttttttagtttgtatgccaagtgagaagatggtatatttggtactgtatttccctctcattttgacctactctcatgctgcagagggtactttaagacatactccttccatcaaatagaaccactatgaagctacctcaaacttccagtcaggtagttgcaattgaattaaattaggaataaataaaaatggatactggtgcagtcattatgagaggcaatgattgttaatttacagctttcatgattagcaagttacagtgatgctgtgctatgaattttcaagtaattgtgaaaaagttaaacattgaagtaatgaatttttatgatattccccccacttaagactgtgtattctagttttgtcaaactgtagaaatgatgatgtggaagaacttaggcatctgtgggcatggtcaaaggctcaaacctttattttagaattgatatacacggatgacttaactgcatttttagaccatttatctgggattatggttttgtgatgtttgtcctgaacacttttgttgtaaaaaaataataataatgtttaatattgagaaagaaactaatattttatgtgagagaaagtgtgagcaaactaacttgacttttaaggctaaaacttaacattcatagaggggtggagttttaactgtaaggtgctacaatgcccctggatctaccagcataaatatcttctgatttgtccctatgcatatcagttgagcttcatataccagcaatatatctgaagagctattatataaaaaccccaaactgttgattattagccaggtaatgtgaataaattctataggaacatatgaaaatacaacttaaataataaacagtggaatataaggaaagcaataaatgaatgggctgagctgcctgtaacttgagagtagatggtttgagcctgagcagagacatgactcagcctgttccatgaaggcagagccatggaccacgcaggaagggcctacagcccatttctccatacgcactggtatgtgtggatgatgctgccagggcgccatcgccaagtaagaaagtgaagcaaatcagaaacttgtgaagtggaaatgttctaaaggtggtgaggcaataaaaatcatagtactctttgtagcaaaattcttaagtatgttattttctgttgaagtttacaatcaaaggaaaatagtaatgttttatactgtttactgaaagaaaaagacctatgagcacataggactctagacggcatccagccggaggccagagctgagccctcagcccgggaggcaggctccaggcctcagcaggtgcggagccgtcactgcaccaagtctcactggctgtcagtatgacatttcacgggagatttcttgttgctcaaaaaatgagctcgcatttgtcaatgacagtttcttttttcttactagacctgtaacttttgtaaatacacatagcatgtaatggtatcttaaagtgtgtttctatgtgacaattttgtacaaatttgttattttccatttttatttcaaaatatacattcaaacttaaaatt

SEQ ID NO: 350 - DNA, 549 bp, Homo sapiens
agtgcagacgcggctcctagcggatgggtgctattgtgaggcggttgtagaagagtttcgtgagtgctcgcagctcatacctgtggctgtgtatccgtggccacagctggttggcgtcgccttgaaatcccaggccgtgaggagttagcgagccctgctcacactcggcgctctggttttcgttaataaaggtatccatggagaacactgaaaactcagtggattcaaaatccattaaaaatttggaaccaaagatcatacatggaagcgaatcaatggactctggaatatccctggacaacagttataaaatggattatcctgagatgggtttatgtataataattaataataagaattttcataaaagcactggaatgacatctcggtctggtacagatgtcgatgcagcaaacctcagggaaacattcagaaacttgaaatatgaagtcaggaataaaaatgatcttacacgtgaagaaattgtggaattgatgcgtgatgtttctaaagaagatcacagcaaaaggagcagttttgtttgtgtgc

SEQ ID NO: 351 - DNA, 2540 bp, Homo sapiens
aggggcgggcgggaggcggggctggcgctggagcacatctcccggcggcgggccgcggaagcagtgcagacgcggctcctagcggatgggtgctattgtgaggcggttgtagaagttaataaaggtatccatggagaacactgaaaactcagtggattcaaaatccattaaaaatttggaaccaaagatcatacatggaagcgaatcaatggactctggaatatccctggacaacagttataaaatggattatcctgagatgggtttatgtataataattaataataagaattttcataaaagcactggaatgacatctcggtctggtacagatgtcgatgcagcaaacctcagggaaacattcagaaacttgaaatatgaagtcaggaataaaaatgatcttacacgtgaagaaattgtggaattgatgcgtgatgtttctaaagaagatcacagcaaaaggagcagttttgtttgtgtgcttctgagccatggtgaagaaggaataatttttggaacaaatggacctgttgacctgaaaaaaataacaaactttttcagaggggatcgttgtagaagtctaactggaaaacccaaacttttcattattcaggcctgccgtggtacagaactggactgtggcattgagacagacagtggtgttgatgatgacatggcgtgtcataaaataccagtggaggccgacttcttgtatgcatactccacagcacctggttattattcttggcgaaattcaaaggatggctcctggttcatccagtcgctttgtgccatgctgaaacagtatgccgacaagcttgaatttatgcacattcttacccgggttaaccgaaaggtggcaacagaatttgagtccttttcctttgacgctacttttcatgcaaagaaacagattccatgtattgtttccatgctcacaaaagaactctatttttatcactaaagaaatggttggttggtggttttttttagtttgtatgccaagtgagaagatggtatatttggtactgtatttccctctcattttgacctactctcatgctgcagagggtactttaagacatactccttccatcaaatagaaccactatgaagctacctcaaacttccagtcaggtagttgcaattgaattaaattaggaataaataaaaatggatactggtgcagtcattatgagaggcaatgattgttaatttacagctttcatgattagcaagttacagtgatgctgtgctatgaattttcaagtaattgtgaaaaagttaaacattgaagtaatgaatttttatgatattccccccacttaagactgtgtattctagttttgtcaaactgtagaaatgatgatgtggaagaacttaggcatctgtgggcatggtcaaaggctcaaacctttattttagaattgatatacacggatgacttaactgcatttttagaccatttatctgggattatggttttgtgatgtttgtcctgaacacttttgttgtaaaaaaataataataatgtttaatattgagaaagaaactaatattttatgtgagagaaagtgtgagcaaactaacttgacttttaaggctaaaacttaacattcatagaggggtggagttttaactgtaaggtgctacaatgcccctggatctaccagcataaatatcttctgatttgtccctatgcatatcagttgagcttcatataccagcaatatatctgaagagctattatataaaaaccccaaactgttgattattagccaggtaatgtgaataaattctataggaacatatgaaaatacaacttaaataataaacagtggaatataaggaaagcaataaatgaatgggctgagctgcctgtaacttgagagtagatggtttgagcctgagcagagacatgactcagcctgttccatgaaggcagagccatggaccacgcaggaagggcctacagcccatttctccatacgcactggtatgtgtggatgatgctgccagggcgccatcgccaagtaagaaagtgaagcaaatcagaaacttgtgaagtggaaatgttctaaaggtggtgaggcaataaaaatcatagtactctttgtagcaaaattcttaagtatgttattttctgttgaagtttacaatcaaaggaaaatagtaatgttttatactgtttactgaaagaaaaagacctatgagcacataggactctagacggcatccagccggaggccagagctgagccctcagcccgggaggcaggctccaggcctcagcaggtgcggagccgtcactgcaccaagtctcactggctgtcagtatgacatttcacgggagatttcttgttgctcaaaaaatgagctcgcatttgtcaatgacagtttcttttttcttactagacctgtaacttttgtaaatacacatagcatgtaatggtatcttaaagtgtgtttctatgtgacaattttgtacaaatttgttattttccatttttatttcaaaatatacattcaaacttaaaatta

SEQ ID NO: 352 - DNA, 1338 bp, Homo sapiens
cagaagcctttgtgatctcacctgttggaatgcactaatgttttctgagccccttaaatatcttgtctacattcttttaagaagctcttcaccaactgtcagaaggcaaccacagaaaaaagccacttaaggtgttggaatccctgggcaaagatttcctcactggtgttttggataacttggtggaacaaaatgtactgaactggaaggaagaggaaaaaaagaaatattacgatgctaaaactgaagacaaagttcgggtcatggcagactctatgcaagagaagcaacgtatggcaggacaaatgcttcttcaaaccttttaacatagaccaaatatcccccaataaaaaagctcatccgaatatggaggctggaccacctgagtcaggagaatctacagatgccctcaagctttgtcctcatgaagaattcctgagactatgtaaagaaagagctgaagagatctatccaataaaggagagaaacaaccgcacacgcctggctctcatcatatgcaatacagagtttgaccatctgcctccgaggaatggagctgactttgacatcacagggatgaaggagctacttgagggtctggactatagtgtagatgtagaagagaatctgacagccagggatatggagtcagcgctgagggcatttgctaccagaccagagcacaagtcctctgacagcacattcttggtactcatgtctcatggcatcctggagggaatctgcggaactgtgcatgatgagaaaaaaccagatgtgctgctttatgacaccatcttccagatattcaacaaccgcaactgcctcagtctgaaggacaaacccaaggtcatcattgtccaggcctgcagaggtgcaaaccgtggggaactgtgggtcagagactctccagcatccttggaagtggcctcttcacagtcatctgagaacctagaggaagatgctgtttacaagacccacgtggagaaggacttcattgctttctgctcttcaacgccacacaacgtgtcctggagagacagcacaatgggctctatcttcatcacacaactcatcacatgcttccagaaatattcttggtgctgccacctagaggaagtatttcggaaggtacagcaatcatttgaaactccaagggccaaagctcaaatgcccaccatagaacgactgtccatgacaagatatttctacctctttcctggcaattgaaaatggaagccacaagcagcccagccctccttaatcaacttcaaggagcaccttcattagtacagcttgcatatttaacattttgtatttcaataaaagtgaagacaaacg

SEQ ID NO: 353 - DNA, 763 bp, Homo sapiens
ggagggatggatcccggtcccacctaaagaagcagtctggccatgatctgccacagcggctgtgctgcactgtgaagactgctgcccagtccaatctgcccagcctccctagcactgtcagaaactaaattccagtaattggatgccaatttgctgatgacaaggcacttcctgataatgagtctggaattctgagcagcagtttcacaatctgtaattacacgtttccgccctttgcaataaggaaatacatagtttactttcatttttgactctgaggctctttccaacgctgtaaaaaaggacagaggctgttccctatggcagaaggcaaccacagaaaaaagccacttaaggtgttggaatccctgggcaaagatttcctcactggtgttttggataacttggtggaacaaaatgtactgaactggaaggaagaggaaaaaaagaaatattacgatgctaaaactgaagacaaagttcgggtcatggcagactctatgcaagagaagcaacgtatggcaggacaaatgcttcttcaaaccttttttaacatagaccaaatatcccccaataaaaaagctcatccgaatatggaggctggaccacctgagtcaggagaatctacagatgccctcaagctttgtcctcatgaagaattcctgagactatgtaaagaaagagctgaagagatctatccaataaaggagagaaacaaccgcacacgcctggctctcatcatatgcaatacagagtttgacca

SEQ ID NO: 354 - DNA, 2158 bp, Homo sapiens
aaatgagagctctgtctgtaaactctaggtggagttgctgaaattcctgcaagcatttcttgccgggagaggagggatggatcccggtcccacctaaagaagcagtctggccatgatctgccacagcggctgtgctgcactgtgaagactgctgcccagtccaatctgcccagcctccctagcactggtagggaaaaaccgctgactagagctgcagtaatggcagtcgcccctcccctggggaactcggtcatctctggcgtactccaggctgctatgctggctagtggggattctaatccagcggatctaagcttgcaggcttctgtgagaatggacctgctgcaaggccattttgctccctggcttcagccccctttccatgggagtggacgggactcctgcctcactagagttccgggagctgctggactatgtaaaaactcctgcagctcagtgcctgcccaaaaagctggaaatatgaactattgggttaattcttatcaggaaatgaaaaagagttgttagattaaacttcttcagtcattgtcgttctttgtaatcagagaaagaaaaactgagagatcaggaagagaagagacagatggatagaagaagtttgggtggccacaggaaacaagaaaagaaacaagctgaggtgtcaacccacaggataatattttgtcattttcatttttttcccccaagtcagaaactaaattccagtaattggatgccaatttgctgatgacaaggcacttcctgataatgagtctggaattctgagcagcagtttcacaatctgtaattacacgtttccgccctttgcaataaggaaatacatagtttactttcatttttgactctgaggctctttccaacgctgtaaaaaaggacagaggctgttccctatggcagaaggcaaccacagaaaaaagccacttaaggtgttggaatccctgggcaaagatttcctcactggtgttttggataacttggtggaacaaaatgtactgaactggaaggaagaggaaaaaaagaaatattacgatgctaaaactgaagacaaagttcgggtcatggcagactctatgcaagagaagcaacgtatggcaggacaaatgcttcttcaaaccttttttaacatagaccaaatatcccccaataaaaaagctcatccgaatatggaggctggaccacctgagtcaggagaatctacagatgccctcaagctttgtcctcatgaagaattcctgagactatgtaaagaaagagctgaagagatctatccaataaaggagagaaacaaccgcacacgcctggctctcatcatatgcaatacagagtttgaccatctgcctccgaggaatggagctgactttgacatcacagggatgaaggagctacttgagggtctggactatagtgtagatgtagaagagaatctgacagccagggatatggagtcagcgctgagggcatttgctaccagaccagagcacaagtcctctgacagcacattcttggtactcatgtctcatggcatcctggagggaatctgcggaactgtgcatgatgagaaaaaaccagatgtgctgctttatgacaccatcttccagatattcaacaaccgcaactgcctcagtctgaaggacaaacccaaggtcatcattgtccaggcctgcagaggtgcaaaccgtggggaactgtgggtcagagactctccagcatccttggaagtggcctcttcacagtcatctgagaacctagaggaagatgctgtttacaagacccacgtggagaaggacttcattgctttctgctcttcaacgccacacaacgtgtcctggagagacagcacaatgggctctatcttcatcacacaactcatcacatgcttccagaaatattcttggtgctgccacctagaggaagtatttcggaaggtacagcaatcatttgaaactccaagggccaaagctcaaatgcccaccatagaacgactgtccatgacaagatatttctacctctttcctggcaattgaaaatggaagccacaagcagcccagccctccttaatcaacttcaaggagcaccttcattagtacagcttgcatatttaacattttgtatttcaataaaagtgaagacaaacgaa

SEQ ID NO: 355 - DNA, 1414 bp, Homo sapiens
atggctgaagacagtggcaaaaaaaaaaggcgtaagaattttgaagctatgttcaaaggtatccttcagagtggattggataacttcgtgataaaccacatgctaaagaacaacgtggctggacaaacatctatccagaccctagtacctaatacggatcaaaagtcgaccagtgtaaaaaaagacaaccacaaaaaaaaaacagttaagatgttggaatacctgggcaaagatgttcttcatggtgtttttaattatttggcaaaacacgatgttctgacattgaaggaagaggaaaagaaaaaatattatgataccaaaattgaagacaaggccctgatcttggtagactctttgcgaaagaatcgcgtggctcatcaaatgtttacccaaacacttctcaatatggaccaaaagatcaccagtgtaaaacctcttctgcaaatcgaggctggaccacctgagtcagcagaatctacaaatatactcaaactttgtcctcgtgaagaattcctgagactgtgtaaaaaaaatcatgatgagatctatccaataaaaaagagagaggaccgcagacgcctggctctcatcatatgcaatacaaagtttgatcacctgcctgcaaggaatggggctcactatgacatcgtggggatgaaaaggctgcttcaaggcctgggctacactgtggttgacgaaaagaatctcacagccagggatatggagtcagtgctgagggcatttgctgccagaccagagcacaagtcctctgacagcacgttcttggtactcatgtctcatggcatcctagagggaatctgcggaactgcgcataaaaagaaaaaaccggatgtgctgctttatgacaccatcttccagatattcaacaaccgcaactgcctcagtctaaaggacaaacccaaggtcatcattgtccaggcctgcagaggtgaaaaacatggggaactctgggtcagagactctccagcatccttggcactcatctcttcacagtcatctgagaacctggaggcagattctgtttgcaagatccacgaggagaaggacttcattgctttctgttcttcaacaccacataacgtgtcctggagagaccgcacaaggggctccatcttcattacggaactcatcacatgcttccagaaatattcttgctgctgccacctaatggaaatatttcggaaggtacagaaatcatttgaagttccacaggctaaagcccagatgcccaccatagaacgagcaaccttgacaagagatttctacctctttcctggcaattgaaaatgaaaccacaggcagcccagccctcctctgtcaacatcaaagagcacatttaccagtatagcttgcatagtcaatatttggtatttcaataaaagtaaagactgta

SEQ ID NO: 356 - DNA, 1378 bp, Homo sapiens
agtgctgtacaaagagacagaggctgttagctatggctgctgtgcccagagttgaaggagtctttatatttctgatagaagacagtggcaaaaaaaaaaggcgtaagaattttgaagctatgttcaaaggtatccttcagagtggattggataacttcgtgataaaccacatgctaaagaacaacgtggctggacaaacatctatccagaccctagtacctaatacggatcaaaagtcgaccagtgtaaaaaaagacaaccacaaaaaaaaaacagttaagatgttggaatacctgggcaaagatgttcttcatggtgtttttaattatttggcaaaacacgatgttctgacattgaaggaagaggaaaagaaaaaatattatgataccaaaattgaagacaaggccctgatcttggtagactctttgcgaaagaatcgcgtggctcatcaaatgtttacccaaacacttctcaatatggaccaaaagatcaccagtgtaaaacatctatccaataaaaaagagagaggaccgcagacgcctggctctcatcatatgcaatacaaagtttgatcacctgcctgcaaggaatggggctcactatgacatcgtggggatgaaaaggctgcttcaaggcctgggctacactgtggttgacgaaaagaatctcacagccagggatatggagtcagtgctgagggcatttgctgccagaccagagcacaagtcctctgacagcacgttcttggtactcatgtctcatggcatcctagagggaatctgcggaactgcgcataaaaagaaaaaaccggatgtgctgctttatgacaccatcttccagatattcaacaaccgcaactgcctcagtctaaaggacaaacccaaggtcatcattgtccaggcctgcagaggtgaaaaacatggggaactctgggtcagagactctccagcatccttggcactcatctcttcacagtcatctgagaacctggaggcagattctgtttgcaagatccacgaggagaaggacttcattgctttctgttcttcaacaccacataacgtgtcctggagagaccgcacaaggggctccatcttcattacggaactcatcacatgcttccagaaatattcttgctgctgccacctaatggaaatatttcggaaggtacagaaatcatttgaagttccacaggctaaagcccagatgcccaccatagaacgagcaaccttgacaagagatttctacctctttcctggcaattgaaaatgaaaccacaggcagcccagccctcctctgtcaacatcaaagagcacatttaccagtatagcttgcatagtcaatatttggtatttcaataaaagtaaagactgtatct

SEQ ID NO: 357 - DNA, 1488 bp, Homo sapiens
agtgctgtacaaagagacagaggctgttagctatggctgctgtgcccagagttgaaggagtctttatatttctgatagaagacagtggcaaaaaaaaaaggcgtaagaattttgaagctatgttcaaaggtatccttcagagtggattggataacttcgtgataaaccacatgctaaagaacaacgtggctggacaaacatctatccagaccctagtacctaatacggatcaaaagtcgaccagtgtaaaaaaagacaaccacaaaaaaaaaacagttaagatgttggaatacctgggcaaagatgttcttcatggtgtttttaattatttggcaaaacacgatgttctgacattgaaggaagaggaaaagaaaaaatattatgataccaaaattgaagacaaggccctgatcttggtagactctttgcgaaagaatcgcgtggctcatcaaatgtttacccaaacacttctcaatatggaccaaaagatcaccagtgtaaaacctcttctgcaaatcgaggctggaccacctgagtcagcagaatctacaaatatactcaaactttgtcctcgtgaagaattcctgagactgtgtaaaaaaaatcatgatgagatctatccaataaaaaagagagaggaccgcagacgcctggctctcatcatatgcaatacaaagtttgatcacctgcctgcaaggaatggggctcactatgacatcgtggggatgaaaaggctgcttcaaggcctgggctacactgtggttgacgaaaagaatctcacagccagggatatggagtcagtgctgagggcatttgctgccagaccagagcacaagtcctctgacagcacgttcttggtactcatgtctcatggcatcctagagggaatctgcggaactgcgcataaaaagaaaaaaccggatgtgctgctttatgacaccatcttccagatattcaacaaccgcaactgcctcagtctaaaggacaaacccaaggtcatcattgtccaggcctgcagaggtgaaaaacatggggaactctgggtcagagactctccagcatccttggcactcatctcttcacagtcatctgagaacctggaggcagattctgtttgcaagatccacgaggagaaggacttcattgctttctgttcttcaacaccacataacgtgtcctggagagaccgcacaaggggctccatcttcattacggaactcatcacatgcttccagaaatattcttgctgctgccacctaatggaaatatttcggaaggtacagaaatcatttgaagttccacaggctaaagcccagatgcccaccatagaacgagcaaccttgacaagagatttctacctctttcctggcaattgaaaatgaaaccacaggcagcccagccctcctctgtcaacatcaaagagcacatttaccagtatagcttgcatagtcaatatttggtatttcaataaaagtaaagactgtatct

SEQ ID NO: 358 - DNA, 1023 bp, Homo sapiens
agtgctgtacaaagagacagaggctgttagctatggctgctcttctgcaaatcgaggctggaccacctgagtcagcagaatctacaaatatactcaaactttgtcctcgtgaagaattcctgagactgtgtaaaaaaaatcatgatgagatctatccaataaaaaagagagaggaccgcagacgcctggctctcatcatatgcaatacaaagtttgatcacctgcctgcaaggaatggggctcactatgacatcgtggggatgaaaaggctgcttcaaggcctgggctacactgtggttgacgaaaagaatctcacagccagggatatggagtcagtgctgagggcatttgctgccagaccagagcacaagtcctctgacagcacgttcttggtactcatgtctcatggcatcctagagggaatctgcggaactgcgcataaaaagaaaaaaccggatgtgctgctttatgacaccatcttccagatattcaacaaccgcaactgcctcagtctaaaggacaaacccaaggtcatcattgtccaggcctgcagaggtgaaaaacatggggaactctgggtcagagactctccagcatccttggcactcatctcttcacagtcatctgagaacctggaggcagattctgtttgcaagatccacgaggagaaggacttcattgctttctgttcttcaacaccacataacgtgtcctggagagaccgcacaaggggctccatcttcattacggaactcatcacatgcttccagaaatattcttgctgctgccacctaatggaaatatttcggaaggtacagaaatcatttgaagttccacaggctaaagcccagatgcccaccatagaacgagcaaccttgacaagagatttctacctctttcctggcaattgaaaatgaaaccacaggcagcccagccctcctctgtcaacatcaaagagcacatttaccagtatagcttgcatagtcaatatttggtatttcaataaaagtaaagactgtatct

SEQ ID NO: 359 - DNA, 1237 bp, Homo sapiens
gtgctgtacaaagagacagaggctgttagctatggctgaagacaaccacaaaaaaaaaacagttaagatgttggaatacctgggcaaagatgttcttcatggtgtttttaattatttggcaaaacacgatgttctgacattgaaggaagaggaaaagaaaaaatattatgataccaaaattgaagacaaggccctgatcttggtagactctttgcgaaagaatcgcgtggctcatcaaatgtttacccaaacacttctcaatatggaccaaaagatcaccagtgtaaaacctcttctgcaaatcgaggctggaccacctgagtcagcagaatctacaaatatactcaaactttgtcctcgtgaagaattcctgagactgtgtaaaaaaaatcatgatgagatctatccaataaaaaagagagaggaccgcagacgcctggctctcatcatatgcaatacaaagtttgatcacctgcctgcaaggaatggggctcactatgacatcgtggggatgaaaaggctgcttcaaggcctgggctacactgtggttgacgaaaagaatctcacagccagggatatggagtcagtgctgagggcatttgctgccagaccagagcacaagtcctctgacagcacgttcttggtactcatgtctcatggcatcctagagggaatctgcggaactgcgcataaaaagaaaaaaccggatgtgctgctttatgacaccatcttccagatattcaacaaccgcaactgcctcagtctaaaggacaaacccaaggtcatcattgtccaggcctgcagaggtgaaaaacatggggaactctgggtcagagactctccagcatccttggcactcatctcttcacagtcatctgagaacctggaggcagattctgtttgcaagatccacgaggagaaggacttcattgctttctgttcttcaacaccacataacgtgtcctggagagaccgcacaaggggctccatcttcattacggaactcatcacatgcttccagaaatattcttgctgctgccacctaatggaaatatttcggaaggtacagaaatcatttgaagttccacaggctaaagcccagatgcccaccatagaacgagcaaccttgacaagagatttctacctctttcctggcaattgaaaatgaaaccacaggcagcccagccctcctctgtcaacatcaaagagcacatttaccagtatagcttgcatagtc

SEQ ID NO: 360 - DNA, 1344 bp, Homo sapiens
atggctgctgtgcccagagttgaaggagtctttatatttctgatagaagacagtggcaaaaaaaaaaggcgtaagaattttgaagctatgttcaaaggtatccttcagagtggattggataacttcgtgataaaccacatgctaaagaacaacgtggctggacaaacatctatccagaccctagtacctaatacggatcaaaagtcgaccagtgtaaaaaaagacaaccacaaaaaaaaaacagttaagatgttggaatacctgggcaaagatgttcttcatggtgtttttaattatttggcaaaacacgatgttctgacattgaaggaagaggaaaagaaaaaatattatgataccaaaattgaagacaaggccctgatcttggtagactctttgcgaaagaatcgcgtggctcatcaaatgtttacccaaacacttctcaatatggaccaaaagatcaccagtgtaaaacctcttctgcaaatcgaggctggaccacctgagtcagcagaatctacaaatatactcaaactttgtcctcgtgaagaattcctgagactgtgtaaaaaaaatcatgatgagatctatccaataaaaaagagagaggaccgcagacgcctggctctcatcatatgcaatacaaagtttgatcacctgcctgcaaggaatggggctcactatgacatcgtggggatgaaaaggctgcttcaaggcctgggctacactgtggttgacgaaaagaatctcacagccagggatatggagtcagtgctgagggcatttgctgccagaccagagcacaagtcctctgacagcacgttcttggtactcatgtctcatggcatcctagagggaatctgcggaactgcgcataaaaagaaaaaaccggatgtgctgctttatgacaccatcttccagatattcaacaaccgcaactgcctcagtctaaaggacaaacccaaggtcatcattgtccaggcctgcagaggtgaaaaacatggggaactctgggtcagagactctccagcatccttggcactcatctcttcacagtcatctgagaacctggaggcagattctgtttgcaagatccacgaggagaaggacttcattgctttctgttcttcaacaccacataacgtgtcctggagagaccgcacaaggggctccatcttcattacggaactcatcacatgcttccagaaatattcttgctgctgccacctaatggaaatatttcggaaggtacagaaatcatttgaagttccacaggctaaagcccagatgcccaccatagaacgagcaaccttgacaagagatttctacctctttcctggcaattga

SEQ ID NO: 361 - DNA, 879 bp, Homo sapiens
atggctgctcttctgcaaatcgaggctggaccacctgagtcagcagaatctacaaatatactcaaactttgtcctcgtgaagaattcctgagactgtgtaaaaaaaatcatgatgagatctatccaataaaaaagagagaggaccgcagacgcctggctctcatcatatgcaatacaaagtttgatcacctgcctgcaaggaatggggctcactatgacatcgtggggatgaaaaggctgcttcaaggcctgggctacactgtggttgacgaaaagaatctcacagccagggatatggagtcagtgctgagggcatttgctgccagaccagagcacaagtcctctgacagcacgttcttggtactcatgtctcatggcatcctagagggaatctgcggaactgcgcataaaaagaaaaaaccggatgtgctgctttatgacaccatcttccagatattcaacaaccgcaactgcctcagtctaaaggacaaacccaaggtcatcattgtccaggcctgcagaggtgaaaaacatggggaactctgggtcagagactctccagcatccttggcactcatctcttcacagtcatctgagaacctggaggcagattctgtttgcaagatccacgaggagaaggacttcattgctttctgttcttcaacaccacataacgtgtcctggagagaccgcacaaggggctccatcttcattacggaactcatcacatgcttccagaaatattcttgctgctgccacctaatggaaatatttcggaaggtacagaaatcatttgaagttccacaggctaaagcccagatgcccaccatagaacgagcaaccttgacaagagatttctacctctttcctggcaattga

SEQ ID NO: 362 - DNA, 1548 bp, Homo sapiens
ccgagggcggggccgggcccgggagcctgtggcttcaggaagaggagggcaaggtgtctggctgcgcgtttggctgcaatgagctcggcctcggggctccgcagggggcacccggcaggtggggaagaaaacatgacagaaacagatgccttctataaaagagaaatgtttgatccggcagaaaagtacaaaatggaccacaggaggagaggaattgctttaatcttcaatcatgagaggttcttttggcacttaacactgccagaaaggcggggcacctgcgcagatagagacaatcttacccgcaggttttcagatctaggatttgaagtgaaatgctttaatgatcttaaagcagaagaactactgctcaaaattcatgaggtgtcaactgttagccacgcagatgccgattgctttgtgtgtgtcttcctgagccatggcgaaggcaatcacatttatgcatatgatgctaaaatcgaaattcagacattaactggcttgttcaaaggagacaagtgtcacagcctggttggaaaacccaagatatttatcattcaggcatgtcggggaaaccagcacgatgtgccagtcattcctttggatgtagtagataatcagacagagaagttggacaccaacataactgaggtggatgcagcctccgtttacacgctgcctgctggagctgacttcctcatgtgttactctgttgcagaaggatattattctcaccgggaaactgtgaacggctcatggtacattcaagatttgtgtgagatgttgggaaaatatggctcctccttagagttcacagaactcctcacactggtgaacaggaaagtttctcagcgccgagtggacttttgcaaagacccaagtgcaattggaaagaagcaggttccctgttttgcctcaatgctaactaaaaagctgcatttctttccaaaatctaattaattaatagaggctatctaattttacactctgtattgaaaatggctttctcagccaggcgtggttactcacacctgtaatcccagcactttgggagtccaaggtgggcggatcacctgaggtcgggagttcgagaccagcctgaccaacatggagaagccccgtctctactaaaaatgcaaaaaaaaatttagctaggcatggcggcgcatgcctgcaatcccagctacttggaaggctgaggcaggagaatcacttgaacccaggaggtggaggctgcggtgagccgagattgcgccattgcactccagcctgggcaacgagtgaaactccgtctcaaaaaaaagaaaatgtctttctcttccttttatataaatatcgttagggtgaagcattatggtctaatgattcaaatgttttaaagtttaatgcctagcagagaactgccttaaaaaaaaaaaaaaaaagttcatgttggccatggtgaaagggtttgatatggagaaacaaaatcctcaggaaattagataaataaaaatttataagcatttgtattattttttaataaactgcagggttacacaaaaatct

SEQ ID NO: 363 - DNA, 1340 bp, Homo sapiens
tgtctggctgcgcgtttggctgcaatgagctcggcctcggggctccgcagggggcacccggcagtgtcaactgttagccacgcagatgccgattgctttgtgtgtgtcttcctgagccatggcgaaggcaatcacatttatgcatatgatgctaaaatcgaaattcagacattaactggcttgttcaaaggagacaagtgtcacagcctggttggaaaacccaagatatttatcattcaggcatgtcggggaaaccagcacgatgtgccagtcattcctttggatgtagtagataatcagacagagaagttggacaccaacataactgaggtggatgcagcctccgtttacacgctgcctgctggagctgacttcctcatgtgttactctgttgcagaaggatattattctcaccgggaaactgtgaacggctcatggtacattcaagatttgtgtgagatgttgggaaaatatggctcctccttagagttcacagaactcctcacactggtgaacaggaaagtttctcagcgccgagtggacttttgcaaagacccaagtgcaattggaaagaagcaggttccctgttttgcctcaatgctaactaaaaagctgcatttctttccaaaatctaattaattaatagaggctatctaattttacactctgtattgaaaatggctttctcagccaggcgtggttactcacacctgtaatcccagcactttgggagtccaaggtgggcggatcacctgaggtcgggagttcgagaccagcctgaccaacatggagaagccccgtctctactaaaaatgcaaaaaaaaatttagctaggcatggcggcgcatgcctgcaatcccagctacttggaaggctgaggcaggagaatcacttgaacccaggaggtggaggctgcggtgagccgagattgcgccattgcactccagcctgggcaacgagtgaaactccgtctcaaaaaaaagaaaatgtctttctcttccttttatataaatatcgttagggtgaagcattatggtctaatgattcaaatgttttaaagtttaatgcctagcagagaactgccttaaaaaaaaaaaaaaaaagttcatgttggccatggtgaaagggtttgatatggagaaacaaaatcctcaggaaattagataaataaaaatttataagcatttgtattattttttaataaactgcagggttacacaaaaatctagctgatttaacttgtattttgtcacttttttataaaagtttattgtttgatgtttttaaaggtttttgaaatccaggaattaaatcatcccttaataaaatattcgaaattc

SEQ ID NO: 364 - DNA, 2659 bp, Homo sapiens
cccgcgcgcgggctcaactttgtagagcgaggggccaacttggcagagcgcgcggccagctttgcagagagcgccctccagggactatgcgtgcggggacacgggtcgctttgggctcttccacccctgcggagcgcactaccccgagccaggggcggtgcaagccccgcccggccctacccagggcggctcctccctccgcagcgccgagacttttagtttcgctttcgctaaaggggccccagacccttgctgcggagcgacggagagagactgtgccagtcccagccgccctaccgccgtgggaacggcaggaagtggcacttggaaaagaacaccagctgcggtggtagcagtgggatttgtgcttcttatgttacccagatggcagatgatcagggctgtattgaagagcagggggttgaggattcagcaaatgaagattcagtggatgctaagccagaccggtcctcgtttgtaccgtccctcttcagtaagaagaagaaaaatgtcaccatgcgatccatcaagaccacccgggaccgagtgcctacatatcagtacaacatgaattttgaaaagctgggcaaatgcatcataataaacaacaagaactttgataaagtgacaggtatgggcgttcgaaacggaacagacaaagatgccgaggcgctcttcaagtgcttccgaagcctgggttttgacgtgattgtctataatgactgctcttgtgccaagatgcaagatctgcttaaaaaagcttctgaagaggaccatacaaatgccgcctgcttcgcctgcatcctcttaagccatggagaagaaaatgtaatttatgggaaagatggtgtcacaccaataaaggatttgacagcccactttaggggggatagatgcaaaacccttttagagaaacccaaactcttcttcattcaggcttgccgagggaccgagcttgatgatggcatccaggccgactcggggcccatcaatgacacagatgctaatcctcgatacaagatcccagtggaagctgacttcctcttcgcctattccacggttccaggctattactcgtggaggagcccaggaagaggctcctggtttgtgcaagccctctgctccatcctggaggagcacggaaaagacctggaaatcatgcagatcctcaccagggtgaatgacagagttgccaggcactttgagtctcagtctgatgacccacacttccatgagaagaagcagatcccctgtgtggtctccatgctcaccaaggaactctacttcagtcaatagccatatcaggggtacattctagctgagaagcaatgggtcactcattaatgaatcacatttttttatgctcttgaaatattcagaaattctccaggattttaatttcaggaaaatgtattgattcaacagggaagaaactttctggtgctgtcttttgttctctgaattttcagagactttttttataatgttattcatttggtgactgtgtaactttctcttaagattaattttctctttgtatgtctgttaccttgttaatagacttaatacatgcaacagaagtgacttctggagaaagctcatggctgtgtccactgcaattggtggtaacagtggtagagtcatgtttgcacttggcaaaaagaatcccaatgtttgacaaaacacagccaaggggatatttactgctctttattgcagaatgtgggtattgagtgtgatttgaatgatttttcattggcttagggcagattttcatgcaaaagttctcatatgagttagaggagaaaaagcttaatgattctgatatgtatccatcaggatccagtctggaaaacagaaaccattctaggtgtttcaacagagggagtttaatacaggaaattgacttacatagatgataaaagagaagccaaacagcaagaagctgttaccacacccagggctatgaggataatgggaagaggtttggtttcctgtgtccagtagtgggatcatccagaggagctggaaccatggtgggggctgcctagtgggagttaggaccaccaatggattgtggaaaatggagccatgacaagaacaaagccactgactgagatggagtgagctgagacagataagagaataccttggtctcacctatcctgccctcacatcttccaccagcaccttactgcccaggcctatctggaagccacctcaccaaggaccttggaagagcaagggacagtgaggcaggagaagaacaagaaatggatgtaagcctggcccataatgtgaacataagtaatcactaatgctcaacaatttatccattcaatcatttattcattgggttgtcagatagtctatgtatgtgtaaaacaatctgttttggctttatgtgcaaaatctgttatagctttaaaatatatctggaactttttagattattccaagccttattttgagtaaatatttgttacttttagttctataagtgaggaagagtttatggcaaagatttttggcactttgttttcaagatggtgttatcttttgaattcttgataaatgactgtttttttctgcctaatagtaactggttaaaaaacaaatgttcatatttattgattaaaaatgtggttgcttaattcct

SEQ ID NO: 365 - DNA, 2421 bp, Homo sapiens
gactgtgccagtcccagccgccctaccgccgtgggaacgatgctgtaatggactgtgttggttggcctccaggcaggaagtggcacttggaaaagaacaccagctgcggtggtagcagtgggatttgtgcttcttatgttacccagatggcagatgatcagggctgtattgaagagcagggggttgaggattcagcaaatgaagattcagtggatgctaagccagaccggtcctcgtttgtaccgtccctcttcagtaagaagaagaaaaatgtcaccatgcgatccatcaagaccacccgggaccgagtgcctacatatcagtacaacatgaattttgaaaagctgggcaaatgcatcataataaacaacaagaactttgataaagtgacaggtatgggcgttcgaaacggaacagacaaagatgccgaggcgctcttcaagtgcttccgaagcctgggttttgacgtgattgtctataatgactgctcttgtgccaagatgcaagatctgcttaaaaaagcttctgaagaggaccatacaaatgccgcctgcttcgcctgcatcctcttaagccatggagaagaaaatgtaatttatgggaaagatggtgtcacaccaataaaggatttgacagcccactttaggggggatagatgcaaaacccttttagagaaacccaaactcttcttcattcaggcttgccgagggaccgagcttgatgatggcatccaggccgactcggggcccatcaatgacacagatgctaatcctcgatacaagatcccagtggaagctgacttcctcttcgcctattccacggttccaggctattactcgtggaggagcccaggaagaggctcctggtttgtgcaagccctctgctccatcctggaggagcacggaaaagacctggaaatcatgcagatcctcaccagggtgaatgacagagttgccaggcactttgagtctcagtctgatgacccacacttccatgagaagaagcagatcccctgtgtggtctccatgctcaccaaggaactctacttcagtcaatagccatatcaggggtacattctagctgagaagcaatgggtcactcattaatgaatcacatttttttatgctcttgaaatattcagaaattctccaggattttaatttcaggaaaatgtattgattcaacagggaagaaactttctggtgctgtcttttgttctctgaattttcagagactttttttataatgttattcatttggtgactgtgtaactttctcttaagattaattttctctttgtatgtctgttaccttgttaatagacttaatacatgcaacagaagtgacttctggagaaagctcatggctgtgtccactgcaattggtggtaacagtggtagagtcatgtttgcacttggcaaaaagaatcccaatgtttgacaaaacacagccaaggggatatttactgctctttattgcagaatgtgggtattgagtgtgatttgaatgatttttcattggcttagggcagattttcatgcaaaagttctcatatgagttagaggagaaaaagcttaatgattctgatatgtatccatcaggatccagtctggaaaacagaaaccattctaggtgtttcaacagagggagtttaatacaggaaattgacttacatagatgataaaagagaagccaaacagcaagaagctgttaccacacccagggctatgaggataatgggaagaggtttggtttcctgtgtccagtagtgggatcatccagaggagctggaaccatggtgggggctgcctagtgggagttaggaccaccaatggattgtggaaaatggagccatgacaagaacaaagccactgactgagatggagtgagctgagacagataagagaataccttggtctcacctatcctgccctcacatcttccaccagcaccttactgcccaggcctatctggaagccacctcaccaaggaccttggaagagcaagggacagtgaggcaggagaagaacaagaaatggatgtaagcctggcccataatgtgaacataagtaatcactaatgctcaacaatttatccattcaatcatttattcattgggttgtcagatagtctatgtatgtgtaaaacaatctgttttggctttatgtgcaaaatctgttatagctttaaaatatatctggaactttttagattattccaagccttattttgagtaaatatttgttacttttagttctataagtgaggaagagtttatggcaaagatttttggcactttgttttcaagatggtgttatcttttgaattcttgataaatgactgtttttttctgcctaatagtaactggttaaaaaacaaatgttcatatttattgattaaaaatgtggttgcttaattcct

SEQ ID NO: 366 - DNA, 777 bp, Homo sapiens
agacccttgctgcggagcgacggagagagactgtgccagtcccagccgccctaccgccgtgggaacgatggcagatgatcagggctgtattgaagagcagggggttgaggattcagcaaatgaagattcagtggatgctaagccagaccggtcctcgtttgtaccgtccctcttcagtaagaagaagaaaaatgtcaccatgcgatccatcaagaccacccgggaccgagtgcctacatatcagtacaacatgaattttgaaaagctgggcaaatgcatcataataaacaacaagaactttgataaagtgacaggtatgggcgttcgaaacggaacagacaaagatgccgaggcgctcttcaagtgcttccgaagcctgggttttgacgtgattgtctataatgactgctctgtcacccaggctggagtgcagcggcgtgatctcggaagactgcaacctccacctcccaggttcaagcaatactcctgcctcagcctcctgagtagctgggattacaggcacgcaccaccacgcctggctaatttttgtatttttagaagagaggggtttcgccatgttggccaggctggtctcaaactcctggcgtcaagtgatccacccacctcaggctcccaaagtgctgggattacaggtgtgagcctccacacccagccacaaattatgaaggtttctttaagacattgcaatacttttatttgctttgcttagtcatttgaaacacattcattcatttatcttttcatcaaattatcatt

SEQ ID NO: 367 - DNA, 2377 bp, Homo sapiens
gagacttttagtttcgctttcgctaaaggggccccagacccttgctgcggagcgacggagagagactgtgccagtcccagccgccctaccgccgtgggaacgatggcagatgatcagggctgtattgaagagcagggggttgaggattcagcaaatgaagattcagtggatgctaagccagaccggtcctcgtttgtaccgtccctcttcagtaagaagaagaaaaatgtcaccatgcgatccatcaagaccacccgggaccgagtgcctacatatcagtacaacatgaattttgaaaagctgggcaaatgcatcataataaacaacaagaactttgataaagtgacaggtatgggcgttcgaaacggaacagacaaagatgccgaggcgctcttcaagtgcttccgaagcctgggttttgacgtgattgtctataatgactgctcttgtgccaagatgcaagatctgcttaaaaaagcttctgaagaggaccatacaaatgccgcctgcttcgcctgcatcctcttaagccatggagaagaaaatgtaatttatgggaaagatggtgtcacaccaataaaggatttgacagcccactttaggggggatagatgcaaaacccttttagagaaacccaaactcttcttcattcaggcttgccgagggaccgagcttgatgatggcatccaggccgactcggggcccatcaatgacacagatgctaatcctcgatacaagatcccagtggaagctgacttcctcttcgcctattccacggttccaggctattactcgtggaggagcccaggaagaggctcctggtttgtgcaagccctctgctccatcctggaggagcacggaaaagacctggaaatcatgcagatcctcaccagggtgaatgacagagttgccaggcactttgagtctcagtctgatgacccacacttccatgagaagaagcagatcccctgtgtggtctccatgctcaccaaggaactctacttcagtcaatagccatatcaggggtacattctagctgagaagcaatgggtcactcattaatgaatcacatttttttatgctcttgaaatattcagaaattctccaggattttaatttcaggaaaatgtattgattcaacagggaagaaactttctggtgctgtcttttgttctctgaattttcagagactttttttataatgttattcatttggtgactgtgtaactttctcttaagattaattttctctttgtatgtctgttaccttgttaatagacttaatacatgcaacagaagtgacttctggagaaagctcatggctgtgtccactgcaattggtggtaacagtggtagagtcatgtttgcacttggcaaaaagaatcccaatgtttgacaaaacacagccaaggggatatttactgctctttattgcagaatgtgggtattgagtgtgatttgaatgatttttcattggcttagggcagattttcatgcaaaagttctcatatgagttagaggagaaaaagcttaatgattctgatatgtatccatcaggatccagtctggaaaacagaaaccattctaggtgtttcaacagagggagtttaatacaggaaattgacttacatagatgataaaagagaagccaaacagcaagaagctgttaccacacccagggctatgaggataatgggaagaggtttggtttcctgtgtccagtagtgggatcatccagaggagctggaaccatggtgggggctgcctagtgggagttaggaccaccaatggattgtggaaaatggagccatgacaagaacaaagccactgactgagatggagtgagctgagacagataagagaataccttggtctcacctatcctgccctcacatcttccaccagcaccttactgcccaggcctatctggaagccacctcaccaaggaccttggaagagcaagggacagtgaggcaggagaagaacaagaaatggatgtaagcctggcccataatgtgaacataagtaatcactaatgctcaacaatttatccattcaatcatttattcattgggttgtcagatagtctatgtatgtgtaaaacaatctgttttggctttatgtgcaaaatctgttatagctttaaaatatatctggaactttttagattattccaagccttattttgagtaaatatttgttacttttagttctataagtgaggaagagtttatggcaaagatttttggcactttgttttcaagatggtgttatcttttgaattcttgataaatgactgtttttttctgcctaatagtaactggttaaaaaacaaatgttcatatttattgattaaaaatgtggttgcttaattcct

SEQ ID NO: 368 - DNA, 741 bp, Homo sapiens
aaaggggccccagacccttgctgcggagcgacggagagagactgtgccagtcccagccgccctaccgccgtgggaacgatggcagatgatcagggctgtattgaagagcagggggttgaggattcagcaaatgaagattcagtggatgctaagccagaccggtcctcgtttgtaccgtccctcttcagtaagaagaagaaaaatgtcaccatgcgatccatcaagaccacccgggaccgagtgcctacatatcagtacaacatgaattttgaaaagctgggcaaatgcatcataataaacaacaagaactttgataaagtgacaggtatgggcgttcgaaacggaacagacaaagatgccgaggcgctcttcaagtgcttccgaagcctgggttttgacgtgattgtctataatgactgctctttcacccaggctggagtgcagcggcgtgatctcggaagactgcaacctccacctcccaggttcaagcaatactcctgcctcagcctcctgagtagctgggattacaggcacgcaccaccacgcctggctaatttttgtatttttagaagagaggggtttcgccatgttggccaggctggtctcaaactcctggcgtcaagtgatccacccacctcaggctcccaaagtgctgggattacaggtgtgagcctccacacccagccacaaattatgaaggtttctttaagacattgcaatacttttatttgctttgcttag

SEQ ID NO: 369 - DNA, 2694 bp, Homo sapiens
ctcccgcgcgcgggctcaactttgtagagcgaggggccaacttggcagagcgcgcggccagctttgcagagagcgccctccagggactatgcgtgcggggacacgggtcgctttgggctcttccacccctgcggagcgcactaccccgagccaggggcggtgcaagccccgcccggccctacccagggcggctcctccctccgcagcgccgagacttttagtttcgctttcgctaaaggggccccagacccttgctgcggagcgacggagagagactgtgccagtcccagccgccctaccgccgtgggaacgatgctgtaatggactgtgttggttggcctccaggcaggaagtggcacttggaaaagaacaccagctgcggtggtagcagtgggatttgtgcttcttatgttacccagatggcagatgatcagggctgtattgaagagcagggggttgaggattcagcaaatgaagattcagtggatgctaagccagaccggtcctcgtttgtaccgtccctcttcagtaagaagaagaaaaatgtcaccatgcgatccatcaagaccacccgggaccgagtgcctacatatcagtacaacatgaattttgaaaagctgggcaaatgcatcataataaacaacaagaactttgataaagtgacaggtatgggcgttcgaaacggaacagacaaagatgccgaggcgctcttcaagtgcttccgaagcctgggttttgacgtgattgtctataatgactgctcttgtgccaagatgcaagatctgcttaaaaaagcttctgaagaggaccatacaaatgccgcctgcttcgcctgcatcctcttaagccatggagaagaaaatgtaatttatgggaaagatggtgtcacaccaataaaggatttgacagcccactttaggggggatagatgcaaaacccttttagagaaacccaaactcttcttcattcaggcttgccgagggaccgagcttgatgatggcatccaggccgactcggggcccatcaatgacacagatgctaatcctcgatacaagatcccagtggaagctgacttcctcttcgcctattccacggttccaggctattactcgtggaggagcccaggaagaggctcctggtttgtgcaagccctctgctccatcctggaggagcacggaaaagacctggaaatcatgcagatcctcaccagggtgaatgacagagttgccaggcactttgagtctcagtctgatgacccacacttccatgagaagaagcagatcccctgtgtggtctccatgctcaccaaggaactctacttcagtcaatagccatatcaggggtacattctagctgagaagcaatgggtcactcattaatgaatcacatttttttatgctcttgaaatattcagaaattctccaggattttaatttcaggaaaatgtattgattcaacagggaagaaactttctggtgctgtcttttgttctctgaattttcagagactttttttataatgttattcatttggtgactgtgtaactttctcttaagattaattttctctttgtatgtctgttaccttgttaatagacttaatacatgcaacagaagtgacttctggagaaagctcatggctgtgtccactgcaattggtggtaacagtggtagagtcatgtttgcacttggcaaaaagaatcccaatgtttgacaaaacacagccaaggggatatttactgctctttattgcagaatgtgggtattgagtgtgatttgaatgatttttcattggcttagggcagattttcatgcaaaagttctcatatgagttagaggagaaaaagcttaatgattctgatatgtatccatcaggatccagtctggaaaacagaaaccattctaggtgtttcaacagagggagtttaatacaggaaattgacttacatagatgataaaagagaagccaaacagcaagaagctgttaccacacccagggctatgaggataatgggaagaggtttggtttcctgtgtccagtagtgggatcatccagaggagctggaaccatggtgggggctgcctagtgggagttaggaccaccaatggattgtggaaaatggagccatgacaagaacaaagccactgactgagatggagtgagctgagacagataagagaataccttggtctcacctatcctgccctcacatcttccaccagcaccttactgcccaggcctatctggaagccacctcaccaaggaccttggaagagcaagggacagtgaggcaggagaagaacaagaaatggatgtaagcctggcccataatgtgaacataagtaatcactaatgctcaacaatttatccattcaatcatttattcattgggttgtcagatagtctatgtatgtgtaaaacaatctgttttggctttatgtgcaaaatctgttatagctttaaaatatatctggaactttttagattattccaagccttattttgagtaaatatttgttacttttagttctataagtgaggaagagtttatggcaaagatttttggcactttgttttcaagatggtgttatcttttgaattcttgataaatgactgtttttttctgcctaatagtaactggttaaaaaacaaatgttcatatttattgattaaaaatgtggttgcttaattcct

SEQ ID NO: 370 - DNA, 2387 bp, Homo sapiens
gcaagctgggctgctgggtgggtacttccttcaaagctgagggagcgtcctacgcccacgcgcgcaggagggcgccccccgcaaagcaacgtctaggagaccacagtggatgccacagcgggcccgaagcggatcagccttgtgggatggcagatgatcagggctgtattgaagagcagggggttgaggattcagcaaatgaagattcagtggatgctaagccagaccggtcctcgtttgtaccgtccctcttcagtaagaagaagaaaaatgtcaccatgcgatccatcaagaccacccgggaccgagtgcctacatatcagtacaacatgaattttgaaaagctgggcaaatgcatcataataaacaacaagaactttgataaagtgacaggtatgggcgttcgaaacggaacagacaaagatgccgaggcgctcttcaagtgcttccgaagcctgggttttgacgtgattgtctataatgactgctcttgtgccaagatgcaagatctgcttaaaaaagcttctgaagaggaccatacaaatgccgcctgcttcgcctgcatcctcttaagccatggagaagaaaatatggaatcttgctctgtcacccaggctggagtgcagcggcgtgatctcggaagactgcaacctccacctcccaggcttgccgagggaccgagcttgatgatggcatccaggccgactcggggcccatcaatgacacagatgctaatcctcgatacaagatcccagtggaagctgacttcctcttcgcctattccacggttccaggctattactcgtggaggagcccaggaagaggctcctggtttgtgcaagccctctgctccatcctggaggagcacggaaaagacctggaaatcatgcagatcctcaccagggtgaatgacagagttgccaggcactttgagtctcagtctgatgacccacacttccatgagaagaagcagatcccctgtgtggtctccatgctcaccaaggaactctacttcagtcaatagccatatcaggggtacattctagctgagaagcaatgggtcactcattaatgaatcacatttttttatgctcttgaaatattcagaaattctccaggattttaatttcaggaaaatgtattgattcaacagggaagaaactttctggtgctgtcttttgttctctgaattttcagagactttttttataatgttattcatttggtgactgtgtaactttctcttaagattaattttctctttgtatgtctgttaccttgttaatagacttaatacatgcaacagaagtgacttctggagaaagctcatggctgtgtccactgcaattggtggtaacagtggtagagtcatgtttgcacttggcaaaaagaatcccaatgtttgacaaaacacagccaaggggatatttactgctctttattgcagaatgtgggtattgagtgtgatttgaatgatttttcattggcttagggcagattttcatgcaaaagttctcatatgagttagaggagaaaaagcttaatgattctgatatgtatccatcaggatccagtctggaaaacagaaaccattctaggtgtttcaacagagggagtttaatacaggaaattgacttacatagatgataaaagagaagccaaacagcaagaagctgttaccacacccagggctatgaggataatgggaagaggtttggtttcctgtgtccagtagtgggatcatccagaggagctggaaccatggtgggggctgcctagtgggagttaggaccaccaatggattgtggaaaatggagccatgacaagaacaaagccactgactgagatggagtgagctgagacagataagagaataccttggtctcacctatcctgccctcacatcttccaccagcaccttactgcccaggcctatctggaagccacctcaccaaggaccttggaagagcaagggacagtgaggcaggagaagaacaagaaatggatgtaagcctggcccataatgtgaacataagtaatcactaatgctcaacaatttatccattcaatcatttattcattgggttgtcagatagtctatgtatgtgtaaaacaatctgttttggctttatgtgcaaaatctgttatagctttaaaatatatctggaactttttagattattccaagccttattttgagtaaatatttgttacttttagttctataagtgaggaagagtttatggcaaagatttttggcactttgttttcaagatggtgttatcttttgaattcttgataaatgactgtttttttctgcctaatagtaactggttaaaaaacaaatgttcatatttattgattaaaaatgtggttgcttaattcct

SEQ ID NO: 371 - DNA, 834 bp, Homo sapiens
ccaggagcagcatctccaccagcaagctgggctgctgggtgggtacttccttcaaagctgagggagcgtcctacgcccacgcgcgcaggagggcgccccccgcaaagcaacgtctaggagaccacagtggatgccacagcgggcccgaagcggatcagccttgtgggatggcagatgatcagggctgtattgaagagcagggggttgaggattcagcaaatgaagattcagtggatgctaagccagaccggtcctcgtttgtaccgtccctcttcagtaagaagaagaaaaatgtcaccatgcgatccatcaagaccacccgggaccgagtgcctacatatcagtacaacatgaattttgaaaagctgggcaaatgcatcataataaacaacaagaactttgataaagtgacaggtatgggcgttcgaaacggaacagacaaagatgccgaggcgctcttcaagtgcttccgaagcctgggttttgacgtgattgtctataatgactgctcttgtgccaagatgcaagatctgcttaaaaaagcttctgaagaggaccatacaaatgccgcctgcttcgcctgcatcctcttaagccatggagaagaaaatgtaatttatgggaaagatggtgtcacaccaataaaggatttgacagcccactttaggggggatagatgcaaaacccttttagagaaacccaaactcttcttcattcaggcttgccgagggaccgagcttgatgatggcatccaggccgactcggggcccatcaatgacacagatgctaatcctcgatacaagatcccagtggaagctgacttcctcttcgcct

SEQ ID NO: 372 - DNA, 2229 bp, Homo sapiens
aaaggggccccagacccttgctgcggagcgacggagagagactgtgccagtcccagccgccctaccgccgtgggaacgatggcagatgatcagggctgtattgaagagcagggggttgaggattcagcaaatgaagattcagtggatgctaagccagaccggtcctcgtttgtaccgtccctcttcagtaagaagaagaaaaatgtcaccatgcgatccatcaagaccacccgggaccgagtgcctacatatcagtacaacatgaattttgaaaagctgggcaaatgcatcataataaacaacaagaactttgataaagtgacaggtatgggcgttcgaaacggaacagacaaagatgccgaggcgctcttcaagtgcttccgaagcctgggttttgacgtgattgtctataatgactgctcttgtgccaagatgcaagatctgcttaaaaaagcttctgaagaggaccatacaaatgccgcctgcttcgcctgcatcctcttcttcattcaggcttgccgagggaccgagcttgatgatggcatccaggccgactcggggcccatcaatgacacagatgctaatcctcgatacaagatcccagtggaagctgacttcctcttcgcctattccacggttccaggctattactcgtggaggagcccaggaagaggctcctggtttgtgcaagccctctgctccatcctggaggagcacggaaaagacctggaaatcatgcagatcctcaccagggtgaatgacagagttgccaggcactttgagtctcagtctgatgacccacacttccatgagaagaagcagatcccctgtgtggtctccatgctcaccaaggaactctacttcagtcaatagccatatcaggggtacattctagctgagaagcaatgggtcactcattaatgaatcacatttttttatgctcttgaaatattcagaaattctccaggattttaatttcaggaaaatgtattgattcaacagggaagaaactttctggtgctgtcttttgttctctgaattttcagagactttttttataatgttattcatttggtgactgtgtaactttctcttaagattaattttctctttgtatgtctgttaccttgttaatagacttaatacatgcaacagaagtgacttctggagaaagctcatggctgtgtccactgcaattggtggtaacagtggtagagtcatgtttgcacttggcaaaaagaatcccaatgtttgacaaaacacagccaaggggatatttactgctctttattgcagaatgtgggtattgagtgtgatttgaatgatttttcattggcttagggcagattttcatgcaaaagttctcatatgagttagaggagaaaaagcttaatgattctgatatgtatccatcaggatccagtctggaaaacagaaaccattctaggtgtttcaacagagggagtttaatacaggaaattgacttacatagatgataaaagagaagccaaacagcaagaagctgttaccacacccagggctatgaggataatgggaagaggtttggtttcctgtgtccagtagtgggatcatccagaggagctggaaccatggtgggggctgcctagtgggagttaggaccaccaatggattgtggaaaatggagccatgacaagaacaaagccactgactgagatggagtgagctgagacagataagagaataccttggtctcacctatcctgccctcacatcttccaccagcaccttactgcccaggcctatctggaagccacctcaccaaggaccttggaagagcaagggacagtgaggcaggagaagaacaagaaatggatgtaagcctggcccataatgtgaacataagtaatcactaatgctcaacaatttatccattcaatcatttattcattgggttgtcagatagtctatgtatgtgtaaaacaatctgttttggctttatgtgcaaaatctgttatagctttaaaatatatctggaactttttagattattccaagccttattttgagtaaatatttgttacttttagttctataagtgaggaagagtttatggcaaagatttttggcactttgttttcaagatggtgttatcttttgaattcttgataaatgactgtttttttctgcctaatagtaactggttaaaaaacaaatgttcatatttattgattaaaaatgtggttgctt

SEQ ID NO: 373 - DNA, 1148 bp, Homo sapiens
tgtcgtcgcagagcacagcctagttctgatgcagaggggactgttttcagatggagacactagtaagaagaagaaaaatgtcaccatgcgatccatcaagaccacccgggaccgagtgcctacatatcagtacaacatgaattttgaaaagctgggcaaatgcatcataataaacaacaagaactttgataaagtgacaggtatgggcgttcgaaacggaacagacaaagatgccgaggcgctcttcaagtgcttccgaagcctgggttttgacgtgattgtctataatgactgctcttgtgccaagatgcaagatctgcttaaaaaagcttctgaagaggaccatacaaatgccgcctgcttcgcctgcatcctcttaagccatggagaagaaaatgtaatttatgggaaagatggtgtcacaccaataaaggatttgacagcccactttaggggggatagatgcaaaacccttttagagaaacccaaactcttcttcattcaggcttgccgagggaccgagcttgatgatggcatccaggccgactcggggcccatcaatgacacagatgctaatcctcgatacaagatcccagtggaagctgacttcctcttcgcctattccacggttccaggctattactcgtggaggagcccaggaagaggctcctggtttgtgcaagccctctgctccatcctggaggagcacggaaaagacctggaaatcatgcagatcctcaccagggtgaatgacagagttgccaggcactttgagtctcagtctgatgacccacacttccatgagaagaagcagatcccctgtgtggtctccatgctcaccaaggaactctacttcagtcaatagccatatcaggggtacattctagctgagaagcaatgggtcactcattaatgaatcacatttttttatgctcttgaaatattcagaaattctccaggattttaatttcaggaaaatgtattgattcaacagggaagaaactttctggtgctgtcttttgttctctgaattttcagagactttttttataatgttattcatttggtgactgtgtaactttctcttaagattaattttctctttgtatgtctgttaccttgttaatagacttaatacatgcaacaga

SEQ ID NO: 374 - DNA, 2540 bp, Homo sapiens
gtgctctgagtttttggtttctgtttcaccttgtgtctgagctggtctgaaggctggttgttcagactgagcttcctgcctgcctgtaccccgccaacagcttcagaagaaggagcagcccctgggtgcgtccactttctgggcacgtgaggttgggccttggccgcctgagcccttgagttggtcacttgaaccttgggaatattgagattatattctcctgccttttaaaaagatggacttcagcagaaatctttatgatattggggaacaactggacagtgaagatctggcctccctcaagttcctgagcctggactacattccgcaaaggaagcaagaacccatcaaggatgccttgatgttattccagagactccaggaaaagagaatgttggaggaaagcaatctgtccttcctgaaggagctgctcttccgaattaatagactggatttgctgattacctacctaaacactagaaaggaggagatggaaagggaacttcagacaccaggcagggctcaaatttctgcctacagggtcatgctctatcagatttcagaagaagtgagcagatcagaattgaggtcttttaagtttcttttgcaagaggaaatctccaaatgcaaactggatgatgacatgaacctgctggatattttcatagagatggagaagagggtcatcctgggagaaggaaagttggacatcctgaaaagagtctgtgcccaaatcaacaagagcctgctgaagataatcaacgactatgaagaattcagcaaaggggctttgaccacgacctttgaagagcttcattttgagatcaagccccacgatgactgcacagtagagcaaatctatgagattttgaaaatctaccaactcatggaccacagtaacatggactgcttcatctgctgtatcctctcccatggagacaagggcatcatctatggcactgatggacaggaggcccccatctatgagctgacatctcagttcactggtttgaagtgcccttcccttgctggaaaacccaaagtgttttttattcaggcttgtcagggggataactaccagaaaggtatacctgttgagactgattcagaggagcaaccctatttagaaatggatttatcatcacctcaaacgagatatatcccggatgaggctgactttctgctggggatggccactgtgaataactgtgtttcctaccgaaaccctgcagagggaacctggtacatccagtcactttgccagagcctgagagagcgatgtcctcgaggcgatgatattctcaccatcctgactgaagtgaactatgaagtaagcaacaaggatgacaagaaaaacatggggaaacagatgcctcagcctactttcacactaagaaaaaaacttgtcttcccttctgattgatggtgctattttgtttgttttgttttgttttgtttttttgagacagaatctcgctctgtcgcccaggctggagtgcagtggcgtgatctcggctcaccgcaagctccgcctcccgggttcaggccattctcctgcctcagcctcccgagtagctgggactacaggggcccgccaccacacctggctaattttttaaaaatatttttagtagagacagggtttcactgtgttagccagggtggtcttgatctcctgacctcgtgatccacccacctcggcctcccaaagtgctgggattacaggcgtgagccaccgcgcctggccgatggtactatttagatataacactatgtttatttactaattttctagattttctactttattaattgttttgcacttttttataagagctaaagttaaataggatattaacaacaataacactgtctcctttctcttatgcttaaggctttgggaatgtttttagctggtggcaataaataccagacacgtacaaaatccagctatgaatatagagggcttatgattcagattgttatctatcaactataagcccactgttaatattctattaactttaattctctttcaaagctaaattccacactaccacattaaaaaaattagaaagtagccacgtatggtggctcatgtctataatcccagcactttgggaggttgaggtgggaggattgcttgaacccaagaggtcaaggctgcagtgagccatgttcacaccgctgcactcaagcttgggtgacagaacaagaccccgtctcaaaaaaaattttttttttaataaaacaaaatttgtttgaaatcttttaaaaattcaaatgatttttacaagttttaaataagctctccccaaacttgctttatgccttcttattgcttttatgatatatatatgcttggctaactatatttgctttttgctaacaatgctctggggtctttttatgcatttgcatttgctctttcatctctgcttggattattttaaatcattaggaattaagttatctttaaaatttaagtatcttttttcaaaaacattttttaatagaataaaatataatttgatcttatt

SEQ ID NO: 375 - DNA, 1906 bp, Homo sapiens
tttcaccttgtgtctgagctggtctgaaggctggttgttcagactgagcttcctgcctgcctgtaccccgccaacagcttcagaagaaggtgactggtggctgcctgaggaataccagtgggcaagagaattagcatttctggagcatctgctgtctgagcagcccctgggtgcgtccactttctgggcacgtgaggttgggccttggccgcctgagcccttgagttggtcacttgaaccttgggaatattgagattatattctcctgccttttaaaaagatggacttcagcagaaatctttatgatattggggaacaactggacagtgaagatctggcctccctcaagttcctgagcctggactacattccgcaaaggaagcaagaacccatcaaggatgccttgatgttattccagagactccaggaaaagagaatgttggaggaaagcaatctgtccttcctgaaggagctgctcttccgaattaatagactggatttgctgattacctacctaaacactagaaaggaggagatggaaagggaacttcagacaccaggcagggctcaaatttctgcctacaggttccacttctgccgcatgagctgggctgaagcaaacagccagtgccagacacagtctgtacctttctggcggagggtcgatcatctattaataagggtcatgctctatcagatttcagaagaagtgagcagatcagaattgaggtcttttaagtttcttttgcaagaggaaatctccaaatgcaaactggatgatgacatgaacctgctggatattttcatagagatggagaagagggtcatcctgggagaaggaaagttggacatcctgaaaagagtctgtgcccaaatcaacaagagcctgctgaagataatcaacgactatgaagaattcagcaaaggggaggagttgtgtggggtaatgacaatctcggactctccaagagaacaggatagtgaatcacagactttggacaaagtttaccaaatgaaaagcaaacctcggggatactgtctgatcatcaacaatcacaattttgcaaaagcacgggagaaagtgcccaaacttcacagcattagggacaggaatggaacacacttggatgcaggggctttgaccacgacctttgaagagcttcattttgagatcaagccccacgatgactgcacagtagagcaaatctatgagattttgaaaatctaccaactcatggaccacagtaacatggactgcttcatctgctgtatcctctcccatggagacaagggcatcatctatggcactgatggacaggaggcccccatctatgagctgacatctcagttcactggtttgaagtgcccttcccttgctggaaaacccaaagtgttttttattcaggcttgtcagggggataactaccagaaaggtatacctgttgagactgattcagaggagcaaccctatttagaaatggatttatcatcacctcaaacgagatatatcccggatgaggctgactttctgctggggatggccactgtgaataactgtgtttcctaccgaaaccctgcagagggaacctggtacatccagtcactttgccagagcctgagagagcgatgtcctcgaggcgatgatattctcaccatcctgactgaagtgaactatgaagtaagcaacaaggatgacaagaaaaacatggggaaacagatgcctcagcctactttcacactaagaaaaaaacttgtcttcccttctgattgatggtgctattttgtttgttttgttttgttttgtttttttgagacagaatctcgctctgtcgcccaggctggagtgcagtggcgtgatctcggctcaccgcaagctccgcctcccgggttcaggccattctcctgc

SEQ ID NO: 376 - DNA, 2650 bp, Homo sapiens
gtagagctggctggctgtgcccttccgtccttcattagacgtttgctcttgtcttagatgctcagatggtagtggataggcctgtgacgaaggtgctaccatcgtgagagtaagattatattctcctgccttttaaaaagatggacttcagcagaaatctttatgatattggggaacaactggacagtgaagatctggcctccctcaagttcctgagcctggactacattccgcaaaggaagcaagaacccatcaaggatgccttgatgttattccagagactccaggaaaagagaatgttggaggaaagcaatctgtccttcctgaaggagctgctcttccgaattaatagactggatttgctgattacctacctaaacactagaaaggaggagatggaaagggaacttcagacaccaggcagggctcaaatttctgcctacagggtcatgctctatcagatttcagaagaagtgagcagatcagaattgaggtcttttaagtttcttttgcaagaggaaatctccaaatgcaaactggatgatgacatgaacctgctggatattttcatagagatggagaagagggtcatcctgggagaaggaaagttggacatcctgaaaagagtctgtgcccaaatcaacaagagcctgctgaagataatcaacgactatgaagaattcagcaaaggggaggagttgtgtggggtaatgacaatctcggactctccaagagaacaggatagtgaatcacagactttggacaaagtttaccaaatgaaaagcaaacctcggggatactgtctgatcatcaacaatcacaattttgcaaaagcacgggagaaagtgcccaaacttcacagcattagggacaggaatggaacacacttggatgcaggggctttgaccacgacctttgaagagcttcattttgagatcaagccccacgatgactgcacagtagagcaaatctatgagattttgaaaatctaccaactcatggaccacagtaacatggactgcttcatctgctgtatcctctcccatggagacaagggcatcatctatggcactgatggacaggaggcccccatctatgagctgacatctcagttcactggtttgaagtgcccttcccttgctggaaaacccaaagtgttttttattcaggcttgtcagggggataactaccagaaaggtatacctgttgagactgattcagaggagcaaccctatttagaaatggatttatcatcacctcaaacgagatatatcccggatgaggctgactttctgctggggatggccactgtgaataactgtgtttcctaccgaaaccctgcagagggaacctggtacatccagtcactttgccagagcctgagagagcgatgtcctcgaggcgatgatattctcaccatcctgactgaagtgaactatgaagtaagcaacaaggatgacaagaaaaacatggggaaacagatgcctcagcctactttcacactaagaaaaaaacttgtcttcccttctgattgatggtgctattttgtttgttttgttttgttttgtttttttgagacagaatctcgctctgtcgcccaggctggagtgcagtggcgtgatctcggctcaccgcaagctccgcctcccgggttcaggccattctcctgcctcagcctcccgagtagctgggactacaggggcccgccaccacacctggctaattttttaaaaatatttttagtagagacagggtttcactgtgttagccagggtggtcttgatctcctgacctcgtgatccacccacctcggcctcccaaagtgctgggattacaggcgtgagccaccgcgcctggccgatggtactatttagatataacactatgtttatttactaattttctagattttctactttattaattgttttgcacttttttataagagctaaagttaaataggatattaacaacaataacactgtctcctttctcttatgcttaaggctttgggaatgtttttagctggtggcaataaataccagacacgtacaaaatccagctatgaatatagagggcttatgattcagattgttatctatcaactataagcccactgttaatattctattaactttaattctctttcaaagctaaattccacactaccacattaaaaaaattagaaagtagccacgtatggtggctcatgtctataatcccagcactttgggaggttgaggtgggaggattgcttgaacccaagaggtcaaggctgcagtgagccatgttcacaccgctgcactcaagcttgggtgacagaacaagaccccgtctcaaaaaaaattttttttttaataaaacaaaatttgtttgaaatcttttaaaaattcaaatgatttttacaagttttaaataagctctccccaaacttgctttatgccttcttattgcttttatgatatatatatgcttggctaactatatttgctttttgctaacaatgctctggggtctttttatgcatttgcatttgctctttcatctctgcttggattattttaaatcattaggaattaagttatctttaaaatttaagtatcttttttcaaaaacattttttaatagaataaaatataatttgatctta

SEQ ID NO: 377 - DNA, 2930 bp, Homo sapiens
agtcatctctgttctgctttaggagtaaagtttaccctgcagttccttctgtggtgaagttttctctttctctcggagaccagattctgcctttctgctggagggaagtgttttcacaggttctcctccttttatcttttgtgttttttttcaagccctgctgaatttgctagtcaactcaacaggaagtgaggccatggagggaggcagaagagccagggtggttattgaaagtaaaagaaacttcttcctgggagcctttcccacccccttccctgctgagcacgtggagttaggcaggttaggggactcggagactgcgatggtgccaggaaagggtggagcggattatattctcctgccttttaaaaagatggacttcagcagaaatctttatgatattggggaacaactggacagtgaagatctggcctccctcaagttcctgagcctggactacattccgcaaaggaagcaagaacccatcaaggatgccttgatgttattccagagactccaggaaaagagaatgttggaggaaagcaatctgtccttcctgaaggagctgctcttccgaattaatagactggatttgctgattacctacctaaacactagaaaggaggagatggaaagggaacttcagacaccaggcagggctcaaatttctgcctacagggtcatgctctatcagatttcagaagaagtgagcagatcagaattgaggtcttttaagtttcttttgcaagaggaaatctccaaatgcaaactggatgatgacatgaacctgctggatattttcatagagatggagaagagggtcatcctgggagaaggaaagttggacatcctgaaaagagtctgtgcccaaatcaacaagagcctgctgaagataatcaacgactatgaagaattcagcaaagagagaagcagcagccttgaaggaagtcctgatgaattttcaaatggggaggagttgtgtggggtaatgacaatctcggactctccaagagaacaggatagtgaatcacagactttggacaaagtttaccaaatgaaaagcaaacctcggggatactgtctgatcatcaacaatcacaattttgcaaaagcacgggagaaagtgcccaaacttcacagcattagggacaggaatggaacacacttggatgcaggggctttgaccacgacctttgaagagcttcattttgagatcaagccccacgatgactgcacagtagagcaaatctatgagattttgaaaatctaccaactcatggaccacagtaacatggactgcttcatctgctgtatcctctcccatggagacaagggcatcatctatggcactgatggacaggaggcccccatctatgagctgacatctcagttcactggtttgaagtgcccttcccttgctggaaaacccaaagtgttttttattcaggcttgtcagggggataactaccagaaaggtatacctgttgagactgattcagaggagcaaccctatttagaaatggatttatcatcacctcaaacgagatatatcccggatgaggctgactttctgctggggatggccactgtgaataactgtgtttcctaccgaaaccctgcagagggaacctggtacatccagtcactttgccagagcctgagagagcgatgtcctcgaggcgatgatattctcaccatcctgactgaagtgaactatgaagtaagcaacaaggatgacaagaaaaacatggggaaacagatgcctcagcctactttcacactaagaaaaaaacttgtcttcccttctgattgatggtgctattttgtttgttttgttttgttttgtttttttgagacagaatctcgctctgtcgcccaggctggagtgcagtggcgtgatctcggctcaccgcaagctccgcctcccgggttcaggccattctcctgcctcagcctcccgagtagctgggactacaggggcccgccaccacacctggctaattttttaaaaatatttttagtagagacagggtttcactgtgttagccagggtggtcttgatctcctgacctcgtgatccacccacctcggcctcccaaagtgctgggattacaggcgtgagccaccgcgcctggccgatggtactatttagatataacactatgtttatttactaattttctagattttctactttattaattgttttgcacttttttataagagctaaagttaaataggatattaacaacaataacactgtctcctttctcttatgcttaaggctttgggaatgtttttagctggtggcaataaataccagacacgtacaaaatccagctatgaatatagagggcttatgattcagattgttatctatcaactataagcccactgttaatattctattaactttaattctctttcaaagctaaattccacactaccacattaaaaaaattagaaagtagccacgtatggtggctcatgtctataatcccagcactttgggaggttgaggtgggaggattgcttgaacccaagaggtcaaggctgcagtgagccatgttcacaccgctgcactcaagcttgggtgacagaacaagaccccgtctcaaaaaaaattttttttttaataaaacaaaatttgtttgaaatcttttaaaaattcaaatgatttttacaagttttaaataagctctccccaaacttgctttatgccttcttattgcttttatgatatatatatgcttggctaactatatttgctttttgctaacaatgctctggggtctttttatgcatttgcatttgctctttcatctctgcttggattattttaaatcattaggaattaagttatctttaaaatttaagtatcttttttcaaaaacattttttaatagaataaaatataatttgatcttatt

SEQ ID NO: 378 - DNA, 1060 bp, Homo sapiens
agactgagcttcctgcctgcctgtaccccgccaacagcttcagaagaaggtgactggtggctgcctgaggaataccagtgggcaagagaattagcatttctggagcatctgctgtctgagcagcccctgggtgcgtccactttctgggcacgtgaggttgggccttggccgcctgagcccttgagttggtcacttgaaccttgggaatattgagattatattctcctgccttttaaaaagatggacttcagcagaaatctttatgatattggggaacaactggacagtgaagatctggcctccctcaagttcctgagcctggactacattccgcaaaggaagcaagaacccatcaaggatgccttgatgttattccagagactccaggaaaagagaatgttggaggaaagcaatctgtccttcctgaaggagctgctcttccgaattaatagactggatttgctgattacctacctaaacactagaaaggaggagatggaaagggaacttcagacaccaggcagggctcaaatttctgcctacagggtcatgctctatcagatttcagaagaagtgagcagatcagaattgaggtcttttaagtttcttttgcaagaggaaatctccaaatgcaaactggatgatgacatgaacctgctggatattttcatagagatggagaagagggtcatcctgggagaaggaaagttggacatcctgaaaagagtctgtgcccaaatcaacaagagcctgctgaagataatcaacgactatgaagaattcagcaaagagagaagcagcagccttgaaggaagtcctgatgaattttcaaatgactttggacaaagtttaccaaatgaaaagcaaacctcggggatactgtctgatcatcaacaatcacaattttgcaaaagcacgggagaaagtgcccaaacttcacagcattagggacaggaatggaacacacttggatgcagggtttgagaatgtttttagctggtggcaataaatattagaagcctgcagaatccagctacgaatatagagggttttgctcttg

SEQ ID NO: 379 - DNA, 2727 bp, Homo sapiens
gtgctctgagtttttggtttctgtttcaccttgtgtctgagctggtctgaaggctggttgttcagactgagcttcctgcctgcctgtaccccgccaacagcttcagaagaaggagcagcccctgggtgcgtccactttctgggcacgtgaggttgggccttggccgcctgagcccttgagttggtcacttgaaccttgggaatattgagattatattctcctgccttttaaaaagatggacttcagcagaaatctttatgatattggggaacaactggacagtgaagatctggcctccctcaagttcctgagcctggactacattccgcaaaggaagcaagaacccatcaaggatgccttgatgttattccagagactccaggaaaagagaatgttggaggaaagcaatctgtccttcctgaaggagctgctcttccgaattaatagactggatttgctgattacctacctaaacactagaaaggaggagatggaaagggaacttcagacaccaggcagggctcaaatttctgcctacagggtcatgctctatcagatttcagaagaagtgagcagatcagaattgaggtcttttaagtttcttttgcaagaggaaatctccaaatgcaaactggatgatgacatgaacctgctggatattttcatagagatggagaagagggtcatcctgggagaaggaaagttggacatcctgaaaagagtctgtgcccaaatcaacaagagcctgctgaagataatcaacgactatgaagaattcagcaaagagagaagcagcagccttgaaggaagtcctgatgaattttcaaatgactttggacaaagtttaccaaatgaaaagcaaacctcggggatactgtctgatcatcaacaatcacaattttgcaaaagcacgggagaaagtgcccaaacttcacagcattagggacaggaatggaacacacttggatgcaggggctttgaccacgacctttgaagagcttcattttgagatcaagccccacgatgactgcacagtagagcaaatctatgagattttgaaaatctaccaactcatggaccacagtaacatggactgcttcatctgctgtatcctctcccatggagacaagggcatcatctatggcactgatggacaggaggcccccatctatgagctgacatctcagttcactggtttgaagtgcccttcccttgctggaaaacccaaagtgttttttattcaggcttgtcagggggataactaccagaaaggtatacctgttgagactgattcagaggagcaaccctatttagaaatggatttatcatcacctcaaacgagatatatcccggatgaggctgactttctgctggggatggccactgtgaataactgtgtttcctaccgaaaccctgcagagggaacctggtacatccagtcactttgccagagcctgagagagcgatgtcctcgaggcgatgatattctcaccatcctgactgaagtgaactatgaagtaagcaacaaggatgacaagaaaaacatggggaaacagatgcctcagcctactttcacactaagaaaaaaacttgtcttcccttctgattgatggtgctattttgtttgttttgttttgttttgtttttttgagacagaatctcgctctgtcgcccaggctggagtgcagtggcgtgatctcggctcaccgcaagctccgcctcccgggttcaggccattctcctgcctcagcctcccgagtagctgggactacaggggcccgccaccacacctggctaattttttaaaaatatttttagtagagacagggtttcactgtgttagccagggtggtcttgatctcctgacctcgtgatccacccacctcggcctcccaaagtgctgggattacaggcgtgagccaccgcgcctggccgatggtactatttagatataacactatgtttatttactaattttctagattttctactttattaattgttttgcacttttttataagagctaaagttaaataggatattaacaacaataacactgtctcctttctcttatgcttaaggctttgggaatgtttttagctggtggcaataaataccagacacgtacaaaatccagctatgaatatagagggcttatgattcagattgttatctatcaactataagcccactgttaatattctattaactttaattctctttcaaagctaaattccacactaccacattaaaaaaattagaaagtagccacgtatggtggctcatgtctataatcccagcactttgggaggttgaggtgggaggattgcttgaacccaagaggtcaaggctgcagtgagccatgttcacaccgctgcactcaagcttgggtgacagaacaagaccccgtctcaaaaaaaattttttttttaataaaacaaaatttgtttgaaatcttttaaaaattcaaatgatttttacaagttttaaataagctctccccaaacttgctttatgccttcttattgcttttatgatatatatatgcttggctaactatatttgctttttgctaacaatgctctggggtctttttatgcatttgcatttgctctttcatctctgcttggattattttaaatcattaggaattaagttatctttaaaatttaagtatcttttttcaaaaacattttttaatagaataaaatataatttgatcttatt

SEQ ID NO: 380 - DNA, 1283 bp, Homo sapiens
gaagttttctctttctctcggagaccagattctgcctttctgctggagggaagtgttttcacagattatattctcctgccttttaaaaagatggacttcagcagaaatctttatgatattggggaacaactggacagtgaagatctggcctccctcaagttcctgagcctggactacattccgcaaaggaagcaagaacccatcaaggatgccttgatgttattccagagactccaggaaaagagaatgttggaggaaagcaatctgtccttcctgaaggagctgctcttccgaattaatagactggatttgctgattacctacctaaacactagaaaggaggagatggaaagggaacttcagacaccaggcagggctcaaatttctgcctacagggtcatgctctatcagatttcagaagaagtgagcagatcagaattgaggtcttttaagtttcttttgcaagaggaaatctccaaatgcaaactggatgatgacatgaacctgctggatattttcatagagatggagaagagggtcatcctgggagaaggaaagttggacatcctgaaaagagtctgtgcccaaatcaacaagagcctgctgaagataatcaacgactatgaagaattcagcaaaggggaggagttgtgtggggtaatgacaatctcggactctccaagagaacaggatagtgaatcacagactttggacaaagtttaccaaatgaaaagcaaacctcggggatactgtctgatcatcaacaatcacaattttgcaaaagcacgggagaaagtgcccaaacttcacagcattagggacaggaatggaacacacttggatgcagggtctcactctgttgcccaggctggagtgcagtggtgtgatctcagctcactgcagcctccacctccctggttcaagtgattctcctgcctcagcctcccaagtagctgggactacaggcacacaccaccacacatggctaatttttgtatttttagtagagatggggttttgccatattggccaggctggtcttgaactcctgacctcaagtgatccgcctgcctcggcctcccaaagtgctggaattacaggtgtcagccacctgtacctggtccctgctaacatttgatttgtttatttaagcaaatctaagcctttaaaaaggcacagagattaagtccattgattacatcattcgtcactatgcgcttggtattgaaaaaaatattttggacccttgatttgtattcttttaaaattaaaacatttctatt

SEQ ID NO: 381 - DNA, 1627 bp, Homo sapiens
gtgctctgagtttttggtttctgtttcaccttgtgtctgagctggtctgaaggctggttgttcagactgagcttcctgcctgcctgtaccccgccaacagcttcagaagaaggagcagcccctgggtgcgtccactttctgggcacgtgaggttgggccttggccgcctgagcccttgagttggtcacttgaaccttgggaatattgagattatattctcctgccttttaaaaagatggacttcagcagaaatctttatgatattggggaacaactggacagtgaagatctggcctccctcaagttcctgagcctggactacattccgcaaaggaagcaagaacccatcaaggatgccttgatgttattccagagactccaggaaaagagaatgttggaggaaagcaatctgtccttcctgaaggagctgctcttccgaattaatagactggatttgctgattacctacctaaacactagaaaggaggagatggaaagggaacttcagacaccaggcagggctcaaatttctgcctacagggtcatgctctatcagatttcagaagaagtgagcagatcagaattgaggtcttttaagtttcttttgcaagaggaaatctccaaatgcaaactggatgatgacatgaacctgctggatattttcatagagatggagaagagggtcatcctgggagaaggaaagttggacatcctgaaaagagtctgtgcccaaatcaacaagagcctgctgaagataatcaacgactatgaagaattcagcaaaggggaggagttgtgtggggtaatgacaatctcggactctccaagagaacaggatagtgaatcacagactttggacaaagtttaccaaatgaaaagcaaacctcggggatactgtctgatcatcaacaatcacaattttgcaaaagcacgggagaaagtgcccaaacttcacagcattagggacaggaatggaacacacttggatgcaggggctttgaccacgacctttgaagagcttcattttgagatcaagccccacgatgactgcacagtagagcaaatctatgagattttgaaaatctaccaactcatggaccacagtaacatggactgcttcatctgctgtatcctctcccatggagacaagggcatcatctatggcactgatggacaggaggcccccatctatgagctgacatctcagttcactggtttgaagtgcccttcccttgctggaaaacccaaagtgttttttattcaggcttgtcagggggataactaccagaaaggtatacctgttgagactgattcagaggagcaaccctatttagaaatggatttatcatcacctcaaacgagatatatcccggatgaggctgactttctgctggggatggccactgtgaataactgtgtttcctaccgaaaccctgcagagggaacctggtacatccagtcactttgccagagcctgagagagcgatgtcctcgaggcgatgatattctcaccatcctgactgaagtgaactatgaagtaagcaacaaggatgacaagaaaaacatggggaaacagatgcctcagcctactttcacactaagaaaaaaacttgtcttcccttctgat

SEQ ID NO: 382 - DNA, 2682 bp, Homo sapiens
gtgctctgagtttttggtttctgtttcaccttgtgtctgagctggtctgaaggctggttgttcagactgagcttcctgcctgcctgtaccccgccaacagcttcagaagaaggagcagcccctgggtgcgtccactttctgggcacgtgaggttgggccttggccgcctgagcccttgagttggtcacttgaaccttgggaatattgagattatattctcctgccttttaaaaagatggacttcagcagaaatctttatgatattggggaacaactggacagtgaagatctggcctccctcaagttcctgagcctggactacattccgcaaaggaagcaagaacccatcaaggatgccttgatgttattccagagactccaggaaaagagaatgttggaggaaagcaatctgtccttcctgaaggagctgctcttccgaattaatagactggatttgctgattacctacctaaacactagaaaggaggagatggaaagggaacttcagacaccaggcagggctcaaatttctgcctacagggtcatgctctatcagatttcagaagaagtgagcagatcagaattgaggtcttttaagtttcttttgcaagaggaaatctccaaatgcaaactggatgatgacatgaacctgctggatattttcatagagatggagaagagggtcatcctgggagaaggaaagttggacatcctgaaaagagtctgtgcccaaatcaacaagagcctgctgaagataatcaacgactatgaagaattcagcaaagactttggacaaagtttaccaaatgaaaagcaaacctcggggatactgtctgatcatcaacaatcacaattttgcaaaagcacgggagaaagtgcccaaacttcacagcattagggacaggaatggaacacacttggatgcaggggctttgaccacgacctttgaagagcttcattttgagatcaagccccacgatgactgcacagtagagcaaatctatgagattttgaaaatctaccaactcatggaccacagtaacatggactgcttcatctgctgtatcctctcccatggagacaagggcatcatctatggcactgatggacaggaggcccccatctatgagctgacatctcagttcactggtttgaagtgcccttcccttgctggaaaacccaaagtgttttttattcaggcttgtcagggggataactaccagaaaggtatacctgttgagactgattcagaggagcaaccctatttagaaatggatttatcatcacctcaaacgagatatatcccggatgaggctgactttctgctggggatggccactgtgaataactgtgtttcctaccgaaaccctgcagagggaacctggtacatccagtcactttgccagagcctgagagagcgatgtcctcgaggcgatgatattctcaccatcctgactgaagtgaactatgaagtaagcaacaaggatgacaagaaaaacatggggaaacagatgcctcagcctactttcacactaagaaaaaaacttgtcttcccttctgattgatggtgctattttgtttgttttgttttgttttgtttttttgagacagaatctcgctctgtcgcccaggctggagtgcagtggcgtgatctcggctcaccgcaagctccgcctcccgggttcaggccattctcctgcctcagcctcccgagtagctgggactacaggggcccgccaccacacctggctaattttttaaaaatatttttagtagagacagggtttcactgtgttagccagggtggtcttgatctcctgacctcgtgatccacccacctcggcctcccaaagtgctgggattacaggcgtgagccaccgcgcctggccgatggtactatttagatataacactatgtttatttactaattttctagattttctactttattaattgttttgcacttttttataagagctaaagttaaataggatattaacaacaataacactgtctcctttctcttatgcttaaggctttgggaatgtttttagctggtggcaataaataccagacacgtacaaaatccagctatgaatatagagggcttatgattcagattgttatctatcaactataagcccactgttaatattctattaactttaattctctttcaaagctaaattccacactaccacattaaaaaaattagaaagtagccacgtatggtggctcatgtctataatcccagcactttgggaggttgaggtgggaggattgcttgaacccaagaggtcaaggctgcagtgagccatgttcacaccgctgcactcaagcttgggtgacagaacaagaccccgtctcaaaaaaaattttttttttaataaaacaaaatttgtttgaaatcttttaaaaattcaaatgatttttacaagttttaaataagctctccccaaacttgctttatgccttcttattgcttttatgatatatatatgcttggctaactatatttgctttttgctaacaatgctctggggtctttttatgcatttgcatttgctctttcatctctgcttggattattttaaatcattaggaattaagttatctttaaaatttaagtatcttttttcaaaaacattttttaatagaataaaatataatttgatcttatt

SEQ ID NO: 383 - DNA, 658 bp, Homo sapiens
gattctgcctttctgctggagggaagtgttttcacagattatattctcctgccttttaaaaagatggacttcagcagaaatctttatgatattggggaacaactggacagtgaagatctggcctccctcaagttcctgagcctggactacattccgcaaaggaagcaagaacccatcaaggatgccttgatgttattccagagactccaggaaaagagaatgttggaggaaagcaatctgtccttcctgaaggagctgctcttccgaattaatagactggatttgctgattacctacctaaacactagaaaggaggagatggaaagggaacttcagacaccaggcagggctcaaatttctgcctacagggtcatgctctatcagatttcagaagaagtgagcagatcagaattgaggtcttttaagtttcttttgcaagaggaaatctccaaatgcaaactggatgatgacatgaacctgctggatattttcatagagatggagaagagggtcatcctgggagaaggaaagttggacatcctgaaaagagtctgtgcccaaatcaacaagagcctgctgaagataatcaacgactatgaagaattcagcaaagagagaagcagcagccttgaaggaagtcctgatgaattttcaaatg

SEQ ID NO: 384 - DNA, 717 bp, Homo sapiens
agattctagcacttcctttgtgaggctctaaccccctctcctatagtggatttgttaagaacttctgtttttgtggctttgttattataaaattttttgaaatgttgttctctaaaaaagttatgattttatgtttttcttcatgagattctttcactgccttccagctgcaagtagaatgacgtctaaatctttgtgatctgtcactgaagcccttgagtgagacacttaaatctggctgtggctctctctcttactagcttatttccaagccgtgatttttcacaacagaaaaatggggacagtaatagtagtttcttcagaggcttttagtgaaatgagattatattctcctgccttttaaaaagatggacttcagcagaaatctttatgatattggggaacaactggacagtgaagatctggcctccctcaagttcctgagcctggactacattccgcaaaggaagcaagaacccatcaaggatgccttgatgttattccagagactccaggaaaagagaatgttggaggaaagcaatctgtccttcctgaaggagctgctcttccgaattaatagactggatttgctgattacctacctaaacactagaaaggaggagatggaaagggaacttcagacaccaggcagggctcaaatttctgcctacagggtcatgctctatcagatttcagaagaagtgagcagatcagaat

SEQ ID NO: 385 - DNA, 1629 bp, Homo sapiens
ctgtttcaccttgtgtctgagctggtctgaaggctggttgttcagactgagcttcctgcctgcctgtaccccgccaacagcttcagaagaaggagcagcccctgggtgcgtccactttctgggcacgtgaggttgggccttggccgcctgagcccttgagttggtcacttgaaccttgggaatattgagatggacttcagcagaaatctttatgatattggggaacaactggacagtgaagatctggcctccctcaagttcctgagcctggactacattccgcaaaggaagcaagaacccatcaaggatgccttgatgttattccagagactccaggaaaagagaatgttggaggaaagcaatctgtccttcctgaaggagctgctcttccgaattaatagactggatttgctgattacctacctaaacactagaaaggaggagatggaaagggaacttcagacaccaggcagggctcaaatttctgcctacagggtcatgctctatcagatttcagaagaagtgagcagatcagaattgaggtcttttaagtttcttttgcaagaggaaatctccaaatgcaaactggatgatgacatgaacctgctggatattttcatagagatggagaagagggtcatcctgggagaaggaaagttggacatcctgaaaagagtctgtgcccaaatcaacaagagcctgctgaagataatcaacgactatgaagaattcagcaaagagagaagcagcagccttgaaggaagtcctgatgaattttcaaatggggaggagttgtgtggggtaatgacaatctcggactctccaagagaacaggatagtgaatcacagactttggacaaagtttaccaaatgaaaagcaaacctcggggatactgtctgatcatcaacaatcacaattttgcaaaagcacgggagaaagtgcccaaacttcacagcattagggacaggaatggaacacacttggatgcaggggctttgaccacgacctttgaagagcttcattttgagatcaagccccacgatgactgcacagtagagcaaatctatgagattttgaaaatctaccaactcatggaccacagtaacatggactgcttcatctgctgtatcctctcccatggagacaagggcatcatctatggcactgatggacaggaggcccccatctatgagctgacatctcagttcactggtttgaagtgcccttcccttgctggaaaacccaaagtgttttttattcaggcttgtcagggggataactaccagaaaggtatacctgttgagactgattcagaggagcaaccctatttagaaatggatttatcatcacctcaaacgagatatatcccggatgaggctgactttctgctggggatggccactgtgaataactgtgtttcctaccgaaaccctgcagagggaacctggtacatccagtcactttgccagagcctgagagagcgatgtcctcgaggcgatgatattctcaccatcctgactgaagtgaactatgaagtaagcaacaaggatgacaagaaaaacatggggaaacagatgcctcagcctactttcacactaagaaaaaaacttgtcttcccttctgattga

SEQ ID NO: 386 - DNA, 592 bp, Homo sapiens
gttcagactgagcttcctgcctgcctgtaccccgccaacagcttcagaagaaggtgactggtggctgcctgaggaataccagtgggcaagagaattagcatttctggagcatctgctgtctgagcagcccctgggtgcgtccactttctgggcacgtgaggttgggccttggccgcctgagcccttgagttggtcacttgaaccttgggaatattgagatggacttcagcagaaatctttatgatattggggaacaactggacagtgaagatctggcctccctcaagttcctgagcctggactacattccgcaaaggaagcaagaacccatcaaggatgccttgatgttattccagagactccaggaaaagagaatgttggaggaaagcaatctgtccttcctgaaggagctgctcttccgaattaatagactggatttgctgattacctacctaaacactagaaaggaggagatggaaagggaacttcagacaccaggcagggctcaaatttctgcctacagggtcatgctctatcagatttcagaagaagtgagcagatcagaattgaggtcttttaagtttcttttgca

SEQ ID NO: 387 - DNA, 707 bp, Homo sapiens
atggttggaaattgggcatctgttcctttaaacaggaaacatttcttgttcgaattatattctcctgccttttaaaaagatggacttcagcagaaatctttatgatattggggaacaactggacagtgaagatctggcctccctcaagttcctgagcctggactacattccgcaaaggaagcaagaacccatcaaggatgccttgatgttattccagagactccaggaaaagagaatgttggaggaaagcaatctgtccttcctgaaggagctgctcttccgaattaatagactggatttgctgattacctacctaaacactagaaaggaggagatggaaagggaacttcagacaccaggcagggctcaaatttctgcctacagggtcatgctctatcagatttcagaagaagtgagcagatcagaattgaggtcttttaagtttcttttgcaagaggaaatctccaaatgcaaactggatgatgacatgaacctgctggatattttcatagagatggagaagagggtcatcctgggagaaggaaagttggacatcctgaaaagagtctgtgcccaaatcaacaagagcctgctgaagataatcaacgactatgaagaattcagcaaagactttggacaaagtttaccaaatgaaaagcaaacctcggggatactgtctgatcatcaacaatcacaattttgcaaaa

SEQ ID NO: 388 - DNA, 2019 bp, Homo sapiens
ggccctggggcgggggcgggtcctggggactggggcgggcggccgaggcccggaagcggactgaggcggcctggagtcttagttggctactcgccatggacgaagcggatcggcggctcctgcggcggtgccggctgcggctggtggaagagctgcaggtggaccagctctgggacgccctgctgagccgcgagctgttcaggccccatatgatcgaggacatccagcgggcaggctctggatctcggcgggatcaggccaggcagctgatcatagatctggagactcgagggagtcaggctcttcctttgttcatctcctgcttagaggacacaggccaggacatgctggcttcgtttctgcgaactaacaggcaagcagcaaagttgtcgaagccaaccctagaaaaccttaccccagtggtgctcagaccagagattcgcaaaccagaggttctcagaccggaaacacccagaccagtggacattggttctggaggatttggtgatgtcggtgctcttgagagtttgaggggaaatgcagatttggcttacatcctgagcatggagccctgtggccactgcctcattatcaacaatgtgaacttctgccgtgagtccgggctccgcacccgcactggctccaacatcgactgtgagaagttgcggcgtcgcttctcctcgctgcatttcatggtggaggtgaagggcgacctgactgccaagaaaatggtgctggctttgctggagctggcgcagcaggaccacggtgctctggactgctgcgtggtggtcattctctctcacggctgtcaggccagccacctgcagttcccaggggctgtctacggcacagatggatgccctgtgtcggtcgagaagattgtgaacatcttcaatgggaccagctgccccagcctgggagggaagcccaagctctttttcatccaggcctgtggtggggagcagaaagaccatgggtttgaggtggcctccacttcccctgaagacgagtcccctggcagtaaccccgagccagatgccaccccgttccaggaaggtttgaggaccttcgaccagctggacgccatatctagtttgcccacacccagtgacatctttgtgtcctactctactttcccaggttttgtttcctggagggaccccaagagtggctcctggtacgttgagaccctggacgacatctttgagcagtgggctcactctgaagacctgcagtccctcctgcttagggtcgctaatgctgtttcggtgaaagggatttataaacagatgcctggttgctttaatttcctccggaaaaaacttttctttaaaacatcataaggccagggcccctcaccctgccttatcttgcaccccaaagctttcctgccccaggcctgaaagaggctgaggcctggactttcctgcaactcaaggactttgcagccggcacagggtctgctctttctctgccagtgacagacaggctcttagcagcttccagattgacgacaagtgctgaacagtggaggaagagggacagatgaatgccgtggattgcacgtggcctcttgagcagtggctggtccagggctagtgacttgtgtcccatgatccctgtgttgtctctagagcagggattaacctctgcactactgacatgtggggccaggtcaccctttgctgtgaggctgtcctgtacattgtgggatgttcagcactgtcccttgcctcaatgccagtaacgcgtcttcctgagtggtgccaaacaaaaaggttctcaggtgttgccaaatatgtcctggggtataaaactttcctcgcctgacaaccactggtctgtagggatttttggctacacacaaaccagtatcgctcatagatcagcaaaccggggcctactagagtctgaacagctgtaatctatgaattctaagtgaaattttaaaaattgttaatttttcctatattgcattaattttaaaaaataaatctgaggcaaatatggactctc

SEQ ID NO: 389 - DNA, 1621 bp, Homo sapiens
gtccggaggcggtggggagcgaagactgacccggggccgtgacgcgggggcaggccctggggcgggggcgggtcctggggactggggcgggcggccgaggcccggaagcggactgaggcggcctggagtcttagttggctactcgccatggacgaagcggatcggcggctcctgcggcggtgccggctgcggctggtggaagagctgcaggtggaccagctctgggacgccctgctgagccgcgagctgttcaggccccatatgatcgaggacatccagcgggcaggctctggatctcggcgggatcaggccaggcagctgatcatagatctggagactcgagggagtcaggctcttcctttgttcatctcctgcttagaggacacaggccaggacatgctggcttcgtttctgcgaactaacaggcaagcagcaaagttgtcgaagccaaccctagaaaaccttaccccagtggtgctcagaccagagattcgcaaaccagaggttctcagaccggaaacacccagaccagtggacattggttctggaggatttggtgatgtcgagcagaaagaccatgggtttgaggtggcctccacttcccctgaagacgagtcccctggcagtaaccccgagccagatgccaccccgttccaggaaggtttgaggaccttcgaccagctggacgccatatctagtttgcccacacccagtgacatctttgtgtcctactctactttcccaggttttgtttcctggagggaccccaagagtggctcctggtacgttgagaccctggacgacatctttgagcagtgggctcactctgaagacctgcagtccctcctgcttagggtcgctaatgctgtttcggtgaaagggatttataaacagatgcctggttgctttaatttcctccggaaaaaacttttctttaaaacatcataaggccagggcccctcaccctgccttatcttgcaccccaaagctttcctgccccaggcctgaaagaggctgaggcctggactttcctgcaactcaaggactttgcagccggcacagggtctgctctttctctgccagtgacagacaggctcttagcagcttccagattgacgacaagtgctgaacagtggaggaagagggacagatgaatgccgtggattgcacgtggcctcttgagcagtggctggtccagggctagtgacttgtgtcccatgatccctgtgttgtctctagagcagggattaacctctgcactactgacatgtggggccaggtcaccctttgctgtgaggctgtcctgtacattgtgggatgttcagcactgtcccttgcctcaatgccagtaacgcgtcttcctgagtggtgccaaacaaaaaggttctcaggtgttgccaaatatgtcctggggtataaaactttcctcgcctgacaaccactggtctgtagggatttttggctacacacaaaccagtatcgctcatagatcagcaaaccggggcctactagagtctgaacagctgtaatctatgaattctaagtgaaattttaaaaattgttaatttttcctatattgcattaattttaaaaaataaatctgaggcaaatatggactctc

SEQ ID NO: 390 - DNA, 1807 bp, Homo sapiens
ggccctggggcgggggcgggtcctggggactggggcgggcggccgaggcccggaagcggactgaggcggcctggagtcttagttggctactcgccatggacgaagcggatcggcggctcctgcggcggtgccggctgcggctggtggaagagctgcaggtggaccagctctgggacgccctgctgagccgcgagctgttcaggccccatatgatcgaggacatccagcgggcaggctctggatctcggcgggatcaggccaggcagctgatcatagatctggagactcgagggagtcaggctcttcctttgttcatctcctgcttagaggacacaggccaggacatgctggcttcgtttctgcgaactaacaggcaagcagcaaagttgtcgaagccaaccctagaaaaccttaccccagtggtgctcagaccagagattcgcaaaccagaggttctcagaccggaaacacccagaccagtggacattggttctggaggatttggtgatgtcggtgctcttgagagtttgaggggaaatgcagatttggcttacatcctgagcatggagccctgtggccactgcctcattatcaacaatgtgaacttctgccgtgagtccgggctccgcacccgcactggctccaacatcgactgtgagaagttgcggcgtcgcttctcctcgctgcatttcatggtggaggtgaagggcgacctgactgccaagaaaatggtgctggctttgctggagctggcgcagcaggaccacggtgctctggactgctgcgtggtggtcattctctctcacggctgtcaggccagccacctgcagttcccaggggctgtctacggcacagatggatgccctgtgtcggtcgagaagattgtgaacatcttcaatgggaccagctgccccagcctgggagggaagcccaagctctttttcatccaggcctgtggtgggggttttgtttcctggagggaccccaagagtggctcctggtacgttgagaccctggacgacatctttgagcagtgggctcactctgaagacctgcagtccctcctgcttagggtcgctaatgctgtttcggtgaaagggatttataaacagatgcctggttgctttaatttcctccggaaaaaacttttctttaaaacatcataaggccagggcccctcaccctgccttatcttgcaccccaaagctttcctgccccaggcctgaaagaggctgaggcctggactttcctgcaactcaaggactttgcagccggcacagggtctgctctttctctgccagtgacagacaggctcttagcagcttccagattgacgacaagtgctgaacagtggaggaagagggacagatgaatgccgtggattgcacgtggcctcttgagcagtggctggtccagggctagtgacttgtgtcccatgatccctgtgttgtctctagagcagggattaacctctgcactactgacatgtggggccaggtcaccctttgctgtgaggctgtcctgtacattgtgggatgttcagcactgtcccttgcctcaatgccagtaacgcgtcttcctgagtggtgccaaacaaaaaggttctcaggtgttgccaaatatgtcctggggtataaaactttcctcgcctgacaaccactggtctgtagggatttttggctacacacaaaccagtatcgctcatagatcagcaaaccggggcctactagagtctgaacagctgtaatctatgaattctaagtgaaattttaaaaattgttaatttttcctatattgcattaatttt

SEQ ID NO: 391 - DNA, 1351 bp, Homo sapiens
aattgaccctggggacagggcgaggcgcggaggcgtcctgaaggcgaggcggtgacgcaagagcgaatccttggggcggggcgaggcgttggagatgcgtcctgcgggcgggacggtaacgcgggggcggggcggtgacgtgagcgggcaggctctggatctcggcgggatcaggccaggcagctgatcatagatctggagactcgagggagtcaggctcttcctttgttcatctcctgcttagaggacacaggccaggacatgctggcttcgtttctgcgaactaacaggcaagcagcaaagttgtcgaagccaaccctagaaaaccttaccccagtggtgctcagaccagagattcgcaaaccagaggttctcagaccggaaacacccagaccagtggacattggttctggaggatttggtgatgtcggtgctcttgagagtttgaggggaaatgcagatttggcttacatcctgagcatggagccctgtggccactgcctcattatcaacaatgtgaacttctgccgtgagtccgggctccgcacccgcactggctccaacatcgactgtgagaagttgcggcgtcgcttctcctcgctgcatttcatggtggaggtgaagggcgacctgactgccaagaaaatggtgctggctttgctggagctggcgcagcaggaccacggtgctctggactgctgcgtggtggtcattctctctcacggctgtcaggccagccacctgcagttcccaggggctgtctacggcacagatggatgccctgtgtcggtcgagaagattgtgaacatcttcaatgggaccagctgccccagcctgggagggaagcccaagctctttttcatccaggcctgtggtggggagcagaaagaccatgggtttgaggtggcctccacttcccctgaagacgagtcccctggcagtaaccccgagccagatgccaccccgttccaggaaggtttgaggaccttcgaccagctggacgccatatctagtttgcccacacccagtgacatctttgtgtcctactctactttcccaggttttgtttcctggagggaccccaagagtggctcctggtacgttgagaccctggacgacatctttgagcagtgggctcactctgaagacctgcagtccctcctgcttagggtcgctaatgctgtttcggtgaaagggatttataaacagatgcctggttgctttaatttcctccggaaaaaacttttctttaaaacatcataaggccagggcccctcaccctgccttatcttgcaccccaaagctttcctgccccaggcctgaaagaggctgaggcctggactttcctgca

SEQ ID NO: 392 - DNA, 781 bp, Homo sapiens
ttagttggctactcgccatggacgaagcggatcggcggctcctgcggcggtgccggctgcggctggtggaagagctgcaggtggaccagctctgggacgccctgctgagccgcgagctgttcaggccccatatgatcgaggacatccagcgggcaggctctggatctcggcgggatcaggccaggcagctgatcatagatctggagactcgagggagtcaggctcttcctttgttcatctcctgcttagaggacacaggccaggacatgctggcttcgtttctgcgaactaacaggcaagcagcaaagttgtcgaagccaaccctagaaaaccttaccccagtggtgctcagaccagagattcgcaaaccagaggttctcagaccggaaacacccagaccagtggacattggttctggaggatttggtgatgtcggtgctcttgagagtttgaggggaaatgcagatttggcttacatcctgagcatggagccctgtggccactgcctcattatcaacaatgtgaacttctgccgtgagtccgggctccgcacccgcactggctccaacatcgactgtgagaagttgcggcgtcgcttctcctcgctgcatttcatggtggaggtgaagggcgacctgactgccaaggccagccacctgcagttcccaggggctgtctacggcacagatggatgccctgtgtcggtcgagaagattgtgaacatcttcaatgggaccagctgccccagcctgggagggaagcccaagctctttttcatcca

SEQ ID NO: 393 - DNA, 954 bp, Homo sapiens
gcgcggaatggattctggggtcggcgcgaggcgctgagcgggcaggctctggatctcggcgggatcaggccaggcagctgatcatagatctggagactcgagggagtcaggctcttcctttgttcatctcctgcttagaggacacaggccaggacatgctggcttcgtttctgcgaactaacaggcaagcagcaaagttgtcgaagccaaccctagaaaaccttaccccagtggtgctcagaccagagattcgcaaaccagaggttctcagaccggaaacacccagaccagtggacattggttctggaggatttggtgatgtcggtgctcttgagagtttgaggggaaatgcagatttggcttacatcctgagcatggagccctgtggccactgcctcattatcaacaatgtgaacttctgccgtgagtccgggctccgcacccgcactggctccaacatcgactgtgagaagttgcggcgtcgcttctcctcgctgcatttcatggtggaggtgaagggcgacctgactgccaagaaaatggtgctggctttgctggagctggcgcagcaggaccacggtgctctggactgctgcgtggtggtcattctctctcacggctgtcaggccagccacctgcagttcccaggggctgtctacggcacagatggatgccctgtgtcggtcgagaagattgtgaacatcttcaatgggaccagctgccccagcctgggagggaagcccaagctctttttcatccaggcctgtggtggggagcagaaagaccatgggtttgaggtggcctccacttcccctgaagacgagtcccctggcagtaaccccgagccagatgccaccccgttccaggaaggtttgaggaccttcgaccagctggacgccatatctagtttgcccacacccagtgacatctttgtgtcctactctactttcccag

SEQ ID NO: 394 - DNA, 4463 bp, Homo sapiens
ttggccctgggggcggggcgaggcgcagaggtgcgtcctgagggcggggcggtgacgcaagagcgactcctgggggcggggcgaggccttggagatgcgtccggaggcggtggggagcgaagactgacccggggccgtgacgcgggggcaggccctggggcgggggcgggtcctggggactggggcgggcggccgaggcccggaagcggactgaggcggcctggagtcttagttggctactcgccatggacgaagcggatcggcggctcctgcggcggtgccggctgcggctggtggaagagctgcaggtggaccagctctgggacgccctgctgagccgcgagctgttcaggccccatatgatcgaggacatccagcgggcaggctctggatctcggcgggatcaggccaggcagctgatcatagatctggagactcgagggagtcaggctcttcctttgttcatctcctgcttagaggacacaggccaggacatgctggcttcgtttctgcgaactaacaggcaagcagcaaagttgtcgaagccaaccctagaaaaccttaccccagtggtgctcagaccagagattcgcaaaccagaggttctcagaccggaaacacccagaccagtggacattggttctggaggatttggtgatgtcggtgctcttgagagtttgaggggaaatgcagatttggcttacatcctgagcatggagccctgtggccactgcctcattatcaacaatgtgaacttctgccgtgagtccgggctccgcacccgcactggctccaacatcgactgtgagaagttgcggcgtcgcttctcctcgctgcatttcatggtggaggtgaagggcgacctgactgccaagaaaatggtgctggctttgctggagctggcgcagcaggaccacggtgctctggactgctgcgtggtggtcattctctctcacggctgtcaggccagccacctgcagttcccaggggctgtctacggcacagatggatgccctgtgtcggtcgagaagattgtgaacatcttcaatgggaccagctgccccagcctgggagggaagcccaagctctttttcatccaggcctgtggtggggagcagaaagaccatgggtttgaggtggcctccacttcccctgaagacgagtcccctggcagtaaccccgagccagatgccaccccgttccaggaaggtttgaggaccttcgaccagctggacgccatatctagtttgcccacacccagtgacatctttgtgtcctactctactttcccaggttttgtttcctggagggaccccaagagtggctcctggtacgttgagaccctggacgacatctttgagcagtgggctcactctgaagacctgcagtccctcctgcttagggtgagtgctgccttcctctgcaaaggagaggggaggctgctgaggggcagcgtgtcctcctggggctggggatttggggtgagcagggcaggcccaaaccaagggtaaaaggtagtagactcctgcctctgagccttggagtcggcacttttgtgtctctttatgagaggcatcctgcctgtggtgacgtttgccctttattcaaagagttgccttccctgtctcctccaaggtccccaggttgacacctcccgctcctccactgatggagctggtcctcagtgccagcgcaggatggctctgtccagaccctgaaggcgggtcatgggcccctccctatatcctgtgggcatcatgtagtcttctactcttgaccctcaagaattgtgaacccctccttgtacatcgccttctcaggaggccccagtgaggaaacagatagggaagggtggcctgataggcccagtcctactccatagaaacccgactcagagcagttgcttcctctgagggtcctgtggccttgtggctgccttgggaggcagcatgtatgggccccagctgctctgctcaggtattcatgccacgagaaggggctgcgaggctggggccactcctggctccttgcaaatatttcagtctgatttgaactttatgaatttggaaattttgaattttgagttttttaaaggtaaagttgaggtgcgtattctttaagccctcctgctcaaagaggctgcagtttgagctgtttttaaggtgcgggttgagtggacattccccccagcccctcttgaattcttccttcagtccagagaactgaactcacagagctctccatggtcatgtcttacaggtcgctaatgctgtttcggtgaaagggatttataaacagatgcctggttgctttaatttcctccggaaaaaacttttctttaaaacatcataaggccagggcccctcaccctgccttatcttgcaccccaaagctttcctgccccaggcctgaaagaggctgaggcctggactttcctgcaactcaaggactttgcagccggcacagggtctgctctttctctgccagtgacagacaggctcttagcagcttccagattgacgacaagtgctgaacagtggaggaagagggacagatgaatgccgtggattgcacgtggcctcttgagcagtggctggtccagggctagtgacttgtgtcccatgatccctgtgttgtctctagagcagggattaacctctgcactactgacatgtggggccaggtcaccctttgctgtgaggctgtcctgtacattgtgggatgttcagcactgtcccttgcctcaatgccagtaacgcgtcttcctgagtggtgccaaacaaaaaggttctcaggtgttgccaaatatgtcctggggtataaaactttcctcgcctgacaaccactggtctgtagggatttttggctacacacaaaccagtatcgctcatagatcagcaaaccggggcctactagagtctgaacagctgtaatctatgaattctaagtgaaattttaaaaattgttaatttttcctatattgcattaattttaaaaaataaatctgaggcaaatatggactctcttttgcctatttcttccctcattttgctccaactctttcttcttccttacaaaagagacttttgcttttttcgaaacatttccccatgtttttctggggtctcgctatgttgcccaggctggtctcaaactcctgggctcaagtgaccctcccaagtagctcttactacaggcgtgcaccattgcacccagccccatttattcatgtcttatttcacttgatccttatcccatcccaggaaggcaacaagggtgagaaccctgtgctcagggaggttaggtctcttgtccaagggaaaacgattatccagagaagagacctggccagaacctgggtcccctgagtcctagccatgcttcccatgtgccttacttgctgaagcacccccggactgcagtgtgaacgtgctgtgcaatagtgacacgctgggcttccccacaaggctccaccctgaggtcttttaagctgtccttatgccagcctatttcttgttttttgggcctttttttttggagatagggtctcactctgtcgcccaggctggagtgcaatgacgcaatcttggcttattgcagtctcgacctcctgggctcaagagatccttccacctcagccacctgagtagcttggactacaggtgtgcaccacctctcccagttaatttttgtatttttagtagagacagagttatgccatgttactcaggctggtcttgaactcctggactcaagcgatcagcctgccttagcctcccaaagtgcaggggttacaggcttgagccattgcgcctgacctatttctggttcttagggccctggatgttaggatggatttctgaattaataataataataaaaccctcatcaagatgtgatttgcatagttgtcactttatataatattattttccttctgtgacctttccaagtctgaaacagtcccagggacttcttttggttagttatttgcaatcacctgcaggacacacacacaagaaaattgtcaggttcacgtaaccacagagctgtgcgtggcagtttcctgtctctgtcctcctgggctaagctactcaagtgagtcacaggcagcccacactacagtagctcctgcctgaggagttcagatgatgtttcggagaaaaagatgcaatcacagcttttcattgacctgttagggtcttcctgtaaagggggtcttagccaggagtcctgtgtgggcttcaggtcagggggccttcgaaccccctaaaaattatatgccaaatgtgcggatggcatatttttagatttcatttgtttctcatcaaaactgctgtttgcaaggcagttatgcactgtggttggggctataactgtttccagaggctgttgatcagtatctgttaaactttttttttttttttttgagacagtcttgctctgttgcccagacgagtaca

SEQ ID NO: 395 - DNA, 1338 bp, Homo sapiens
aatactctccccagcacacggaaggggaagggggtggaggttgctgctatgagagagaaaaaaaaaacagccacaatagagattctgccttcaaaggttggcttgccacctgaagcagccactgcccagggggtgcaaagaagagacagcagcgcccagcttggaggtgctaactccagaggccagcatcagcaactgggcacagaaaggagccgcctgggcagggaccatggcacggccacatccctggtggctgtgcgttctggggaccctggtggggctctcagctactccagcccccaagagctgcccagagaggcactactgggctcagggaaagctgtgctgccagatgtgtgagccaggaacattcctcgtgaaggactgtgaccagcatagaaaggctgctcagtgtgatccttgcataccgggggtctccttctctcctgaccaccacacccggccccactgtgagagctgtcggcactgtaactctggtcttctcgttcgcaactgcaccatcactgccaatgctgagtgtgcctgtcgcaatggctggcagtgcagggacaaggagtgcaccgagtgtgatcctcttccaaacccttcgctgaccgctcggtcgtctcaggccctgagcccacaccctcagcccacccacttaccttatgtcagtgagatgctggaggccaggacagctgggcacatgcagactctggctgacttcaggcagctgcctgcccggactctctctacccactggccaccccaaagatccctgtgcagctccgattttattcgcatccttgtgatcttctctggaatgttccttgttttcaccctggccggggccctgttcctccatcaacgaaggaaatatagatcaaacaaaggagaaagtcctgtggagcctgcagagccttgtcattacagctgccccagggaggaggagggcagcaccatccccatccaggaggattaccgaaaaccggagcctgcctgctccccctgagccagcacctgcgggagctgcactacagccctggcctccacccccaccccgccgaccatccaagggagagtgagacctggcagccacaactgcagtcccatcctcttgtcagggccctttcctgtgtacacgtgacagagtgccttttcgagactggcagggacgaggacaaatatggatgaggtggagagtgggaagcaggagcccagccagctgcgcctgcgctgcaggagggcgggggctctggttgtaaaacacacttcctgctgcgaaagacccacatgctacaagacgggcaaaataaagtgacagatgaccaccctgca

SEQ ID NO: 396 - DNA, 3686 bp, Homo sapiens
atacgggagaactaaggctgaaacctcggaggaacaaccacttttgaagtgacttcgcggcgtgcgttgggtgcggactaggtggccgcggcgggagtgtgctggagcctgaagtccacgcgcgcggctgagaaccgccgggaccgcacgtgggcgccgcgcgcttcccccgcttcccaggtgggcgccggccgccaggccacctcacgtccggccccggggatgcgcgtcctcctcgccgcgctgggactgctgttcctgggggcgctacgagccttcccacaggatcgacccttcgaggacacctgtcatggaaaccccagccactactatgacaaggctgtcaggaggtgctgttaccgctgccccatggggctgttcccgacacagcagtgcccacagaggcctactgactgcaggaagcagtgtgagcctgactactacctggatgaggccgaccgctgtacagcctgcgtgacttgttctcgagacgacctcgtggagaagacgccgtgtgcatggaactcctcccgtgtctgcgaatgtcgacccggcatgttctgttccacgtctgccgtcaactcctgtgcccgctgcttcttccattctgtctgtccggcagggatgattgtcaagttcccaggcacggcgcagaagaacacggtctgtgagccggcttccccaggggtcagccctgcctgtgccagcccagagaactgcaaggaaccctccagtggcaccatcccccaggccaagcccaccccggtgtccccagcaacctccagtgccagcaccatgcctgtaagagggggcacccgcctcgcccaggaagctgcttctaaactgacgagggctcccgactctccctcctctgtgggaaggcctagttcagatccaggtctgtccccaacacagccatgcccagaggggtctggtgattgcagaaagcagtgtgagcccgactactacctggacgaggccggccgctgcacggcctgcgtgagctgttctcgagatgaccttgtggagaagacgccatgtgcatggaactcctcccgcacctgcgaatgtcgacctggcatgatctgtgccacatcagccaccaactcccgtgcccgctgtgtcccctacccaatctgtgcagcagagacggtcaccaagccccaggatatggctgagaaggacaccacctttgaggcgccacccctggggacccagccggactgcaaccccaccccagagaatggcgaggcgcctgccagcaccagccccactcagagcttgctggtggactcccaggccagtaagacgctgcccatcccaaccagcgctcccgtcgctctctcctccacggggaagcccgttctggatgcagggccagtgctcttctgggtgatcctggtgttggttgtggtggtcggctccagcgccttcctcctgtgccaccggagggcctgcaggaagcgaattcggcagaagctccacctgtgctacccggtccagacctcccagcccaagctagagcttgtggattccagacccaggaggagctcaacgcagctgaggagtggtgcgtcggtgacagaacccgtcgcggaagagcgagggttaatgagccagccactgatggagacctgccacagcgtgggggcagcctacctggagagcctgccgctgcaggatgccagcccggccgggggcccctcgtcccccagggaccttcctgagccccgggtgtccacggagcacaccaataacaagattgagaaaatctacatcatgaaggctgacaccgtgatcgtggggaccgtgaaggctgagctgccggagggccggggcctggcggggccagcagagcccgagttggaggaggagctggaggcggaccataccccccactaccccgagcaggagacagaaccgcctctgggcagctgcagcgatgtcatgctctcagtggaagaggaagggaaagaagaccccttgcccacagctgcctctggaaagtgaggcctgggctgggctggggctaggagggcagcagggtggcctctgggaggccaggatggcactgttggcaccgaggttgggggcagaggcccatctggcctgaactgaggctccagcatctagtggtggaccggccggtcactgcaggggtctggtggtctctgcttgcatccccaacttagctgtcccctgacccagagcctaggggatccggggcttgtacagaagagacagtccaaggggactggatcccagcagtgatgttggttgaggcagcaaacagatggcaggatgggcactgccgagaacagcattggtcccagagccctgggcatcagaccttaaccaccaggcccacagcccagcgagggagaggtcgtgaggccagctcccggggcccctgtaaccctactctcctctctccctggacctcagaggtgacacccattgggcccttccggcatgcccccagttactgtaaatgtggcccccagtgggcatggagccagtgcctgtggttgtttctccagagtcaaaagggaagtcgagggatggggcgtcgtcagctggcactgtctctgctgcagcggccacactgtactctgcactggtgtgagggcccctgcctggactgtgggaccctcctggtgctgcccaccttccctgtcctgtagccccctcggtgggcccagggcctagggcccaggatcaagtcactcatctcagaatgtccccaccaatccccgccacagcaggcgcctcgggtcccagatgtctgcagccctcagcagctgcagaccgcccctcaccaacccagagaacctgctttactttgcccagggacttcctccccatgtgaacatggggaacttcgggccctgcctggagtccttgaccgctctctgtgggccccacccactctgtcctgggaaatgaagaagcatcttccttaggtctgccctgcttgcaaatccactagcaccgaccccaccacctggttccggctctgcacgctttggggtgtggatgtcgagaggcaccacggcctcacccaggcatctgctttactctggaccataggaaacaagaccgtttggaggtttcatcaggattttgggtttttcacatttcacgctaaggagtagtggccctgacttccggtcggctggccagctgactccctagggccttcagacgtgtatgcaaatgagtgatggataaggatgagtcttggagttgcgggcagcctggagactcgtggacttaccgcctggaggcaggcccgggaaggctgctgtttactcatcgggcagccacgtgctctctggaggaagtgatagtttctgaaaccgctcagatgttttggggaaagttggagaagccgtggccttgcgagaggtggttacaccagaacctggacattggccagaagaagcttaagtgggcagacactgtttgcccagtgtttgtgcaaggatggagtgggtgtctctgcatcacccacagccgcagctgtaaggcacgctggaaggcacacgcctgccaggcagggcagtctggcgcccatgatgggagggattgacatgtttcaacaaaataatgcacttccttacctagtggcccttcacacaacttttgaatctctaaaaatccataaaatccttaaagaactgtaa

SEQ ID NO: 397 - DNA, 2363 bp, Homo sapiens
gtcttgtgtggttgcagcaaggcaaagagtgtggggcgtctctgtgttccagggccagtgctcttctgggtgatcctggtgttggttgtggtggtcggctccagcgccttcctcctgtgccaccggagggcctgcaggaagcgaattcggcagaagctccacctgtgctacccggtccagacctcccagcccaagctagagcttgtggattccagacccaggaggagctcaacgcagctgaggagtggtgcgtcggtgacagaacccgtcgcggaagagcgagggttaatgagccagccactgatggagacctgccacagcgtgggggcagcctacctggagagcctgccgctgcaggatgccagcccggccgggggcccctcgtcccccagggaccttcctgagccccgggtgtccacggagcacaccaataacaagattgagaaaatctacatcatgaaggctgacaccgtgatcgtggggaccgtgaaggctgagctgccggagggccggggcctggcggggccagcagagcccgagttggaggaggagctggaggcggaccataccccccactaccccgagcaggagacagaaccgcctctgggcagctgcagcgatgtcatgctctcagtggaagaggaagggaaagaagaccccttgcccacagctgcctctggaaagtgaggcctgggctgggctggggctaggagggcagcagggtggcctctgggaggccaggatggcactgttggcaccgaggttgggggcagaggcccatctggcctgaactgaggctccagcatctagtggtggaccggccggtcactgcaggggtctggtggtctctgcttgcatccccaacttagctgtcccctgacccagagcctaggggatccggggcttgtacagaagagacagtccaaggggactggatcccagcagtgatgttggttgaggcagcaaacagatggcaggatgggcactgccgagaacagcattggtcccagagccctgggcatcagaccttaaccaccaggcccacagcccagcgagggagaggtcgtgaggccagctcccggggcccctgtaaccctactctcctctctccctggacctcagaggtgacacccattgggcccttccggcatgcccccagttactgtaaatgtggcccccagtgggcatggagccagtgcctgtggttgtttctccagagtcaaaagggaagtcgagggatggggcgtcgtcagctggcactgtctctgctgcagcggccacactgtactctgcactggtgtgagggcccctgcctggactgtgggaccctcctggtgctgcccaccttccctgtcctgtagccccctcggtgggcccagggcctagggcccaggatcaagtcactcatctcagaatgtccccaccaatccccgccacagcaggcgcctcgggtcccagatgtctgcagccctcagcagctgcagaccgcccctcaccaacccagagaacctgctttactttgcccagggacttcctccccatgtgaacatggggaacttcgggccctgcctggagtccttgaccgctctctgtgggccccacccactctgtcctgggaaatgaagaagcatcttccttaggtctgccctgcttgcaaatccactagcaccgaccccaccacctggttccggctctgcacgctttggggtgtggatgtcgagaggcaccacggcctcacccaggcatctgctttactctggaccataggaaacaagaccgtttggaggtttcatcaggattttgggtttttcacatttcacgctaaggagtagtggccctgacttccggtcggctggccagctgactccctagggccttcagacgtgtatgcaaatgagtgatggataaggatgagtcttggagttgcgggcagcctggagactcgtggacttaccgcctggaggcaggcccgggaaggctgctgtttactcatcgggcagccacgtgctctctggaggaagtgatagtttctgaaaccgctcagatgttttggggaaagttggagaagccgtggccttgcgagaggtggttacaccagaacctggacattggccagaagaagcttaagtgggcagacactgtttgcccagtgtttgtgcaaggatggagtgggtgtctctgcatcacccacagccgcagctgtaaggcacgctggaaggcacacgcctgccaggcagggcagtctggcgcccatgatgggagggattgacatgtttcaacaaaataatgcacttccttacctagtggcccttcacacaacttttgaatctctaaaaatccataaaatccttaaagaactgtaa

SEQ ID NO: 398 - DNA, 2412 bp, Homo sapiens
ggagtgtgctggagcctgaagtccacgcgcgcggctgagaaccgccgggaccgcacgtgggcgccgcgcgcttcccccgcttcccaggtgggcgccggccgccaggccacctcacgtccggccccggggatgcgcgtcctcctcgccgcgctgggactgctgttcctgggggcgctacgagccttcccacagggctgttcccgacacagcagtgcccacagaggcctactgactgcaggaagcagtgtgagcctgactactacctggatgaggccgaccgctgtacagcctgcgtgacttgttctcgagacgacctcgtggagaagacgccgtgtgcatggaactcctcccgtgtctgcgaatgtcgacccggcatgttctgttccacgtctgccgtcaactcctgtgcccgctgcttcttccattctgtctgtccggcagggatgattgtcaagttcccaggcacggcgcagaagaacacggtctgtgagccggcttccccaggggtcagccctgcctgtgccagcccagagaactgcaaggaaccctccagtggcaccatcccccaggccaagcccaccccggtgtccccagcaacctccagtgccagcaccatgcctgtaagagggggcacccgcctcgcccaggaagctgcttctaaactgacgagggctcccgactctccctcctctgtgggaaggcctagttcagatccaggtctgtccccaacacagccatgcccagaggggtctggtgattgcagaaagcagtgtgagcccgactactacctggacgaggccggccgctgcacggcctgcgtgagctgttctcgagatgaccttgtggagaagacgccatgtgcatggaactcctcccgcacctgcgaatgtcgacctggcatgatctgtgccacatcagccaccaactcccgtgcccgctgtgtcccctacccaatctgtgcagcagagacggtcaccaagccccaggatatggctgagaaggacaccacctttgaggcgccacccctggggacccagccggactgcaaccccaccccagagaatggcgaggcgcctgccagcaccagccccactcagagcttgctggtggactcccaggccagtaagacgctgcccatcccaaccagcgctcccgtcgctctctcctccacggggaagcccgttctggatgcagggccagtgctcttctgggtgatcctggtgttggttgtggtggtcggctccagcgccttcctcctgtgccaccggagggcctgcaggaagcgaattcggcagaagctccacctgtgctacccggtccagacctcccagcccaagctagagcttgtggattccagacccaggaggagctcaacgctgaggagtggtgcgtcggtgacagaacccgtcgcggaagagcgagggttaatgagccagccactgatggagacctgccacagcgtgggggcagcctacctggagagcctgccgctgcaggatgccagcccggccgggggcccctcgtcccccagggaccttcctgagccccgggtgtccacggagcacaccaataacaagattgagaaaatctacatcatgaaggctgacaccgtgatcgtggggaccgtgaaggctgagctgccggagggccggggcctggcggggccagcagagcccgagttggaggaggagctggaggcggaccataccccccactaccccgagcaggagacagaaccgcctctgggcagctgcagcgatgtcatgctctcagtggaagaggaagggaaagaagaccccttgcccacagctgcctctggaaagtgaggcctgggctgggctggggctaggagggcagcagggtggcctctgggaggccaggatggcactgttggcaccgaggttgggggcagaggcccatctggcctgaactgaggctccagcatctagtggtggaccggccggtcactgcaggggtctggtggtctctgcttgcatccccaacttagctgtcccctgacccagagcctaggggatccggggcttgtacagaagagacagtccaaggggactggatcccagcagtgatgttggttgaggcagcaaacagatggcaggatgggcactgccgagaacagcattggtcccagagccctgggcatcagaccttaaccaccaggcccacagcccagcgagggagaggtcgtgaggccagctcccggggcccctgtaaccctactctcctctctccctggacctcagaggtgacacccattgggcccttccggcatgcccccagttactgtaaatgtggcccccagtgggcatggagccagtgcctgtggttgtttctccagagtcaaaagggaagtcgagggatggggcgtcgtcagctggcactgtctctgctgca

SEQ ID NO: 399 - DNA, 1906 bp, Homo sapiens
ccaagtcacatgattcaggattcagggggagaatccttcttggaacagagatgggcccagaactgaatcagatgaagagagataaggtgtgatgtggggaagactatataaagaatggacccagggctgcagcaagcactcaacggaatggcccctcctggagacacagccatgcatgtgccggcgggctccgtggccagccacctggggaccacgagccgcagctatttctatttgaccacagccactctggctctgtgccttgtcttcacggtggccactattatggtgttggtcgttcagaggacggactccattcccaactcacctgacaacgtccccctcaaaggaggaaattgctcagaagacctcttatgtatcctgaaaagggctccattcaagaagtcatgggcctacctccaagtggcaaagcatctaaacaaaaccaagttgtcttggaacaaagatggcattctccatggagtcagatatcaggatgggaatctggtgatccaattccctggtttgtacttcatcatttgccaactgcagtttcttgtacaatgcccaaataattctgtcgatctgaagttggagcttctcatcaacaagcatatcaaaaaacaggccctggtgacagtgtgtgagtctggaatgcaaacgaaacacgtataccagaatctctctcaattcttgctggattacctgcaggtcaacaccaccatatcagtcaatgtggatacattccagtacatagatacaagcacctttcctcttgagaatgtgttgtccatcttcttatacagtaattcagactgaacagtttctcttggccttcaggaagaaagcgcctctctaccatacagtatttcatccctccaaacacttgggcaaaaagaaaactttagaccaagacaaactacacagggtattaaatagtatacttctccttctgtctcttggaaagatacagctccagggttaaaaagagagtttttagtgaagtatctttcagatagcaggcagggaagcaatgtagtgtggtgggcagagccccacacagaatcagaagggatgaatggatgtcccagcccaacctctaattcactgtatggtcttgatctatttcttctgttttgagagcctccagttaaaatggggctccagtaccagagcagctagcaactctgccctaatgggaaatgaaggggagctgggtgtgagtgtttacactgtgcccttcacgggatacttcttttatctgcagatggcctaatacttagttgtccaagtcgcgatcaaggactctctcacacaggaaacttccctatactggcagatacacttgtgactgaaccatgcccagtttatgcctgtctgactgtcactctggcactaggaggctgatcttgtactccatatgaccccacccctaggaacccccagggaaaaccaggctgggacagccccctgttcctgagatggaaagcacaaatttaatacaccaccacaatggaaaacaagttcaaagacttttacttacagatcctggacagaaagggcataatgagtctgaagggcagtcctccttctctaggttacatgaggcaggaataagaagtcagacagagacagcaagacagttaacaatgtaggtaaagaaatagggtgtggtcactctcaattcactggcaaatgcctgaatggtctgtctgaaggaagcaacagagaagtggggaatccagtctgctaggcaggaaagatgcctctaagttcttgtctctggccagaggtgtggtatagaaccagaaacccatatcaagggtgactaagcccggcttctggtatgagaaattaaacttgtatacaaaatggttgccaaggcaacataaaattataagaattc

SEQ ID NO: 400 - DNA, 5815 bp, Homo sapiens
cctcgctatggttcgtctgcctctgcagtgcgtcctctggggctgcttgctgaccgctgtccatccagaaccacccactgcatgcagagaaaaacagtacctaataaacagtcagtgctgttctttgtgccagccaggacagaaactggtgagtgactgcacagagttcactgaaacggaatgccttccttgcggtgaaagcgaattcctagacacctggaacagagagacacactgccaccagcacaaatactgcgaccccaacctagggcttcgggtccagcagaagggcacctcagaaacagacaccatctgcacctgtgaagaaggctggcactgtacgagtgaggcctgtgagagctgtgtcctgcaccgctcatgctcgcccggctttggggtcaagcagattggtaagtggctcatctgggaatcagttttggagggggacagaggagcttagggcccaaggtgaggggctgggcagtgggcacttagccccagaggcagaggaagcagaggctccaacctatgtcggtatccccactggagtgagctgcagacgggaccttgttcattctgccttctgccatggggatctgcctttgaagggcaatgggagaagtcctcctggggactgcagctgtcgggggcagtaccacatcgggggaagagtgctcaaggcaggagctcttcccgtcctgcctggccactggctgccttgtgagccggacaggtggtccactgtgatggttaatgtccccctccccacccactcccagctacaggggtttctgataccatctgcgagccctgcccagtcggcttcttctccaatgtgtcatctgctttcgaaaaatgtcacccttggacaaggtataagcactcatcccttgtgtttcctgctctaagagtggcatggagctgcctccattctctccagccacctgtcctgtccctgctcccagaggtccacacacactcatgtacttgtgaagcatctgcagagtggcctcatggccaaccagacaggcacatttccacattttttttgcctgctgtctctttgaggtaatagacactgttgatctctcgcttcatgagagcctcctatcttgggggtattgggacacttattttagctttccttctgcccctcctgcttctcctcagttttcctcgtcttgctttcaccttacctggctttctagggctttctgggctctgggtgctcaccctgagggcctccctctcttacctccaactccaaacccacaccaggtcctgccactggctgtctacgtgttttgggaacttactgtctccactgttgtcactttagtttgggcctcatcactgtggtctgggtgatgccttttctgcctcctggcctccctgcctctgtctctcccctcctgctggttctgtctccatcctcttgccaacatgagcgttcgacagtttctttcaaatcatgacactctcctatttgagatgcttcctgtctctctgttggaactaagactccttagcatggcacccaaccttcctgttgcatttcctgctctctttcctgcatcgcatagcttcatgctacttgcaatcctctgaacacactgttcattctcttccatcaaactcatctgcctggaataccttaaacatgggccccaggccaggcgcggtggctcttgcctgtaatctcagcactttggatgccaaggcgggtggatcacttgaggtcaggagttcaagaccagccagcacaacatggtaaaaacccatctctactaaaaataccaaaaaattagctgggtgtggtggtgggcgcctgtaatcccagctcctcgggaggctgaggcaggagaatcacttgaacccggaaggtggagtttgcagtgagccaagatagcgccactgcactccagcctgggcaacagagcgacattctgtctcaaaaaaaaaaaaaaaaaaaaaaaagactaaagtacatggtttcttcaaagcttctctctctttctcccaccttagatgatttttcctttgcaatgtcctgtgtccattccgccccactcctcctggggccacctggaccaggtcttcatcatctcatatctatatgtttgctgtgtctcctggctggccactcttctgtaatttctcctcctctgagctctctgggcagctgaatcttctcactagtgaagtcgcctggttggatgctgatgagactgaccagctgaatccagttgaaaacttcacacttggcagtgatctggttctaaagacacaattttccatagtttcctaacaccatcctgcatgccacctgccttatttccccacatcacatcgtcccacttagcgggactgcactgctgatccaaattttacatcctttagggcccactcaggtcatatgtcctcagggaagtctttctggaagaaccttaaaccagaggttctcaacagggggcagttttgctccctgtggaacgtttgccaatgtctggacacatttcattcgtcacaaacggagagggggatgctacagggatctggcggatagaggccagggatgctgctgaacatctgcaatgcataggacagcccacccccacccccacacccccagtaaataatgatccagcccaagtgtcactggtgctgacgttgagtaaccctatcttaagctgaactcatcatctctccattccagccttggtggattctgtctcctctgaaccattcccatctcactttagcctacctagatcacaaagcttggcactcattatagactcccctatttattactccttcaagatgtgcaagaatcttttctctgcacttttaagttctgtaagaagagtctgtgtcgttcctataataaccagcataggacgttgcacgtgttgtgtgctcagtgaacctggatttgttgattgttgactgactcactctagagttggaaatcttatgcttggggaaacttaatatctctttctttctctgtgtgtgtgcatttgtgcacgtgtctgtgcatagctgtgagaccaaagacctggttgtgcaacaggcaggcacaaacaagactgatgttgtctgtggtgagtcctggacaatgggccctggagaaagcctaggaaggtgggaactgaagggggagatgaggcacacaggaacactggatgggaaaaaggggaggggaggcagtttgggggtgtggtatcacagctctgccacttatcttgggagtctgggcaaatcacttcccctctcttagcctcagtttcttcatctgtaaaatgggatgataacagcacttccttagtaggttttgattttagagtgagaaggttggcctacagtaaagatcagataatgtaaatcagtgaaaaaggtcaggggtaagaaaattacattctctttacctaacgctaaatgaccagttaatgggtgcagcacaccaacatggtacatgtatacatatgtaacaaacctgcacattatgcacatgtaccctaaagcttaaagtataataataataaaatttaaaaaaacgaaaaatacattctctttgctttttctcaaaatgtactttcctctttgtagggctgggactagaatgaggtgagcaaggcacttgccctcgggcgcaatatttaagaaggtgccataaaagtgtagtaatcaaggtaaattcattttgatgcaatatttttaaaaataaaaattaatgcaaagaaatccatgatgagcaagatagcaacattttaaataaagaacaggatccgaccctgtgtttgcatgaccctgcctcactcacctcaccctaatcctggccctggttccagtaaaaggaataggcagccagcctgcaggccgtagtttgctgacttggtgtccgcctgatgattttcaaaatatggcattaaaagaatgtttaccttgatgactgagtgttttggacatccttttcaattttgtcctgaaacaatttcatcccttgcctcacgctagtctccgccctgccttttggtctttcttttattttcccactttgaaaaaaaaattcggcatgagaaatactttacctttcccctccactcttctataccaaaagcaacatgcagacatgaatcatgctagacctcggcattgggcagagagcagggagtggcggggagcatggtgagcaggtggtgacagccactgccaccactcgcttctagatggttcccaggtggggaggctgccaactggaacccagtcttcccagtttgtaagagaaatcagatgtctaggtttgaatatgtgatctcccagtttaaaaatgtcggcaaatatttccaaacgttaagaaaatgttctggctcctttaaagacatctgccagccacatttccccaaggaccgcggtttgaaccttctgatgtagatgagctctgacattggaagattctggagtctgacaagtcacagcaggttgagggtagggagaaactgcaggtgaggggtgcatgctgaagtcctgatttctccaggtccccaggatcggctgagagccctggtggtgatccccatcatcttcgggatcctgtttgccatcctcttggtgctggtctttatcaaaaaggtggccaagaagccaaccaataaggtaggtcacccctgagaacccgggacagagttttgacaaactgggaagatggcctcacggttgcctatggggcagtaaaactgattcagagtctgtctctgcagccagtggggtggcagcagaattggggactgtcatccccacccaccatgctccttccatccagagctcaatcccccacagaactgcccctggcaccactggcagagcctaacactggctgttcttcactcctttcctggcattcaacgcgtggggagctgcatctttgggccttggggctgggtcaaatgggtgggagcaaatgtggcagccccttaagcccactggctcccactctggaagctcttcgtcgcccttggtgtggccagcagggggcaggaggcacccgaggaatcagcactgacccgccgtctgggaaaggggggagggcttggggaagggatccgcttcccagggaggggctcctcagaggcacagctgcccctgctgctgggggtgacctcacaccttgcctctccaggccccccaccccaagcaggaaccccaggagatcaattttcccgacgatcttcctggctccaacactgctgctccagtgcaggagactttacatggatgccaaccggtcacccaggaggatggcaaagagagtcgcatctcagtgcaggagagacagtgaggctgcacccacccaggagtgtggccacgtgggcaaacaggcagttggccagagagcctggtgctgctgctgctgtggcgtgagggtgaggggctggcactgactgggcatagctccccgcttctgcctgcacccctgcagtttgagacaggagacctggcactggatgcagaaacagttcaccttgaagaacctctcacttcaccctggagcccatccagtctcccaacttgtattaaagacagaggcagaagtttggtggtggtggtgttggggtatggtttagtaatatccaccagaccttccgatccagcagtttggtgcccagagaggcatcatggtggcttccctgcgcccaggaagccatatacacagatgcccattgcagcattgtttgtgatagtgaacaactggaagctgcttaactgtccatcagcaggagactggctaaataaaattagaatatatttatac

SEQ ID NO: 401 - DNA, 1720 bp, Homo sapiens
accatttcaactttaacacagcatgatcgaaacatacaaccaaacttctccccgatctgcggccactggactgcccatcagcatgaaaatttttatgtatttacttactgtttttcttatcacccagatgattgggtcagcactttttgctgtgtatcttcatagaaggttggacaagatagaagatgaaaggaatcttcatgaagattttgtattcatgaaaacgatacagagatgcaacacaggagaaagatccttatccttactgaactgtgaggagattaaaagccagtttgaaggctttgtgaaggatataatgttaaacaaagaggagacgaagaaagaaaacagctttgaaatgcaaaaagtgttacagtgggctgaaaaaggatactacaccatgagcaacaacttggtaaccctggaaaatgggaaacagctgaccgttaaaagacaaggactctattatatctatgcccaagtcaccttctgttccaatcgggaagcttcgagtcaagctccatttatagccagcctctgcctaaagtcccccggtagattcgagagaatcttactcagagctgcaaatacccacagttccgccaaaccttgcgggcaacaatccattcacttgggaggagtatttgaattgcaaccaggtgcttcggtgtttgtcaatgtgactgatccaagccaagtgagccatggcactggcttcacgtcctttggcttactcaaactctgaacagtgtcaccttgcaggctgtggtggagctgacgctgggagtcttcataatacagcacagcggttaagcccaccccctgttaactgcctatttataaccctaggatcctccttatggagaactatttattatacactccaaggcatgtagaactgtaataagtgaattacaggtcacatgaaaccaaaacgggccctgctccataagagcttatatatctgaagcagcaaccccactgatgcagacatccagagagtcctatgaaaagacaaggccattatgcacaggttgaattctgagtaaacagcagataacttgccaagttcagttttgtttctttgcgtgcagtgtctttccatggataatgcatttgatttatcagtgaagatgcagaagggaaatggggagcctcagctcacattcagttatggttgactctgggttcctatggccttgttggagggggccaggctctagaacgtctaacacagtggagaaccgaaaccccccccccccccccgccaccctctcggacagttattcattctctttcaatctctctctctccatctctctctttcagtctctctctctcaacctctttcttccaatctctctttctcaatctctctgtttccctttgtcagtctcttccctcccccagtctctcttctcaatccccctttctaacacacacacacacacacacacacacacacacacacacacacacacacacacagagtcaggccgttgctagtcagttctcttctttccaccctgtccctatctctaccactatagatgagggtgaggagtagggagtgcagccctgagcctgcccactcctcattacgaaatgactgtatttaaaggaaatctattgtatctacctgcagtctccattgtttccagagtgaacttgtaattatcttgttatttattttttgaataataaagacctcttaacatta

SEQ ID NO: 402 - DNA, 1817 bp, Homo sapiens
catgctgcctctgccaccttctctgccagaagataccatttcaactttaacacagcatgatcgaaacatacaaccaaacttctccccgatctgcggccactggactgcccatcagcatgaaaatttttatgtatttacttactgtttttcttatcacccagatgattgggtcagcactttttgctgtgtatcttcatagaaggttggacaagatagaagatgaaaggaatcttcatgaagattttgtattcatgaaaacgatacagagatgcaacacaggagaaagatccttatccttactgaactgtgaggagattaaaagccagtttgaaggctttgtgaaggatataatgttaaacaaagaggagacgaagaaagaaaacagctttgaaatgcaaaaaggtgatcagaatcctcaaattgcggcacatgtcataagtgaggccagcagtaaaacaacatctgtgttacagtgggctgaaaaaggatactacaccatgagcaacaacttggtaaccctggaaaatgggaaacagctgaccgttaaaagacaaggactctattatatctatgcccaagtcaccttctgttccaatcgggaagcttcgagtcaagctccatttatagccagcctctgcctaaagtcccccggtagattcgagagaatcttactcagagctgcaaatacccacagttccgccaaaccttgcgggcaacaatccattcacttgggaggagtatttgaattgcaaccaggtgcttcggtgtttgtcaatgtgactgatccaagccaagtgagccatggcactggcttcacgtcctttggcttactcaaactctgaacagtgtcaccttgcaggctgtggtggagctgacgctgggagtcttcataatacagcacagcggttaagcccaccccctgttaactgcctatttataaccctaggatcctccttatggagaactatttattatacactccaaggcatgtagaactgtaataagtgaattacaggtcacatgaaaccaaaacgggccctgctccataagagcttatatatctgaagcagcaaccccactgatgcagacatccagagagtcctatgaaaagacaaggccattatgcacaggttgaattctgagtaaacagcagataacttgccaagttcagttttgtttctttgcgtgcagtgtctttccatggataatgcatttgatttatcagtgaagatgcagaagggaaatggggagcctcagctcacattcagttatggttgactctgggttcctatggccttgttggagggggccaggctctagaacgtctaacacagtggagaaccgaaaccccccccccccccccgccaccctctcggacagttattcattctctttcaatctctctctctccatctctctctttcagtctctctctctcaacctctttcttccaatctctctttctcaatctctctgtttccctttgtcagtctcttccctcccccagtctctcttctcaatccccctttctaacacacacacacacacacacacacacacacacacacacacacacacacacacagagtcaggccgttgctagtcagttctcttctttccaccctgtccctatctctaccactatagatgagggtgaggagtagggagtgcagccctgagcctgcccactcctcattacgaaatgactgtatttaaaggaaatctattgtatctacctgcagtctccattgtttccagagtgaacttgtaattatcttgttatttattttttgaataataaagacctcttaacatta

SEQ ID NO: 403 - DNA, 1623 bp, Homo sapiens
tggtcctgccgcctggtctcacctcgctatggttcgtctgcctctgcagtgcgtcctctggggctgcttgctgaccgctgtccatccagaaccacccactgcatgcagagaaaaacagtacctaataaacagtcagtgctgttctttgtgccagccaggacagaaactggtgagtgactgcacagagttcactgaaacggaatgccttccttgcggtgaaagcgaattcctagacacctggaacagagagacacactgccaccagcacaaatactgcgaccccaacctagggcttcgggtccagcagaagggcacctcagaaacagacaccatctgcacctgtgaagaaggctggcactgtacgagtgaggcctgtgagagctgtgtcctgcaccgctcatgctcgcccggctttggggtcaagcagattgctacaggggtttctgataccatctgcgagccctgcccagtcggcttcttctccaatgtgtcatctgctttcgaaaaatgtcacccttggacaaggtccccaggatcggctgagagccctggtggtgatccccatcatcttcgggatcctgtttgccatcctcttggtgctggtctttatcaaaaaggtggccaagaagccaaccaataaggccccccaccccaagcaggaaccccaggagatcaattttcccgacgatcttcctggctccaacactgctgctccagtgcaggagactttacatggatgccaaccggtcacccaggaggatggcaaagagagtcgcatctcagtgcaggagagacagtgaggctgcacccacccaggagtgtggccacgtgggcaaacaggcagttggccagagagcctggtgctgctgctgctgtggcgtgagggtgaggggctggcactgactgggcatagctccccgcttctgcctgcacccctgcagtttgagacaggagacctggcactggatgcagaaacagttcaccttgaagaacctctcacttcaccctggagcccatccagtctcccaacttgtattaaagacagaggcagaagtttggtggtggtggtgttggggtatggtttagtaatatccaccagaccttccgatccagcagtttggtgcccagagaggcatcatggtggcttccctgcgcccaggaagccatatacacagatgcccattgcagcattgtttgtgatagtgaacaactggaagctgcttaactgtccatcagcaggagactggctaaataaaattagaatatatttatacaacagaatctcaaaaacactgttgagtaaggaaaaaaaggcatgctgctgaatgatgggtatggaactttttaaaaaagtacatgcttttatgtatgtatattgcctatggatatatgtataaatacaatatgcatcatatattgatataacaagggttctggaagggtacacagaaaacccacagctcgaagagtggtgacgtctggggtggggaagaagggtctgggggagggttggttaaagggagatttggctttcccataatgcttcatcatttttcccaaaaggagagtgaattcacataatgcttatgtaattaaaaaatcatcaaacatgtaaaaagaaaa

SEQ ID NO: 404 - DNA, 1729 bp, Homo sapiens
ggctggggcaggggagtcagcagaggcctcgctcgggcgcccagtggtcctgccgcctggtctcacctcgctatggttcgtctgcctctgcagtgcgtcctctggggctgcttgctgaccgctgtccatccagaaccacccactgcatgcagagaaaaacagtacctaataaacagtcagtgctgttctttgtgccagccaggacagaaactggtgagtgactgcacagagttcactgaaacggaatgccttccttgcggtgaaagcgaattcctagacacctggaacagagagacacactgccaccagcacaaatactgcgaccccaacctagggcttcgggtccagcagaagggcacctcagaaacagacaccatctgcacctgtgaagaaggctggcactgtacgagtgaggcctgtgagagctgtgtcctgcaccgctcatgctcgcccggctttggggtcaagcagattgctacaggggtttctgataccatctgcgagccctgcccagtcggcttcttctccaatgtgtcatctgctttcgaaaaatgtcacccttggacaagctgtgagaccaaagacctggttgtgcaacaggcaggcacaaacaagactgatgttgtctgtggtccccaggatcggctgagagccctggtggtgatccccatcatcttcgggatcctgtttgccatcctcttggtgctggtctttatcaaaaaggtggccaagaagccaaccaataaggccccccaccccaagcaggaaccccaggagatcaattttcccgacgatcttcctggctccaacactgctgctccagtgcaggagactttacatggatgccaaccggtcacccaggaggatggcaaagagagtcgcatctcagtgcaggagagacagtgaggctgcacccacccaggagtgtggccacgtgggcaaacaggcagttggccagagagcctggtgctgctgctgctgtggcgtgagggtgaggggctggcactgactgggcatagctccccgcttctgcctgcacccctgcagtttgagacaggagacctggcactggatgcagaaacagttcaccttgaagaacctctcacttcaccctggagcccatccagtctcccaacttgtattaaagacagaggcagaagtttggtggtggtggtgttggggtatggtttagtaatatccaccagaccttccgatccagcagtttggtgcccagagaggcatcatggtggcttccctgcgcccaggaagccatatacacagatgcccattgcagcattgtttgtgatagtgaacaactggaagctgcttaactgtccatcagcaggagactggctaaataaaattagaatatatttatacaacagaatctcaaaaacactgttgagtaaggaaaaaaaggcatgctgctgaatgatgggtatggaactttttaaaaaagtacatgcttttatgtatgtatattgcctatggatatatgtataaatacaatatgcatcatatattgatataacaagggttctggaagggtacacagaaaacccacagctcgaagagtggtgacgtctggggtggggaagaagggtctgggggagggttggttaaagggagatttggctttcccataatgcttcatcatttttcccaaaaggagagtgaattcacataatgcttatgtaattaaaaaatcatcaaacatgtaaaaagaaaa

SEQ ID NO: 405 - DNA, 896 bp, Homo sapiens
ccagagaggggcaggctggtcccctgacaggttgaagcaagtagacgcccaggagccccgggagggggctgcagtttccttccttccttctcggcagcgctccgcgcccccatcgcccctcctgcgctagcggaggtgatcgccgcggcgatgccggaggagggttcgggctgctcggtgcggcgcaggccctatgggtgcgtcctgcgggctgctttggtcccattggtcgcgggcttggtgatctgcctcgtggtgtgcatccagcgcttcgcacaggctcagcagcagctgccgctcgagtcacttgggtgggacgtagctgagctgcagctgaatcacacaggacctcagcaggaccccaggctatactggcaggggggcccagcactgggccgctccttcctgcatggaccagagctggacaaggggcagctacgtatccatcgtgatggcatctacatggtacacatccaggtgacgctggccatctgctcctccacgacggcctccaggcaccaccccaccaccctggccgtgggaatctgctctcccgcctcccgtagcatcagcctgctgcgtctcagcttccaccaaggttgtaccattgcctcccagcgcctgacgcccctggcccgaggggacacactctgcaccaacctcactgggacacttttgccttcccgaaacactgatgagaccttctttggagtgcagtgggtgcgcccctgaccactgctgctgattagggttttttaaattttattttattttatttaagttcaagagaaaaagtgtacacacaggggccacccggggttggggtgggagtgtggtggggcgtagtggtggcaggacaagagaaggcattgagctttttctttcattttcctatt

SEQ ID NO: 406 - DNA, 915 bp, Homo sapiens
aagtagacgcccaggagccccgggagggggctgcagtttccttccttccttctcggcagcgctccgcgcccccatcgcccctcctgcgctagcggaggtgatcgccgcggcgatgccggaggagggttcgggctgctcggtgcggcgcaggccctatgggtgcgtcctgcgggctgctttggtcccattggtcgcgggcttggtgatctgcctcgtggtgtgcatccagcgcttcgcacaggctcagcagcagctgccgctcgagtcacttgggtgggacgtagctgagctgcagctgaatcacacaggacctcagcaggaccccaggctatactggcaggggggcccagcactgggccgctccttcctgcatggaccagagctggacaaggggcagctacgtatccatcgtgatggcatctacatggtacacatccaggtgacgctggccatctgctcctccacgacggcctccaggcaccaccccaccaccctggccgtgggaatctgctctcccgcctcccgtagcatcagcctgctgcgtctcagcttccaccaagggctttttggattttggaactggggactcaaagtcaagtgcttcttacggcatttaatatggactgcacactgttttatcccattaactcagctcgtgttcatgcaagccctacaaagctggaggaatcatcattgttcccatttcacagatgaggaaaacagaggcgtaaaccgttgagtcatctgtccaaagttactggttttgtaacagctggaacctcagtatttaacagttgaggaaaatagtggcagaaaacctgagtcacaagcccgaggcaattcatctacatagtagtggactcaggattccaagccagataatcccgcatcttgcatccatgatctcacttctag

SEQ ID NO: 407 - DNA, 1733 bp, Homo sapiens
agcgcggtgagtttgaaactgctcgcacttggcttcaaagctggctcttggaaattgagcggagagcgacgcggttgttgtagctgccgctgcggccgccgcggaataataagccgggatctaccatacccattgactaactatggaagattataccaaaatagagaaaattggagaaggtacctatggagttgtgtataagggtagacacaaaactacaggtcaagtggtagccatgaaaaaaatcagactagaaagtgaagaggaaggggttcctagtactgcaattcgggaaatttctctattaaaggaacttcgtcatccaaatatagtcagtcttcaggatgtgcttatgcaggattccaggttatatctcatctttgagtttctttccatggatctgaagaaatacttggattctatccctcctggtcagtacatggattcttcacttgttaaggtagtaacactctggtacagatctccagaagtattgctggggtcagctcgttactcaactccagttgacatttggagtataggcaccatatttgctgaactagcaactaagaaaccacttttccatggggattcagaaattgatcaactcttcaggattttcagagctttgggcactcccaataatgaagtgtggccagaagtggaatctttacaggactataagaatacatttcccaaatggaaaccaggaagcctagcatcccatgtcaaaaacttggatgaaaatggcttggatttgctctcgaaaatgttaatctatgatccagccaaacgaatttctggcaaaatggcactgaatcatccatattttaatgatttggacaatcagattaagaagatgtagctttctgacaaaaagtttccatatgttatatcaacagatagttgtgtttttattgttaactcttgtctatttttgtcttatatatatttctttgttatcaaacttcagctgtacttcgtcttctaatttcaaaaatataacttaaaaatgtaaatattctatatgaatttaaatataattctgtaaatgtgtgtaggtctcactgtaacaactatttgttactataataaaactataatattgatgtcaggaatcaggaaaaaatttgagttggcttaaatcatctcagtccttatggcagttttattttcctgtagttggaactactaaaatttaggaaaatgctaagttcaagtttcgtaatgctttgaagtatttttatgctctgaatgtttaaatgttctcatcagtttcttgccatgttgttaactatacaacctggctaaagatgaatatttttctactggtattttaatttttgacctaaatgtttaagcattcggaatgagaaaactatacagatttgagaaatgatgctaaatttataggagttttcagtaacttaaaaagctaacatgagagcatgccaaaatttgctaagtcttacaaagatcaagggctgtccgcaacagggaagaacagttttgaaaatttatgaactatcttatttttaggtaggttttgaaagctttttgtctaagtgaattcttatgccttggtcagagtaataactgaaggagttgcttatcttggctttcgagtctgagtttaaaactacacattttgacatagtgtttattagcagccatctaaaaaggctctaatgtatatttaactaaaattactagctttgggaattaaactgttt

SEQ ID NO: 408 - DNA, 1613 bp, Homo sapiens
ccattgactaactatggaagattataccaaaatagagaaaattggagaaggtacctatggagttgtgtataagggtagacacaaaactacaggtcaagtggtagccatgaaaaaaatcagactagaaagtgaagaggaaggggttcctagtactgcaattcgggaaatttctctattaaaggaacttcgtcatccaaatatagtcagtcttcaggatgtgcttatgcaggattccaggttatatctcatctttgagtttctttccatggatctgaagaaatacttggattctatccctcctggtcagtacatggattcttcacttgttaaggtagtaacactctggtacagatctccagaagtattgctggggtcagctcgttactcaactccagttgacatttggagtataggcaccatatttgctgaactagcaactaagaaaccacttttccatggggattcagaaattgatcaactcttcaggattttcagagctttgggcactcccaataatgaagtgtggccagaagtggaatctttacaggactataagaatacatttcccaaatggaaaccaggaagcctagcatcccatgtcaaaaacttggatgaaaatggcttggatttgctctcgaaaatgttaatctatgatccagccaaacgaatttctggcaaaatggcactgaatcatccatattttaatgatttggacaatcagattaagaagatgtagctttctgacaaaaagtttccatatgttatatcaacagatagttgtgtttttattgttaactcttgtctatttttgtcttatatatatttctttgttatcaaacttcagctgtacttcgtcttctaatttcaaaaatataacttaaaaatgtaaatattctatatgaatttaaatataattctgtaaatgtgtgtaggtctcactgtaacaactatttgttactataataaaactataatattgatgtcaggaatcaggaaaaaatttgagttggcttaaatcatctcagtccttatggcagttttattttcctgtagttggaactactaaaatttaggaaaatgctaagttcaagtttcgtaatgctttgaagtatttttatgctctgaatgtttaaatgttctcatcagtttcttgccatgttgttaactatacaacctggctaaagatgaatatttttctactggtattttaatttttgacctaaatgtttaagcattcggaatgagaaaactatacagatttgagaaatgatgctaaatttataggagttttcagtaacttaaaaagctaacatgagagcatgccaaaatttgctaagtcttacaaagatcaagggctgtccgcaacagggaagaacagttttgaaaatttatgaactatcttatttttaggtaggttttgaaagctttttgtctaagtgaattcttatgccttggtcagagtaataactgaaggagttgcttatcttggctttcgagtctgagtttaaaactacacattttgacatagtgtttattagcagccatctaaaaaggctctaatgtatatttaactaaaattactagctttgggaattaaactgtttaacaaataa

SEQ ID NO: 409 - DNA, 1913 bp, Homo sapiens
agcgcggtgagtttgaaactgctcgcacttggcttcaaagctggctcttggaaattgagcggagagcgacgcggttgttgtagctgccgctgcggccgccgcggaataataagccgggatctaccatacccattgactaactatggaagattataccaaaatagagaaaattggagaaggtacctatggagttgtgtataagggtagacacaaaactacaggtcaagtggtagccatgaaaaaaatcagactagaaagtgaagaggaaggggttcctagtactgcaattcgggaaatttctctattaaaggaacttcgtcatccaaatatagtcagtcttcaggatgtgcttatgcaggattccaggttatatctcatctttgagtttctttccatggatctgaagaaatacttggattctatccctcctggtcagtacatggattcttcacttgttaagagttatttataccaaatcctacaggggattgtgttttgtcactctagaagagttcttcacagagacttaaaacctcaaaatctcttgattgatgacaaaggaacaattaaactggctgattttggccttgccagagcttttggaatacctatcagagtatatacacatgaggtagtaacactctggtacagatctccagaagtattgctggggtcagctcgttactcaactccagttgacatttggagtataggcaccatatttgctgaactagcaactaagaaaccacttttccatggggattcagaaattgatcaactcttcaggattttcagagctttgggcactcccaataatgaagtgtggccagaagtggaatctttacaggactataagaatacatttcccaaatggaaaccaggaagcctagcatcccatgtcaaaaacttggatgaaaatggcttggatttgctctcgaaaatgttaatctatgatccagccaaacgaatttctggcaaaatggcactgaatcatccatattttaatgatttggacaatcagattaagaagatgtagctttctgacaaaaagtttccatatgttatatcaacagatagttgtgtttttattgttaactcttgtctatttttgtcttatatatatttctttgttatcaaacttcagctgtacttcgtcttctaatttcaaaaatataacttaaaaatgtaaatattctatatgaatttaaatataattctgtaaatgtgtgtaggtctcactgtaacaactatttgttactataataaaactataatattgatgtcaggaatcaggaaaaaatttgagttggcttaaatcatctcagtccttatggcagttttattttcctgtagttggaactactaaaatttaggaaaatgctaagttcaagtttcgtaatgctttgaagtatttttatgctctgaatgtttaaatgttctcatcagtttcttgccatgttgttaactatacaacctggctaaagatgaatatttttctactggtattttaatttttgacctaaatgtttaagcattcggaatgagaaaactatacagatttgagaaatgatgctaaatttataggagttttcagtaacttaaaaagctaacatgagagcatgccaaaatttgctaagtcttacaaagatcaagggctgtccgcaacagggaagaacagttttgaaaatttatgaactatcttatttttaggtaggttttgaaagctttttgtctaagtgaattcttatgccttggtcagagtaataactgaaggagttgcttatcttggctttcgagtctgagtttaaaactacacattttgacatagtgtttattagcagccatctaaaaaggctctaatgtatatttaactaaaattactagctttgggaattaaactgtttaacaaataa

SEQ ID NO: 410 - DNA, 1948 bp, Homo sapiens
gctggctcttggaaattgagcggagagcgacgcggttgttgtagctgccgctgcggccgccgcggaataataagccgggtacagtggctggggtcagggtcgtgtctaggggacggccgagggcctcggagggcgagtattgaggaacggggtcctctaagaaggccggactggaggatctaccatacccattgactaactatggaagattataccaaaatagagaaaattggagaaggtacctatggagttgtgtataagggtagacacaaaactacaggtcaagtggtagccatgaaaaaaatcagactagaaagtgaagaggaaggggttcctagtactgcaattcgggaaatttctctattaaaggaacttcgtcatccaaatatagtcagtcttcaggatgtgcttatgcaggattccaggttatatctcatctttgagtttctttccatggatctgaagaaatacttggattctatccctcctggtcagtacatggattcttcacttgttaagagttatttataccaaatcctacaggggattgtgttttgtcactctagaagagttcttcacagagacttaaaacctcaaaatctcttgattgatgacaaaggaacaattaaactggctgattttggccttgccagagcttttggaatacctatcagagtatatacacatgaggcaataacactctggtacagatctccagaagtattgctggggtcagctcgttactcaactccagttgacatttggagtataggcaccatatttgctgaactagcaactaagaaaccacttttccatggggattcagaaattgatcaactcttcaggattttcagagctttgggcactcccaataatgaagtgtggccagaagtggaatctttacaggactataagaatacatttcccaaatggaaaccaggaagcctagcatcccatgtcaaaaacttggatgaaaatggcttggatttgctctcgaaaatgttaatctatgatccagccaaacgaatttctggcaaaatggcactgaatcatccatattttaatgatttggacaatcagattaagaagatgtagctttctgacaaaaagtttccatatgttatatcaacagatagttgtgtttttattgttaactcttgtctatttttgtcttatatatatttctttgttatcaaacttcagctgtacttcgtcttctaatttcaaaaatataacttaaaaatgtaaatattctatatgaatttaaatataattctgtaaatgtgtgtaggtctcactgtaacaactatttgttactataataaaactataatattgatgtcaggaatcaggaaaaaatttgagttggcttaaatcatctcagtccttatggcagttttattttcctgtagttggaactactaaaatttaggaaaatgctaagttcaagtttcgtaatgctttgaagtatttttatgctctgaatgtttaaatgttctcatcagtttcttgccatgttgttaactatacaacctggctaaagatgaatatttttctactggtattttaatttttgacctaaatgtttaagcattcggaatgagaaaactatacagatttgagaaatgatgctaaatttataggagttttcagtaacttaaaaagctaacatgagagcatgccaaaatttgctaagtcttacaaagatcaagggctgtccgcaacagggaagaacagttttgaaaatttatgaactatcttatttttaggtaggttttgaaagctttttgtctaagtgaattcttatgccttggtcagagtaataactgaaggagttgcttatcttggctttcgagtctgagtttaaaactacacattttgacatagtgtttattagcagccatctaaaaaggctctaatgtatatttaactaaaattactagctttg

SEQ ID NO: 411 - DNA, 723 bp, Homo sapiens
agccgccctttcctctttctttcgcgctctagccacccgggaaggcctgcccagcgtagctgggctctgattggctgctttgaaagtctacgggctacccgattggtgaatccggggccctttagcgcggatctaccatacccattgactaactatggaagattataccaaaatagagaaaattggagaaggtacctatggagttgtgtataagggtagacacaaaactacaggtcaagtggtagccatgaaaaaaatcagactagaaagtgaagaggaaggggttcctagtactgcaattcgggaaatttctctattaaaggaacttcgtcatccaaatatagtcagtcttcaggatgtgcttatgcaggattccaggttatatctcatctttgagtttctttccatggatctgaagaaatacttggattctatccctcctggtcagtacatggattcttcacttgttaagagttatttataccaaatcctacaggggattgtgttttgtcactctagaagagttcttcacagagacttaaaacctcaaaatctcttgattgatgacaaaggaacaattaaactggctgattttggccttgccagagcttttggaatacctatcagagtatatacacatgaggcaataacactctggtacagatctccagaagtattgctggggtcagctcgttactcaactccagttgacatttggagtat

SEQ ID NO: 412 - DNA, 1758 bp, Homo sapiens
actaaaatccagcctcgaaggggcacagctgttctcccagccctgcggtcagctgttccctgtgaggtcatcatcgctcacaggcattccccagtcaattctggggtcactaggtggcttggggagaggtggaaacccgtgctgaggtcgtcaagaggccgttgggaacacaatgccaccaaccaggtcagcgctgggccgccagtgcccgggatctaggccgccaaaccccaaacccctaaccgagagcgctccgcccccatttccgctgcattctggaacgcgtagtcccggagcggcccttttcaagagggctgggagcacataaaaggaataacaacagcggggcacactgggaaccacggcgccgcggcggggcgcccggaaaacggacacgcgttgcttcctgggacttgaagtccaaggtttgcctccgcggtagaaacggagccctggagtcgagtgctgcagagagcgtgagcgcagacggctgggggttgtagtcttcttgtcctcggtctcgggcattgcggggagacctagtcgttttaggactacaagccccagaaggccctgcgcgggcagacggggcggggctggaggctcaggtgccgcctcctctgcaacgccggggccagagtcttaaaaccgagggcccgcaggggtccccgcggccgccgcgatgcagaaatacgagaaactggaaaagattggggaaggcacctacggaactgtgttcaaggccaaaaaccgggagactcatgagatcgtggctctgaaacgggtgaggctggatgacgatgatgagggtgtgccgagttccgccctccgggagatctgcctactcaaggagctgaagcacaagaacatcgtcaggcttcatgacgtcctgcacagcgacaagaagctgactttggtttttgaattctgtgaccaggacctgaagaagtattttgacagttgcaatggtgacctcgatcctgagattgtaaagtcattcctcttccagctactaaaagggctgggattctgtcatagccgcaatgtgctacacagggacctgaagccccagaacctgctaataaacaggaatggggagctgaaattggctgattttggcctggctcgagcctttgggattcccgtccgctgttactcagctgaggtggtcacactgtggtaccgcccaccggatgtcctctttggggccaagctgtactccacgtccatcgacatgtggtcagccggctgcatctttgcagagctggccaatgctgggcggcctctttttcccggcaatgatgtcgatgaccagttgaagaggatcttccgactgctggggacgcccaccgaggagcagtggccctctatgaccaagctgccagactataagccctatccgatgtacccggccacaacatccctggtgaacgtcgtgcccaaactcaatgccacagggagggatctgctgcagaaccttctgaagtgtaaccctgtccagcgtatctcagcagaagaggccctgcagcacccctacttctccgacttctgtccgccctaggccccgggacccccggcctccaggctggggcctggcctatttaagccccctcttgagaggggtgagacagtgggggtgcctggtgcgctgtgctccagcagtgctgggcccagccggggtggggtgcctgagcccgaatttctcactccctttgtggactttatttaatttcataaattggctcctttcccacagtc

SEQ ID NO: 413 - DNA, 4325 bp, Homo sapiens
ggctgctgttgggcggcggcgcggagcgggcggcgagctgtgcgggaggggcggccccgaggggcggggcgggccgacgccgcgtgtcccgccgcagccgcggagtccggctcctagatggggcccggcgcgtagaggtgcctcccgctcgttgccgcgtcctacccgcaccgtgcgcggctcgagctgaggacaccaacggccgcgactccccggcgagaccaggccggagcgtggacggcgcgcgcgccccgcgagggagggcgctgaggcgcgcgccggaagcgggagcgggagcgggagcgcggcggcggcggcgaaggtgcgggcggccgagcggggggcggggctgcggtgcctgcagaaccttggacagaagctccctagctgccgccgccgccgccgccgccgtcgccgccgccgagcgcgagcccagccgatccccgccgagcgcccccgagcgccgccgagcgccgggaccgcggcggcggggccgcggcgcgcattgcggagggcgcggagcgcaggagctgccgcctgccgggcagatccaagggggcagcacgcttcccgggagcgcccccgcctcctctccggggccgccgcaggctcggtgagcggttttatccctccggccggcaggctgggcgcgcaggggcgcgagcccccgcccggcgcgcagcagcaccatgggcacggtgctgtccctgtctcccagctaccggaaggccacgctgtttgaggatggcgcggccaccgtgggccactatacggccgtacagaacagcaagaacgccaaggacaagaacctgaagcgccactccatcatctccgtgctgccttggaagagaatcgtggccgtgtcggccaagaagaagaactccaagaaggtgcagcccaacagcagctaccagaacaacatcacgcacctcaacaatgagaacctgaagaagtcgctgtcgtgcgccaacctgtccacattcgcccagcccccaccggcccagccgcctgcacccccggccagccagctctcgggttcccagaccgggggctcctcctcagtcaagaaagcccctcaccctgccgtcacctccgcagggacgcccaaacgggtcatcgtccaggcgtccaccagtgagctgcttcgctgcctgggtgagtttctctgccgccggtgctaccgcctgaagcacctgtcccccacggaccccgtgctctggctgcgcagcgtggaccgctcgctgcttctgcagggctggcaggaccagggcttcatcacgccggccaacgtggtcttcctctacatgctctgcagggatgttatctcctccgaggtgggctcggatcacgagctccaggccgtcctgctgacatgcctgtacctctcctactcctacatgggcaacgagatctcctacccgctcaagcccttcctggtggagagctgcaaggaggccttttgggaccgttgcctctctgtcatcaacctcatgagctcaaagatgctgcagataaatgccgacccacactacttcacacaggtcttctccgacctgaagaacgagagcggccaggaggacaagaagcggctcctcctaggcctggatcggtgagcactgtagcctgcgtcatggctcaaggattcaatgcatttttaagaatttattattaaatcagttttgtgtacagtatgtgtctagcaaagccaccaagggcctcacctttcccacagtctctccctggggtttttttcatccctgccaagaactctgggcacttttgaactcacgagccttgcgcaaaacccagaagatgtattcagagccacccaggccactgacctcccactttggggaactcaaaggactgacctgcccctgccgcctgtgcccttgctgggtccagggtaggcaaggctgccggctgcaccctgtatggagctagagaggggcctctggctgcctggcccagggaggaattggggtttctggttggaggcccttttctggctcctgtgtggagttattcactctcccagaggctcctggagccagccaccctaactgagctgccagtggggtcgtgaggcaagatccccgccacccggggacatcttcaatctaggcgaggcgaagctgagcgggtctagtggaaagattgtgtctggtcgtttgaccacacaccgccctgatttgctgttttctttttttagggagaagggcttttctttagtggagaaatggaactcgcccccctacccccttgtctgctgctcccagccacgttggtggtattggccgatgagctggtttgactcattaatttctctcaatttgggtcccagctaaagaggtggggtgaagctggggacagctttcctgggtgagtttttcttttgaataatgtagtgcagtcaccctgtggcaaatgccaggacagctgcaggtgcccattagcaacgcctgccttctgggcaaggtgagggatgccataccttgagaccaagccggtgcccacctaagggctaaggcctcttgctggtgcacatgacatttgtcctgcagagctggggggaaggcgatgtggtgaccccacccccacccgttaatttaaagctgtttctaaacagttgagtttcttctaaagaggaagccttgcccagcaaggaccagtgagacagccggatcttggagacaattacaagacggggagtgagactcctgattgctctggaagcctgctgatttctacaactgatcatttgcagctgctggttttggtttccaccttaccctactggctgtaaaaacacaaatgtgtactttattgattttctttctaattctcccgcattggtggcttgggacttgggagagggagcaagccttcctccatggcccatcactcggctgtggagaacaaagaccaatgtgaagacactacagaggattctgtcttccaggcccagtccactggggagtgctggaatggggacctggggtggggaggcagagggtcactttacataggattaagttcgaggtggctaccgatttcagcacatgcactactgaaatttacacaaaaagaaagctgtgaaattgaagtcccaatttaagagtcctgaggcagaacctggtggctggaggcattcccagaggtggggaagagagcctgcccggccggagaacatctgccttgctgcacctgaggcccagcagagccgttcctgggactgtcagataatcggtgcagcggtggaaggagcctgcggctgctggcacagacttcacacagcacctcctctctgctgggtttccacacagcctgtcttcagatcctgctgccgcgtgcgaccagaggtgggaggcccctggtggcatggaagagggagggtcagtgccaagtctcaggaggagggcgcatgtgtgtatcaccctcagctggcggaacctggctgcgaactgtgcagttacgttgcatccacaggattccagttgcgtgtctgtttccttctctttctccgtatttatttttttattcttcggaggaggtggacatttcggaagtggtggggactaagggaagaactctctagttccctcagtgtgaagcctgtcgtgttctctccccttgcactggtcatcagtattgtgtaaaggaacaactgatatacttgagtgtgcaagcaaagaacccatttgccatgctgctatgaagactacttttagatcaacaataaaaaaaaacctacaaaaaaacctttattctttaattgttgcttttacggtgatattgtgcatgcaaaccaggagcattttgtgtcttaagaaaaataatcttagaacagatggctgtgaaaattacacccatgcacagaacaagccacaggaataatagttcaggatttggtttttctctttttcttgtaaacctggagggttgatatattctttccatgcagttattagaacttagttttgttccaacagttaaacttgcaatgaaaagaaaatgtgccatttttttcactcagaattattcatagctgtatatttgaaactgctaattacacacgtgtgatgtatgttggttttttagtgcaatttcttctgtagctattctttgaccaaactgtgggtattgttaatattaatttatatttgtctcattttgtatgtatgtgtagtgtgtttgtgagtatgtgtggtttataatctgacaaagtcatgaagctcagtttggctgtaatttaattccccttcccttatttttatttatttttgtactgtgctgattcaataaaatgcactgaccatccatta

SEQ ID NO: 414 - DNA, 2295 bp, Homo sapiens
tttactcctaacgcgtggaacttgtgtcgacatccacccccggttactgcatactcagtcacacaagccatagcaggaaacagcgagcttgcagcctcaccgacgagtctcaactaaaagggactcccggagctaggggtggggactcggcctcacacagtgagtgccggctattggacttttgtccagtgacagctgagacaacaaggaccacgggaggaggtgtaggagagaagcgccgcgaacagcgatcgcccagcaccaagtccgcttccaggctttcggtttctttgcctccatcttgggtgcgccttcccggcgtctaggggagcgaaggctgaggtggcagcggcaggagagtccggccgcgacaggacgaactcccccactggaaaggattctgaaagaaatgaagtcagccctcagaaatgaagttgactgcctgctggctttctgttgactggcccggagctgtactgcaagacccttgtgagcttccctagtctaagagtaggatgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagaaaagctgtggagacccacctgctcaggaaccctcaccttgtttcggactatagagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctgttcaaggagcagggacaagttacaggaatgttctccaagcagcaatccaaaagagtctcaaggatccttcaaataacttcaggctccataatgggagaagtaaagaacaaagacttaaggaacagcttggcgctcaacaagaaccagtgaagaaatccattcaggaatcagaagcttttttgcctcagagcatacctgaagagagatacaagatgaagagcaagcccctaggaatctgcctgataatcgattgcattggcaatgagacagagcttcttcgagacaccttcacttccctgggctatgaagtccagaaattcttgcatctcagtatgcatggtatatcccagattcttggccaatttgcctgtatgcccgagcaccgagactacgacagctttgtgtgtgtcctggtgagccgaggaggctcccagagtgtgtatggtgtggatcagactcactcagggctccccctgcatcacatcaggaggatgttcatgggagattcatgcccttatctagcagggaagccaaagatgttttttattcagaactatgtggtgtcagagggccagctggaggacagcagcctcttggaggtggatgggccagcgatgaagaatgtggaattcaaggctcagaagcgagggctgtgcacagttcaccgagaagctgacttcttctggagcctgtgtactgcggacatgtccctgctggagcagtctcacagctcaccatccctgtacctgcagtgcctctcccagaaactgagacaagaaagaaaacgcccactcctggatcttcacattgaactcaatggctacatgtatgattggaacagcagagtttctgccaaggagaaatattatgtctggctgcagcacactctgagaaagaaacttatcctctcctacacataagaaaccaaaaggctgggcgtagtggctcacacctgtaatcccagcactttgggaggccaaggagggcagatcacttcaggtcaggagttcgagaccagcctggccaacatggtaaacgctgtccctagtaaaaatacaaaaattagctgggtgtgggtgtgggtacctgtattcccagttacttgggaggctgaggtgggaggatcttttgaacccaggagttcagggtcatagcatgctgtgattgtgcctacgaatagccactgcataccaacctgggcaatatagcaagatcccatctctttaaaaaaaaaaaaaaaggacaggaactatctta

SEQ ID NO: 415 - DNA, 1841 bp, Homo sapiens
caagccatagcaggaaacagcgagcttgcagcctcaccgacgagtctcaactaaaagggactcccggagctaggggtggggactcggcctcacacagtgagtgccggctattggacttttgtccagtgacagctgagacaacaaggaccacgggaggaggtgtaggagagaagcgccgcgaacagcgatcgcccagcaccaagtccgcttccaggctttcggtttctttgcctccatcttgggtgcgccttcccggcgtctaggggagcgaaggctgaggtggcagcggcaggagagtccggccgcgacaggacgaactcccccactggaaaggattctgaaagaaatgaagtcagccctcagaaatgaagttgactgcctgctggctttctgttgactggcccggagctgtactgcaagacccttgtgagcttccctagtctaagagtaggatgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagaaaagctgtggagacccacctgctcaggaaccctcaccttgtttcggactatagagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctgttcaaggagcagggacaagttacaggaatgttctccaagcagcaatccaaaagagtctcaaggatccttcaaataacttcaggctccataatgggagaagtaaagaacaaagacttaaggaacagcttggcgctcaacaagaaccagtgaagaaatccattcaggaatcagaagcttttttgcctcagagcatacctgaagagagatacaagatgaagagcaagcccctaggaatctgcctgataatcgattgcattggcaatgagacagagcttcttcgagacaccttcacttccctgggctatgaagtccagaaattcttgcatctcagtatgcatggtatatcccagattcttggccaatttgcctgtatgcccgagcaccgagactacgacagctttgtgtgtgtcctggtgagccgaggaggctcccagagtgtgtatggtgtggatcagactcactcagggctccccctgcatcacatcaggaggatgttcatgggagattcatgcccttatctagcagggaagccaaagatgttttttattcagaactatgtggtgtcagagggccagctggaggacagcagcctcttggaggtggatgggccagcgatgaagaatgtggaattcaaggctcagaagcgagggctgtgcacagttcaccgagaagctgacttcttctggagcctgtgtactgcggacatgtccctgctggagcagtctcacagctcaccatccctgtacctgcagtgcctctcccagaaactgagacaagaaagggggacaattcccggaagtggaattacagagtcaaaggacatgcatttttcaagcctcggatgcatcttactagatgtcctatag

SEQ ID NO: 416 - DNA, 1787 bp, Homo sapiens
caagccatagcaggaaacagcgagcttgcagcctcaccgacgagtctcaactaaaagggactcccggagctaggggtggggactcggcctcacacagtgagtgccggctattggacttttgtccagtgacagctgagacaacaaggaccacgggaggaggtgtaggagagaagcgccgcgaacagcgatcgcccagcaccaagtccgcttccaggctttcggtttctttgcctccatcttgggtgcgccttcccggcgtctaggggagcgaaggctgaggtggcagcggcaggagagtccggccgcgacaggacgaactcccccactggaaaggattctgaaagaaatgaagtcagccctcagaaatgaagttgactgcctgctggctttctgttgactggcccggagctgtactgcaagacccttgtgagcttccctagtctaagagtaggatgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagaaaagctgtggagacccacctgctcaggaaccctcaccttgtttcggactatagagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctgttcaaggagcagggacaagttacaggaatgttctccaagcagcaatccaaaagagtctcaaggatccttcaaataacttcagggaagaaccagtgaagaaatccattcaggaatcagaagcttttttgcctcagagcatacctgaagagagatacaagatgaagagcaagcccctaggaatctgcctgataatcgattgcattggcaatgagacagagcttcttcgagacaccttcacttccctgggctatgaagtccagaaattcttgcatctcagtatgcatggtatatcccagattcttggccaatttgcctgtatgcccgagcaccgagactacgacagctttgtgtgtgtcctggtgagccgaggaggctcccagagtgtgtatggtgtggatcagactcactcagggctccccctgcatcacatcaggaggatgttcatgggagattcatgcccttatctagcagggaagccaaagatgttttttattcagaactatgtggtgtcagagggccagctggaggacagcagcctcttggaggtggatgggccagcgatgaagaatgtggaattcaaggctcagaagcgagggctgtgcacagttcaccgagaagctgacttcttctggagcctgtgtactgcggacatgtccctgctggagcagtctcacagctcaccatccctgtacctgcagtgcctctcccagaaactgagacaagaaagggggacaattcccggaagtggaattacagagtcaaaggacatgcatttttcaagcctcggatgcatcttactagatgtcctatag

SEQ ID NO: 417 - DNA, 1689 bp, Homo sapiens
caagccatagcaggaaacagcgagcttgcagcctcaccgacgagtctcaactaaaagggactcccggagctaggggtggggactcggcctcacacagtgagtgccggctattggacttttgtccagtgacagctgagacaacaaggaccacgggaggaggtgtaggagagaagcgccgcgaacagcgatcgcccagcaccaagtccgcttccaggctttcggtttctttgcctccatcttgggtgcgccttcccggcgtctaggggagcgaaggctgaggtggcagcggcaggagagtccggccgcgacaggacgaactcccccactggaaaggattctgaaagaaatgaagtcagccctcagaaatgaagttgactgcctgctggctttctgttgactggcccggagctgtactgcaagacccttgtgagcttccctagtctaagagtaggatgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagaaaagctgtggagacccacctgctcaggaaccctcaccttgtttcggactatagagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctgttcaaggagcagggacaagttacaggaatgttctccaagcagcaatccaaaagagtctcaaggatccttcaaataacttcaggctccataatgggagaagtaaagaacaaagacttaaggaacagcttggcgctcaacaagaaccagtgaagaaatccattcaggaatcagaagcttttttgcctcagagcatacctgaagagagatacaagatgaagagcaagcccctaggaatctgcctgataatcgattgcattggcaatgagacagaaaacgcccactcctggatcttcacattgaactcaatggctacatgtatgattggaacagcagagtttctgccaaggagaaatattatgtctggctgcagcacactctgagaaagaaacttatcctctcctacacataagaaaccaaaaggctgggcgtagtggctcacacctgtaatcccagcactttgggaggccaaggagggcagatcacttcaggtcaggagttcgagaccagcctggccaacatggtaaacgctgtccctagtaaaaatacaaaaattagctgggtgtgggtgtgggtacctgtattcccagttacttgggaggctgaggtgggaggatcttttgaacccaggagttcagggtcatagcatgctgtgattgtgcctacgaatagccactgcataccaacctgggcaatatagcaagatcccatctcttt

SEQ ID NO: 418 - DNA, 4415 bp, Homo sapiens
gggtgcgccttcccggcgtctaggggagcgaaggctgaggtggcagcggcaggagagtccggccgcgacaggacgaactcccccactggaaaggattctgaaagaaatgaagtcagccctcagaaatgaagttgactgcctgctggctttctgttgactggcccggagctgtactgcaagacccttgtgagcttccctagtctaagagtaggatgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagaaaagctgtggagacccacctgctcaggaaccctcaccttgtttcggactatagagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctggtggatggaatggaacctggatgaccaaagcctcctttagcttgtggctagaaatcgcgtccctttatattcttcatatcccagatctgccaactccattgccctgtatattcatgatctctgcaaaatgctgccaagcagttcttaacatttcagtcttcaagaaagaatctgggatctgcacaggctggcagagctatggacattcaggggttttgcatgtatgctgaaccctactgccttgctctggtatttggcctcacaaccactgtccaacttcgggtgatgtcacttgggtctcataccttccttgcatgtgtcccaagtttcacaaaacctccttatggaaaagagcacattcgatttcttccttgataaaagggaccagattcacattggccttctgctttacttgcattcctcattgtcttttagactcagcctcagcttgggctttgttagcaagttcactgccaccatagcatcacagcctaaagggcatggctgagactcattgatctatagagcactcttttaccccaacatactctaaatgactgatcaaagatcaaaaacagaagagcatttatactccattcttgttttttgagacctgcttgatttattccgattatttaacacacagggacgcaacagtgatcccaaagtgtgtaaagttaaagccttcaactgcagctgaggagagggcaggaatggggacggtggtgagtcaggaatgacaggcaggcagccatgaccagggcagcctcctccccagggccagggactggggagtggcctaaggagcaggacctaagggtagcccagagctggggaagggggcagagacctccccttggcctaggtctggagctcagaagtgccacatgcctgagggggcagcggcctgggaagggccagaggcagggtcaggagagcaccatttcctggggggctggggacagggaggtgccctataggagaagccaggaggggccgtctgcccctgaggtgggggctgggctggagcaggctgcagcaagaaagacctgaggcaggcacagggcctgagagcccagctgcctgggttcaggggggctcccagggcagcctggcccagggagcagtcctgactctgcaggggatgcccagcaaggggggctgcagacccctcagagcctcccctcctctctccctggaaaggagctggggaacccatagtgcaaatctgtggaccactcagttatggagggaggctgtgcctgaaggtggacactggggtgcactccctccaccatctcgccctgcaccgctgtcctcagtacagccacttctcgtaagagtgcaggccatggatgccaccgtcgatctgggctgacatggtctgcttctcaaacttgagctcccctgagtacatcatggaccgaaggacagacaggctgtgggccccgatatcctggcagccatgctggatgcccactatgaggtagggcacgaacttctgaatggaccctttgtcctggatggagcccaagacatcctgcgtgatcttcgccttatccccgtcgttgaagtattgtttctggctgctgctgctcttctccatggcatccagtgagcccatgccctggtacttcttgagctgcattccgtctgagaagaagcactcgccgggggcctccatggtggcggccagcagggagcccatcatcactgtggaggctcctagggccagggccttgaccacatgccccatggtctggatgccaccatcggctatgatgggcacaccaaagttctgggtatgcttggccaccttgtacacagcagtgccctggggctgactgcaggctatcacttcctggttgatgtagatggagccgcgcagtccatgcccctgcccagcccatccacaccagcgtcaatcaggttgttggcctgggctgctgtcaccacgttccccccaatcacctggaggtggggttacttttgtttgatgtaatgcaccatggcgatctgatacaccgagttcccttgggacgagtccaagcctatgacattgacgcctacctgggtgagcaggtccaggtggtatttgtcatcctcatgggtacccacagctgccccgcccagcagctgctcatgggaatccttggaggccacagggtagtctcggttcttcagcgcggtgcaggtgataatggccaccagctcatcgcgatcattgacgataggcagcttcctttcttactaagctgcaggatctcatttgcctctttcaacctcacactgctggagccaccactagcttgatccttggcatcatcacctcactgaggagggtggtgtggtccttctcagcaagaaagtcgatgtctcgggaggtgacgatgcccaccagcttgctgcccatggtacccgtctcagtgatggggatgccagagaagccatgacgcatcttggcctccaacacatcacccacagtgtgcaaggggctcagcaccacggggtgtgtgataaagcccggttcaaacttcttgaccttctgcacctcactggcctggaactctggggtgcagttgtggtgaatgaaaccagtacctcccatcagagccatcacgatggccaggtcggcctctgtcacagtgtccatgggggaggagatcagcggcgtcttcagagtgaccattgggtcagggctgaggtcaggtccacctcatcagctatgaagtctatgaatcctgggagaatcaagaagtcgttgtaggtgagtccctggtcactggcgaagagctgctgcacggtgtggggaaaagaaagagagatcagattgttactgtgtctgtgtagaaagaagtagacataggagactccattttgttctgtactaagaaaaattcttctgcctcgagatgctgttaatctgtaaccttacccccaaccctgtgctccctgaaacatgtgctatgtcaactcagggttaagtggattaagggctgtgcaagatgtgctttgttaaacagatgcttgaaggcagcgtgctcgttaagagtcatcaccactccctaatctcaagtacccagggacacaaacactgcggaaggccgcagggacctctgcctaggaaagccaggtattgtccaaggtttctccccatgtgatagtctgaaatatggcctcatgggaagggaaagacctgaccgtcccccagcccgacacccataaagggtctgtgctgaggaggattagtaaaagaggaaggaacgcctgtttgcagttgagagaagaggaaggcatctgtctcctgccagtccctgggcaatggaatgtctcggtgtaaaacctgattgtatgttccatctgctgagataggggaaaaccgccttagggctggaggtgggacatgcgggcagcactactgctctttaagtcattgagatgtttatgtgtatgcatatctgaagcacagcacttaattctttaccttgttcttgatgcagagacctttgttcacgtgtttatctgctgaccttctctccactattattctatgaccctgccacacccccctctccgagaaacacctaaaaatgatcaataaatactaagggaactaagaggccggcgggatcctccgtatgctgaacgccggtcccctgggcccccttttttctttctct

SEQ ID NO: 419 - DNA, 684 bp, Homo sapiens
agtcaggctgtctgtcgttgggcttttcccacttccttctactacgtacttcttccctattcctcctactgaggccattaaacccttagttgtaattttccctgaacatgctttacattctgatgaattctgaaaaagaatgtggggtttccttgcagatgagttcatctgttgtttcatttcctttacaataactcccccactggaaaggattctgaaagaaatgaagtcagccctcagaaatgaagttgactgcctgctggctttctgttgactggcccggagctgtactgcaagacccttgtgagcttccctagtctaagagtaggatgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagaaaagctgtggagacccacctgctcaggaaccctcaccttgtttcggactatagagtgctgatggcagagattggtgaggatttggataaatctgatgtgtcctcattaattttcctcatgaaggatt

SEQ ID NO: 420 - DNA, 2128 bp, Homo sapiens
cactcagtcctggtggggtcgcacgtaacggtcctgagctatgcataagccgtttgaccacgcatggagaattttaccacccagagacacgcgagtggccctgtgcaagtttcaactgcgcggggggcggggaattccgcagacaggattctagaatttatgtcttgtgtggtaacatttcagccggtgggtggcggggattaggcgtgaagcggttcagcaggcagaggttctcggacgccctccggcgaagccacctgttgatgcttttgactttctgtccttgttcctcgtcccatctggagcatttccaattctggttttgcggagcagcaggtctgagcttgtccggcgagggtgggagttggtcccggcggagatccagtgggaagagccggcggctgcccgggcaactcccccactggaaaggattctgaaagaaatgaagtcagccctcagaaatgaagttgactgcctgctggctttctgttgactggcccggagctgtactgcaagacccttgtgagcttccctagtctaagagtaggatgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagaaaagctgtggagacccacctgctcaggaaccctcaccttgtttcggactatagagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctgttcaaggagcagggacaagttacaggaatgttctccaagcagcaatccaaaagagtctcaaggatccttcaaataacttcaggctccataatgggagaagtaaagaacaaagacttaaggaacagcttggcgctcaacaagaaccagtgaagaaatccattcaggaatcagaagcttttttgcctcagagcatacctgaagagagatacaagatgaagagcaagcccctaggaatctgcctgataatcgattgcattggcaatgagacagagcttcttcgagacaccttcacttccctgggctatgaagtccagaaattcttgcatctcagtatgcatggtatatcccagattcttggccaatttgcctgtatgcccgagcaccgagactacgacagctttgtgtgtgtcctggtgagccgaggaggctcccagagtgtgtatggtgtggatcagactcactcagggctccccctgcatcacatcaggaggatgttcatgggagattcatgcccttatctagcagggaagccaaagatgttttttattcagaactatgtggtgtcagagggccagctggaggacagcagcctcttggaggtggatgggccagcgatgaagaatgtggaattcaaggctcagaagcgagggctgtgcacagttcaccgagaagctgacttcttctggagcctgtgtactgcggacatgtccctgctggagcagtctcacagctcaccatccctgtacctgcagtgcctctcccagaaactgagacaagaaagaaaacgcccactcctggatcttcacattgaactcaatggctacatgtatgattggaacagcagagtttctgccaaggagaaatattatgtctggctgcagcacactctgagaaagaaacttatcctctcctacacataagaaaccaaaaggctgggcgtagtggctcacacctgtaatcccagcactttgggaggccaaggagggcagatcacttcaggtcaggagttcgagaccagcctggccaacatggtaaacgctgtccctagtaaaaatac

SEQ ID NO: 421 - DNA, 435 bp, Homo sapiens
cctttcgaaagttgttgggaacgtggactttcccaacaattgtgtatgcgctcgatctcactcagtgggagccgccgccctggagggaatttcacaatagcctgaactcccccactggaaaggattctgaaagaaatgaagtcagccctcagaaatgaagttgactgcctgctggctttctgttgactggcccggagctgtactgcaagacccttgtgagcttccctagtctaagagtaggatgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatt

SEQ ID NO: 422 - DNA, 655 bp, Homo sapiens
cacagcggtacaagctgcaccccgatggacctgagagaccggaagtaacccttggccaactctggccgccccctgcagccgcagccccagaggcccacccgcgagcttcagtggcgggccctcagcgtcgtaactcccccactggaaaggattctgaaagaaatgaagtcagccctcagaaatgaagttgactgcctgctggctttctgttgactggcccggagctgtactgcaagacccttgtgagcttccctagtctaagagtaggatgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagaaaagctgtggagacccacctgctcaggaaccctcaccttgtttcggactatagagtgctgatggcagagattggtgaggatttggataaatctgatgtgtcctcattaattttcctcatgaaggattacatgggccgaggcaagataagcaaggagaag

SEQ ID NO: 423 - DNA, 1679 bp, Homo sapiens
atactcagtcacacaagccatagcaggaaacagcgagcttgcagcctcaccgacgagtctcaactaaaagggactcccggagctaggggtggggactcggcctcacacagtgagtgccggctattggacttttgtccagtgacagctgagacaacaaggaccacgggaggaggtgtaggagagaagcgccgcgaacagcgatcgcccagcaccaagtccgcttccaggctttcggtttctttgcctccatcttgggtgcgccttcccggcgtctaggggagcgaaggctgaggtggcagcggcaggagagtccggccgcgacaggacgagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctgttcaaggagcagggacaagttacaggaatgttctccaagcagcaatccaaaagagtctcaaggatccttcaaataacttcaggctccataatgggagaagtaaagaacaaagacttaaggaacagcttggcgctcaacaagaaccagtgaagaaatccattcaggaatcagaagcttttttgcctcagagcatacctgaagagagatacaagatgaagagcaagcccctaggaatctgcctgataatcgattgcattggcaatgagacagagcttcttcgagacaccttcacttccctgggctatgaagtccagaaattcttgcatctcagtatgcatggtatatcccagattcttggccaatttgcctgtatgcccgagcaccgagactacgacagctttgtgtgtgtcctggtgagccgaggaggctcccagagtgtgtatggtgtggatcagactcactcagggctccccctgcatcacatcaggaggatgttcatgggagattcatgcccttatctagcagggaagccaaagatgttttttattcagaactatgtggtgtcagagggccagctggaggacagcagcctcttggaggtggatgggccagcgatgaagaatgtggaattcaaggctcagaagcgagggctgtgcacagttcaccgagaagctgacttcttctggagcctgtgtactgcggacatgtccctgctggagcagtctcacagctcaccatccctgtacctgcagtgcctctcccagaaactgagacaagaaagaaaacgcccactcctggatcttcacattgaactcaatggctacatgtatgattggaacagcagagtttctgccaaggagaaatattatgtctggctgcagcacactctgagaaagaaacttatcctctcctacacataagaaaccaaaaggctgggcgtagtggctcacacctgtaatcccagcactttgggaggccaaggagggcagatcacttcaggtcaggagttcgagaccagcctggccaacatggtaaacgctgtccctagtaaaaatacaaaaattagctgggtgtgggtgtgggtacctgtattcccagttacttgggag

SEQ ID NO: 424 - DNA, 2043 bp, Homo sapiens
taatacgactcactatagggaaataagagagaaaagaagagtaagaagaaatataagagccaccatgcacaaaactgcctcccaaagacttttcccaggtccctcgtatcaaaacattaagagtataatggaagatagcacgatcttgtcagattggacaaacagcaacaaacaaaaaatgaagtatgacttttcctgtgaactctacagaatgtctacatattcaactttccccgccggggtgcctgtctcagaaaggagtcttgctcgtgctggtttttattatactggtgtgaatgacaaggtcaaatgcttctgttgtggcctgatgctggataactggaaactaggagacagtcctattcaaaagcataaacagctatatcctagctgtagctttattcagaatctggtttcagctagtctgggatccacctctaagaatacgtctccaatgagaaacagttttgcacattcattatctcccaccttggaacatagtagcttgttcagtggttcttactccagcctttctccaaaccctcttaattctagagcagttgaagacatctcttcatcgaggactaacccctacagttatgcaatgagtactgaagaagccagatttcttacctaccatatgtggccattaacttttttgtcaccatcagaattggcaagagctggtttttattatataggacctggagatagggtagcctgctttgcctgtggtgggaagctcagtaactgggaaccaaaggatgatgctatgtcagaacaccggaggcattttcccaactgtccatttttggaaaattctctagaaactctgaggtttagcatttcaaatctgagcatgcagacacatgcagctcgaatgagaacatttatgtactggccatctagtgttccagttcagcctgagcagcttgcaagtgctggtttttattatgtgggtcgcaatgatgatgtcaaatgcttttgttgtgatggtggcttgaggtgttgggaatctggagatgatccatgggtagaacatgccaagtggtttccaaggtgtgagttcttgatacgaatgaaaggccaagagtttgttgatgagattcaaggtagatatcctcatcttcttgaacagctgttgtcaacttcagataccactggagaagaaaatgctgacccaccaattattcattttggacctggagaaagttcttcagaagatgctgtcatgatgaatacacctgtggttaaatctgccttggaaatgggctttaatagagacctggtgaaacaaacagttcaaagtaaaatcctgacaactggagagaactataaaacagttaatgatattgtgtcagcacttcttaatgctgaagatgaaaaaagagaagaggagaaggaaaaacaagctgaagaaatggcatcagatgatttgtcattaattcggaagaacagaatggctctctttcaacaattgacatgtgtgcttcctatcctggataatcttttaaaggccaatgtaattaataaacaggaacatgatattattaaacaaaaaacacagatacctttacaagcgagagaactgattgataccattttggttaaaggaaatgctgcggccaacatcttcaaaaactgtctaaaagaaattgactctacattgtataagaacttatttgtggataagaatatgaagtatattccaacagaagatgtttcaggtctgtcactggaagaacaattgaggaggttgcaagaagaacgaacttgtaaagtgtgtatggacaaagaagtttctgttgtatttattccttgtggtcatctggtagtatgccaggaatgtgccccttctctaagaaaatgccctatttgcaggggtataatcaagggtactgttcgtacatttctctcttgataataggctggagcctcggtggccatgcttcttgccccttgggcctccccccagcccctcctccccttcctgcacccgtacccccgtggtctttgaataaagtctgagtgggcggctctaga

SEQ ID NO: 425 - DNA, 5197 bp, Homo sapiens
ggccaggcgacaggtgtcgcttgaaaagactgggcttgtccttgctggtgcatgcgtcgtcggcctctgggcagcaggtttacaaaggaggaaaacgacttcttctagatttttttttcagtttcttctataaatcaaaacatctcaaaatggagacctaaaatccttaaagggacttagtctaatctcgggaggtagttttgtgcatgggtaaacaaattaagtattaactggtgttttactatccaaagaatgctaattttataaacatgatcgagttatataaggtataccataatgagtttgattttgaatttgatttgtggaaataaaggaaaagtgattctagctggggcatattgttaaagcatttttttcagagttggccaggcagtctcctactggcacattctcccattatgtagaatagaaatagtacctgtgtttgggaaagattttaaaatgagtgacagttatttggaacaaagagctaataatcaatccactgcaaattaaagaaacatgcagatgaaagttttgacacattaaaatacttctacagtgacaaagaaaaatcaagaacaaagctttttgatatgtgcaacaaatttagaggaagtaaaaagataaatgtgatgattggtcaagaaattatccagttatttacaaggccactgatattttaaacgtccaaaagtttgtttaaatgggctgttaccgctgagaatgatgaggatgagaatgatggttgaaggttacattttaggaaatgaagaaacttagaaaattaatataaagacagtgatgaatacaaagaagatttttataacaatgtgtaaaatttttggccagggaaaggaatattgaagttagatacaattacttacctttgagggaaataattgttggtaatgagatgtgatgtttctcctgccacctggaaacaaagcattgaagtctgcagttgaaaagcccaacgtctgtgagatccaggaaaccatgcttgcaaaccactggtaaaaaaaaaaaaaaaaaaaaaaaaaagccacagtgacttgcttattggtcattgctagtattatcgactcagaacctctttactaatggctagtaaatcataattgagaaattctgaattttgacaaggtctctgctgttgaaatggtaaatttattattttttttgtcatgataaattctggttcaaggtatgctatccatgaaataatttctgaccaaaactaaattgatgcaatttgattatccatcttagcctacagatggcatctggtaacttttgactgttttaaaaaataaatccactatcagagtagatttgatgttggcttcagaaacatttagaaaaacaaaagttcaaaaatgttttcaggaggtgataagttgaataactctacaatgttagttctttgagggggacaaaaaatttaaaatctttgaaaggtcttattttacagccatatctaaattatcttaagaaaatttttaacaaagggaatgaaatatatatcatgattctgtttttccaaaagtaacctgaatatagcaatgaagttcagttttgttattggtagtttgggcagagtctctttttgcagcacctgttgtctaccataattacagaggacatttccatgttctagccaagtatactattagaataaaaaaacttaacattgagttgcttcaacagcatgaaactgagtccaaaagaccaaatgaacaaacacattaatctctgattatttattttaaatagaatatttaattgtgtaagatctaatagtatcattatacttaagcaatcatattcctgatgatctatgggaaataactattatttaattaatattgaaaccaggttttaagatgtgttagccagtcctgttactagtaaatctctttatttggagagaaattttagattgttttgttctccttattagaaggattgtagaaagaaaaaaatgactaattggagaaaaattggggatatatcatatttcactgaattcaaaatgtcttcagttgtaaatcttaccattattttacgtacctctaagaaataaaagtgcttctaattaaaatatgatgtcattaattatgaaatacttcttgataacagaagttttaaaatagccatcttagaatcagtgaaatatggtaatgtattattttcctcctttgagttaggtcttgtgcttttttttcctggccactaaatttcacaatttccaaaaagcaaaataaacatattctgaatatttttgctgtgaaacacttgacagcagagctttccaccatgaaaagaagcttcatgagtcacacattacatctttgggttgattgaatgccactgaaacattctagtagcctggagaagttgacctacctgtggagatgcctgccattaaatggcatcctgatggcttaatacacatcactcttctgtgaagggttttaattttcaacacagcttactctgtagcatcatgtttacattgtatgtataaagattatacaaaggtgcaattgtgtatttcttccttaaaatgtatcagtataggatttagaatctccatgttgaaactctaaatgcatagaaataaaaataataaaaaatttttcattttggcttttcagcctagtattaaaactgataaaagcaaagccatgcacaaaactacctccctagagaaaggctagtcccttttcttccccattcatttcattatgaacatagtagaaaacagcatattcttatcaaatttgatgaaaagcgccaacacgtttgaactgaaatacgacttgtcatgtgaactgtaccgaatgtctacgtattccacttttcctgctggggttcctgtctcagaaaggagtcttgctcgtgctggtttctattacactggtgtgaatgacaaggtcaaatgcttctgttgtggcctgatgctggataactggaaaagaggagacagtcctactgaaaagcataaaaagttgtatcctagctgcagattcgttcagagtctaaattccgttaacaacttggaagctacctctcagcctacttttccttcttcagtaacaaattccacacactcattacttccgggtacagaaaacagtggatatttccgtggctcttattcaaactctccatcaaatcctgtaaactccagagcaaatcaagatttttctgccttgatgagaagttcctaccactgtgcaatgaataacgaaaatgccagattacttacttttcagacatggccattgacttttctgtcgccaacagatctggcaaaagcaggcttttactacataggacctggagacagagtggcttgctttgcctgtggtggaaaattgagcaattgggaaccgaaggataatgctatgtcagaacacctgagacattttcccaaatgcccatttatagaaaatcagcttcaagacacttcaagatacacagtttctaatctgagcatgcagacacatgcagcccgctttaaaacattctttaactggccctctagtgttctagttaatcctgagcagcttgcaagtgcgggtttttattatgtgggtaacagtgatgatgtcaaatgcttttgctgtgatggtggactcaggtgttgggaatctggagatgatccatgggttcaacatgccaagtggtttccaaggtgtgagtacttgataagaattaaaggacaggagttcatccgtcaagttcaagccagttaccctcatctacttgaacagctgctatccacatcagacagcccaggagatgaaaatgcagagtcatcaattatccattttgaacctggagaagaccattcagaagatgcaatcatgatgaatactcctgtgattaatgctgccgtggaaatgggctttagtagaagcctggtaaaacagacagttcagagaaaaatcctagcaactggagagaattatagactagtcaatgatcttgtgttagacttactcaatgcagaagatgaaataagggaagaggagagagaaagagcaactgaggaaaaagaatcaaatgatttattattaatccggaagaatagaatggcactttttcaacatttgacttgtgtaattccaatcctggatagtctactaactgccggaattattaatgaacaagaacatgatgttattaaacagaagacacagacgtctttacaagcaagagaactgattgatacgattttagtaaaaggaaatattgcagccactgtattcagaaactctctgcaagaagctgaagctgtgttatatgagcatttatttgtgcaacaggacataaaatatattcccacagaagatgtttcagatctaccagtggaagaacaattgcggagactacaagaagaaagaacatgtaaagtgtgtatggacaaagaagtgtccatagtgtttattccttgtggtcatctagtagtatgcaaagattgtgctccttctttaagaaagtgtcctatttgtaggagtacaatcaagggtacagttcgtacatttctttcatgaagaagaaccaaaacatcgtctaaactttagaattaatttattaaatgtattataactttaacttttatcctaatttggtttccttaaaatttttatttatttacaactcaaaaaacattgttttgtgtaacatatttatatatgtatctaaaccatatgaacatatattttttagaaactaagagaatgataggcttttgttcttatgaacgaaaaagaggtagcactacaaacacaatattcaatcaaaatttcagcattattgaaattgtaagtgaagtaaaacttaagatatttgagttaacctttaagaattttaaatattttggcattgtactaataccgggaacatgaagccaggtgtggtggtatgtgcctgtagtcccaggctgaggcaagagaattacttgagcccaggagtttgaatccatcctgggcagcatactgagaccctgcctttaaaaacaaacagaacaaaaacaaaacaccagggacacatttctctgtcttttttgatcagtgtcctatacatcgaaggtgtgcatatatgttgaatgacattttagggacatggtgtttttataaagaattctgtgagaaaaaatttaataaagcaacaaaaattactctta

SEQ ID NO: 426 - DNA, 4238 bp, Homo sapiens
gggcagcaggtttacaaaggaggaaaacgacttcttctagatttttttttcagtttcttctataaatcaaaactacctccctagagaaaggctagtcccttttcttccccattcatttcattatgaacatagtagaaaacagcatattcttatcaaatttgatgaaaagcgccaacacgtttgaactgaaatacgacttgtcatgtgaactgtaccgaatgtctacgtattccacttttcctgctggggttcctgtctcagaaaggagtcttgctcgtgctggtttctattacactggtgtgaatgacaaggtcaaatgcttctgttgtggcctgatgctggataactggaaaagaggagacagtcctactgaaaagcataaaaagttgtatcctagctgcagattcgttcagagtctaaattccgttaacaacttggaagctacctctcagcctacttttccttcttcagtaacaaattccacacactcattacttccgggtacagaaaacagtggatatttccgtggctcttattcaaactctccatcaaatcctgtaaactccagagcaaatcaagatttttctgccttgatgagaagttcctaccactgtgcaatgaataacgaaaatgccagattacttacttttcagacatggccattgacttttctgtcgccaacagatctggcaaaagcaggcttttactacataggacctggagacagagtggcttgctttgcctgtggtggaaaattgagcaattgggaaccgaaggataatgctatgtcagaacacctgagacattttcccaaatgcccatttatagaaaatcagcttcaagacacttcaagatacacagtttctaatctgagcatgcagacacatgcagcccgctttaaaacattctttaactggccctctagtgttctagttaatcctgagcagcttgcaagtgcgggtttttattatgtgggtaacagtgatgatgtcaaatgcttttgctgtgatggtggactcaggtgttgggaatctggagatgatccatgggttcaacatgccaagtggtttccaaggtgtgagtacttgataagaattaaaggacaggagttcatccgtcaagttcaagccagttaccctcatctacttgaacagctgctatccacatcagacagcccaggagatgaaaatgcagagtcatcaattatccattttgaacctggagaagaccattcagaagatgcaatcatgatgaatactcctgtgattaatgctgccgtggaaatgggctttagtagaagcctggtaaaacagacagttcagagaaaaatcctagcaactggagagaattatagactagtcaatgatcttgtgttagacttactcaatgcagaagatgaaataagggaagaggagagagaaagagcaactgaggaaaaagaatcaaatgatttattattaatccggaagaatagaatggcactttttcaacatttgacttgtgtaattccaatcctggatagtctactaactgccggaattattaatgaacaagaacatgatgttattaaacagaagacacagacgtctttacaagcaagagaactgattgatacgattttagtaaaaggaaatattgcagccactgtattcagaaactctctgcaagaagctgaagctgtgttatatgagcatttatttgtgcaacaggacataaaatatattcccacagaagatgtttcagatctaccagtggaagaacaattgcggagactacaagaagaaagaacatgtaaagtgtgtatggacaaagaagtgtccatagtgtttattccttgtggtcatctagtagtatgcaaagattgtgctccttctttaagaaagtgtcctatttgtaggagtacaatcaagggtacagttcgtacatttctttcatgaagaagaaccaaaacatcgtctaaactttagaattaatttattaaatgtattataactttaacttttatcctaatttggtttccttaaaatttttatttatttacaactcaaaaaacattgttttgtgtaacatatttatatatgtatctaaaccatatgaacatatattttttagaaactaagagaatgataggcttttgttcttatgaacgaaaaagaggtagcactacaaacacaatattcaatcaaaatttcagcattattgaaattgtaagtgaagtaaaacttaagatatttgagttaacctttaagaattttaaatattttggcattgtactaataccgggaacatgaagccaggtgtggtggtatgtgcctgtagtcccaggctgaggcaagagaattacttgagcccaggagtttgaatccatcctgggcagcatactgagaccctgcctttaaaaacaaacagaacaaaaacaaaacaccagggacacatttctctgtcttttttgatcagtgtcctatacatcgaaggtgtgcatatatgttgaatgacattttagggacatggtgtttttataaagaattctgtgagaaaaaatttaataaagcaacaaaaattactcttattcttcattgctttatttcaatgacattggatagtttagtcactcccagactctttccataccttcttaaagcctctcaaatattgaactacagtttatactccttcccataagatgcttcttcattgacacttgtagaacacggggtcaacacatcataaaatctattatggaatgcctgagacaagaatcaaacagtccctttagtaagtttgtttattcacttctctattgattcattcaagaagtctcatgccagccccacctattggaagaaggtctgagttttattcttatctctttggtattaattctgaaacttagaaagtacactggttagcaatgcttgggaccaacaggttgttctggtaaataaatctgtttcatattgtcagtgcaacaaaatgtccccctctgcattatgttattggtactcaacacgtccgagtcataactctgtcctttgcttcttatagaggtattaggtcttcaagagcagaagtaagactgtaatagggaatactcaggggaaggcaggcaaaggctagtcatctaaaccagttctagatgtctgtataggggcagatggctctgtaagggcagaagggaaagaccccttcataagggtcacagctgacaatcctataacaaaagacaggttaacaagagaaaaacttaacaaatttatttaatcacagatttacatcaccggggagccttcgtaatgaagatccaaaattacaggggaaactgtgcatttttatgcttaggtttgataatgaatggacagccctgaagaatagtgattggaaaaaaaggatatgatctaatgggaatagacacaggttggggacccagcaaggcctgtctgttcagattattcttggtctctgtgcagcattccttcctcctggatatagggcagggcctgtatgggatggggatattataacctgctatcaagcaaggtaggtcagagaatttatttatggccagctcttacatagttaggtgaggaaagattagagtactatctttaagatgtaagtctggcattgtggaaagatggttccagtttctatgacctaccttggggaagaggaattcaagtttctgtggcttgccttcagggagaatgaggctgagacaggagggcaggataacatcagagaaaaactttgcttctgaggccttcactttgggttttctgagccccaacatctgctagtgttgtaaagagaacaattagggaccaagtgaggggaggaaagaatccatctctgcattctgatgctgggagacttatttccttgaaatgcaattgattttgcctctgctaagaggctctgctggctacccatgtactagccagtgtcctgcatgggtgctaggctgaattatttgtaattgtgcttaggtgatttgtaactcaggtatagggtatttaaatagtaggcaccctttttgcaccatgtgtttttttttttatctagttcttgtatactacagataatatttgaactttgtcatctcactgtaaaacttttgttcatttctcattatggtaataaatagctattataaccaacccatttattcaaatatgttatttccctaagtgttattttgacattttgttttggaaaaaataaatcaccatagataataa

SEQ ID NO: 427 - DNA, 2001 bp, Homo sapiens
taatacgactcactatagggaaataagagagaaaagaagagtaagaagaaatataagagccaccatgaacatagtagaaaacagcatattcttatcaaatttgatgaaaagcgccaacacgtttgaactgaaatacgacttgtcatgtgaactgtaccgaatgtctacgtattccacttttcctgctggggttcctgtctcagaaaggagtcttgctcgtgctggtttctattacactggtgtgaatgacaaggtcaaatgcttctgttgtggcctgatgctggataactggaaaagaggagacagtcctactgaaaagcataaaaagttgtatcctagctgcagattcgttcagagtctaaattccgttaacaacttggaagctacctctcagcctacttttccttcttcagtaacaaattccacacactcattacttccgggtacagaaaacagtggatatttccgtggctcttattcaaactctccatcaaatcctgtaaactccagagcaaatcaagatttttctgccttgatgagaagttcctaccactgtgcaatgaataacgaaaatgccagattacttacttttcagacatggccattgacttttctgtcgccaacagatctggcaaaagcaggcttttactacataggacctggagacagagtggcttgctttgcctgtggtggaaaattgagcaattgggaaccgaaggataatgctatgtcagaacacctgagacattttcccaaatgcccatttatagaaaatcagcttcaagacacttcaagatacacagtttctaatctgagcatgcagacacatgcagcccgctttaaaacattctttaactggccctctagtgttctagttaatcctgagcagcttgcaagtgcgggtttttattatgtgggtaacagtgatgatgtcaaatgcttttgctgtgatggtggactcaggtgttgggaatctggagatgatccatgggttcaacatgccaagtggtttccaaggtgtgagtacttgataagaattaaaggacaggagttcatccgtcaagttcaagccagttaccctcatctacttgaacagctgctatccacatcagacagcccaggagatgaaaatgcagagtcatcaattatccattttgaacctggagaagaccattcagaagatgcaatcatgatgaatactcctgtgattaatgctgccgtggaaatgggctttagtagaagcctggtaaaacagacagttcagagaaaaatcctagcaactggagagaattatagactagtcaatgatcttgtgttagacttactcaatgcagaagatgaaataagggaagaggagagagaaagagcaactgaggaaaaagaatcaaatgatttattattaatccggaagaatagaatggcactttttcaacatttgacttgtgtaattccaatcctggatagtctactaactgccggaattattaatgaacaagaacatgatgttattaaacagaagacacagacgtctttacaagcaagagaactgattgatacgattttagtaaaaggaaatattgcagccactgtattcagaaactctctgcaagaagctgaagctgtgttatatgagcatttatttgtgcaacaggacataaaatatattcccacagaagatgtttcagatctaccagtggaagaacaattgcggagactacaagaagaaagaacatgtaaagtgtgtatggacaaagaagtgtccatagtgtttattccttgtggtcatctagtagtatgcaaagattgtgctccttctttaagaaagtgtcctatttgtaggagtacaatcaagggtacagttcgtacatttctttcatgataataggctggagcctcggtggccatgcttcttgccccttgggcctccccccagcccctcctccccttcctgcacccgtacccccgtggtctttgaataaagtctgagtgggcggctctaga

SEQ ID NO: 428 - DNA, 3743 bp, Homo sapiens
ggatggggcggcgggcttcgggagcgcccgggctgatccgagccgagcgggccgtatctccttgtcggcgccgctgattcccggctctgcggaggcctctaggcagccgcgcagcttccgtgtttgctgcgcccgcactgcgatttacaaccctgaagaatctccctatccctattttgtccccctgcagtaataaatcccattatggagatctcgaaactttataaagggatatagtttgaattctatggagtgtaattttgtgtatgaattatatttttaaaacattgaagagttttcagaaagaaggctagtagagttgattactgatactttatgctaagcagtacttttttggtagtacaatattttgttaggcgtttctgataacactagaaaggacaagttttatcttgtgataaattgattaatgtttacaacatgactgataattatagctgaatagtccttaaatgatgaacaggttatttagtttttaaatgcagtgtaaaaagtgtgctgtggaaattttatggctaactaagtttatggagaaaataccttcagttgatcaagaataatagtggtatacaaagttaggaagaaagtcaacatgatgctgcaggaaatggaaacaaatacaaatgatatttaacaaagatagagtttacagtttttgaactttaagccaaattcatttgacatcaagcactatagcaggcacaggttcaacaaagcttgtgggtattgacttcccccaaaagttgtcagctgaagtaatttagcccacttaagtaaatactatgatgataagctgtgtgaacttagcttttaaatagtgtgaccatatgaaggttttaattacttttgtttattggaataaaatgagattttttgggttgtcatgttaaagtgcttatagggaaagaagcctgcatataattttttaccttgtggcataatcagtaattggtctgttattcaggcttcatagcttgtaaccaaatataaataaaaggcataatttaggtattctatagttgcttagaattttgttaatataaatctctgtgaaaaatcaaggagttttaatattttcagaagtgcatccacctttcagggctttaagttagtattactcaagattatgaacaaatagcacttaggttacctgaaagagttactacaaccccaaagagttgtgttctaagtagtatcttggtaattcagagagatactcatcctacctgaatataaactgagataaatccagtaaagaaagtgtagtaaattctacataagagtctatcattgatttctttttgtggtaaaaatcttagttcatgtgaagaaatttcatgtgaatgttttagctatcaaacagtactgtcacctactcatgcacaaaactgcctcccaaagacttttcccaggtccctcgtatcaaaacattaagagtataatggaagatagcacgatcttgtcagattggacaaacagcaacaaacaaaaaatgaagtatgacttttcctgtgaactctacagaatgtctacatattcaactttccccgccggggtgcctgtctcagaaaggagtcttgctcgtgctggtttttattatactggtgtgaatgacaaggtcaaatgcttctgttgtggcctgatgctggataactggaaactaggagacagtcctattcaaaagcataaacagctatatcctagctgtagctttattcagaatctggtttcagctagtctgggatccacctctaagaatacgtctccaatgagaaacagttttgcacattcattatctcccaccttggaacatagtagcttgttcagtggttcttactccagcctttctccaaaccctcttaattctagagcagttgaagacatctcttcatcgaggactaacccctacagttatgcaatgagtactgaagaagccagatttcttacctaccatatgtggccattaacttttttgtcaccatcagaattggcaagagctggtttttattatataggacctggagatagggtagcctgctttgcctgtggtgggaagctcagtaactgggaaccaaaggatgatgctatgtcagaacaccggaggcattttcccaactgtccatttttggaaaattctctagaaactctgaggtttagcatttcaaatctgagcatgcagacacatgcagctcgaatgagaacatttatgtactggccatctagtgttccagttcagcctgagcagcttgcaagtgctggtttttattatgtgggtcgcaatgatgatgtcaaatgcttttgttgtgatggtggcttgaggtgttgggaatctggagatgatccatgggtagaacatgccaagtggtttccaaggtgtgagttcttgatacgaatgaaaggccaagagtttgttgatgagattcaaggtagatatcctcatcttcttgaacagctgttgtcaacttcagataccactggagaagaaaatgctgacccaccaattattcattttggacctggagaaagttcttcagaagatgctgtcatgatgaatacacctgtggttaaatctgccttggaaatgggctttaatagagacctggtgaaacaaacagttcaaagtaaaatcctgacaactggagagaactataaaacagttaatgatattgtgtcagcacttcttaatgctgaagatgaaaaaagagaagaggagaaggaaaaacaagctgaagaaatggcatcagatgatttgtcattaattcggaagaacagaatggctctctttcaacaattgacatgtgtgcttcctatcctggataatcttttaaaggccaatgtaattaataaacaggaacatgatattattaaacaaaaaacacagatacctttacaagcgagagaactgattgataccattttggttaaaggaaatgctgcggccaacatcttcaaaaactgtctaaaagaaattgactctacattgtataagaacttatttgtggataagaatatgaagtatattccaacagaagatgtttcaggtctgtcactggaagaacaattgaggaggttgcaagaagaacgaacttgtaaagtgtgtatggacaaagaagtttctgttgtatttattccttgtggtcatctggtagtatgccaggaatgtgccccttctctaagaaaatgccctatttgcaggggtataatcaagggtactgttcgtacatttctctcttaaagaaaaatagtctatattttaacctgcataaaaaggtctttaaaatattgttgaacacttgaagccatctaaagtaaaaagggaattatgagtttttcaattagtaacattcatgttctagtctgctttggtactaataatcttgtttctgaaaagatggtatcatatatttaatcttaatctgtttatttacaagggaagatttatgtttggtgaactatattagtatgtatgtgtacctaagggagtagtgtcactgcttgttatgcatcatttcaggagttactggatttgttgttctttcagaaagctttgaatactaaattatagtgtagaaaagaactggaaaccaggaactctggagttcatcagagttatggtgccgaattgtctttggtgcttttcacttgtgttttaaaataaggatttttctcttatttctccccctagtttgtgagaaacatctcaataaagtgctttaaaaaga

SEQ ID NO: 429 - DNA, 1927 bp, Homo sapiens
atcgtgcgtcagagtgagcccggatggggcggcgggcttcgggagcgcccgggctgatccgagccgagcgggccgtatctccttgtcggcgccgctgattcccggctctgcggaggcctctaggcagccgcgcagcttccgtgtttgctgcgcccgcactgcgaatgtctacatattcaactttccccgccggggtgcctgtctcagaaaggagtcttgctcgtgctggtttttattatactggtgtgaatgacaaggtcaaatgcttctgttgtggcctgatgctggataactggaaactaggagacagtcctattcaaaagcataaacagctatatcctagctgtagctttattcagaatctggtttcagctagtctgggatccacctctaagaatacgtctccaatgagaaacagttttgcacattcattatctcccaccttggaacatagtagcttgttcagtggttcttactccagcctttctccaaaccctcttaattctagagcagttgaagacatctcttcatcgaggactaacccctacagttatgcaatgagtactgaagaagccagatttcttacctaccatatgtggccattaacttttttgtcaccatcagaattggcaagagctggtttttattatataggacctggagatagggtagcctgctttgcctgtggtgggaagctcagtaactgggaaccaaaggatgatgctatgtcagaacaccggaggcattttcccaactgtccatttttggaaaattctctagaaactctgaggtttagcatttcaaatctgagcatgcagacacatgcagctcgaatgagaacatttatgtactggccatctagtgttccagttcagcctgagcagcttgcaagtgctggtttttattatgtgggtcgcaatgatgatgtcaaatgcttttgttgtgatggtggcttgaggtgttgggaatctggagatgatccatgggtagaacatgccaagtggtttccaaggtgtgagttcttgatacgaatgaaaggccaagagtttgttgatgagattcaaggtagatatcctcatcttcttgaacagctgttgtcaacttcagataccactggagaagaaaatgctgacccaccaattattcattttggacctggagaaagttcttcagaagatgctgtcatgatgaatacacctgtggttaaatctgccttggaaatgggctttaatagagacctggtgaaacaaacagttcaaagtaaaatcctgacaactggagagaactataaaacagttaatgatattgtgtcagcacttcttaatgctgaagatgaaaaaagagaagaggagaaggaaaaacaagctgaagaaatggcatcagatgatttgtcattaattcggaagaacagaatggctctctttcaacaattgacatgtgtgcttcctatcctggataatcttttaaaggccaatgtaattaataaacaggaacatgatattattaaacaaaaaacacagatacctttacaagcgagagaactgattgataccattttggttaaaggaaatgctgcggccaacatcttcaaaaactgtctaaaagaaattgactctacattgtataagaacttatttgtggataagaatatgaagtatattccaacagaagatgtttcaggtctgtcactggaagaacaattgaggaggttgcaagaagaacgaacttgtaaagtgtgtatggacaaagaagtttctgttgtatttattccttgtggtcatctggtagtatgccaggaatgtgccccttctctaagaaaatgccctatttgcaggggtataatcaagggtactgttcgtacatttctctcttaaagaaaaatagtctatattttaacctgcataaaaaggtctttaaaatattgttg

SEQ ID NO: 430 - DNA, 2617 bp, Homo sapiens
gggcttcgggagcgcccgggctgatccgagccgagcgggccgtatctccttgtcggcgccgctgattcccggctctgcggaggcctctaggcagccgcgcagcttccgtgtttgctgcgcccgcactgcgatttacaaccctgaagaatctccctatccctattttgtccccctgcagtaataaatcccattatggagatctcgaaactttataaagggatatagtttgaattctatggagtgtaattttgtgtatgaattatatttttaaaacattgaagagttttcagaaagaagacttttcccaggtccctcgtatcaaaacattaagagtataatggaagatagcacgatcttgtcagattggacaaacagcaacaaacaaaaaatgaagtatgacttttcctgtgaactctacagaatgtctacatattcaactttccccgccggggtgcctgtctcagaaaggagtcttgctcgtgctggtttttattatactggtgtgaatgacaaggtcaaatgcttctgttgtggcctgatgctggataactggaaactaggagacagtcctattcaaaagcataaacagctatatcctagctgtagctttattcagaatctggtttcagctagtctgggatccacctctaagaatacgtctccaatgagaaacagttttgcacattcattatctcccaccttggaacatagtagcttgttcagtggttcttactccagcctttctccaaaccctcttaattctagagcagttgaagacatctcttcatcgaggactaacccctacagttatgcaatgagtactgaagaagccagatttcttacctaccatatgtggccattaacttttttgtcaccatcagaattggcaagagctggtttttattatataggacctggagatagggtagcctgctttgcctgtggtgggaagctcagtaactgggaaccaaaggatgatgctatgtcagaacaccggaggcattttcccaactgtccatttttggaaaattctctagaaactctgaggtttagcatttcaaatctgagcatgcagacacatgcagctcgaatgagaacatttatgtactggccatctagtgttccagttcagcctgagcagcttgcaagtgctggtttttattatgtgggtcgcaatgatgatgtcaaatgcttttgttgtgatggtggcttgaggtgttgggaatctggagatgatccatgggtagaacatgccaagtggtttccaaggtgtgagttcttgatacgaatgaaaggccaagagtttgttgatgagattcaaggtagatatcctcatcttcttgaacagctgttgtcaacttcagataccactggagaagaaaatgctgacccaccaattattcattttggacctggagaaagttcttcagaagatgctgtcatgatgaatacacctgtggttaaatctgccttggaaatgggctttaatagagacctggtgaaacaaacagttcaaagtaaaatcctgacaactggagagaactataaaacagttaatgatattgtgtcagcacttcttaatgctgaagatgaaaaaagagaagaggagaaggaaaaacaagctgaagaaatggcatcagatgatttgtcattaattcggaagaacagaatggctctctttcaacaattgacatgtgtgcttcctatcctggataatcttttaaaggccaatgtaattaataaacaggaacatgatattattaaacaaaaaacacagatacctttacaagcgagagaactgattgataccattttggttaaaggaaatgctgcggccaacatcttcaaaaactgtctaaaagaaattgactctacattgtataagaacttatttgtggataagaatatgaagtatattccaacagaagatgtttcaggtctgtcactggaagaacaattgaggaggttgcaagaagaacgaacttgtaaagtgtgtatggacaaagaagtttctgttgtatttattccttgtggtcatctggtagtatgccaggaatgtgccccttctctaagaaaatgccctatttgcaggggtataatcaagggtactgttcgtacatttctctcttaaagaaaaatagtctatattttaacctgcataaaaaggtctttaaaatattgttgaacacttgaagccatctaaagtaaaaagggaattatgagtttttcaattagtaacattcatgttctagtctgctttggtactaataatcttgtttctgaaaagatggtatcatatatttaatcttaatctgtttatttacaagggaagatttatgtttggtgaactatattagtatgtatgtgtacctaagggagtagtgtcactgcttgttatgcatcatttcaggagttactggatttgttgttctttcagaaagctttgaatactaaattatagtgtagaaaagaactggaaaccaggaactctggagttcatcagagttatggtgccgaattgtctttggtgcttttcacttgtgttttaaaataaggatttttctcttatttctccccctagtttgtgagaaacatctcaataaagtgctttaaaaag

SEQ ID NO: 431 - DNA, 3001 bp, Homo sapiens
ggatggggcggcgggcttcgggagcgcccgggctgatccgagccgagcgggccgtatctccttgtcggcgccgctgattcccggctctgcggaggcctctaggcagccgcgcagcttccgtgtttgctgcgcccgcactgcgatttacaaccctgaagaatctccctatccctattttgtccccctgcagtaataaatcccattatggagatctcgaaactttataaagggatatagtttgaattctatggagtgtaattttgtgtatgaattatatttttaaaacattgaagagttttcagaaagaaggctagtagagttgattactgatactttatgctaagcagtacttttttggtagtacaatattttgttaggcgtttctgataacactagaaaggacaagttttatcttgtgataaattgattaatgtttacaacatgactgataattatagctgaatagtccttaaatgatgaacaggttatttagtttttaaatgcagtgtaaaaagtgtgctgtggaaattttatggctaactaagtttatggagaaaataccttcagttgatcaagaataatagtggtatacaaagttaggaagaaagtcaacatgatgctgcaggaaatggaaacaaatacaaatgatatttaacaaagatagagtttacagtttttgaactttaagccaaattcatttgacatcaagcactatagcaggcacaggttcaacaaagcttgtgggtattgacttcccccaaaagttgtcagctgaagtaatttagcccacttaagtaaatactatgatgataagctgtgtgaacttagcttttaaatagtgtgaccatatgaaggttttaattacttttgtttattggaataaaatgagattttttgggttgtcatgttaaagtgcttatagggaaagaagcctgcatataattttttaccttgtggcataatcagtaattggtctgttattcaggcttcatagcttgtaaccaaatataaataaaaggcataatttaggtattctatagttgcttagaattttgttaatataaatctctgtgaaaaatcaaggagttttaatattttcagaagtgcatccacctttcagggctttaagttagtattactcaagattatgaacaaatagcacttaggttacctgaaagagttactacaaccccaaagagttgtgttctaagtagtatcttggtaattcagagagatactcatcctacctgaatataaactgagataaatccagtaaagaaagtgtagtaaattctacataagagtctatcattgatttctttttgtggtaaaaatcttagttcatgtgaagaaatttcatgtgaatgttttagctatcaaacagtactgtcacctactcatgcacaaaactgcctcccaaagacttttcccaggtccctcgtatcaaaacattaagagtataatggaagatagcacgatcttgtcagattggacaaacagcaacaaacaaaaaatgaagtatgacttttcctgtgaactctacagaatgtctacatattcaactttccccgccggggtgcctgtctcagaaaggagtcttgctcgtgctggtttttattatactggtgtgaatgacaaggtcaaatgcttctgttgtggcctgatgctggataactggaaactaggagacagtcctattcaaaagcataaacagctatatcctagctgtagctttattcagaatctggtttcagctagtctgggatccacctctaagaatacgtctccaatgagaaacagttttgcacattcattatctcccaccttggaacatagtagcttgttcagtggttcttactccagcctttctccaaaccctcttaattctagagcagttgaagacatctcttcatcgaggactaacccctacagttatgcaatgagtactgaagaagccagatttcttacctaccatatgtggccattaacttttttgtcaccatcagaattggcaagagctggtttttattatataggacctggagatagggtagcctgctttgcctgtggtgggaagctcagtaactgggaaccaaaggatgatgctatgtcagaacaccggaggcattttcccaactgtccatttttggaaaattctctagaaactctgaggtttagcatttcaaatctgagcatgcagacacatgcagctcgaatgagaacatttatgtactggccatctagtgttccagttcagcctgagcagcttgcaagtgctggtttttattatgtgggtcgcaatgatgatgtcaaatgcttttgttgtgatggtggcttgaggtgttgggaatctggagatgatccatgggtagaacatgccaagtggtttccaaggtgtgagttcttgatacgaatgaaaggccaagagtttgttgatgagattcaaggtagatatcctcatcttcttgaacagctgttgtcaacttcagataccactggagaagaaaatgctgacccaccaattattcattttggacctggagaaagttcttcagaagatgctgtcatgatgaatacacctgtggttaaatctgccttggaaatgggctttaatagagacctggtgaaacaaacagttcaaagtaaaatcctgacaactggagagaactataaaacagttaatgatattgtgtcagcacttcttaatgctgaagatgaaaaaagagaagaggagaaggaaaaacaagctgaagaaatggcatcagatgatttgtcattaattcggaagaacagaatggctctctttcaacaattgacatgtgtgcttcctatcctggataatcttttaaaggccaatgtaattaataaacaggaacatgatattattaaacaaaaaacacagatacctttacaagcgagagaactgattgataccattttggttaaaggaaatgctgcggccaacatcttcaaaaactgtctaaaagtaaaacaaagattt

SEQ ID NO: 432 - DNA, 3321 bp, Homo sapiens
gacatcatgggctatttttaggggttgactggtagcagataagtgttgagctcgggctggataagggctcagagttgcactgagtgtggctgaagcagcgaggcgggagtggaggtgcgcggagtcaggcagacagacagacacagccagccagccaggtcggcagtatagtccgaactgcaaatcttattttcttttcaccttctctctaactgcccagagctagcgcctgtggctcccgggctggtgtttcgggagtgtccagagagcctggtctccagccgcccccgggaggagagccctgctgcccaggcgctgttgacagcggcggaaagcagcggtacccacgcgcccgccgggggaagtcggcgagcggctgcagcagcaaagaactttcccggctgggaggaccggagacaagtggcagagtcccggagccaacttttgcaagcctttcctgcgtcttaggcttctccacggcggtaaagaccagaaggcggcggagagccacgcaagagaagaaggacgtgcgctcagcttcgctcgcaccggttgttgaacttgggcgagcgcgagccgcggctgccgggcgccccctccccctagcagcggaggaggggacaagtcgtcggagtccgggcggccaagacccgccgccggccggccactgcagggtccgcactgatccgctccgcggggagagccgctgctctgggaagtgagttcgcctgcggactccgaggaaccgctgcgcacgaagagcgctcagtgagtgaccgcgacttttcaaagccgggtagcgcgcgcgagtcgacaagtaagagtgcgggaggcatcttaattaaccctgcgctccctggagcgagctggtgaggagggcgcagcggggacgacagccagcgggtgcgtgcgctcttagagaaactttccctgtcaaaggctccggggggcgcgggtgtcccccgcttgccacagccctgttgcggccccgaaacttgtgcgcgcagcccaaactaacctcacgtgaagtgacggactgttctatgactgcaaagatggaaacgaccttctatgacgatgccctcaacgcctcgttcctcccgtccgagagcggaccttatggctacagtaaccccaagatcctgaaacagagcatgaccctgaacctggccgacccagtggggagcctgaagccgcacctccgcgccaagaactcggacctcctcacctcgcccgacgtggggctgctcaagctggcgtcgcccgagctggagcgcctgataatccagtccagcaacgggcacatcaccaccacgccgacccccacccagttcctgtgccccaagaacgtgacagatgagcaggagggcttcgccgagggcttcgtgcgcgccctggccgaactgcacagccagaacacgctgcccagcgtcacgtcggcggcgcagccggtcaacggggcaggcatggtggctcccgcggtagcctcggtggcagggggcagcggcagcggcggcttcagcgccagcctgcacagcgagccgccggtctacgcaaacctcagcaacttcaacccaggcgcgctgagcagcggcggcggggcgccctcctacggcgcggccggcctggcctttcccgcgcaaccccagcagcagcagcagccgccgcaccacctgccccagcagatgcccgtgcagcacccgcggctgcaggccctgaaggaggagcctcagacagtgcccgagatgcccggcgagacaccgcccctgtcccccatcgacatggagtcccaggagcggatcaaggcggagaggaagcgcatgaggaaccgcatcgctgcctccaagtgccgaaaaaggaagctggagagaatcgcccggctggaggaaaaagtgaaaaccttgaaagctcagaactcggagctggcgtccacggccaacatgctcagggaacaggtggcacagcttaaacagaaagtcatgaaccacgttaacagtgggtgccaactcatgctaacgcagcagttgcaaacattttgaagagagaccgtcgggggctgaggggcaacgaagaaaaaaaataacacagagagacagacttgagaacttgacaagttgcgacggagagaaaaaagaagtgtccgagaactaaagccaagggtatccaagttggactgggttgcgtcctgacggcgcccccagtgtgcacgagtgggaaggacttggcgcgccctcccttggcgtggagccagggagcggccgcctgcgggctgccccgctttgcggacgggctgtccccgcgcgaacggaacgttggacttttcgttaacattgaccaagaactgcatggacctaacattcgatctcattcagtattaaaggggggagggggagggggttacaaactgcaatagagactgtagattgcttctgtagtactccttaagaacacaaagcggggggagggttggggaggggcggcaggagggaggtttgtgagagcgaggctgagcctacagatgaactctttctggcctgccttcgttaactgtgtatgtacatatatatattttttaatttgatgaaagctgattactgtcaataaacagcttcatgcctttgtaagttatttcttgtttgtttgtttgggtatcctgcccagtgttgtttgtaaataagagatttggagcactctgagtttaccatttgtaataaagtatataatttttttatgttttgtttctgaaaattccagaaaggatatttaagaaaatacaataaactattggaaagtactcccctaacctcttttctgcatcatctgtagatactagctatctaggtggagttgaaagagttaagaatgtcgattaaaatcactctcagtgcttcttactattaagcagtaaaaactgttctctattagactttagaaataaatgtacctgatgtacctgatgctatggtcaggttatactcctcctcccccagctatctatatggaattgcttaccaaaggatagtgcgatgtttcaggaggctggaggaaggggggttgcagtggagagggacagcccactgagaagtcaaacatttcaaagtttggattgtatcaagtggcatgtgctgtgaccatttataatgttagtagaaattttacaataggtgcttattctcaaagcaggaattggtggcagattttacaaaagatgtatccttccaatttggaatcttctctttgacaattcctagataaaaagatggcctttgcttatgaatatttataacagcattcttgtcacaataaatgtattcaaatacc

SEQ ID NO: 433 - DNA, 3300 bp, Homo sapiens
agtcgactgccagtagggctcgcgcagaatcggagagccggtggcgtcgcaggtcgggaggacgagcaccgagtcgagggctcgctcgtctgggccgcccgagagtcttaatcgcgggcgcttgggccgccatcttagatggcgggagtaagaggaaaacgattgtgaggcgggaacggctttctgctgccttttttgggccccgaaaagggtcagctggccgggctttggggcgcgtgccctgaggcgcggagcgcgtttgctacgatgcgggggctgctcggggctccgtcccctgggctggggacgcgccgaatgtgaccgcctcccgctccctcacccgccgcggggaggaggagcgggcgagaagctgccgccgaacgacaggacgttggggcggcctggctccctcaggtttaagaattgtttaagctgcatcaatggagcacatacagggagcttggaagacgatcagcaatggttttggattcaaagatgccgtgtttgatggctccagctgcatctctcctacaatagttcagcagtttggctatcagcgccgggcatcagatgatggcaaactcacagatccttctaagacaagcaacactatccgtgttttcttgccgaacaagcaaagaacagtggtcaatgtgcgaaatggaatgagcttgcatgactgccttatgaaagcactcaaggtgaggggcctgcaaccagagtgctgtgcagtgttcagacttctccacgaacacaaaggtaaaaaagcacgcttagattggaatactgatgctgcgtctttgattggagaagaacttcaagtagatttcctggatcatgttcccctcacaacacacaactttgctcggaagacgttcctgaagcttgccttctgtgacatctgtcagaaattcctgctcaatggatttcgatgtcagacttgtggctacaaatttcatgagcactgtagcaccaaagtacctactatgtgtgtggactggagtaacatcagacaactcttattgtttccaaattccactattggtgatagtggagtcccagcactaccttctttgactatgcgtcgtatgcgagagtctgtttccaggatgcctgttagttctcagcacagatattctacacctcacgccttcacctttaacacctccagtccctcatctgaaggttccctctcccagaggcagaggtcgacatccacacctaatgtccacatggtcagcaccaccctgcctgtggacagcaggatgattgaggatgcaattcgaagtcacagcgaatcagcctcaccttcagccctgtccagtagccccaacaatctgagcccaacaggctggtcacagccgaaaacccccgtgccagcacaaagagagcgggcaccagtatctgggacccaggagaaaaacaaaattaggcctcgtggacagagagattcaagctattattgggaaatagaagccagtgaagtgatgctgtccactcggattgggtcaggctcttttggaactgtttataagggtaaatggcacggagatgttgcagtaaagatcctaaaggttgtcgacccaaccccagagcaattccaggccttcaggaatgaggtggctgttctgcgcaaaacacggcatgtgaacattctgcttttcatggggtacatgacaaaggacaacctggcaattgtgacccagtggtgcgagggcagcagcctctacaaacacctgcatgtccaggagaccaagtttcagatgttccagctaattgacattgcccggcagacggctcagggaatggactatttgcatgcaaagaacatcatccatagagacatgaaatccaacaatatatttctccatgaaggcttaacagtgaaaattggagattttggtttggcaacagtaaagtcacgctggagtggttctcagcaggttgaacaacctactggctctgtcctctggatggccccagaggtgatccgaatgcaggataacaacccattcagtttccagtcggatgtctactcctatggcatcgtattgtatgaactgatgacgggggagcttccttattctcacatcaacaaccgagatcagatcatcttcatggtgggccgaggatatgcctccccagatcttagtaagctatataagaactgccccaaagcaatgaagaggctggtagctgactgtgtgaagaaagtaaaggaagagaggcctctttttccccagatcctgtcttccattgagctgctccaacactctctaccgaagatcaaccggagcgcttccgagccatccttgcatcgggcagcccacactgaggatatcaatgcttgcacgctgaccacgtccccgaggctgcctgtcttctagttgactttgcacctgtcttcaggctgccaggggaggaggagaagccagcaggcaccacttttctgctccctttctccagaggcagaacacatgttttcagagaagctgctgctaaggaccttctagactgctcacagggccttaacttcatgttgccttcttttctatccctttgggccctgggagaaggaagccatttgcagtgctggtgtgtcctgctccctccccacattccccatgctcaaggcccagccttctgtagatgcgcaagtggatgttgatggtagtacaaaaagcaggggcccagccccagctgttggctacatgagtatttagaggaagtaaggtagcaggcagtccagccctgatgtggagacacatgggattttggaaatcagcttctggaggaatgcatgtcacaggcgggactttcttcagagagtggtgcagcgccagacattttgcacataaggcaccaaacagcccaggactgccgagactctggccgcccgaaggagcctgctttggtactatggaacttttcttaggggacacgtcctcctttcacagcttctaaggtgtccagtgcattgggatggttttccaggcaaggcactcggccaatccgcatctcagccctctcagggagcagtcttccatcatgctgaattttgtcttccaggagctgcccctatggggcggggccgcagggccagccttgtttctctaacaaacaaacaaacaaacagccttgtttctctagtcacatcatgtgtatacaaggaagccaggaatacaggttttcttgatgatttgggttttaattttgtttttattgcacctgacaaaatacagttatctgatggtccctcaattatgttattttaataaaataaattaaatttaggtgtaa

SEQ ID NO: 434 - DNA, 3085 bp, Homo sapiens
ggctcgctcgtctgggccgcccgagagtcttaatcgcgggcgcttgggccgccatcttagatggcgggagtaagaggaaaacgattgtgaggcgggaacggctttctgctgccttttttgggccccgaaaagggtcagctggccgggctttggggcgcgtgccctgaggcgcggagcgcgtttgctacgatgcgggggctgctcggggctccgtcccctgggctggggacgcgccgaatgtgaccgcctcccgctccctcacccgccgcggggaggaggagcgggcgagaagctgccgccgaacgacaggacgttggggcggcctggctccctcaggtttaagaattgtttaagctgcatcaatggagcacatacagggagcttggaagacgatcagcaatggttttggattcaaagatgccgtgtttgatggctccagctgcatctctcctacaatagttcagcagtttggctatcagcgccgggcatcagatgatggcaaactcacagatccttctaagacaagcaacactatccgtgttttcttgccgaacaagcaaagaacagtggtcaatgtgcgaaatggaatgagcttgcatgactgccttatgaaagcactcaaggtgaggggcctgcaaccagagtgctgtgcagtgttcagacttctccacgaacacaaaggtaaaaaagcacgcttagattggaatactgatgctgcgtctttgattggagaagaacttcaagtagatttcctggatcatgttcccctcacaacacacaactttgctcggaagacgttcctgaagcttgccttctgtgacatctgtcagaaattcctgctcaatggatttcgatgtcagacttgtggctacaaatttcatgagcactgtagcaccaaagtacctactatgtgtgtggactggagtaacatcagacaactcttattgtttccaaattccactattggtgatagtggagtcccagcactaccttctttgactatgcgtcgtatgcgagagtctgtttccaggatgcctgttagttctcagcacagatattctacacctcacgccttcacctttaacacctccagtccctcatctgaaggttccctctcccagaggcagaggtcgacatccacacctaatgtccacatggtcagcaccaccctgcctgtggacagcaggatgattgagaataacaacctgagtgcttctcccagggcgtggtccagacgattttgtttgaggggaagagatgcaattcgaagtcacagcgaatcagcctcaccttcagccctgtccagtagccccaacaatctgagcccaacaggctggtcacagccgaaaacccccgtgccagcacaaagagagcgggcaccagtatctgggacccaggagaaaaacaaaattaggcctcgtggacagagagattcaagctattattgggaaatagaagccagtgaagtgatgctgtccactcggattgggtcaggctcttttggaactgtttataagggtaaatggcacggagatgttgcagtaaagatcctaaaggttgtcgacccaaccccagagcaattccaggccttcaggaatgaggtggctgttctgcgcaaaacacggcatgtgaacattctgcttttcatggggtacatgacaaaggacaacctggcaattgtgacccagtggtgcgagggcagcagcctctacaaacacctgcatgtccaggagaccaagtttcagatgttccagctaattgacattgcccggcagacggctcagggaatggactatttgcatgcaaagaacatcatccatagagacatgaaatccaacaatatatttctccatgaaggcttaacagtgaaaattggagattttggtttggcaacagtaaagtcacgctggagtggttctcagcaggttgaacaacctactggctctgtcctctggatggccccagaggtgatccgaatgcaggataacaacccattcagtttccagtcggatgtctactcctatggcatcgtattgtatgaactgatgacgggggagcttccttattctcacatcaacaaccgagatcagatcatcttcatggtgggccgaggatatgcctccccagatcttagtaagctatataagaactgccccaaagcaatgaagaggctggtagctgactgtgtgaagaaagtaaaggaagagaggcctctttttccccagatcctgtcttccattgagctgctccaacactctctaccgaagatcaaccggagcgcttccgagccatccttgcatcgggcagcccacactgaggatatcaatgcttgcacgctgaccacgtccccgaggctgcctgtcttctagttgactttgcacctgtcttcaggctgccaggggaggaggagaagccagcaggcaccacttttctgctccctttctccagaggcagaacacatgttttcagagaagctgctgctaaggaccttctagactgctcacagggccttaacttcatgttgccttcttttctatccctttgggccctgggagaaggaagccatttgcagtgctggtgtgtcctgctccctccccacattccccatgctcaaggcccagccttctgtagatgcgcaagtggatgttgatggtagtacaaaaagcaggggcccagccccagctgttggctacatgagtatttagaggaagtaaggtagcaggcagtccagccctgatgtggagacacatgggattttggaaatcagcttctggaggaatgcatgtcacaggcgggactttcttcagagagtggtgcagcgccagacattttgcacataaggcaccaaacagcccaggactgccgagactctggccgcccgaaggagcctgctttggtactatggaacttttcttaggggacacgtcctcctttcacagcttctaaggtgtccagtgcattgggatggttttccaggcaaggcactcggccaatccgcatctcagccctctcagggagcagtcttccatcatgctgaattttgtcttccaggagctgcccctatggggcggggccgcagggccag

SEQ ID NO: 435 - DNA, 1686 bp, Homo sapiens
caacacacaactttgctcggaagacgttcctgaagcttgccttctgtgacatctgtcagaaattcctgctcaatggatttcgatgtcagacttgtggctacaaatttcatgagcactgtagcaccaaagtacctactatgtgtgtggactggagtaacatcagacaactcttttctcagcacagatattctacacctcacgccttcacctttaacacctccagtccctcatctgaaggttccctctcccagaggcagaggtcgacatccacacctaatgtccacatggtcagcaccaccctgcctgtggacagcaggatgattgaggatgcaattcgaagtcacagcgaatcagcctcaccttcagccctgtccagtagccccaacaatctgagcccaacaggctggtcacagccgaaaacccccgtgccagcacaaagagagcgggcaccagtatctgggacccaggagaaaaacaaaattaggcctcgtggacagagagattcaagctattattgggaaatagaagccagtgaagtgatgctgtccactcggattgggtcaggctcttttggaactgtttataagggtaaatggcacggagatgttgcagtaaagatcctaaaggttgtcgacccaaccccagagcaattccaggccttcaggaatgaggtggctgttctgcgcaaaacacggcatgtgaacattctgcttttcatggggtacatgacaaaggacaacctggcaattgtgacccagtggtgcgagggcagcagcctctacaaacacctgcatgtccaggagaccaagtttcagatgttccagctaattgacattgcccggcagacggctcagggaatggactatttgcatgcaaagaacatcatccatagagacatgaaatccaacaatatatttctccatgaaggcttaacagtgaaaattggagattttggtttggcaacagtaaagtcacgctggagtggttctcagcaggttgaacaacctactggctctgtcctctggatggccccagaggtgatccgaatgcaggataacaacccattcagtttccagtcggatgtctactcctatggcatcgtattgtatgaactgatgacgggggagcttccttattctcacatcaacaaccgagatcagatcatcttcatggtgggccgaggatatgcctccccagatcttagtaagctatataagaactgccccaaagcaatgaagaggctggtagctgactgtgtgaagaaagtaaaggaagagaggcctctttttccccagatcctgtcttccattgagctgctccaacactctctaccgaagatcaaccggagcgcttccgagccatccttgcatcgggcagcccacactgaggatatcaatgcttgcacgctgaccacgtccccgaggctgcctgtcttctagttgactttgcacctgtcttcaggctgccaggggaggaggagaagccagcaggcaccacttttctgctccctttctccagaggcagaacacatgttttcagagaagctgctgctaaggaccttctagactgctcacagggccttaacttcatgttgccttcttttctatccctttgggccctgggagaaggaagccatttgcagtgctggtgtgtcctgctccctccccacattccccatgctcaagg

SEQ ID NO: 436 - DNA, 2346 bp, Homo sapiens
aatcgcgggcgcttgggccgccatcttagatggcgggagtaagaggaaaacgattgtgaggcgggaacggctttctgctgccttttttgggccccgaaaagggtcagctggccgggctttggggcgcgtgccctgaggcgcggagcgcgtttgctacgatgcgggggctgctcggggctccgtcccctgggctggggacgcgccgaatgtgaccgcctcccgctccctcacccgccgcggggaggaggagcgggcgagaagctgccgccgaacgacaggacgttggggcggcctggctccctcaggtttaagaattgtttaagctgcatcaatggagcacatacagggagcttggaagacgatcagcaatggttttggattcaaagatgccgtgtttgatggctccagctgcatctctcctacaatagttcagcagtttggctatcagcgccgggcatcagatgatggcaaactcacagatccttctaagacaagcaacactatccgtgttttcttgccgaacaagcaaagaacagtgtaaaaaagcacgcttagattggaatactgatgctgcgtctttgattggagaagaacttcaagtagatttcctggatcatgttcccctcacaacacacaactttgctcggaagacgttcctgaagcttgccttctgtgacatctgtcagaaattcctgctcaatggatttcgatgtcagacttgtggctacaaatttcatgagcactgtagcaccaaagtacctactatgtgtgtggactggagtaacatcagacaactcttattgtttccaaattccactattggtgatagtggagtcccagcactaccttctttgactatgcgtcgtatgcgagagtctgtttccaggatgcctgttagttctcagcacagatattctacacctcacgccttcacctttaacacctccagtccctcatctgaaggttccctctcccagaggcagaggtcgacatccacacctaatgtccacatggtcagcaccaccctgcctgtggacagcaggatgattgaggatgcaattcgaagtcacagcgaatcagcctcaccttcagccctgtccagtagccccaacaatctgagcccaacaggctggtcacagccgaaaacccccgtgccagcacaaagagagcgggcaccagtatctgggacccaggagaaaaacaaaattaggcctcgtggacagagagattcaagctattattgggaaatagaagccagtgaagtgatgctgtccactcggattgggtcaggctcttttggaactgtttataagggtaaatggcacggagatgttgcagtaaagatcctaaaggttgtcgacccaaccccagagcaattccaggccttcaggaatgaggtggctgttctgcgcaaaacacggcatgtgaacattctgcttttcatggggtacatgacaaaggacaacctggcaattgtgacccagtggtgcgagggcagcagcctctacaaacacctgcatgtccaggagaccaagtttcagatgttccagctaattgacattgcccggcagacggctcagggaatggactatttgcatgcaaagaacatcatccatagagacatgaaatccaacaatatatttctccatgaaggcttaacagtgaaaattggagattttggtttggcaacagtaaagtcacgctggagtggttctcagcaggttgaacaacctactggctctgtcctctggatggccccagaggtgatccgaatgcaggataacaacccattcagtttccagtcggatgtctactcctatggcatcgtattgtatgaactgatgacgggggagcttccttattctcacatcaacaaccgagatcagatcatcttcatggtgggccgaggatatgcctccccagatcttagtaagctatataagaactgccccaaagcaatgaagaggctggtagctgactgtgtgaagaaagtaaaggaagagaggcctctttttccccagatcctgtcttccattgagctgctccaacactctctaccgaagatcaaccggagcgcttccgagccatccttgcatcgggcagcccacactgaggatatcaatgcttgcacgctgaccacgtccccgaggctgcctgtcttctagttgactttgcacctgtcttcaggctgccaggggaggaggagaagccagcaggcaccacttttctgctccctttctccagaggcagaacacatgttttcagagaagctgctgctaaggaccttctagactgctcacagggccttaacttcatgttgccttcttttctatccctttgggccct

SEQ ID NO: 437 - DNA, 4098 bp, Homo sapiens
gtagccgccagctcggccgcacgtcagggcgcgggagcgcggagcgagtttggttgcacttacaccggtacttaagcgcggaccggcgtgtccttggacttagagagtggggacgtccggcttcggagcgggagtgttcgttgtgccagcgactaaaaagagaattaaatatgggtgatgttgagaaaggcaagaagatttttattatgaagtgttcccagtgccacaccgttgaaaagggaggcaagcacaagactgggccaaatctccatggtctctttgggcggaagacaggtcaggcccctggatactcttacacagccgccaataagaacaaaggcatcatctggggagaggatacactgatggagtatttggagaatcccaagaagtacatccctggaacaaaaatgatctttgtcggcattaagaagaaggaagaaagggcagacttaatagcttatctcaaaaaagctactaatgagtaataattggccactgccttatttattacaaaacagaaatgtctcatgacttttttatgtgtaccatcctttaatagatctcatacaccagaattcagatcatgaatgactgacagaatattttgttgggcagtcctgatttaaaactaagactggcttgtggttaaatgaatatgttcagtttttgaattttaatagtaactccaattcagtaaatggtatcactgtttaccccttttaaagatatgattagacttcgttagtaatgttcaacttttcacaaagatggtgagtgccatcttaaaacttactggagattggttttatatttagatttatataactggttatgtgaatatatttaaatactggggaaattgcttcactgtcttagaaccaagcaagattcacctgtgttttgtgttcatgttcatttgcctcttaaaggcaagggttgaagataaataaggtagcaatgtctatagttttggccttaactatgccaatctaattataattccctgtatttaaaatggtttcttttacttattgaaaggcattttagtgtggtttatgtgtaatattaaagattattcaacacctctcacatcttacagatctataaggtcacatgcttttaaaatagtagcaagttaaacttcactcttgaattctttacaatctaagtcaaactaagttataatttaggattgtctttaaacagccattcagaaacaaaactgtagaactgtgtatttgattgggaatggtgcttttgccaacttaaaaggattaaagtaacggagatatacacaaattttaaaattatgtgtgatcacaagactaaagataattaaaaagaaaaccacagatcatgactttttgactgtgcttgatttcatgactgatgcacaaattttaatgattaaaaagtgcaggagccctaaatgtcagtgcagcagccctaaatgtcagtgcagcagtgttaaccagtcatggtgctagattgtttacttggttttctaggactgcctcaactagaataacacttcactaattgactcttagtttctttgctcagattgagaactgcagcatttatgccagacatggacagaggaatgcctgtggtcatagttttgtgatgtgtaacagtgtataattacatactgaattatttcatgcatagtctgtgccatacacatttagagtagtccttggagattttatggagatggtgagcacaaggtaagtcataaagaataatgagaaaataaatctatgctggtgcagctgagaactgtatctttgtgggacagtgagaagactgagaagatgtgaatccatggtctcaaaggtgatagggacgattagataggtgttttaaggcctgaaagcaatttataacatatgagtcttatttttatttatagaaatgtggaaagcttgctgtaattcatatttgaagtcctagtctgagttctggtggggaatttaaaaatgcatcctggaaatcctttaaagatttcagactttgaaaggccttgtagcagaggacttggtgactgtataaagttagtggtattcagggacagtgtagcaagtagcttacaaggggacaattctggactaatgagaaagacctgaagtgaaggctagagagttgattttttttttttttggcatcctggaaatgatacaggaaacatattaagatagatacagaaatgtgttcaaccttccatcttggctagttgtggcgtttagtttgttttttgagacatggtcacgctgtgtcgccaaggctggagtgcagtggtgcgatctcggctggctgcaacctctatttcccaggctcaagcgattctctcacttcagcttcccaagtagctgggactacaggtgttcgccaccatgcccagctaatttttttgtagagatggagttttgccatgtggtcccaggctggtctcaaactcctgagctcaagcaatccgtccacttgccttggctccccaaagtgctgggattacaggcgtgagccaccaggccctgcctggttttcaaattcagaaatcttattatttaacccagaagtaatcagcccagtagtaacttaggtttaattttttttcaggtttaaaatttttctcatttattttttctgagacggagtttcgcccttttcgcccaggctgagtacagtggtgcaatctcactgcaacctccgccttccagttgcaagtgattctcctgcctcagcctcctgagtagctgggattacaggcacccgccaccacgcctggctaatttttgtatttttagtggagatggtgtttcaccatgttggccagactggtcttggactcctgacctcgtgatccacccaccttggcctcccaaagttctaggattacaggtgtgagccaccacgtccggccaatttttctcatttctatgcctcctatattaaggtctgtgttggcacagatgagtaactgccatgttctaggtcagttatacccaagcacttctggtggtttaaaatgtgattctgtaacttttttatttttatttttttgagataatttcactcttgttgcccaggctggagtgcaatggcgtgatcgctgctcaccgcaacctccgccttccaggttcaagcgattctcctgactcagcctctcaagtagctgggattacaagcatgcgccaccatgcccagcttattttgtgtttttagtagagacagggtttctccatgctggacaggctggtcttgaactcccgacgtcaggtgatctacctgcctcggcctcccaaagtgctgggattacaggcgtgagccaccacgcctggccaattatgtaattttttaaaaaggacatttctatcagggatatataccttcagaaataaggaaataggggaaaaaaagagcactataaaccacatgttttcatttctagtgcttcgctgtaagtggctaggttggtagaatcaaaaacaagggccagatgtatttaaggggtattcagatgccacctacatgcttattttgtctagaacagtgctgtctaatagaactttctgtgacgatggatattttgtagacttttgctgtccagtgtggtagccactaaccacatgtggctgttaagcccttgaaatatagctagtgtgactagaaagtattttattttaaatttacataggcacaagtggctagtggctactgtattgacattctgggtctaggactagaaccagtggtctgtaacaaaagtactttctctttactctattaaatctagaattagccgggcatggtcgctcatgcctgtaatcccagcactttgggaggccaaggcaggcagatcacttgaggtcaggcgtttgagaccagcctggtcaacatggcgaaaccctgtctctacaaaaaacataaaaattagccaggtgtggtggtgggcacctgtaatctcagctacttgggaggctgaggcacaagaatcacttgaacttgggaggtggaggttgcagtgagccaagattgtgccactgcactcaagcctgggtgacgagtgaaactgtctccaaaaaaaaaaaaaaa

SEQ ID NO: 438 - DNA, 974 bp, Homo sapiens
acgtccggcttcggagcgggagtgttcgttgtgccagcgactaaaaagaggtgagagcgggtcgcggaggccgcacctggttagaggcagagctgtgggaggcgcgcacttgcgagcgaccgaaacccaagcggggagcattcgagtggagcccgcgctgggtgggagggcggggagtgaagaccctggactgtggtcagaccgagctgggcgagtaacggcttgaggtgcggcggagccctaactagggacagaattaaatatgggtgatgttgagaaaggcaagaagatttttattatgaagtgttcccagtgccacaccgttgaaaagggaggcaagcacaagactgggccaaatctccatggtctctttgggcggaagacaggtcaggcccctggatactcttacacagccgccaataagaacaaaggcatcatctggggagaggatacactgatggagtatttggagaatcccaagaagtacatccctggaacaaaaatgatctttgtcggcattaagaagaaggaagaaagggcagacttaatagcttatctcaaaaaagctactaatgagtaataattggccactgccttatttattacaaaacagaaatgtctcatgacttttttatgtgtaccatcctttaatagatctcatacaccagaattcagatcatgaatgactgacagaatattttgttgggcagtcctgatttaaaactaagactggcttgtggttaaatgaatatgttcagtttttgaattttaatagtaactccaattcagtaaatggtatcactgtttaccccttttaaagatatgattagacttcgttagtaatgttcaacttttcacaaagatggtgagtgccatcttaaaacttactggagattggttttatatttagatttatataactggttatgtgaatatatttaaatactggggaaattgcttcactgtcttagaac

SEQ ID NO: 439 - DNA, 799 bp, Homo sapiens
agagagtggggacgtccggcttcggagcgggagtgttcgttgtgccagcgactaaaaagagagggcaaaagctgttgctcttctaataaggggccagttcttttcgtgggcacatgtttcttccgtcagtcgttctgacatcctagaaggagtttcatcaatcaccttgaaaccgacctggacgggtgacctcgtggtcgccccaggagatcacagaattaaatatgggtgatgttgagaaaggcaagaagatttttattatgaagtgttcccagtgccacaccgttgaaaagggaggcaagcacaagactgggccaaatctccatggtctctttgggcggaagacaggtcaggcccctggatactcttacacagccgccaataagaacaaaggcatcatctggggagaggatacactgatggagtatttggagaatcccaagaagtacatccctggaacaaaaatgatctttgtcggcattaagaagaaggaagaaagggcagacttaatagcttatctcaaaaaagctactaatgagtaataattggccactgccttatttattacaaaacagaaatgtctcatgacttttttatgtgtaccatcctttaatagatctcatacaccagaattcagatcatgaatgactgacagaatattttgttgggcagtcctgatttaaaactaagactggcttgtggttaaatgaatatgttcagtttttgaattttaatagtaactccaattcagtaaatggtatcactgtttaccccttttaaagatatgattagacttcgt

SEQ ID NO: 440 - DNA, 498 bp, Homo sapiens
agagagtggggacgtccggcttcggagcgggagtgttcgttgtgccagcgactaaaaagaggggccagttcttttcgtgggcacatgtttcttccgtcagtcgttctgacatcctagaaggagtttcatcaatcaccttgaaaccgacctggacgggtgacctcgtggtcgccccaggagatcacagaattaaatatgggtgatgttgagaaaggcaagaagatttttattatgaagtgttcccagtgccacaccgttgaaaagggaggcaagcacaagactgggccaaatctccatggtctctttgggcggaagacaggtcaggcccctggatactcttacacagccgccaataagaacaaaggcatcatctggggagaggatacactgatggagtatttggagaatcccaagaagtacatccctggaacaaaaatgatctttgtcggcattaagaagaaggaagaaagggcagacttaatagcttatctcaaaaaa

SEQ ID NO: 441 - DNA, 2606 bp, Homo sapiens
atatggcggcgcttagttgcatgaaggcggaaactctgtgacttccggtccgtagtggggcctgcggtgggagtgggaaggaaggcggagggaaccatgcgaggttctgagaattgcggcgagggtcgcctcgagagacggtttctgaggaattctgaaatccccaccacttcctccctccgggggatttgatcccctatggccaccgctaacagcatcatcgtgctggatgatgatgacgaagatgaagcagctgctcagccagggccctcccacccactccccaatgcggcctcacctggggcagaagcccctagctcctctgagcctcatggggccagaggaagcagtagttcgggcggcaagaaatgctacaagctggagaatgagaagctgttcgaagagttccttgaactttgtaagatgcagacagcagaccaccctgaggtggtcccattcctctataaccggcagcaacgtgcccactctctgtttttggcctcggcggagttctgcaacatcctctctagggtcctgtctcgggcccggagccggccagccaagctctatgtctacatcaatgagctctgcactgttctcaaggcccactcagccaaaaagaagctgaacttggcccctgccgccaccacctccaatgagccctctgggaataaccctcccacacacctctccttggaccccacaaatgctgaaaacactgcctctcagtctccaaggacccgtggttcccggcggcagatccagcgtttggagcagctgctggcgctctatgtggcagagatccggcggctgcaggaaaaggagttggatctctcagaattggatgacccagactccgcatacctgcaggaggcacggttgaagcgtaagctgatccgcctctttgggcgactatgtgagctgaaagactgctcttcactgaccggccgtgtcatagagcagcgcatcccctaccgtggcacccgctacccagaggttaacaggcgcattgagcggctcatcaacaagccagggcctgataccttccctgactatggggatgtgcttcgggctgtagagaaggcagctgcccgacacagccttggcctcccccgacagcagctccagctcatggctcaggatgccttccgagatgtgggcatcaggttacaggagcgacgtcacctcgatctcatctacaactttggctgccacctcacagatgactataggccaggcgttgaccctgcactatcagatcctgtgttggcccggcgccttcgggaaaaccggagtttggccatgagtcggctggatgaggtcatctccaaatatgcaatgttgcaagacaaaagtgaggagggcgagagaaaaaagagaagagctcggctccaaggcacctcttcccactctgcagacacccccgaagcctccttggattctggtgagggccctagtggaatggcatcccaggggtgcccttctgcctccagagctgagacagatgacgaagacgatgaggagagtgatgaggaagaggaggaggaggaggaagaagaagaggaggaggccacagattctgaagaggaggaggatctggaacagatgcaggagggtcaggaggatgatgaagaggaggacgaagaggaagaagcagcagcaggtaaagatggagacaagagccccatgtcctcactacagatctccaatgaaaagaacctggaacctggcaaacagatcagcagatcttcaggggagcagcaaaacaaaggacgcatagtgtcaccatcgttactgtcagaagaacccctggccccctccagcatagatgctgaaagcaatggagaacagcctgaggagctgaccctggaggaagaaagccctgtgtctcagctctttgagctagagattgaagctttgcccctggataccccttcctctgtggagacggacatttcctcttccaggaagcaatcagaggagcccttcaccactgtcttagagaatggagcaggcatggtctcttctacttccttcaatggaggcgtctctcctcacaactggggagattctggtcccccctgcaaaaaatctcggaaggagaagaagcaaacaggatcagggccattaggaaacagctatgtggaaaggcaaaggtcagtgcatgagaagaatgggaaaaagatatgtaccctgcccagcccaccttcccccttggcttccttggccccagttgctgattcctccacgagggtggactctcccagccatggcctggtgaccagctccctctgcatcccttctccagcccggctgtcccaaaccccccattcacagcctcctcggcctggtacttgcaagacaagtgtggccacacaatgcgatccagaagagatcatcgtgctctcagactctgattagctgcctccccttctccctgcctccagaatgttctgggataacatttggaggaaggtgggaagcagatgactgaggaagggatggactaagctaatccccttttggtggtgtttctttaaaaaaaaaaaaaagcttaagttttacacagaaacattaataaacaataaagttcttttcttactgta

SEQ ID NO: 442 - DNA, 2613 bp, Homo sapiens
gacaatatggcggcgcttagttgcatgaaggcggaaactctgtgacttccggtccgtagtggggcctgcggtgggagtgggaaggaaggcggagggaaccatgcgaggttctgagaattgcggcgagggtcgcctcgagagacggtttctgagcaggaattctgaaatccccaccacttcctccctccgggggatttgatcccctatggccaccgctaacagcatcatcgtgctggatgatgatgacgaagatgaagcagctgctcagccagggccctcccacccactccccaatgcggcctcacctggggcagaagcccctagctcctctgagcctcatggggccagaggaagcagtagttcgggcggcaagaaatgctacaagctggagaatgagaagctgttcgaagagttccttgaactttgtaagatgcagacagcagaccaccctgaggtggtcccattcctctataaccggcagcaacgtgcccactctctgtttttggcctcggcggagttctgcaacatcctctctagggtcctgtctcgggcccggagccggccagccaagctctatgtctacatcaatgagctctgcactgttctcaaggcccactcagccaaaaagaagctgaacttggcccctgccgccaccacctccaatgagccctctgggaataaccctcccacacacctctccttggaccccacaaatgctgaaaacactgcctctcagtctccaaggacccgtggttcccggcggcagatccagcgtttggagcagctgctggcgctctatgtggcagagatccggcggctgcaggaaaaggagttggatctctcagaattggatgacccagactccgcatacctgcaggaggcacggttgaagcgtaagctgatccgcctctttgggcgactatgtgagctgaaagactgctcttcactgaccggccgtgtcatagagcagcgcatcccctaccgtggcacccgctacccagaggttaacaggcgcattgagcggctcatcaacaagccagggcctgataccttccctgactatggggatgtgcttcgggctgtagagaaggcagctgcccgacacagccttggcctcccccgacagcagctccagctcatggctcaggatgccttccgagatgtgggcatcaggttacaggagcgacgtcacctcgatctcatctacaactttggctgccacctcacagatgactataggccaggcgttgaccctgcactatcagatcctgtgttggcccggcgccttcgggaaaaccggagtttggccatgagtcggctggatgaggtcatctccaaatatgcaatgttgcaagacaaaagtgaggagggcgagagaaaaaagagaagagctcggctccaaggcacctcttcccactctgcagacacccccgaagcctccttggattctggtgagggccctagtggaatggcatcccaggggtgcccttctgcctccagagctgagacagatgacgaagacgatgaggagagtgatgaggaagaggaggaggaggaggaagaagaagaggaggaggccacagattctgaagaggaggaggatctggaacagatgcaggagggtcaggaggatgatgaagaggaggacgaagaggaagaagcagcagcaggtaaagatggagacaagagccccatgtcctcactacagatctccaatgaaaagaacctggaacctggcaaacagatcagcagatcttcaggggagcagcaaaacaaaggacgcatagtgtcaccatcgttactgtcagaagaacccctggccccctccagcatagatgctgaaagcaatggagaacagcctgaggagctgaccctggaggaagaaagccctgtgtctcagctctttgagctagagattgaagctttgcccctggataccccttcctctgtggagacggacatttcctcttccaggaagcaatcagaggagcccttcaccactgtcttagagaatggagcaggcatggtctcttctacttccttcaatggaggcgtctctcctcacaactggggagattctggtcccccctgcaaaaaatctcggaaggagaagaagcaaacaggatcagggccattaggaaacagctatgtggaaaggcaaaggtcagtgcatgagaagaatgggaaaaagatatgtaccctgcccagcccaccttcccccttggcttccttggccccagttgctgattcctccacgagggtggactctcccagccatggcctggtgaccagctccctctgcatcccttctccagcccggctgtcccaaaccccccattcacagcctcctcggcctggtacttgcaagacaagtgtggccacacaatgcgatccagaagagatcatcgtgctctcagactctgattagctgcctccccttctccctgcctccagaatgttctgggataacatttggaggaaggtgggaagcagatgactgaggaagggatggactaagctaatccccttttggtggtgtttctttaaaaaaaaaaaaaagcttaagttttacacagaaacattaataaacaataaagttcttttcttactgta

SEQ ID NO: 443 - DNA, 2615 bp, Homo sapiens
gacaatatggcggcgcttagttgcatgaaggcggaaactctgtgacttccggtccgtagtggggcctgcggtgggagtgggaaggaaggcggagggaaccatgcgaggttctgagaattgcggcgagggtcgcctcgagagacggtttctgagcaggaattctgaaatccccaccacttcctccctccgggggatttgatcccctatggccaccgctaacagcatcatcgtgctggatgatgatgacgaagatgaagcagctgctcagccagggccctcccacccactccccaatgcggcctcacctggggcagaagcccctagctcctctgagcctcatggggccagaggaagcagtagttcgggcggcaagaaatgctacaagctggagaatgagaagctgttcgaagagttccttgaactttgtaagatgcagacagcagaccaccctgaggtggtcccattcctctataaccggcagcaacgtgcccactctctgtttttggcctcggcggagttctgcaacatcctctctagggtcctgtctcgggcccggagccggccagccaagctctatgtctacatcaatgagctctgcactgttctcaaggcccactcagccaaaaagaagctgaacttggcccctgccgccaccacctccaatgagccctctgggaataaccctcccacacacctctccttggaccccacaaatgctgaaaacactgcctctcagtctccaaggacccgtggttcccggcggcagatccagcgtttggagcagctgctggcgctctatgtggcagagatccggcggctgcaggaaaaggagttggatctctcagaattggatgacccagactccgcatacctgcaggaggcacggttgaagcgtaagctgatccgcctctttgggcgactatgtgagctgaaagactgctcttcactgaccggccgtgtcatagagcagcgcatcccctaccgtggcacccgctacccagaggttaacaggcgcattgagcggctcatcaacaagccagggcctgataccttccctgactatggggatgtgcttcgggctgtagagaaggcagctgcccgacacagccttggcctcccccgacagcagctccagctcatggctcaggatgccttccgagatgtgggcatcaggttacaggagcgacgtcacctcgatctcatctacaactttggctgccacctcacagatgactataggccaggcgttgaccctgcactatcagatcctgtgttggcccggcgccttcgggaaaaccggagtttggccatgagtcggctggatgaggtcatctccaaatacgcaatgttgcaagacaaaagtgaggagggcgagagaaaaaagagaagagctcggctccaaggcacctcttcccactctgcagacacccccgaagcctccttggattctggtgagggccctagtggaatggcatcccaggggtgcccttctgcctccagagctgagacagatgacgaagacgatgaggagagtgatgaggaagaggaggaggaggaggaagaagaagaggaggaggccacagattctgaagaggaggaggatctggaacagatgcaggagggtcaggaggatgatgaagaggaggacgaagaggaagaagcagcagcaggtaaagatggagacaagagccccatgtcctcactacagatctccaatgaaaagaacctggaacctggcaaacagatcagcagatcttcaggggagcagcaaaacaaaggacgcatagtgtcaccatcgttactgtcagaagaacccctggccccctccagcatagatgctgaaagcaatggagaacagcctgaggagctgaccctggaggaagaaagccctgtgtctcagctctttgagctagagattgaagctttgcccctggataccccttcctctgtggagacggacatttcctcttccaggaagcaatcagaggagcccttcaccactgtcttagagaatggagcaggcatggtctcttctacttccttcaatggaggcgtctctcctcacaactggggagattctggtcccccctgcaaaaaatctcggaaggagaagaagcaaacaggatcagggccattaggaaacagctatgtggaaaggcaaaggtcagtgcatgagaagaatgggaaaaagatatgtaccctgcccagcccaccttcccccttggcttccttggccccagttgctgattcctccacgagggtggactctcccagccatggcctggtgaccagctccctctgcatcccttctccagcccggctgtcccaaaccccccattcacagcctcctcggcctggtacttgcaagacaagtgtggccacacaatgcgatccagaagagatcatcgtgctctcagactctgattagctgcctccccttctccctgcctccagaatgttctgggataacatttggaggaaggtgggaagcagatgactgaggaagggatggactaagctaatccccttttggtggtgtttctttaaaaaaaaaaaaaaaagcttaagttttacacagaaacattaataaacaataaagttcttttcttactgta

SEQ ID NO: 444 - DNA, 2614 bp, Homo sapiens
gacaatatggcggcgcttagttgcatgaaggcggaaactctgtgacttccggtccgtagtggggcctgcggtgggagtgggaaggaaggcggagggaaccatgcgaggttctgagaattgcggcgagggtcgcctcgagagacggtttctgagcaggaattctgaaatccccaccacttcctccctccgggggatttgatcccctatggccaccgctaacagcatcatcgtgctggatgatgatgacgaagatgaagcagctgctcagccagggccctcccacccactccccaatgcggcctcacctggggcagaagcccctagctcctctgagcctcatggggccagaggaagcagtagttcgggcggcaagaaatgctacaagctggagaatgagaagctgttcgaagagttccttgaactttgtaagatgcagacagcagaccaccctgaggtggtcccattcctctataaccggcagcaacgtgcccactctctgtttttggcctcggcggagttctgcaacatcctctctagggtcctgtctcgggcccggagccggccagccaagctctatgtctacatcaatgagctctgcactgttctcaaggcccactcagccaaaaagaagctgaacttggcccctgccgccaccacctccaatgagccctctgggaataaccctcccacacacctctccttggaccccacaaatgctgaaaacactgcctctcagtctccaaggacccgtggttcccggcggcagatccagcgtttggagcagctgctggcgctctatgtggcagagatccggcggctgcaggaaaaggagttggatctctcagaattggatgacccagactccgcatacctgcaggaggcacggttgaagcgtaagctgatccgcctctttgggcgactatgtgagctgaaagactgctcttcactgaccggccgtgtcatagagcagcgcatcccctaccgtggcacccgctacccagaggttaacaggcgcattgagcggctcatcaacaagccagggcctgataccttccctgactatggggatgtgcttcgggctgtagagaaggcagctgcccgacacagccttggcctcccccgacagcagctccagctcatggctcaggatgccttccgagatgtgggcatcaggttacaggagcgacgtcacctcgatctcatctacaactttggctgccacctcacagatgactataggccaggcgttgaccctgcactatcagatcctgtgttggcccggcgccttcgggaaaaccggagtttggccatgagtcggctggatgaggtcatctccaaatatgcaatgttgcaagacaaaagtgaggagggcgagagaaaaaagagaagagctcggctccaaggcacctcttcccactctgcagacacccccgaagcctccttggattctggtgagggccctagtggaatggcatcccaggggtgcccttctgcctccagagctgagacagatgacgaagacgatgaggagagtgatgaggaagaggaggaggaggaggaagaagaagaggaggaggccacagattctgaagaggaggaggatctggaacagatgcaggagggtcaggaggatgatgaagaggaggacgaagaggaagaagcagcagcaggtaaagatggagacaagagccccatgtcctcactacagatctccaatgaaaagaacctggaacctggcaaacagatcagcagatcttcaggggagcagcaaaacaaaggacgcatagtgtcaccatcgttactgtcagaagaacccctggccccctccagcatagatgctgaaagcaatggagaacagcctgaggagctgaccctggaggaagaaagccctgtgtctcagctctttgagctagagattgaagctttgcccctggataccccttcctctgtggagacggacatttcctcttccaggaagcaatcagaggagcccttcaccactgtcttagagaatggagcaggcatggtctcttctacttccttcaatggaggcgtctctcctcacaactggggagattctggtcccccctgcaaaaaatctcggaaggagaagaagcaaacaggatcagggccattaggaaacagctatgtggaaaggcaaaggtcagtgcatgagaagaatgggaaaaagatatgtaccctgcccagcccaccttcccccttggcttccttggccccagttgctgattcctccacgagggtggactctcccagccatggcctggtgaccagctccctctgcatcccttctccagcccggctgtcccaaaccccccattcacagcctcctcggcctggtacttgcaagacaagtgtggccacacaatgcgatccagaagagatcatcgtgctctcagactctgattagctgcctccccttctccctgcctccagaatgttctgggataacatttggaggaaggtgggaagcagatgactgaggaagggatggactaagctaatccccttttggtggtgtttctttaaaaaaaaaaaaaaagcttaagttttacacagaaacattaataaacaataaagttcttttcttactgta

SEQ ID NO: 445 - DNA, 2608 bp, Homo sapiens
atatggcggcgcttagttgcatgaaggcggaaactctgtgacttccggtccgtagtggggcctgcggtgggagtgggaaggaaggcggagggaaccatgcgaggttctgagaattgcggcgagggtcgcctcgagagacggtttctgaggaattctgaaatccccaccacttcctccctccgggggatttgatcccctatggccaccgctaacagcatcatcgtgctggatgatgatgacgaagatgaagcagctgctcagccagggccctcccacccactccccaatgcggcctcacctggggcagaagcccctagctcctctgagcctcatggggccagaggaagcagtagttcgggcggcaagaaatgctacaagctggagaatgagaagctgttcgaagagttccttgaactttgtaagatgcagacagcagaccaccctgaggtggtcccattcctctataaccggcagcaacgtgcccactctctgtttttggcctcggcggagttctgcaacatcctctctagggtcctgtctcgggcccggagccggccagccaagctctatgtctacatcaatgagctctgcactgttctcaaggcccactcagccaaaaagaagctgaacttggcccctgccgccaccacctccaatgagccctctgggaataaccctcccacacacctctccttggaccccacaaatgctgaaaacactgcctctcagtctccaaggacccgtggttcccggcggcagatccagcgtttggagcagctgctggcgctctatgtggcagagatccggcggctgcaggaaaaggagttggatctctcagaattggatgacccagactccgcatacctgcaggaggcacggttgaagcgtaagctgatccgcctctttgggcgactatgtgagctgaaagactgctcttcactgaccggccgtgtcatagagcagcgcatcccctaccgtggcacccgctacccagaggttaacaggcgcattgagcggctcatcaacaagccagggcctgataccttccctgactatggggatgtgcttcgggctgtagagaaggcagctgcccgacacagccttggcctcccccgacagcagctccagctcatggctcaggatgccttccgagatgtgggcatcaggttacaggagcgacgtcacctcgatctcatctacaactttggctgccacctcacagatgactataggccaggcgttgaccctgcactatcagatcctgtgttggcccggcgccttcgggaaaaccggagtttggccatgagtcggctggatgaggtcatctccaaatacgcaatgttgcaagacaaaagtgaggagggcgagagaaaaaagagaagagctcggctccaaggcacctcttcccactctgcagacacccccgaagcctccttggattctggtgagggccctagtggaatggcatcccaggggtgcccttctgcctccagagctgagacagatgacgaagacgatgaggagagtgatgaggaagaggaggaggaggaggaagaagaagaggaggaggccacagattctgaagaggaggaggatctggaacagatgcaggagggtcaggaggatgatgaagaggaggacgaagaggaagaagcagcagcaggtaaagatggagacaagagccccatgtcctcactacagatctccaatgaaaagaacctggaacctggcaaacagatcagcagatcttcaggggagcagcaaaacaaaggacgcatagtgtcaccatcgttactgtcagaagaacccctggccccctccagcatagatgctgaaagcaatggagaacagcctgaggagctgaccctggaggaagaaagccctgtgtctcagctctttgagctagagattgaagctttgcccctggataccccttcctctgtggagacggacatttcctcttccaggaagcaatcagaggagcccttcaccactgtcttagagaatggagcaggcatggtctcttctacttccttcaatggaggcgtctctcctcacaactggggagattctggtcccccctgcaaaaaatctcggaaggagaagaagcaaacaggatcagggccattaggaaacagctatgtggaaaggcaaaggtcagtgcatgagaagaatgggaaaaagatatgtaccctgcccagcccaccttcccccttggcttccttggccccagttgctgattcctccacgagggtggactctcccagccatggcctggtgaccagctccctctgcatcccttctccagcccggctgtcccaaaccccccattcacagcctcctcggcctggtacttgcaagacaagtgtggccacacaatgcgatccagaagagatcatcgtgctctcagactctgattagctgcctccccttctccctgcctccagaatgttctgggataacatttggaggaaggtgggaagcagatgactgaggaagggatggactaagctaatccccttttggtggtgtttctttaaaaaaaaaaaaaaaagcttaagttttacacagaaacattaataaacaataaagttcttttcttactgta

SEQ ID NO: 446 - DNA, 2607 bp, Homo sapiens
atatggcggcgcttagttgcatgaaggcggaaactctgtgacttccggtccgtagtggggcctgcggtgggagtgggaaggaaggcggagggaaccatgcgaggttctgagaattgcggcgagggtcgcctcgagagacggtttctgaggaattctgaaatccccaccacttcctccctccgggggatttgatcccctatggccaccgctaacagcatcatcgtgctggatgatgatgacgaagatgaagcagctgctcagccagggccctcccacccactccccaatgcggcctcacctggggcagaagcccctagctcctctgagcctcatggggccagaggaagcagtagttcgggcggcaagaaatgctacaagctggagaatgagaagctgttcgaagagttccttgaactttgtaagatgcagacagcagaccaccctgaggtggtcccattcctctataaccggcagcaacgtgcccactctctgtttttggcctcggcggagttctgcaacatcctctctagggtcctgtctcgggcccggagccggccagccaagctctatgtctacatcaatgagctctgcactgttctcaaggcccactcagccaaaaagaagctgaacttggcccctgccgccaccacctccaatgagccctctgggaataaccctcccacacacctctccttggaccccacaaatgctgaaaacactgcctctcagtctccaaggacccgtggttcccggcggcagatccagcgtttggagcagctgctggcgctctatgtggcagagatccggcggctgcaggaaaaggagttggatctctcagaattggatgacccagactccgcatacctgcaggaggcacggttgaagcgtaagctgatccgcctctttgggcgactatgtgagctgaaagactgctcttcactgaccggccgtgtcatagagcagcgcatcccctaccgtggcacccgctacccagaggttaacaggcgcattgagcggctcatcaacaagccagggcctgataccttccctgactatggggatgtgcttcgggctgtagagaaggcagctgcccgacacagccttggcctcccccgacagcagctccagctcatggctcaggatgccttccgagatgtgggcatcaggttacaggagcgacgtcacctcgatctcatctacaactttggctgccacctcacagatgactataggccaggcgttgaccctgcactatcagatcctgtgttggcccggcgccttcgggaaaaccggagtttggccatgagtcggctggatgaggtcatctccaaatatgcaatgttgcaagacaaaagtgaggagggcgagagaaaaaagagaagagctcggctccaaggcacctcttcccactctgcagacacccccgaagcctccttggattctggtgagggccctagtggaatggcatcccaggggtgcccttctgcctccagagctgagacagatgacgaagacgatgaggagagtgatgaggaagaggaggaggaggaggaagaagaagaggaggaggccacagattctgaagaggaggaggatctggaacagatgcaggagggtcaggaggatgatgaagaggaggacgaagaggaagaagcagcagcaggtaaagatggagacaagagccccatgtcctcactacagatctccaatgaaaagaacctggaacctggcaaacagatcagcagatcttcaggggagcagcaaaacaaaggacgcatagtgtcaccatcgttactgtcagaagaacccctggccccctccagcatagatgctgaaagcaatggagaacagcctgaggagctgaccctggaggaagaaagccctgtgtctcagctctttgagctagagattgaagctttgcccctggataccccttcctctgtggagacggacatttcctcttccaggaagcaatcagaggagcccttcaccactgtcttagagaatggagcaggcatggtctcttctacttccttcaatggaggcgtctctcctcacaactggggagattctggtcccccctgcaaaaaatctcggaaggagaagaagcaaacaggatcagggccattaggaaacagctatgtggaaaggcaaaggtcagtgcatgagaagaatgggaaaaagatatgtaccctgcccagcccaccttcccccttggcttccttggccccagttgctgattcctccacgagggtggactctcccagccatggcctggtgaccagctccctctgcatcccttctccagcccggctgtcccaaaccccccattcacagcctcctcggcctggtacttgcaagacaagtgtggccacacaatgcgatccagaagagatcatcgtgctctcagactctgattagctgcctccccttctccctgcctccagaatgttctgggataacatttggaggaaggtgggaagcagatgactgaggaagggatggactaagctaatccccttttggtggtgtttctttaaaaaaaaaaaaaaagcttaagttttacacagaaacattaataaacaataaagttcttttcttactgta

SEQ ID NO: 447 - DNA, 2152 bp, Homo sapiens
gtgacttccggtccgtagtggggcctgcggtgggagtgggaaggaaggcggagggaaccatgcgaggttctgagaattgcggcgagggtcgcctcgagagacggtttctgagttccttgaactttgtaagatgcagacagcagaccaccctgaggtggtcccattcctctataaccggcagcaacgtgcccactctctgtttttggcctcggcggagttctgcaacatcctctctagggtcctgtctcgggcccggagccggccagccaagctctatgtctacatcaatgagctctgcactgttctcaaggcccactcagccaaaaagaagctgaacttggcccctgccgccaccacctccaatgagccctctgggaataaccctcccacacacctctccttggaccccacaaatgctgaaaacactgcctctcagtctccaaggacccgtggttcccggcggcagatccagcgtttggagcagctgctggcgctctatgtggcagagatccggcggctgcaggaaaaggagttggatctctcagaattggatgacccagactccgcatacctgcaggaggcacggttgaagcgtaagctgatccgcctctttgggcgactatgtgagctgaaagactgctcttcactgaccggccgtgtcatagagcagcgcatcccctaccgtggcacccgctacccagaggttaacaggcgcattgagcggctcatcaacaagccagggcctgataccttccctgactatggggatgtgcttcgggctgtagagaaggcagctgcccgacacagccttggcctcccccgacagcagctccagctcatggctcaggatgccttccgagatgtgggcatcaggttacaggagcgacgtcacctcgatctcatctacaactttggctgccacctcacagatgactataggccaggcgttgaccctgcactatcagatcctgtgttggcccggcgccttcgggaaaaccggagtttggccatgagtcggctggatgaggtcatctccaaatatgcaatgttgcaagacaaaagtgaggagggcgagagaaaaaagagaagagctcggctccaaggcacctcttcccactctgcagacacccccgaagcctccttggattctggtgagggccctagtggaatggcatcccaggggtgcccttctgcctccagagctgagacagatgacgaagacgatgaggagagtgatgaggaagaggaggaggaggaggaagaagaagaggaggaggccacagattctgaagaggaggaggatctggaacagatgcaggagggtcaggaggatgatgaagaggaggacgaagaggaagaagcagcagcaggtaaagatggagacaagagccccatgtcctcactacagatctccaatgaaaagaacctggaacctggcaaacagatcagcagatcttcaggggagcagcaaaacaaaggacgcatagtgtcaccatcgttactgtcagaagaacccctggccccctccagcatagatgctgaaagcaatggagaacagcctgaggagctgaccctggaggaagaaagccctgtgtctcagctctttgagctagagattgaagctttgcccctggataccccttcctctgtggagacggacatttcctcttccaggaagcaatcagaggagcccttcaccactgtcttagagaatggagcaggcatggtctcttctacttccttcaatggaggcgtctctcctcacaactggggagattctggtcccccctgcaaaaaatctcggaaggagaagaagcaaacaggatcagggccattaggaaacagctatgtggaaaggcaaaggtcagtgcatgagaagaatgggaaaaagatatgtaccctgcccagcccaccttcccccttggcttccttggccccagttgctgattcctccacgagggtggactctcccagccatggcctggtgaccagctccctctgcatcccttctccagcccggctgtcccaaaccccccattcacagcctcctcggcctggtacttgcaagacaagtgtggccacacaatgcgatccagaagagatcatcgtgctctcagactctgattagctgcctccccttctccctgcctcc

SEQ ID NO: 448 - DNA, 751 bp, Homo sapiens
ggatgtgttcctggcatttgcccagggtccctcccctcccaggggtcccgtgcgacgtgccttggacaaggctttctttatcttcctggccctcttcctgacactgctgatgctggaggctgcttataagctgctgtggttactactatgggcaaagttaggggactggctcctggggacacctcagaaggaggaggagctggaattgtgaccacctttcctataaacatcttctttccccaccaaggagctcacctctggacccagccttgcctccacgagtccctccagcctccctaaacacaacgagcaggaattctgaaatccccaccacttcctccctccgggggatttgatcccctatggccaccgctaacagcatcatcgtgctggatgatgatgacgaagatgaagcagctgctcagccagggccctcccacccactccccaatgcggcctcacctggggcagaagcccctagctcctctgagcctcatggggccagaggaagcagtagttcgggcggcaagaaatgctacaagctggagaatgagaagctgttcgaagagttccttgaactttgtaagatgcagacagcagaccaccctgaggtggtcccattcctctataaccggcagcaacgtgcccactctctgtttttggcctcggcggagttctgcaacatcctctctagggtcctgtctcgggcccggagccggccagccaagctctatgtctacatcaatgagct

SEQ ID NO: 449 - DNA, 751 bp, Homo sapiens; identical to SEQ ID NO: 448

SEQ ID NO: 450 - DNA, 702 bp, Homo sapiens
ggtgggagtgggaaggaaggcggagggaaccatgcgaggttctgagaattgcggcgagggtcgcctcgagagacggtttctgaggggctcattctgaggccccatccccttccagcaggaattctgaaatccccaccacttcctccctccgggggatttgatcccctatggccaccgctaacagcatcatcgtgctggatgatgatgacgaagatgaagcagctgctcagccagggccctcccacccactccccaatgcggcctcacctggggcagaagcccctagctcctctgagcctcatggggccagaggaagcagtagttcgggcggcaagaaatgctacaagctggagaatgagaagctgttcgaagagttccttgaactttgtaagatgcagacagcagaccaccctgaggtggtcccattcctctataaccggcagcaacgtgcccactctctgtttttggcctcggcggagttctgcaacatcctctctagggtcctgtctcgggcccggagccggccagccaagctctatgtctacatcaatgagctctgcactgttctcaaggcccactcagccaaaaagaagctgaacttggcccctgccgccaccacctccaatgagccctctgggaataaccctcccacacacctctccttggaccccacaaatgctgaaaacactgcctctcagtctc

SEQ ID NO: 451 - DNA, 702 bp, Homo sapiens; identical to SEQ ID NO: 450

SEQ ID NO: 452 - DNA, 2522 bp, Homo sapiens
ggcggagggaaccatgcgaggttctgagaattgcggcgagggtcgcctcgagagacggtttctgaggaattctgaaatccccaccacttcctccctccgggggatttgatcccctatggccaccgctaacagcatcatcgtgctggatgatgatgacgaagatgaagcagctgctcagccagggccctcccacccactccccaatgcggcctcacctggggcagaagcccctagctcctctgagcctcatggggccagaggaagcagtagttcgggcggcaagaaatgctacaagctggagaatgagaagctgttcgaagagttccttgaactttgtaagatgcagacagcagaccaccctgaggtggtcccattcctctataaccggcagcaacgtgcccactctctgtttttggcctcggcggagttctgcaacatcctctctagggtcctgtctcgggcccggagccggccagccaagctctatgtctacatcaatgagctctgcactgttctcaaggcccactcagccaaaaagaagctgaacttggcccctgccgccaccacctccaatgagccctctgggaataaccctcccacacacctctccttggaccccacaaatgctgaaaacactgcctctcagtctccaaggacccgtggttcccggcggcagatccagcgtttggagcagctgctggcgctctatgtggcagagatccggcggctgcaggaaaaggagttggatctctcagaattggatgacccagactccgcatacctgcaggaggcacggttgaagcgtaagctgatccgcctctttgggcgactatgtgagctgaaagactgctcttcactgaccggccgtgtcatagagcagcgcatcccctaccgtggcacccgctacccagaggttaacaggcgcattgagcggctcatcaacaagccagggcctgataccttccctgactatggggatgtgcttcgggctgtagagaaggcagctgcccgacacagccttggcctcccccgacagcagctccagctcatggctcaggatgccttccgagatgtgggcatcaggttacaggagcgacgtcacctcgatctcatctacaactttggctgccacctcacagatgactataggccaggcgttgaccctgcactatcagatcctgtgttggcccggcgccttcgggaaaaccggagtttggccatgagtcggctggatgaggtcatctccaaatatgcaatgttgcaagacaaaagtgaggagggcgagagaaaaaagagaagagctcggctccaaggcacctcttcccactctgcagacacccccgaagcctccttggattctggtgagggccctagtggaatggcatcccaggggtgcccttctgcctccagagctgagacagatgacgaagacgatgaggagagtgatgaggaagaggaggaggaggaggaagaagaagaggaggaggccacagattctgaagaggaggaggatctggaacagatgcaggagggtcaggaggatgatgaagaggaggacgaagaggaagaagcagcagcaggtaaagatggagacaagagccccatgtcctcactacagatctccaatgaaaagaacctggaacctggcaaacagatcagcagatcttcaggggagcagcaaaacaaaggacgcatagtgtcaccatcgttactgtcagaagaacccctggccccctccagcatagatgctgaaagcaatggagaacagcctgaggagctgaccctggaggaagaaagccctgtgtctcagctctttgagctagagattgaagctttgcccctggataccccttcctctgtggagacggacatttcctcttccaggaagcaatcagaggagcccttcaccactgtcttagagaatggagcaggcatggtctcttctacttccttcaatggaggcgtctctcctcacaactggggagattctggtcccccctgcaaaaaatctcggaaggagaagaagcaaacaggatcagggccattaggaaacagctatgtggaaaggcaaaggtcagtgcatgagaagaatgggaaaaagatatgtaccctgcccagcccaccttcccccttggcttccttggccccagttgctgattcctccacgagggtggactctcccagccatggcctggtgaccagctccctctgcatcccttctccagcccggctgtcccaaaccccccattcacagcctcctcggcctggtacttgcaagacaagtgtggccacacaatgcgatccagaagagatcatcgtgctctcagactctgattagctgcctccccttctccctgcctccagaatgttctgggataacatttggaggaaggtgggaagcagatgactgaggaagggatggactaagctaatccccttttggtggtgtttctttaaaaaaaaaaaaagcttaagttttacacagaaacattaataaacaataaagttcttttcttactgta

SEQ ID NO: 453 - DNA, 2615 bp, Homo sapiens; identical to SEQ ID NO: 443

SEQ ID NO: 454 - DNA, 751 bp, Homo sapiens; identical to SEQ ID NO: 448

SEQ ID NO: 455 - DNA, 702 bp, Homo sapiens; identical to SEQ ID NO: 450

SEQ ID NO: 456 - DNA, 2545 bp, Homo sapiens
gcggtgggagtgggaaggaaggcggagggaaccatgcgaggttctgagaattgcggcgagggtcgcctcgagagacggtttctgagcaggaattctgaaatccccaccacttcctccctccgggggatttgatcccctatggccaccgctaacagcatcatcgtgctggatgatgatgacgaagatgaagcagctgctcagccagggccctcccacccactccccaatgcggcctcacctggggcagaagcccctagctcctctgagcctcatggggccagaggaagcagtagttcgggcggcaagaaatgctacaagctggagaatgagaagctgttcgaagagttccttgaactttgtaagatgcagacagcagaccaccctgaggtggtcccattcctctataaccggcagcaacgtgcccactctctgtttttggcctcggcggagttctgcaacatcctctctagggtcctgtctcgggcccggagccggccagccaagctctatgtctacatcaatgagctctgcactgttctcaaggcccactcagccaaaaagaagctgaacttggcccctgccgccaccacctccaatgagccctctgggaataaccctcccacacacctctccttggaccccacaaatgctgaaaacactgcctctcagtctccaaggacccgtggttcccggcggcagatccagcgtttggagcagctgctggcgctctatgtggcagagatccggcggctgcaggaaaaggagttggatctctcagaattggatgacccagactccgcatacctgcaggaggcacggttgaagcgtaagctgatccgcctctttgggcgactatgtgagctgaaagactgctcttcactgaccggccgtgtcatagagcagcgcatcccctaccgtggcacccgctacccagaggttaacaggcgcattgagcggctcatcaacaagccagggcctgataccttccctgactatggggatgtgcttcgggctgtagagaaggcagctgcccgacacagccttggcctcccccgacagcagctccagctcatggctcaggatgccttccgagatgtgggcatcaggttacaggagcgacgtcacctcgatctcatctacaactttggctgccacctcacagatgactataggccaggcgttgaccctgcactatcagatcctgtgttggcccggcgccttcgggaaaaccggagtttggccatgagtcggctggatgaggtcatctccaaatatgcaatgttgcaagacaaaagtgaggagggcgagagaaaaaagagaagagctcggctccaaggcacctcttcccactctgcagacacccccgaagcctccttggattctggtgagggccctagtggaatggcatcccaggggtgcccttctgcctccagagctgagacagatgacgaagacgatgaggagagtgatgaggaagaggaggaggaggaggaagaagaagaggaggaggccacagattctgaagaggaggaggatctggaacagatgcaggagggtcaggaggatgatgaagaggaggacgaagaggaagaagcagcagcaggtaaagatggagacaagagccccatgtcctcactacagatctccaatgaaaagaacctggaacctggcaaacagatcagcagatcttcaggggagcagcaaaacaaaggacgcatagtgtcaccatcgttactgtcagaagaacccctggccccctccagcatagatgctgaaagcaatggagaacagcctgaggagctgaccctggaggaagaaagccctgtgtctcagctctttgagctagagattgaagctttgcccctggataccccttcctctgtggagacggacatttcctcttccaggaagcaatcagaggagcccttcaccactgtcttagagaatggagcaggcatggtctcttctacttccttcaatggaggcgtctctcctcacaactggggagattctggtcccccctgcaaaaaatctcggaaggagaagaagcaaacaggatcagggccattaggaaacagctatgtggaaaggcaaaggtcagtgcatgagaagaatgggaaaaagatatgtaccctgcccagcccaccttcccccttggcttccttggccccagttgctgattcctccacgagggtggactctcccagccatggcctggtgaccagctccctctgcatcccttctccagcccggctgtcccaaaccccccattcacagcctcctcggcctggtacttgcaagacaagtgtggccacacaatgcgatccagaagagatcatcgtgctctcagactctgattagctgcctccccttctccctgcctccagaatgttctgggataacatttggaggaaggtgggaagcagatgactgaggaagggatggactaagctaatccccttttggtggtgtttctttaaaaaaaaaaaaagcttaagttttacacagaaacattaataaacaataaagttcttttcttactgta

SEQ ID NO: 457 - DNA, 702 bp, Homo sapiens; identical to SEQ ID NO: 450

SEQ ID NO: 458 - DNA, 751 bp, Homo sapiens; identical to SEQ ID NO: 448

SEQ ID NO: 459 - DNA, 751 bp, Homo sapiens; identical to SEQ ID NO: 448

SEQ ID NO: 460 - DNA, 702 bp, Homo sapiens; identical to SEQ ID NO: 450

SEQ ID NO: 461 - DNA, 2608 bp, Homo sapiens; identical to SEQ ID NO: 445

SEQ ID NO: 462 - DNA, 2152 bp, Homo sapiens; identical to SEQ ID NO: 447

SEQ ID NO: 463 - DNA, 2152 bp, Homo sapiens; identical to SEQ ID NO: 447

SEQ ID NO: 464 - DNA, 2152 bp, Homo sapiens
gtgacttccggtccgtagtggggcctgcggtgggagtgggaaggaaggcggagggaaccatgcgaggttctgagaattgcggcgagggtcgcctcgagagacggtttctgagttccttgaactttgtaagatgcagacagcagaccaccctgaggtggtcccattcctctataaccggcagcaacgtgcccactctctgtttttggcctcggcggagttctgcaacatcctctctagggtcctgtctcgggcccggagccggccagccaagctctatgtctacatcaatgagctctgcactgttctcaaggcccactcagccaaaaagaagctgaacttggcccctgccgccaccacctccaatgagccctctgggaataaccctcccacacacctctccttggaccccacaaatgctgaaaacactgcctctcagtctccaaggacccgtggttcccggcggcagatccagcgtttggagcagctgctggcgctctatgtggcagagatccggcggctgcaggaaaaggagttggatctctcagaattggatgacccagactccgcatacctgcaggaggcacggttgaagcgtaagctgatccgcctctttgggcgactatgtgagctgaaagactgctcttcactgaccggccgtgtcatagagcagcgcatcccctaccgtggcacccgctacccagaggttaacaggcgcattgagcggctcatcaacaagccagggcctgataccttccctgactatggggatgtgcttcgggctgtagagaaggcagctgcccgacacagccttggcctcccccgacagcagctccagctcatggctcaggatgccttccgagatgtgggcatcaggttacaggagcgacgtcacctcgatctcatctacaactttggctgccacctcacagatgactataggccaggcgttgaccctgcactatcagatcctgtgttggcccggcgccttcgggaaaaccggagtttggccatgagtcggctggatgaggtcatctccaaatacgcaatgttgcaagacaaaagtgaggagggcgagagaaaaaagagaagagctcggctccaaggcacctcttcccactctgcagacacccccgaagcctccttggattctggtgagggccctagtggaatggcatcccaggggtgcccttctgcctccagagctgagacagatgacgaagacgatgaggagagtgatgaggaagaggaggaggaggaggaagaagaagaggaggaggccacagattctgaagaggaggaggatctggaacagatgcaggagggtcaggaggatgatgaagaggaggacgaagaggaagaagcagcagcaggtaaagatggagacaagagccccatgtcctcactacagatctccaatgaaaagaacctggaacctggcaaacagatcagcagatcttcaggggagcagcaaaacaaaggacgcatagtgtcaccatcgttactgtcagaagaacccctggccccctccagcatagatgctgaaagcaatggagaacagcctgaggagctgaccctggaggaagaaagccctgtgtctcagctctttgagctagagattgaagctttgcccctggataccccttcctctgtggagacggacatttcctcttccaggaagcaatcagaggagcccttcaccactgtcttagagaatggagcaggcatggtctcttctacttccttcaatggaggcgtctctcctcacaactggggagattctggtcccccctgcaaaaaatctcggaaggagaagaagcaaacaggatcagggccattaggaaacagctatgtggaaaggcaaaggtcagtgcatgagaagaatgggaaaaagatatgtaccctgcccagcccaccttcccccttggcttccttggccccagttgctgattcctccacgagggtggactctcccagccatggcctggtgaccagctccctctgcatcccttctccagcccggctgtcccaaaccccccattcacagcctcctcggcctggtacttgcaagacaagtgtggccacacaatgcgatccagaagagatcatcgtgctctcagactctgattagctgcctccccttctccctgcctcc

SEQ ID NO: 465 - DNA, 2152 bp, Homo sapiens; identical to SEQ ID NO: 464

SEQ ID NO: 466 - DNA, 420 bp, Homo sapiens
atgagggcgctggaggggccaggcctgtcgctgctgtgcctggtgttggcgctgcctgccctgctgccggtgccggctgtacgcggagtggcagaaacacccacctacccctggcgggacgcagagacaggggagcggctggtgtgcgcccagtgccccccaggcacctttgtgcagcggccgtgccgccgagacagccccacgacgtgtggcccgtgtccaccgcgccactacacgcagttctggaactacctagagcgctgccgctactgcaacgtcctctgcggggagcgtgaggaggaggcacgggcttgccacgccacccacaaccgtgcctgctgcggctgctgcaggcgctgcgcgtggccaggatgcccgggctggagcggagcgtccgtgagcgcttcctccctgtgcact

SEQ ID NO: 467 - DNA, 1124 bp, Homo sapiens
tccgcaggcggaccgggggcaaaggaggtggcatgtcggtcaggcacagcagggtcctgtgtccgcgctgagccgcgctctccctgctccagcaaggaccatgagggcgctggaggggccaggcctgtcgctgctgtgcctggtgttggcgctgcctgccctgctgccggtgccggctgtacgcggagtggcagaaacacccacctacccctggcgggacgcagagacaggggagcggctggtgtgcgcccagtgccccccaggcacctttgtgcagcggccgtgccgccgagacagccccacgacgtgtggcccgtgtccaccgcgccactacacgcagttctggaactacctagagcgctgccgctactgcaacgtcctctgcggggagcgtgaggaggaggcacgggcttgccacgccacccacaaccgtgcctgccgctgccgcaccggcttcttcgcgcacgctggtttctgcttggagcacgcatcgtgtccacctggtgccggcgtgattgccccgggcacccccagccagaacacgcagtgccagccgtgccccccaggcaccttctcagccagcagctccagctcagagcagtgccagccccaccgcaactgcacggccctgggcctggccctcaatgtgccaggctcttcctcccatgacaccctgtgcaccagctgcactggcttccccctcagcaccagggtaccaggagctgaggagtgtgagcgtgccgtcatcgactttgtggctttccaggacatctccatcaagaggctgcagcggctgctgcaggccctcgaggccccggagggctggggtccgacaccaagggcgggccgcgcggccttgcagctgaagctgcgtcggcggctcacggagctcctgggggcgcaggacggggcgctgctggtgcggctgctgcaggcgctgcgcgtggccaggatgcccgggctggagcggagcgtccgtgagcgcttcctccctgtgcactgatcctggccccctcttatttattctacatccttggcaccccacttgcactgaaagaggcttttttttaaatagaagaaatgaggtttcttaaagcttatttttataaagctttttcataaaa

SEQ ID NO: 468 - DNA, 4945 bp, Homo sapiens
atgcccaagatagtcctgaatggtgtgaccgtagacttccctttccagccctacaaatgccaacaggagtacatgaccaaggtcctggaatgtctgcagcagaaggtgaatggcatcctggagagccctacgggtacagggaagacgctgtgcctgctgtgcaccacgctggcctggcgagaacacctccgagacggcatctctgcccgcaagattgccgagagggcgcaaggagagcttttcccggatcgggccttgtcatcctggggcaacgctgctgctgctgctggagaccccatagcttgctacacggacatcccaaagattatttacgcctccaggacccactcgcaactcacacaggtcatcaacgagcttcggaacacctcctaccggcctaaggtgtgtgtgctgggctcccgggagcagctgtgcatccatcctgaggtgaagaaacaagagagtaaccatctacagatccacttgtgccgtaagaaggtggcaagtcgctcctgtcatttctacaacaacgtagaagaaaaaagcctggagcaggagctggccagccccatcctggacattgaggacttggtcaagagcggaagcaagcacagggtgtgcccttactacctgtcccggaacctgaagcagcaagccgacatcatattcatgccgtacaattacttgttggatgccaagagccgcagagcacacaacattgacctgaaggggacagtcgtgatctttgacgaagctcacaacgtggagaagatgtgtgaagaatcggcatcctttgacctgactccccatgacctggcttcaggactggacgtcatagaccaggtgctggaggagcagaccaaggcagcgcagcagggtgagccccacccggagttcagcgcggactcccccagcccagggctgaacatggagctggaagacattgcaaagctgaagatgatcctgctgcgcctggagggggccatcgatgctgttgagctgcctggagacgacagcggtgtcaccaagccagggagctacatctttgagctgtttgctgaagcccagatcacgtttcagaccaagggctgcatcctggactcgctggaccagatcatccagcacctggcaggacgtgctggagtgttcaccaacacggccggactgcagaagctggcggacattatccagattgtgttcagtgtggacccctccgagggcagccctggttccccagcagggctgggggccttacagtcctataaggtgcacatccatcctgatgctggtcaccggaggacggctcagcggtctgatgcctggagcaccactgcagccagaaagcgagggaaggtgctgagctactggtgcttcagtcccggccacagcatgcacgagctggtccgccagggcgtccgctccctcatccttaccagcggcacgctggccccggtgtcctcctttgctctggagatgcagatccctttcccagtctgcctggagaacccacacatcatcgacaagcaccagatctgggtgggggtcgtccccagaggccccgatggagcccagttgagctccgcgtttgacagacggttttccgaggagtgcttatcctccctggggaaggctctgggcaacatcgcccgcgtggtgccctatgggctcctgatcttcttcccttcctatcctgtcatggagaagagcctggagttctggcgggcccgcgacttggccaggaagatggaggcgctgaagccgctgtttgtggagcccaggagcaaaggcagcttctccgagaccatcagtgcttactatgcaagggttgccgcccctgggtccaccggcgccaccttcctggcggtctgccggggcaaggccagcgaggggctggacttctcagacacgaatggccgtggtgtgattgtcacgggcctcccgtaccccccacgcatggacccccgggttgtcctcaagatgcagttcctggatgagatgaagggccagggtggggctgggggccagttcctctctgggcaggagtggtaccggcagcaggcgtccagggctgtgaaccaggccatcgggcgagtgatccggcaccgccaggactacggagctgtcttcctctgtgaccacaggttcgcctttgccgacgcaagagcccaactgccctcctgggtgcgtccccacgtcagggtgtatgacaactttggccatgtcatccgagacgtggcccagttcttccgtgttgccgagcgaactatgccagcgccggccccccgggctacagcacccagtgtgcgtggagaagatgctgtcagcgaggccaagtcgcctggccccttcttctccaccaggaaagctaagagtctggacctgcatgtccccagcctgaagcagaggtcctcagggtcaccagctgccggggaccccgagagtagcctgtgtgtggagtatgagcaggagccagttcctgcccggcagaggcccagggggctgctggccgccctggagcacagcgaacagcgggcggggagccctggcgaggagcaggcccacagctgctccaccctgtccctcctgtctgagaagaggccggcagaagaaccgcgaggagggaggaagaagatccggctggtcagccacccggaggagcccgtggctggtgcacagacggacagggccaagctcttcatggtggccgtgaagcaggagttgagccaagccaactttgccaccttcacccaggccctgcaggactacaagggttccgatgacttcgccgccctggccgcctgtctcggccccctctttgctgaggaccccaagaagcacaacctgctccaaggcttctaccagtttgtgcggccccaccataagcagcagtttgaggaggtctgtatccagctgacaggacgaggctgtggctatcggcctgagcacagcattccccgaaggcagcgggcacagccggtcctggaccccactggaagaacggcgccggatcccaagctgaccgtgtccacggctgcagcccagcagctggacccccaagagcacctgaaccagggcaggccccacctgtcgcccaggccacccccaacaggagaccctggcagccaaccacagtgggggtctggagtgcccagagcagggaagcagggccagcacgccgtgagcgcctacctggctgatgcccgcagggccctggggtccgcgggctgtagccaactcttggcagcgctgacagcctataagcaagacgacgacctcgacaaggtgctggctgtgttggccgccctgaccactgcaaagccagaggacttccccctgctgcacaggttcagcatgtttgtgcgtccacaccacaagcagcgcttctcacagacgtgcacagacctgaccggccggccctacccgggcatggagccaccgggaccccaggaggagaggcttgccgtgcctcctgtgcttacccacagggctccccaaccaggcccctcacggtccgagaagaccgggaagacccagagcaagatctcgtccttccttagacagaggccagcagggactgtgggggcgggcggtgaggatgcaggtcccagccagtcctcaggacctccccacgggcctgcagcatctgagtggggtgagcctcatgggagagacatcgctgggcagcaggccacgggagctccgggcgggcccctctcagcaggctgtgtgtgccagggctgtggggcagaggacgtggtgcccttccagtgccctgcctgtgacttccagcgctgccaagcctgctggcaacggcaccttcaggcctctaggatgtgcccagcctgccacaccgcctccaggaagcagagcgtcatgcaggtcttctggccagagccccacaaggaccatgagggcgctggaggggccaggcctgtcgctgctgtgcctggtgttggcgctgcctgccctgctgccggtgccggctgtacgcggagtggcagaaacacccacctacccctggcgggacgcagagacaggggagcggctggtgtgcgcccagtgccccccaggcacctttgtgcagcggccgtgccgccgagacagccccacgacgtgtggcccgtgtccaccgcgccactacacgcagttctggaactacctagagcgctgccgctactgcaacgtcctctgcggggagcgtgaggaggaggcacgggcttgccacgccacccacaaccgtgcctgccgctgccgcaccggcttcttcgcgcacgctggtttctgcttggagcacgcatcgtgtccacctggtgccggcgtgattgccccgggcacccccagccagaacacgcagtgccagccgtgccccccaggcaccttctcagccagcagctccagctcagagcagtgccagccccaccgcaactgcacggccctgggcctggccctcaatgtgccaggctcttcctcccatgacaccctgtgcaccagctgcactggcttccccctcagcaccagggtaccaggagctgaggagtgtgagcgtgccgtcatcgactttgtggctttccaggacatctccatcaagaggctgcagcggctgctgcaggccctcgaggccccggagggctggggtccgacaccaagggcgggccgcgcggccttgcagctgaagctgcgtcggcggctcacggagctcctgggggcgcaggacggggcgctgctggtgcggctgctgcaggcgctgcgcgtggccaggatgcccgggctggagcggagcgtccgtgagcgcttcctccctgtgcactgatcctggccccctcttatttattctacatccttggcaccccacttgcactgaaagaggcttttttttaaatagaagaaatgaggtttcttaaagcttatttttataaagctttttcataaaactggttgtagttgc

SEQ ID NO: 469 - DNA, 1136 bp, Homo sapiens
ccgctactctggccctcagggttgtgtagtttccggggccacggcacctgggcacaccaggtggcgtcgcgcctttgctttcctgagccttctgagtaaggtaatgtggtgtccgtggggcgacgcctgcgcacaagaccgcgtcgggcctcacttttcccaggccttctgggtaatgtagtttccgggatcggcacccggcctgtgccagcttgcagagctcaccaggtgcagacccctgcggccagggcgaggacggatctgagcagctgggcagcaggtgccaccgcctgtgggacccagagggcttgaggacatctgcaatgctccagaagcccaagagcgtgaagctgcgggccctgcgcagcccgaggaagttcggcgtggctggccggagctgccaggaggtgctgcgcaagggctgtctccgcttccagctccctgagcgcggttcccggctgtgcctgtacgaggatggcacggagctgacggaagattacttccccagtgttcccgacaacgccgagctggtgctgctcaccttgggccaggcctggcagggctatgtgagcgacatcaggcgcttcctcagtgcatttcacgagccacaggtggggctcatccaggccgcccagcagctgctgtgtgatgagcaggccccacagaggcagaggctgctggctgacctcctgcacaacgtcagccagaacatcgcggccgagacccgggctgaggacccgccgtggtttgaaggcttggagtcccgatttcagagcaagtctggctatctgagatacagctgtgagagccggatccggagttacctgagggaggtgagctcctacccctccacggtgggtgcggaggctcaggaggaattcctgcgggtcctcggctccatgtgccagaggctccggtccatgcagtacaatggcagctacttcgacagaggagccaagggcggcagccgcctctgcacaccggaaggctggttctcctgccagggtccctttgacatggacagctgcttatcaagacactccatcaacccctacagtaacagggagagcaggatcctcttcagcacctggaacctggatcacatagatggagtcttgctctgtggcccaggctaa

SEQ ID NO: 470 - DNA, 3005 bp, Homo sapiens
ggcacccggcctgtgccagcttgcagagctcaccaggtgcagacccctgcggccagggcgaggacggatctgagcagctgggcagcaggtgccaccgcctgtgggacccagagggcttgaggacatctgcaatgctccagaagcccaagagcgtgaagctgcgggccctgcgcagcccgaggaagttcggcgtggctggccggagctgccaggaggtgctgcgcaagggctgtctccgcttccagctccctgagcgcggttcccggctgtgcctgtacgaggatggcacggagctgacggaagattacttccccagtgttcccgacaacgccgagctggtgctgctcaccttgggccaggcctggcagggctctgttggtgtcagggcaaggacaaagacccgggacacctcaagtctgagtcctggtgattgccaggccctggggaatgggggaagatgtggtcagaggctcttcttgtgaccggggcaggatgtgtcttctgctggaccggcaccttttgtttgtcccattggtggcagatgtgagcgacatcaggcgcttcctcagtgcatttcacgagccacaggtggggctcatccaggccgcccagcagctgctgtgtgatgagcaggccccacagaggcagaggctgctggctgacctcctgcacaacgtcagccagaacatcgcggccgagacccgggctgaggacccgccgtggtttgaaggcttggagtcccgatttcagagcaagtctggctatctgagatacagctgtgagagccggatccggagttacctgagggaggtgagctcctacccctccacggtgggtgcggaggctcaggaggaattcctgcgggtcctcggctccatgtgccagaggctccggtccatgcagtacaatggcagctacttcgacagaggagccaagggcggcagccgcctctgcacaccggaaggctggttctcctgccagggtccctttgacatggacagctgcttatcaagacactccatcaacccctacagtaacagggagagcaggatcctcttcagcacctggaacctggatcacataatagaaaagaaacgcaccatcattcctacactggtggaagcaattaaggaacaagatggaagagaagtggactgggagtatttttatggcctgctttttacctcagagaacctaaaactagtgcacattgtctgccataagaaaaccacccacaagctcaactgtgacccaagcagaatctacaaaccccagacaaggttgaagcggaagcagcctgtgcggaaacgccagtgacacgtacacaccacgtcctggtctttgtttgaggcctgacgtgggcatcattttaacaggtgccttttttgtttttttgtttttcgtttttttggtcactccagtagctcctggaaaaaaccttaaaaaatgtttcctccaaatctgatttcattacatttctgaattgttggggttttttttgttgttttgttttgttttgtagatggagtttcacttttgttgcccaggctggagtgtagtggcgcgatctcggctcagcctcccgagtagctgggattacaggcatgtgccaccacgcccggctaatgtttgtatttttagtagagacggggtttcaccatgttggtcaggctggtctcaaactcctgacctcaggtgatccgcccacctcagcctcccaaagtgctgggatgacaggtgtgagccactgcgcccagcctgaatcatttcttataccttctgacagcccaacttccagaggacagctctggggtactcgttggatgtctgtgagtacctggtcatacgggtcagtagggataagaattgtctctgggctgaggaattcttctgttctctggtttcaccagcgttgggtttgctcatgtaatgtggtcaccatactcaaatggtgtcatggctgaagttggccaccttgcttgagggacaagttgtttatgtatcagctctctgctgggtctccctttccatggcaaatgggcagctccatcctcttgactcttctaaatgcccaaaagaggtgtcatgctttgggggtacgatgtttatactccgtaaagaacatacaaggacattcactgctgatttttttttttgtttgtttgagacagggtctcactctgtcgctcaggctggagtgcagtgatgcaatcttggctcactgcaacctccgcctctcaggttcaagtggttctccttcctcagcctcccaagtagctgggattacaggcacctaccaccagggccagctaatttttgtatgtttagtagaaacggggtttcaccatgttggccaggctgttctcgaactcctgacctcaggtgatctgcccgcctcggtctcccaaagtgctgggattacaggcatgagccactgcacctgacctgctgaattgtttataatggcaagaaataggaaaccccccaatgtctgttgaacagctatcacgttgaaccacgtgaaactgctgttttctaggccaaaaatggtgagcgatcatttatttcatgattcaacctgatacatttacatagtgcaaaactgtgtcacagtttcaggcttttatgaggaaagcgtttctgtgtagaaactggaagctgttcagggcatcggcagctgaaccctgctccgttggtcagcgttactatcatctcggatcatatggagctcatgtcagccgtgtgggtggcgggtgcacagagacggtctggaaggaaacacgcggatctgaacagcagtaatcctgggggatacgggggttgggctagattacagagggctcattttctacgtcatgtattttatgatacttgaattttttgaaatgggcatttattttataacatgttaaaatgtactttttaaattaagtcattttgtaatatttgaatttttacatttgttgtacaatcaggaaaagcaataaagatttttcaaaaataga

SEQ ID NO: 471 - DNA, 635 bp, Homo sapiens
ccgctactctggccctcagggttgtgtagtttccggggccacggcacctgggcacaccaggtggcgtcgcgcctttgctttcctgagccttctgagtaaggtaatgtggtgtccgtggggcgacgcctgcgcacaagaccgcgtcgggcctcacttttcccaggccttctgggtaatgtagtttccgggatcggcacccggcctgtgccagcttgcagagctcaccaggtgcagacccctgcggccagggcgaggacggatctgagcagctgggcagcaggtgccaccgcctgtgggacccagagggcttgaggacatctgcaatgctccagaagcccaagagcgtgaagctgcgggccctgcgcagcccgaggaagttcggcgtggctggccggagctgccaggaggtgctgcgcaagggctgtctccgcttccagctccctgagcgcggttcccggctgtgcctgtacgaggatggcacggagctgacggaagattacttccccagtgttcccgacaacgccgagctggtgctgctcaccttgggccaggcctggcagggctggtttcgccatgtttcccaggatagtctcacactcctgggctcaagctgtcctcctgccttggtctcctaa

SEQ ID NO: 472 - DNA, 2842 bp, Homo sapiens
ccctgcggccagggcgaggacggatctgagcagctgggcagcaggtgccaccgcctgtgggacccagagggcttgaggacatctgcaatgctccagaagcccaagagcgtgaagctgcgggccctgcgcagcccgaggaagttcggcgtggctggccggagctgccaggaggtgctgcgcaagggctgtctccgcttccagctccctgagcgcggttcccggctgtgcctgtacgaggatggcacggagctgacggaagattacttccccagtgttcccgacaacgccgagctggtgctgctcaccttgggccaggcctggcagggctgatgtgtcttctgctggaccggcaccttttgtttgtcccattggtggcagatgtgagcgacatcaggcgcttcctcagtgcatttcacgagccacaggtggggctcatccaggccgcccagcagctgctgtgtgatgagcaggccccacagaggcagaggctgctggctgacctcctgcacaacgtcagccagaacatcgcggccgagacccgggctgaggacccgccgtggtttgaaggcttggagtcccgatttcagagcaagtctggctatctgagatacagctgtgagagccggatccggagttacctgagggaggtgagctcctacccctccacggtgggtgcggaggctcaggaggaattcctgcgggtcctcggctccatgtgccagaggctccggtccatgcagtacaatggcagctacttcgacagaggagccaagggcggcagccgcctctgcacaccggaaggctggttctcctgccagggtccctttgacatggacagctgcttatcaagacactccatcaacccctacagtaacagggagagcaggatcctcttcagcacctggaacctggatcacataatagaaaagaaacgcaccatcattcctacactggtggaagcaattaaggaacaagatggaagagaagtggactgggagtatttttatggcctgctttttacctcagagaacctaaaactagtgcacattgtctgccataagaaaaccacccacaagctcaactgtgacccaagcagaatctacaaaccccagacaaggttgaagcggaagcagcctgtgcggaaacgccagtgacacgtacacaccacgtcctggtctttgtttgaggcctgacgtgggcatcattttaacaggtgccttttttgtttttttgtttttcgtttttttggtcactccagtagctcctggaaaaaaccttaaaaaatgtttcctccaaatctgatttcattacatttctgaattgttggggttttttttgttgttttgttttgttttgtagatggagtttcacttttgttgcccaggctggagtgtagtggcgcgatctcggctcagcctcccgagtagctgggattacaggcatgtgccaccacgcccggctaatgtttgtatttttagtagagacggggtttcaccatgttggtcaggctggtctcaaactcctgacctcaggtgatccgcccacctcagcctcccaaagtgctgggatgacaggtgtgagccactgcgcccagcctgaatcatttcttataccttctgacagcccaacttccagaggacagctctggggtactcgttggatgtctgtgagtacctggtcatacgggtcagtagggataagaattgtctctgggctgaggaattcttctgttctctggtttcaccagcgttgggtttgctcatgtaatgtggtcaccatactcaaatggtgtcatggctgaagttggccaccttgcttgagggacaagttgtttatgtatcagctctctgctgggtctccctttccatggcaaatgggcagctccatcctcttgactcttctaaatgcccaaaagaggtgtcatgctttgggggtacgatgtttatactccgtaaagaacatacaaggacattcactgctgatttttttttttgtttgtttgagacagggtctcactctgtcgctcaggctggagtgcagtgatgcaatcttggctcactgcaacctccgcctctcaggttcaagtggttctccttcctcagcctcccaagtagctgggattacaggcacctaccaccagggccagctaatttttgtatgtttagtagaaacggggtttcaccatgttggccaggctgttctcgaactcctgacctcaggtgatctgcccgcctcggtctcccaaagtgctgggattacaggcatgagccactgcacctgacctgctgaattgtttataatggcaagaaataggaaaccccccaatgtctgttgaacagctatcacgttgaaccacgtgaaactgctgttttctaggccaaaaatggtgagcgatcatttatttcatgattcaacctgatacatttacatagtgcaaaactgtgtcacagtttcaggcttttatgaggaaagcgtttctgtgtagaaactggaagctgttcagggcatcggcagctgaaccctgctccgttggtcagcgttactatcatctcggatcatatggagctcatgtcagccgtgtgggtggcgggtgcacagagacggtctggaaggaaacacgcggatctgaacagcagtaatcctgggggatacgggggttgggctagattacagagggctcattttctacgtcatgtattttatgatacttgaattttttgaaatgggcatttattttataacatgttaaaatgtactttttaaattaagtcattttgtaatatttgaatttttacatttgttgtacaatcaggaaaagcaataaagatttttcaaaaataga

SEQ ID NO: 473 - DNA, 3028 bp, Homo sapiens
ccgctactctggccctcagggttgtgtagtttccggggccacggcacctgggcacaccaggtggcgtcgcgcctttgctttcctgagccttctgagtaaggtaatgtggtgtccgtggggcgacgcctgcgcacaagaccgcgtcgggcctcacttttcccaggccttctgggtaatgtagtttccgggatcggcacccggcctgtgccagcttgcagagctcaccaggtgcagacccctgcggccagggcgaggacggatctgagcagctgggcagcaggtgccaccgcctgtgggacccagagggcttgaggacatctgcaatgctccagaagcccaagagcgtgaagctgcgggccctgcgcagcccgaggaagttcggcgtggctggccggagctgccaggaggtgctgcgcaagggctgtctccgcttccagctccctgagcgcggttcccggctgtgcctgtacgaggatggcacggagctgacggaagattacttccccagtgttcccgacaacgccgagctggtgctgctcaccttgggccaggcctggcagggctatgtgagcgacatcaggcgcttcctcagtgcatttcacgagccacaggtggggctcatccaggccgcccagcagctgctgtgtgatgagcaggccccacagaggcagaggctgctggctgacctcctgcacaacgtcagccagaacatcgcggccgagacccgggctgaggacccgccgtggtttgaaggcttggagtcccgatttcagagcaagtctggctatctgagatacagctgtgagagccggatccggagttacctgagggaggtgagctcctacccctccacggtgggtgcggaggctcaggaggaattcctgcgggtcctcggctccatgtgccagaggctccggtccatgcagtacaatggcagctacttcgacagaggagccaagggcggcagccgcctctgcacaccggaaggctggttctcctgccagggtccctttgacatggacagctgcttatcaagacactccatcaacccctacagtaacagggagagcaggatcctcttcagcacctggaacctggatcacataatagaaaagaaacgcaccatcattcctacactggtggaagcaattaaggaacaagatggaagagaagtggactgggagtatttttatggcctgctttttacctcagagaacctaaaactagtgcacattgtctgccataagaaaaccacccacaagctcaactgtgacccaagcagaatctacaaaccccagacaaggttgaagcggaagcagcctgtgcggaaacgccagtgacacgtacacaccacgtcctggtctttgtttgaggcctgacgtgggcatcattttaacaggtgccttttttgtttttttgtttttcgtttttttggtcactccagtagctcctggaaaaaaccttaaaaaatgtttcctccaaatctgatttcattacatttctgaattgttggggttttttttgttgttttgttttgttttgtagatggagtttcacttttgttgcccaggctggagtgtagtggcgcgatctcggctcagcctcccgagtagctgggattacaggcatgtgccaccacgcccggctaatgtttgtatttttagtagagacggggtttcaccatgttggtcaggctggtctcaaactcctgacctcaggtgatccgcccacctcagcctcccaaagtgctgggatgacaggtgtgagccactgcgcccagcctgaatcatttcttataccttctgacagcccaacttccagaggacagctctggggtactcgttggatgtctgtgagtacctggtcatacgggtcagtagggataagaattgtctctgggctgaggaattcttctgttctctggtttcaccagcgttgggtttgctcatgtaatgtggtcaccatactcaaatggtgtcatggctgaagttggccaccttgcttgagggacaagttgtttatgtatcagctctctgctgggtctccctttccatggcaaatgggcagctccatcctcttgactcttctaaatgcccaaaagaggtgtcatgctttgggggtacgatgtttatactccgtaaagaacatacaaggacattcactgctgatttttttttttgtttgtttgagacagggtctcactctgtcgctcaggctggagtgcagtgatgcaatcttggctcactgcaacctccgcctctcaggttcaagtggttctccttcctcagcctcccaagtagctgggattacaggcacctaccaccagggccagctaatttttgtatgtttagtagaaacggggtttcaccatgttggccaggctgttctcgaactcctgacctcaggtgatctgcccgcctcggtctcccaaagtgctgggattacaggcatgagccactgcacctgacctgctgaattgtttataatggcaagaaataggaaaccccccaatgtctgttgaacagctatcacgttgaaccacgtgaaactgctgttttctaggccaaaaatggtgagcgatcatttatttcatgattcaacctgatacatttacatagtgcaaaactgtgtcacagtttcaggcttttatgaggaaagcgtttctgtgtagaaactggaagctgttcagggcatcggcagctgaaccctgctccgttggtcagcgttactatcatctcggatcatatggagctcatgtcagccgtgtgggtggcgggtgcacagagacggtctggaaggaaacacgcggatctgaacagcagtaatcctgggggatacgggggttgggctagattacagagggctcattttctacgtcatgtattttatgatacttgaattttttgaaatgggcatttattttataacatgttaaaatgtactttttaaattaagtcattttgtaatatttgaatttttacatttgttgtacaatcaggaaaagcaataaagatttttcaaaaataga

SEQ ID NO: 474 - DNA, 674 bp, Homo sapiens
ccgctactctggccctcagggttgtgtagtttccggggccacggcacctgggcacaccaggtggcgtcgcgcctttgctttcctgagccttctgagtaaggtaatgtggtgtccgtggggcgacgcctgcgcacaagaccgcgtcgggcctcacttttcccaggccttctgggtaatgtagtttccgggatcggcacccggcctgtgccagcttgcagagctcaccaggtgcagacccctgcggccagggcgaggacggatctgagcagctgggcagcaggtgccaccgcctgtgggacccagagggcttgaggacatctgcaatgctccagaagcccaagagcgtgaagctgcgggccctgcgcagcccgaggaagttcggcgtggctggccggagctgccaggaggtgctgcgcaagggctgtctccgcttccagctccctgagcgcggttcccggctgtgcctgtacgaggatggcacggagctgacggaagattacttccccagtgttcccgacaacgccgagctggtgctgctcaccttgggccaggcctggcagggctctgttggtgtcagggcaaggacaaagacccgggacacctcaagtctgagtcctggtgattgccaggccctggggaatgggggaagatgtggtcagaggctcttcttgtga

SEQ ID NO: 475 - DNA, 944 bp, Homo sapiens
atgctccagaagcccaagagcgtgaagctgcgggccctgcgcagcccgaggaagttcggcgtggctggccggagctgccaggaggtgctgcgcaagggctgtctccgcttccagctccctgagcgcggttcccggctgtgcctgtacgaggatggcacggagctgacggaagattacttccccagtgttcccgacaacgccgagctggtgctgctcaccttgggccaggcctggcagggctgctggagtgcagtggcgtgatcttggctcaccgcaacctctgcctccctgcaccctctgcctcccaggttaaagcgattctcctgcctcagcctcccgagtagctgggattacagggcttggagtcccgatttcagagcaagtctggctatctgagatacagctgtgagagccggatccggagttacctgagggaggtgagctcctacccctccacggtgggtgcggaggctcaggaggaattcctgcgggtcctcggctccatgtgccagaggctccggtccatgcagtacaatggcagctacttcgacagaggagccaagggcggcagccgcctctgcacaccggaaggctggttctcctgccagggtccctttgacatggacagctgcttatcaagacactccatcaacccctacagtaacagggagagcaggatcctcttcagcacctggaacctggatcacataatagaaaagaaacgcaccatcattcctacactggtggaagcaattaaggaacaagatggaagagaagtggactgggagtatttttatggcctgctttttacctcagagaacctaaaactagtgcacattgtctgccataagaaaaccacccacaagctcaactgtgacccaagcagaatctacaaaccccagacaaggttgaagcggaagcagcctgtgcggaaacgccagtga

SEQ ID NO: 476 - DNA, 572 bp, Homo sapiens
atgctccagaagcccaagagcgtgaagctgcgggccctgcgcagcccgaggaagttcggcgtggctggccggagctgccaggaggtgctgcgcaagggctgtctccgcttccagctccctgagcgcggttcccggctgtgcctgtacgaggatggcacggagctgacggaagattacttccccagtgttcccgacaacgccgagctggtgctgctcaccttgggccaggcctggcagggctgtgagtgatggacagctgcttatcaagacactccatcaacccctacagtaacagggagagcaggatcctcttcagcacctggaacctggatcacataatagaaaagaaacgcaccatcattcctacactggtggaagcaattaaggaacaagatggaagagaagtggactgggagtatttttatggcctgctttttacctcagagaacctaaaactagtgcacattgtctgccataagaaaaccacccacaagctcaactgtgacccaagcagaatctacaaaccccagacaaggttgaagcggaagcagcctgtgcggaaacgccagtga

SEQ ID NO: 477 - DNA, 3152 bp, Homo sapiens
ccgctactctggccctcagggttgtgtagtttccggggccacggcacctgggcacaccaggtggcgtcgcgcctttgctttcctgagccttctgagtaaggtaatgtggtgtccgtggggcgacgcctgcgcacaagaccgcgtcgggcctcacttttcccaggccttctgggtaatgtagtttccgggatcggcacccggcctgtgccagcttgcagagctcaccaggtgcagacccctgcggccagggcgaggacggatctgagcagctgggcagcaggtgccaccgcctgtgggacccagagggcttgaggacatctgcaatgctccagaagcccaagagcgtgaagctgcgggccctgcgcagcccgaggaagttcggcgtggctggccggagctgccaggaggtgctgcgcaagggctgtctccgcttccagctccctgagcgcggttcccggctgtgcctgtacgaggatggcacggagctgacggaagattacttccccagtgttcccgacaacgccgagctggtgctgctcaccttgggccaggcctggcagggctatgtgagcgacatcaggcgcttcctcagtgcatttcacgagccacaggtggggctcatccaggccgcccagcagctgctgtgtgatgagcaggccccacagaggcagaggctgctggctgacctcctgcacaacgtcagccagaacatcgcggccgagacccgggctgaggacccgccgtggtttgaaggcttggagtcccgatttcagagcaagtctggctatctgagatacagctgtgagagccggatccggagttacctgagggaggtgagctcctacccctccacggtgggtgcggaggctcaggaggaattcctgcgggtcctcggctccatgtgccagaggctccggtccatgcagtacaatggcagctacttcgacagaggagccaagggcggcagccgcctctgcacaccggaaggctggttctcctgccagggtccctttgacatggacagctgcttatcaagacactccatcaacccctacagtaacagggagagcaggatcctcttcagcacctggaacctggatcacatagatggagtcttgctctgtggcccaggctaaagtgcagtggcaggatcatggctcactgaagccctgaactcctggcctcaagcaatcctcctgcctcagcctcctgagtcgctgggactacagaatagaaaagaaacgcaccatcattcctacactggtggaagcaattaaggaacaagatggaagagaagtggactgggagtatttttatggcctgctttttacctcagagaacctaaaactagtgcacattgtctgccataagaaaaccacccacaagctcaactgtgacccaagcagaatctacaaaccccagacaaggttgaagcggaagcagcctgtgcggaaacgccagtgacacgtacacaccacgtcctggtctttgtttgaggcctgacgtgggcatcattttaacaggtgccttttttgtttttttgtttttcgtttttttggtcactccagtagctcctggaaaaaaccttaaaaaatgtttcctccaaatctgatttcattacatttctgaattgttggggttttttttgttgttttgttttgttttgtagatggagtttcacttttgttgcccaggctggagtgtagtggcgcgatctcggctcagcctcccgagtagctgggattacaggcatgtgccaccacgcccggctaatgtttgtatttttagtagagacggggtttcaccatgttggtcaggctggtctcaaactcctgacctcaggtgatccgcccacctcagcctcccaaagtgctgggatgacaggtgtgagccactgcgcccagcctgaatcatttcttataccttctgacagcccaacttccagaggacagctctggggtactcgttggatgtctgtgagtacctggtcatacgggtcagtagggataagaattgtctctgggctgaggaattcttctgttctctggtttcaccagcgttgggtttgctcatgtaatgtggtcaccatactcaaatggtgtcatggctgaagttggccaccttgcttgagggacaagttgtttatgtatcagctctctgctgggtctccctttccatggcaaatgggcagctccatcctcttgactcttctaaatgcccaaaagaggtgtcatgctttgggggtacgatgtttatactccgtaaagaacatacaaggacattcactgctgatttttttttttgtttgtttgagacagggtctcactctgtcgctcaggctggagtgcagtgatgcaatcttggctcactgcaacctccgcctctcaggttcaagtggttctccttcctcagcctcccaagtagctgggattacaggcacctaccaccagggccagctaatttttgtatgtttagtagaaacggggtttcaccatgttggccaggctgttctcgaactcctgacctcaggtgatctgcccgcctcggtctcccaaagtgctgggattacaggcatgagccactgcacctgacctgctgaattgtttataatggcaagaaataggaaaccccccaatgtctgttgaacagctatcacgttgaaccacgtgaaactgctgttttctaggccaaaaatggtgagcgatcatttatttcatgattcaacctgatacatttacatagtgcaaaactgtgtcacagtttcaggcttttatgaggaaagcgtttctgtgtagaaactggaagctgttcagggcatcggcagctgaaccctgctccgttggtcagcgttactatcatctcggatcatatggagctcatgtcagccgtgtgggtggcgggtgcacagagacggtctggaaggaaacacgcggatctgaacagcagtaatcctgggggatacgggggttgggctagattacagagggctcattttctacgtcatgtattttatgatacttgaattttttgaaatgggcatttattttataacatgttaaaatgtactttttaaattaagtcattttgtaatatttgaatttttacatttgttgtacaatcaggaaaagcaataaagatttttcaaaaataga

SEQ ID NO: 478 - DNA, 1119 bp, Homo sapiens
atggagcagcggccgcggggctgcgcggcggtggcggcggcgctcctcctggtgctgctgggggcccgggcccagggcggcactcgtagccccaggtgtgactgtgccggtgacttccacaagaagattggtctgttttgttgcagaggctgcccagcggcctcccaggtggcgctggagaactgttcagcagtggccgacacccgctgtggctgtaagccaggctggtttgtggagtgccaggtcagccaatgtgtcagcagttcacccttctactgccaaccatgcctagactgcggggccctgcaccgccacacacggctactctgttcccgcagagatactgactgtgggacctgcctgcctggcttctatgaacatggcgatggctgcgtgtcctgccccacgagcaccctggggagctgtccagagcgctgtgccgctgtctgtggctggaggcagatgttctgggtccaggtgctcctggctggccttgtggtccccctcctgcttggggccaccctgacctacacataccgccactgctggcctcacaagcccctggttactgcagatgaagctgggatggaggctctgaccccaccaccggccacccatctgtcacccttggacagcgcccacacccttctagcacctcctgacagcagtgagaagatctgcaccgtccagttggtgggtaacagctggacccctggctaccccgagacccaggaggcgctctgcccgcaggtgacatggtcctgggaccagttgcccagcagagctcttggccccgctgctgcgcccacactctcgccagagtccccagccggctcgccagccatgatgctgcagccgggcccgcagctctacgacgtgatggacgcggtcccagcgcggcgctggaaggagttcgtgcgcacgctggggctgcgcgaggcagagatcgaagccgtggaggtggagatcggccgcttccgagaccagcagtacgagatgctcaagcgctggcgccagcagcagcccgcgggcctcggagccgtttacgcggccctggagcgcatggggctggacggctgcgtggaagacttgcgcagccgcctgcagcgcggcccgtga

SEQ ID NO: 479 - DNA, 705 bp, Homo sapiens
atggagcagcggccgcggggctgcgcggcggtggcggcggcgctcctcctggtgctgctgggggcccgggcccagggcggcactcgtagccccaggtgtgactgtgccggtgacttccacaagaagattggtctgttttgttgcagaggctgcccagcggatgaagctgggatggaggctctgaccccaccaccggccacccatctgtcacccttggacagcgcccacacccttctagcacctcctgacagcagtgagaagatctgcaccgtccagttggtgggtaacagctggacccctggctaccccgagacccaggaggcgctctgcccgcaggtgacatggtcctgggaccagttgcccagcagagctcttggccccgctgctgcgcccacactctcgccagagtccccagccggctcgccagccatgatgctgcagccgggcccgcagctctacgacgtgatggacgcggtcccagcgcggcgctggaaggagttcgtgcgcacgctggggctgcgcgaggcagagatcgaagccgtggaggtggagatcggccgcttccgagaccagcagtacgagatgctcaagcgctggcgccagcagcagcccgcgggcctcggagccgtttacgcggccctggagcgcatggggctggacggctgcgtggaagacttgcgcagccgcctgcagcgcggcccgtga

SEQ ID NO: 480 - DNA, 1441 bp, Homo sapiens
ctgaaggcggaaccacgacgggcagagagcacggagccgggaagcccctgggcgcccgtcggagggctatggagcagcggccgcggggctgcgcggcggtggcggcggcgctcctcctggtgctgctgggggcccgggcccagggcggcactcgtagccccaggtgtgactgtgccggtgacttccacaagaagattggtctgttttgttgcagaggctgcccagcggggcactacctgaaggccccttgcacggagccctgcggcaactccacctgccttgtgtgtccccaagacaccttcttggcctgggagaaccaccataattctgaatgtgcccgctgccaggcctgtgatgagcaggcctcccaggtggcgctggagaactgttcagcagtggccgacacccgctgtggctgtaagccaggctggtttgtggagtgccaggtcagccaatgtgtcagcagttcacccttctactgccaaccatgcctagactgcggggccctgcaccgccacacacggctactctgttcccgcagagatactgactgtgggacctgcctgcctggcttctatgaacatggcgatggctgcgtgtcctgccccacgagcaccctggggagctgtccagagcgctgtgccgctgtctgtggctggaggcagaatgaagctgggatggaggctctgaccccaccaccggccacccatctgtcacccttggacagcgcccacacccttctagcacctcctgacagcagtgagaagatctgcaccgtccagttggtgggtaacagctggacccctggctaccccgagacccaggaggcgctctgcccgcaggtgacatggtcctgggaccagttgcccagcagagctcttggccccgctgctgcgcccacactctcgccagagtccccagccggctcgccagccatgatgctgcagccgggcccgcagctctacgacgtgatggacgcggtcccagcgcggcgctggaaggagttcgtgcgcacgctggggctgcgcgaggcagagatcgaagccgtggaggtggagatcggccgcttccgagaccagcagtacgagatgctcaagcgctggcgccagcagcagcccgcgggcctcggagccgtttacgcggccctggagcgcatggggctggacggctgcgtggaagacttgcgcagccgcctgcagcgcggcccgtgacacggcgcccacttgccacctaggcgctctggtggcccttgcagaagccctaagtacggttacttatgcgtgtagacattttatgtcacttattaagccgctggcacggccctgcgtagcagcaccagccggccccacccctgctcgcccctatcgctccagccaaggcgaagaagcacgaacgaatgtcgagagggggtgaagacatttctcaacttctcggccggagt

SEQ ID NO: 481 - DNA, 1625 bp, Homo sapiens
cgggccctgcgggcgcggggctgaaggcggaaccacgacgggcagagagcacggagccgggaagcccctgggcgcccgtcggagggctatggagcagcggccgcggggctgcgcggcggtggcggcggcgctcctcctggtgctgctgggggcccgggcccagggcggcactcgtagccccaggtgtgactgtgccggtgacttccacaagaagattggtctgttttgttgcagaggctgcccagcggggcactacctgaaggccccttgcacggagccctgcggcaactccacctgccttgtgtgtccccaagacaccttcttggcctgggagaaccaccataattctgaatgtgcccgctgccaggcctgtgatgagcaggcctcccaggtggcgctggagaactgttcagcagtggccgacacccgctgtggctgtaagccaggctggtttgtggagtgccaggtcagccaatgtgtcagcagttcacccttctactgccaaccatgcctagactgcggggccctgcaccgccacacacggctactctgttcccgcagagatactgactgtgggacctgcctgcctggcttctatgaacatggcgatggctgcgtgtcctgccccacgagcaccctggggagctgtccagagcgctgtgccgctgtctgtggctggaggcagatgttctgggtccaggtgctcctggctggccttgtggtccccctcctgcttggggccaccctgacctacacataccgccactgctggcctcacaagcccctggttactgcagatgaagctgggatggaggctctgaccccaccaccggccacccatctgtcacccttggacagcgcccacacccttctagcacctcctgacagcagtgagaagatctgcaccgtccagttggtgggtaacagctggacccctggctaccccgagacccaggaggcgctctgcccgcaggtgacatggtcctgggaccagttgcccagcagagctcttggccccgctgctgcgcccacactctcgccagagtccccagccggctcgccagccatgatgctgcagccgggcccgcagctctacgacgtgatggacgcggtcccagcgcggcgctggaaggagttcgtgcgcacgctggggctgcgcgaggcagagatcgaagccgtggaggtggagatcggccgcttccgagaccagcagtacgagatgctcaagcgctggcgccagcagcagcccgcgggcctcggagccgtttacgcggccctggagcgcatggggctggacggctgcgtggaagacttgcgcagccgcctgcagcgcggcccgtgacacggcgcccacttgccacctaggcgctctggtggcccttgcagaagccctaagtacggttacttatgcgtgtagacattttatgtcacttattaagccgctggcacggccctgcgtagcagcaccagccggccccacccctgctcgcccctatcgctccagccaaggcgaagaagcacgaacgaatgtcgagagggggtgaagacatttctcaacttctcggccggagtttggctgagatcgcggtattaaatctgtgaaagaaaacaaaacaaaacaaaaa

SEQ ID NO: 482 - DNA, 1632 bp, Homo sapiens
ctgaaggcggaaccacgacgggcagagagcacggagccgggaagcccctgggcgcccgtcggagggctatggagcagcggccgcggggctgcgcggcggtggcggcggcgctcctcctggtgctgctgggggcccgggcccagggcggcactcgtagccccaggtgtgactgtgccggtgacttccacaagaagattggtctgttttgttgcagaggctgcccagcggggcactacctgaaggccccttgcacggagccctgcggcaactccacctgccttgtgtgtccccaagacaccttcttggcctgggagaaccaccataattctgaatgtgcccgctgccaggcctgtgatgagcaggcctcccaggtggcgctggagaactgttcagcagtggccgacacccgctgtggctgtaagccaggctggtttgtggagtgccaggtcagccaatgtgtcagcagttcacccttctactgccaaccatgcctagactgcggggccctgcaccgccacacacggctactctgttcccgcagagatactgactgtgggacctgcctgcctggcttctatgaacatggcgatggctgcgtgtcctgccccacgccacccccgtcccttgcaggagcaccctggggagctgtccagagcgctgtgccgctgtctgtggctggaggcagagtaggtgtgttctgggtccaggtgctcctggctggccttgtggtccccctcctgcttggggccaccctgacctacacataccgccactgctggcctcacaagcccctggttactgcagatgaagctgggatggaggctctgaccccaccaccggccacccatctgtcacccttggacagcgcccacacccttctagcacctcctgacagcagtgagaagatctgcaccgtccagttggtgggtaacagctggacccctggctaccccgagacccaggaggcgctctgcccgcaggtgacatggtcctgggaccagttgcccagcagagctcttggccccgctgctgcgcccacactctcgccagagtccccagccggctcgccagccatgatgctgcagccgggcccgcagctctacgacgtgatggacgcggtcccagcgcggcgctggaaggagttcgtgcgcacgctggggctgcgcgaggcagagatcgaagccgtggaggtggagatcggccgcttccgagaccagcagtacgagatgctcaagcgctggcgccagcagcagcccgcgggcctcggagccgtttacgcggccctggagcgcatggggctggacggctgcgtggaagacttgcgcagccgcctgcagcgcggcccgtgacacggcgcccacttgccacctaggcgctctggtggcccttgcagaagccctaagtacggttacttatgcgtgtagacattttatgtcacttattaagccgctggcacggccctgcgtagcagcaccagccggccccacccctgctcgcccctatcgctccagccaaggcgaagaagcacgaacgaatgtcgagagggggtgaagacatttctcaacttctcggccggagtttggctgagatcgcggtattaaatctgtgaaagaaaacaaaacaaaacaaaaa

SEQ ID NO: 483 - DNA, 2714 bp, Homo sapiens
actccgaatgcgaagttctgtcttgtcatagccaagcacgctgcttcttggattgacctggcaggatggcgccaccaccagctagagtacatctaggtgcgttcctggcagtgactccgaatcccgggagcgcagcgagtgggacagaggcagccgcggccacacccagcaaagtgtggggctcttccgcggggaggattgaaccacgaggcgggggccgaggagcgctccctacctccatgggacagcacggacccagtgcccgggcccgggcagggcgcgccccaggacccaggccggcgcgggaagccagccctcggctccgggtccacaagaccttcaagtttgtcgtcgtcggggtcctgctgcaggtcgtacctagctcagctgcaaccatcaaacttcatgatcaatcaattggcacacagcaatgggaacatagccctttgggagagttgtgtccaccaggatctcatagatcagaacatcctggagcctgtaaccggtgcacagagggtgtgggttacaccaatgcttccaacaatttgtttgcttgcctcccatgtacagcttgtaaatcagatgaagaagagagaagtccctgcaccacgaccaggaacacagcatgtcagtgcaaaccaggaactttccggaatgacaattctgctgagatgtgccggaagtgcagcagagggtgccccagagggatggtcaaggtcaaggattgtacgccctggagtgacatcgagtgtgtccacaaagaatcaggcaatggacataatatatgggtgattttggttgtgactttggttgttccgttgctgttggtggctgtgctgattgtctgttgttgcatcggctcaggttgtggaggggaccccaagtgcatggacagggtgtgtttctggcgcttgggtctcctacgagggcctggggctgaggacaatgctcacaacgagattctgagcaacgcagactcgctgtccactttcgtctctgagcagcaaatggaaagccaggagccggcagatttgacaggtgtcactgtacagtccccaggggaggcacagtgtctgctgggaccggcagaagctgaagggtctcagaggaggaggctgctggttccagcaaatggtgctgaccccactgagactctgatgctgttctttgacaagtttgcaaacatcgtgccctttgactcctgggaccagctcatgaggcagctggacctcacgaaaaatgagatcgatgtggtcagagctggtacagcaggcccaggggatgccttgtatgcaatgctgatgaaatgggtcaacaaaactggacggaacgcctcgatccacaccctgctggatgccttggagaggatggaagagagacatgcaagagagaagattcaggacctcttggtggactctggaaagttcatctacttagaagatggcacaggctctgccgtgtccttggagtgaaagactctttttaccagaggtttcctcttaggtgttaggagttaatacatattaggttttttttttttttaacatgtatacaaagtaaattcttagccaggtgtagtggctcatgcctgtaatcccagcactttgggaggctgaggcgggtggatcacttgaggtcagaagttcaagaccagcctgaccaacatcgtgaaatgccgtctttacaaaaaaatacaaaaattaactggatgtgatggtgtgtgcatatattctcggctactcgggaggctgaggcaggagaatcacttgaacccacgaggcagtgagctgagattgcaccactgcactccagcctgggacacagagcaagactctgtctcaagataaaataaaataaacttgaaagaattattgcccgactgaggctcacatgccaaaggaaaatctggttctcccctgagctggcctccgtgtgtttccttatcatggtggtcaattggaggtgttaatttgaatggattaaggaacacctagaacactggtaaggcattatttctgggacattatttctgggcatgtcttcgagggtgtttccagaggggattggcatgcgatcgggtggactgagtggaaaagacctacccttaatttgggggggcaccgtccgacagactggggagcaagatagaagaaaacaaaaaaaaaaggaaaagcaaatccatctgatctcctggagctgggacactcttctgcctgtggacatcagagtctaggatttctagcccttggactccagggcatacaccagtggcctcccgaaggatctaaggattttggccttgaactaagaattacaccatcggcttccctgggtcttaggtttttgggctggattaagtcctgcttccagcatttcagggtctctgctgtgcagatggcctgttgtggaacttctcaacctccattatcagatgcattaattcctccaataagtcccatttcatatatagtcatttaccccacaacatttcagtcaagggaacagcatataagatggtggccgtccagtaagctaaggttaatttattaattatttaatttatttaccttgagttcaagtcacaattaaagtacatatacctttggaaatttggacttttgtatataaaagtacttttttttggcgggggcagtgggcagctctcatcctaaacaaatgtgttatttggtacctatgcaaagatttggttaaaa

SEQ ID NO: 484 - DNA, 4146 bp, Homo sapiens
gcgcttgcggaggattgcgttgacgagactcttatttattgtcaccaacctgtggtggaatttgcagttgcacattggatctgattcgccccgccccgaatgacgcctgcccggaggcagtgaaagtacagccgcgccgccccaagtcagcctggacacataaatcagcacgcggccggagaaccccgcaatctctgcgcccacaaaatacaccgacgatgcccgatctactttaagggctgaaacccacgggcctgagagactataagagcgttccctaccgccatggaacaacggggacagaacgccccggccgcttcgggggcccggaaaaggcacggcccaggacccagggaggcgcggggagccaggcctgggccccgggtccccaagacccttgtgctcgttgtcgccgcggtcctgctgttggtctcagctgagtctgctctgatcacccaacaagacctagctccccagcagagagcggccccacaacaaaagaggtccagcccctcagagggattgtgtccacctggacaccatatctcagaagacggtagagattgcatctcctgcaaatatggacaggactatagcactcactggaatgacctccttttctgcttgcgctgcaccaggtgtgattcaggtgaagtggagctaagtccctgcaccacgaccagaaacacagtgtgtcagtgcgaagaaggcaccttccgggaagaagattctcctgagatgtgccggaagtgccgcacagggtgtcccagagggatggtcaaggtcggtgattgtacaccctggagtgacatcgaatgtgtccacaaagaatcaggtacaaagcacagtggggaagtcccagctgtggaggagacggtgacctccagcccagggactcctgcctctccctgttctctctcaggcatcatcataggagtcacagttgcagccgtagtcttgattgtggctgtgtttgtttgcaagtctttactgtggaagaaagtccttccttacctgaaaggcatctgctcaggtggtggtggggaccctgagcgtgtggacagaagctcacaacgacctggggctgaggacaatgtcctcaatgagatcgtgagtatcttgcagcccacccaggtccctgagcaggaaatggaagtccaggagccagcagagccaacaggtgtcaacatgttgtcccccggggagtcagagcatctgctggaaccggcagaagctgaaaggtctcagaggaggaggctgctggttccagcaaatgaaggtgatcccactgagactctgagacagtgcttcgatgactttgcagacttggtgccctttgactcctgggagccgctcatgaggaagttgggcctcatggacaatgagataaaggtggctaaagctgaggcagcgggccacagggacaccttgtacacgatgctgataaagtgggtcaacaaaaccgggcgagatgcctctgtccacaccctgctggatgccttggagacgctgggagagagacttgccaagcagaagattgaggaccacttgttgagctctggaaagttcatgtatctagaaggtaatgcagactctgccatgtcctaagtgtgattctcttcaggaagtcagaccttccctggtttaccttttttctggaaaaagcccaactggactccagtcagtaggaaagtgccacaattgtcacatgaccggtactggaagaaactctcccatccaacatcacccagtggatggaacatcctgtaacttttcactgcacttggcattatttttataagctgaatgtgataataaggacactatggaaatgtctggatcattccgtttgtgcgtactttgagatttggtttgggatgtcattgttttcacagcacttttttatcctaatgtaaatgctttatttatttatttgggctacattgtaagatccatctacacagtcgttgtccgacttcacttgatactatatgatatgaaccttttttgggtggggggtgcggggcagttcactctgtctcccaggctggagtgcaatggtgcaatcttggctcactatagccttgacctctcaggctcaagcgattctcccacctcagccatccaaatagctgggaccacaggtgtgcaccaccacgcccggctaattttttgtattttgtctagatataggggctctctatgttgctcagggtggtctcgaattcctggactcaagcagtctgcccacctcagactcccaaagcggtggaattagaggcgtgagcccccatgcttggccttacctttctacttttataattctgtatgttattattttatgaacatgaagaaactttagtaaatgtacttgtttacatagttatgtgaatagattagataaacataaaaggaggagacatacaatgggggaagaagaagaagtcccctgtaagatgtcactgtctgggttccagccctccctcagatgtactttggcttcaatgattggcaacttctacaggggccagtcttttgaactggacaaccttacaagtatatgagtattatttataggtagttgtttacatatgagtcgggaccaaagagaactggatccacgtgaagtcctgtgtgtggctggtccctacctgggcagtctcatttgcacccatagcccccatctatggacaggctgggacagaggcagatgggttagatcacacataacaatagggtctatgtcatatcccaagtgaacttgagccctgtttgggctcaggagatagaagacaaaatctgtctcccacgtctgccatggcatcaagggggaagagtagatggtgcttgagaatggtgtgaaatggttgccatctcaggagtagatggcccggctcacttctggttatctgtcaccctgagcccatgagctgccttttagggtacagattgcctacttgaggaccttggccgctctgtaagcatctgactcatctcagaaatgtcaattcttaaacactgtggcaacaggacctagaatggctgacgcattaaggttttcttcttgtgtcctgttctattattgttttaagacctcagtaaccatttcagcctctttccagcaaacccttctccatagtatttcagtcatggaaggatcatttatgcaggtagtcattccaggagtttttggtcttttctgtctcaaggcattgtgtgttttgttccgggactggtttgggtgggacaaagttagaattgcctgaagatcacacattcagactgttgtgtctgtggagttttaggagtggggggtgacctttctggtctttgcacttccatcctctcccacttccatctggcatcccacgcgttgtcccctgcacttctggaaggcacagggtgctgctgcctcctggtctttgcctttgctgggccttctgtgcaggacgctcagcctcagggctcagaaggtgccagtccggtcccaggtcccttgtcccttccacagaggccttcctagaagatgcatctagagtgtcagccttatcagtgtttaagatttttcttttatttttaatttttttgagacagaatctcactctctcgcccaggctggagtgcaacggtacgatcttggctcagtgcaacctccgcctcctgggttcaagcgattctcgtgcctcagcctccggagtagctgggattgcaggcacccgccaccacgcctggctaatttttgtatttttagtagagacggggtttcaccatgttggtcaggctggtctcgaactcctgacctcaggtgatccaccttggcctccgaaagtgctgggattacaggcgtgagccaccagccaggccaagctattcttttaaagtaagcttcctgacgacatgaaataattgggggttttgttgtttagttacattaggctttgctatatccccaggccaaatagcatgtgacacaggacagccatagtatagtgtgtcactcgtggttggtgtcctttcatgcttctgccctgtcaaaggtccctatttgaaatgtgttataatacaaacaaggaagcacattgtgtacaaaatacttatgtatttatgaatccatgaccaaattaaatatgaaaccttatataaaaa

SEQ ID NO: 485 - DNA, 1723 bp, Homo sapiens
cataaatcagcacgcggccggagaaccccgcaatctctgcgcccacaaaatacaccgacgatgcccgatctactttaagggctgaaacccacgggcctgagagactataagagcgttccctaccgccatggaacaacggggacagaacgccccggccgcttcgggggcccggaaaaggcacggcccaggacccagggaggcgcggggagccaggcctgggccccgggtccccaagacccttgtgctcgttgtcgccgcggtcctgctgttggtctcagctgagtctgctctgatcacccaacaagacctagctccccagcagagagcggccccacaacaaaagaggtccagcccctcagagggattgtgtccacctggacaccatatctcagaagacggtagagattgcatctcctgcaaatatggacaggactatagcactcactggaatgacctccttttctgcttgcgctgcaccaggtgtgattcaggtgaagtggagctaagtccctgcaccacgaccagaaacacagtgtgtcagtgcgaagaaggcaccttccgggaagaagattctcctgagatgtgccggaagtgccgcacagggtgtcccagagggatggtcaaggtcggtgattgtacaccctggagtgacatcgaatgtgtccacaaagaatcaggcatcatcataggagtcacagttgcagccgtagtcttgattgtggctgtgtttgtttgcaagtctttactgtggaagaaagtccttccttacctgaaaggcatctgctcaggtggtggtggggaccctgagcgtgtggacagaagctcacaacgacctggggctgaggacaatgtcctcaatgagatcgtgagtatcttgcagcccacccaggtccctgagcaggaaatggaagtccaggagccagcagagccaacaggtgtcaacatgttgtcccccggggagtcagagcatctgctggaaccggcagaagctgaaaggtctcagaggaggaggctgctggttccagcaaatgaaggtgatcccactgagactctgagacagtgcttcgatgactttgcagacttggtgccctttgactcctgggagccgctcatgaggaagttgggcctcatggacaatgagataaaggtggctaaagctgaggcagcgggccacagggacaccttgtacacgatgctgataaagtgggtcaacaaaaccgggcgagatgcctctgtccacaccctgctggatgccttggagacgctgggagagagacttgccaagcagaagattgaggaccacttgttgagctctggaaagttcatgtatctagaaggtaatgcagactctgccatgtcctaagtgtgattctcttcaggaagtcagaccttccctggtttaccttttttctggaaaaagcccaactggactccagtcagtaggaaagtgccacaattgtcacatgaccggtactggaagaaactctcccatccaacatcacccagtggatggaacatcctgtaacttttcactgcacttggcattatttttataagctgaatgtgataataaggacactatggaaatgtctggatcattccgtttgtgcgtactttgagatttggtttgggatgtcattgttttcacagcacttttttatcctaatgtaaatgctttatttatttatttgggctacattgtaagatccatctacacagtcgt

SEQ ID NO: 486 - DNA, 1464 bp, Homo sapiens
agcctggacacataaatcagcacgcggccggagaaccccgcaatctctgcgcccacaaaatacaccgacgatgcccgatctactttaagggctgaaacccacgggcctgagagactataagagcgttccctaccgccatggaacaacggggacagaacgccccggccgcttcgggggcccggaaaaggcacggcccaggacccagggaggcgcggggagccaggcctgggccccgggtccccaagacccttgtgctcgttgtcgccgcggtcctgctgttggacaccatatctcagaagacggtagagattgcatctcctgcaaatatggacaggactatagcactcactggaatgacctccttttctgcttgcgctgcaccaggtgtgattcaggtgaagtggagctaagtccctgcaccacgaccagaaacacagtgtgtcagtgcgaagaaggcaccttccgggaagaagattctcctgagatgtgccggaagtgccgcacagggtgtcccagagggatggtcaaggtcggtgattgtacaccctggagtgacatcgaatgtgtccacaaagaatcaggcatcatcataggagtcacagttgcagccgtagtcttgattgtggctgtgtttgtttgcaagtctttactgtggaagaaagtccttccttacctgaaaggcatctgctcaggtggtggtggggaccctgagcgtgtggacagaagctcacaacgacctggggctgaggacaatgtcctcaatgagatcgtgagtatcttgcagcccacccaggtccctgagcaggaaatggaagtccaggagccagcagagccaacaggtgtcaacatgttgtcccccggggagtcagagcatctgctggaaccggcagaagctgaaaggtctcagaggaggaggctgctggttccagcaaatgaaggtgatcccactgagactctgagacagtgcttcgatgactttgcagacttggtgccctttgactcctgggagccgctcatgaggaagttgggcctcatggacaatgagataaaggtggctaaagctgaggcagcgggccacagggacaccttgtacacgatgctgataaagtgggtcaacaaaaccgggcgagatgcctctgtccacaccctgctggatgccttggagacgctgggagagagacttgccaagcagaagattgaggaccacttgttgagctctggaaagttcatgtatctagaaggtaatgcagactctgccatgtcctaagtgtgattctcttcaggaagtcagaccttccctggtttaccttttttctggaaaaagcccaactggactccagtcagtaggaaagtgccacaattgtcacatgaccggtactggaagaaactctcccatccaacatcacccagtggatggaacatcctgtaacttttcactgcacttggcattatttttataagctg

SEQ ID NO: 487 - DNA, 3595 bp, Homo sapiens
agtccctcgccgaccagtctgggcagcggaggagggtggttggcagtggctggaagcttcgctatgggaagtcgttcctttgctctctcgcgcccagtcctcctccctggttctcctcagccgctgtcggaggagagcacccggagacgcgggctgcagtcgcggcggcttctccccgcctgggcggccgcgccgctgggcaggtgctgagcgcccctagagcctcccttgccgcctccctcctctgcccggccgcagcagtgcacatggggtgttggaggtagatgggctcccggcccgggaggcggcggtggatgcggcgctgggcagaagcagccgccgattccagctgccccgcgcgccccgggcgcccctgcgagtccccggttcagccatggggacctctccgagcagcagcaccgccctcgcctcctgcagccgcatcgcccgccgagccacagccacgatgatcgcgggctcccttctcctgcttggattccttagcaccaccacagctcagccagaacagaaggcctcgaatctcattggcacataccgccatgttgaccgtgccaccggccaggtgctaacctgtgacaagtgtccagcaggaacctatgtctctgagcattgtaccaacacaagcctgcgcgtctgcagcagttgccctgtggggacctttaccaggcatgagaatggcatagagaaatgccatgactgtagtcagccatgcccatggccaatgattgagaaattaccttgtgctgccttgactgaccgagaatgcacttgcccacctggcatgttccagtctaacgctacctgtgccccccatacggtgtgtcctgtgggttggggtgtgcggaagaaagggacagagactgaggatgtgcggtgtaagcagtgtgctcggggtaccttctcagatgtgccttctagtgtgatgaaatgcaaagcatacacagactgtctgagtcagaacctggtggtgatcaagccggggaccaaggagacagacaacgtctgtggcacactcccgtccttctccagctccacctcaccttcccctggcacagccatctttccacgccctgagcacatggaaacccatgaagtcccttcctccacttatgttcccaaaggcatgaactcaacagaatccaactcttctgcctctgttagaccaaaggtactgagtagcatccaggaagggacagtccctgacaacacaagctcagcaagggggaaggaagacgtgaacaagaccctcccaaaccttcaggtagtcaaccaccagcaaggcccccaccacagacacatcctgaagctgctgccgtccatggaggccactgggggcgagaagtccagcacgcccatcaagggccccaagaggggacatcctagacagaacctacacaagcattttgacatcaatgagcatttgccctggatgattgtgcttttcctgctgctggtgcttgtggtgattgtggtgtgcagtatccggaaaagctcgaggactctgaaaaaggggccccggcaggatcccagtgccattgtggaaaaggcagggctgaagaaatccatgactccaacccagaaccgggagaaatggatctactactgcaatggccatggtatcgatatcctgaagcttgtagcagcccaagtgggaagccagtggaaagatatctatcagtttctttgcaatgccagtgagagggaggttgctgctttctccaatgggtacacagccgaccacgagcgggcctacgcagctctgcagcactggaccatccggggccccgaggccagcctcgcccagctaattagcgccctgcgccagcaccggagaaacgatgttgtggagaagattcgtgggctgatggaagacaccacccagctggaaactgacaaactagctctcccgatgagccccagcccgcttagcccgagccccatccccagccccaacgcgaaacttgagaattccgctctcctgacggtggagccttccccacaggacaagaacaagggcttcttcgtggatgagtcggagccccttctccgctgtgactctacatccagcggctcctccgcgctgagcaggaacggttcctttattaccaaagaaaagaaggacacagtgttgcggcaggtacgcctggacccctgtgacttgcagcctatctttgatgacatgctccactttctaaatcctgaggagctgcgggtgattgaagagattccccaggctgaggacaaactagaccggctattcgaaattattggagtcaagagccaggaagccagccagaccctcctggactctgtttatagccatcttcctgacctgctgtagaacatagggatactgcattctggaaattactcaatttagtggcagggtggttttttaattttcttctgtttctgatttttgttgtttggggtgtgtgtgtgtgtttgtgtgtgtgtgtgtgtgtgtgtgtgtgtgtgtgtttaacagagaatatggccagtgcttgagttctttctccttctctctctctcttttttttttaaataactcttctgggaagttggtttataagcctttgccaggtgtaactgttgtgaaatacccaccactaaagttttttaagttccatattttctccattttgccttcttatgtattttcaagattattctgtgcactttaaatttacttaacttaccataaatgcagtgtgacttttcccacacactggattgtgaggctcttaacttcttaaaagtataatggcatcttgtgaatcctataagcagtctttatgtctcttaacattcacacctactttttaaaaacaaatattattactatttttattattgtttgtcctttataaattttcttaaagattaagaaaatttaagaccccattgagttactgtaatgcaattcaactttgagttatcttttaaatatgtcttgtatagttcatattcatggctgaaacttgaccacactattgctgattgtatggttttcacctggacaccgtgtagaatgcttgattacttgtactcttcttatgctaatatgctctgggctggagaaatgaaatcctcaagccatcaggatttgctatttaagtggcttgacaactgggccaccaaagaacttgaacttcaccttttaggatttgagctgttctggaacacattgctgcactttggaaagtcaaaatcaagtgccagtggcgccctttccatagagaatttgcccagctttgctttaaaagatgtcttgttttttatatacacataatcaataggtccaatctgctctcaaggccttggtcctggtgggattccttcaccaattactttaattaaaaatggctgcaactgtaagaacccttgtctgatatatttgcaactatgctcccatttacaaatgtaccttctaatgctcagttgccaggttccaatgcaaaggtggcgtggactccctttgtgtgggtggggtttgtgggtagtggtgaaggaccgatatcagaaaaatgccttcaagtgtactaatttattaataaacattaggtgtttgtta

SEQ ID NO: 488 - DNA, 2267 bp, Homo sapiens
agctgctgccgtccatggaggccactgggggcgagaagtccagcacgcccatcaaggcccaagaggggacatcctagacagaacctacacaagcattttgacatcaatgagcatttgccctggatgattgtgcttttcctgctgctggtgcttgtggtgattgtggtgtgcagtatccggaaaagctcgaggactctgaaaaaggggccccggcaggatcccagtgccattgtggaaaaggcagggctgaagaaatccatgactccaacccagaaccgggagaaatggatctactactgcaatggccatggtatcgatatcctgaagcttgtagcagcccaagtgggaagccagtggaaagatatctatcagtttctttgcaatgccagtgagagggaggttgctgctttctccaatgggtacacagccgaccacgagcgggcctacgcagctctgcagcactggaccatccggggccccgaggccagcctcgcccagctaattagcgccctgcgccagcaccggagaaacgatgttgtggagaagattcgtgggctgatggaagacaccacccagctggaaactgacaaactagctctcccgatgagccccagcccgcttagcccgagccccatccccagccccaacgcgaaacttgagaattccgctctcctgacggtggagccttccccacaggacaagaacaagggcttcttcgtggatgagtcggagccccttctccgctgtgactctacatccagcggctcctccgcgctgagcaggaacggttcctttattaccaaagaaaagaaggacacagtgttgcggcaggtacgcctggacccctgtgacttgcagcctatctttgatgacatgctccactttctaaatcctgaggagctgcgggtgattgaagagattccccaggctgaggacaaactagaccggctattcgaaattattggagtcaagagccaggaagccagccagaccctcctggactctgtttatagccatcttcctgacctgctgtagaacatagggatactgcattctggaaattactcaatttagtggcagggtggttttttaattttcttctgtttctgatttttgttgtttggggtgtgtgtgtgtgtttgtgtgtgtgtgtgtgtgtgtgtgtgtgtgtgtgtttaacagagaatatggccagtgcttgagttctttctccttctctctctctcttttttttttaaataactcttctgggaagttggtttataagcctttgccaggtgtaactgttgtgaaatacccaccactaaagttttttaagttccatattttctccattttgccttcttatgtattttcaagattattctgtgcactttaaatttacttaacttaccataaatgcagtgtgacttttcccacacactggattgtgaggctcttaacttcttaaaagtataatggcatcttgtgaatcctataagcagtctttatgtctcttaacattcacacctactttttaaaaacaaatattattactatttttattattgtttgtcctttataaattttcttaaagattaagaaaatttaagaccccattgagttactgtaatgcaattcaactttgagttatcttttaaatatgtcttgtatagttcatattcatggctgaaacttgaccacactattgctgattgtatggttttcacctggacaccgtgtagaatgcttgattacttgtactcttcttatgctaatatgctctgggctggagaaatgaaatcctcaagccatcaggatttgctatttaagtggcttgacaactgggccaccaaagaacttgaacttcaccttttaggatttgagctgttctggaacacattgctgcactttggaaagtcaaaatcaagtgccagtggcgccctttccatagagaatttgcccagctttgctttaaaagatgtcttgttttttatatacacataatcaataggtccaatctgctctcaaggccttggtcctggtgggattccttcaccaattactttaattaaaaatggctgcaactgtaagaacccttgtctgatatatttgcaactatgctcccatttacaaatgtaccttctaatgctcagttgccaggttccaatgcaaaggtggcgtggactccctttgtgtgggtggggtttgtgggtagtggtgaaggaccgatatcagaaaaatgccttcaagtgtactaatttattaataaacattaggtgtttgtt

SEQ ID NO: 489 - DNA, 9821 bp, Homo sapiens
gccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatgggcctaagatcccgtccatcgccactgggatggtgggggccctcctcttgctgctggtggtggccctggggatcggcctcttcatgcgaaggcgccacatcgttcggaagcgcacgctgcggaggctgctgcaggagagggagcttgtggagcctcttacacccagtggagaagctcccaaccaagctctcttgaggatcttgaaggaaactgaattcaaaaagatcaaagtgctgggctccggtgcgttcggcacggtgtataagggactctggatcccagaaggtgagaaagttaaaattcccgtcgctatcaaggaattaagagaagcaacatctccgaaagccaacaaggaaatcctcgatgaagcctacgtgatggccagcgtggacaacccccacgtgtgccgcctgctgggcatctgcctcacctccaccgtgcagctcatcacgcagctcatgcccttcggctgcctcctggactatgtccgggaacacaaagacaatattggctcccagtacctgctcaactggtgtgtgcagatcgcaaagggcatgaactacttggaggaccgtcgcttggtgcaccgcgacctggcagccaggaacgtactggtgaaaacaccgcagcatgtcaagatcacagattttgggctggccaaactgctgggtgcggaagagaaagaataccatgcagaaggaggcaaagtgcctatcaagtggatggcattggaatcaattttacacagaatctatacccaccagagtgatgtctggagctacggggtgactgtttgggagttgatgacctttggatccaagccatatgacggaatccctgccagcgagatctcctccatcctggagaaaggagaacgcctccctcagccacccatatgtaccatcgatgtctacatgatcatggtcaagtgctggatgatagacgcagatagtcgcccaaagttccgtgagttgatcatcgaattctccaaaatggcccgagacccccagcgctaccttgtcattcagggggatgaaagaatgcatttgccaagtcctacagactccaacttctaccgtgccctgatggatgaagaagacatggacgacgtggtggatgccgacgagtacctcatcccacagcagggcttcttcagcagcccctccacgtcacggactcccctcctgagctctctgagtgcaaccagcaacaattccaccgtggcttgcattgatagaaatgggctgcaaagctgtcccatcaaggaagacagcttcttgcagcgatacagctcagaccccacaggcgccttgactgaggacagcatagacgacaccttcctcccagtgcctgaatacataaaccagtccgttcccaaaaggcccgctggctctgtgcagaatcctgtctatcacaatcagcctctgaaccccgcgcccagcagagacccacactaccaggacccccacagcactgcagtgggcaaccccgagtatctcaacactgtccagcccacctgtgtcaacagcacattcgacagccctgcccactgggcccagaaaggcagccaccaaattagcctggacaaccctgactaccagcaggacttctttcccaaggaagccaagccaaatggcatctttaagggctccacagctgaaaatgcagaatacctaagggtcgcgccacaaagcagtgaatttattggagcatgaccacggaggatagtatgagccctaaaaatccagactctttcgatacccaggaccaagccacagcaggtcctccatcccaacagccatgcccgcattagctcttagacccacagactggttttgcaacgtttacaccgactagccaggaagtacttccacctcgggcacattttgggaagttgcattcctttgtcttcaaactgtgaagcatttacagaaacgcatccagcaagaatattgtccctttgagcagaaatttatctttcaaagaggtatatttgaaaaaaaaaaaaagtatatgtgaggatttttattgattggggatcttggagtttttcattgtcgctattgatttttacttcaatgggctcttccaacaaggaagaagcttgctggtagcacttgctaccctgagttcatccaggcccaactgtgagcaaggagcacaagccacaagtcttccagaggatgcttgattccagtggttctgcttcaaggcttccactgcaaaacactaaagatccaagaaggccttcatggccccagcaggccggatcggtactgtatcaagtcatggcaggtacagtaggataagccactctgtcccttcctgggcaaagaagaaacggaggggatggaattcttccttagacttacttttgtaaaaatgtccccacggtacttactccccactgatggaccagtggtttccagtcatgagcgttagactgacttgtttgtcttccattccattgttttgaaactcagtatgctgcccctgtcttgctgtcatgaaatcagcaagagaggatgacacatcaaataataactcggattccagcccacattggattcatcagcatttggaccaatagcccacagctgagaatgtggaatacctaaggatagcaccgcttttgttctcgcaaaaacgtatctcctaatttgaggctcagatgaaatgcatcaggtcctttggggcatagatcagaagactacaaaaatgaagctgctctgaaatctcctttagccatcaccccaaccccccaaaattagtttgtgttacttatggaagatagttttctccttttacttcacttcaaaagctttttactcaaagagtatatgttccctccaggtcagctgcccccaaaccccctccttacgctttgtcacacaaaaagtgtctctgccttgagtcatctattcaagcacttacagctctggccacaacagggcattttacaggtgcgaatgacagtagcattatgagtagtgtggaattcaggtagtaaatatgaaactagggtttgaaattgataatgctttcacaacatttgcagatgttttagaaggaaaaaagttccttcctaaaataatttctctacaattggaagattggaagattcagctagttaggagcccaccttttttcctaatctgtgtgtgccctgtaacctgactggttaacagcagtcctttgtaaacagtgttttaaactctcctagtcaatatccaccccatccaatttatcaaggaagaaatggttcagaaaatattttcagcctacagttatgttcagtcacacacacatacaaaatgttccttttgcttttaaagtaatttttgactcccagatcagtcagagcccctacagcattgttaagaaagtatttgatttttgtctcaatgaaaataaaactatattcatttccactctattatgctctcaaatacccctaagcatctatactagcctggtatgggtatgaaagatacaaagataaataaaacatagtccctgattctaagaaattcacaatttagcaaaggaaatggactcatagatgctaaccttaaaacaacgtgacaaatgccagacaggacccatcagccaggcactgtgagagcacagagcagggaggttgggtcctgcctgaggagacctggaagggaggcctcacaggaggatgaccaggtctcagtcagcggggaggtggaaagtgcaggtgcatcaggggcaccctgaccgaggaaacagctgccagaggcctccactgctaaagtccacataaggctgaggtcagtcaccctaaacaacctgctccctctaagccaggggatgagcttggagcatcccacaagttccctaaaagttgcagcccccagggggattttgagctatcatctctgcacatgcttagtgagaagactacacaacatttctaagaatctgagattttatattgtcagttaaccactttcattattcattcacctcaggacatgcagaaatatttcagtcagaactgggaaacagaaggacctacattctgctgtcacttatgtgtcaagaagcagatgatcgatgaggcaggtcagttgtaagtgagtcacattgtagcattaaattctagtatttttgtagtttgaaacagtaacttaataaaagagcaaaagctattctagctttcttcttcatattttaattttccaccataaagtttagttgctaaattctattaattttaagattgtgcttcccaaaatagttctcacttcatctgtccagggaggcacagttctgtctggtagaagccgcaaagcccttagcctcttcacggatctggcgactgtgatgggcaggtcaggagaggagctgcccaaagtcccatgattttcacctaacagccctgatcagtcagtactcaaagcttggactccatccctgaaggtcttcctgattgatagcctggccttaataccctacagaaagcctgtccattggctgtttcttcctcagtcagttcctggaagaccttaccccatgaccccagcttcagatgtggtctttggaaacagaggtcgaaggaaagtaaggagctgagagctcacattcataggtgccgccagccttcgtgcatcttcttgcatcatctctaaggagctcctctaattacaccatgcccgtcaccccatgagggatcagagaagggatgagtcttctaaactctatattcgctgtgagtccaggttgtaagggggagcactgtggatgcatcctattgcactccagctgatgacaccaaagcttaggtgtttgctgaaagttcttgatgttgtgacttaccacccctgcctcacaactgcagacataaggggactatggattgcttagcaggaaaggcactggttctcaagggcggctgcccttgggaatcttctggtcccaaccagaaagactgtggcttgattttctcaggtgcagcccagccgtagggccttttcagagcaccccctggttattgcaacattcatcaaagtttctagaacctctggcctaaaggaagggcctggtgggatctacttggcactcgctggggggccaccccccagtgccactctcactaggcctctgattgcacttgtgtaggatgaagctggtgggtgatgggaactcagcacctcccctcaggcagaaaagaatcatctgtggagcttcaaaagaaggggcctggagtctctgcagaccaattcaacccaaatctcgggggctctttcatgattctaatgggcaaccagggttgaaacccttatttctagggtcttcagttgtacaagactgtgggtctgtaccagagcccccgtcagagtagaataaaaggctgggtagggtagagattcccatgtgcagtggagagaacaatctgcagtcactgataagcctgagacttggctcatttcaaaagcgttcaattcatcctcaccagcagttcagctggaaaggggcaaatacccccacctgagctttgaaaacgccctgggaccctctgcattctctaagtaagttatagaaaccagtctcttccctcctttgtgagtgagctgctattccacgtaggcaacacctgttgaaattgccctcaatgtctactctgcatttctttcttgtgataagcacacacttttattgcaacataatgatctgctcacatttccttgcctgggggctgtaaaaccttacagaacagaaatccttgcctctttcaccagccacacctgccataccaggggtacagctttgtactattgaagacacagacaggatttttaaatgtaaatctatttttgtaactttgttgcgggatatagttctctttatgtagcactgaactttgtacaatatatttttagaaactcatttttctactaaaacaaacacagtttactttagagagactgcaatagaatcaaaatttgaaactgaaatctttgtttaaaagggttaagttgaggcaagaggaaagccctttctctctcttataaaaaggcacaacctcattggggagctaagctaggtcattgtcatggtgaagaagagaagcatcgtttttatatttaggaaattttaaaagatgatggaaagcacatttagcttggtctgaggcaggttctgttggggcagtgttaatggaaagggctcactgttgttactactagaaaaatccagttgcatgccatactctcatcatctgccagtgtaaccctgtacatgtaagaaaagcaataacatagcactttgttggtttatatatataatgtgacttcaatgcaaattttatttttatatttacaattgatatgcatttaccagtataaactagacatgtctggagagcctaataatgttcagcacactttggttagttcaccaacagtcttaccaagcctgggcccagccaccctagagaagttattcagccctggctgcagtgacatcacctgaggagcttttaaaagcttgaagcccagctacacctcagaccgattaaacgcaaatctctggggctgaaacccaagcattcgtagtttttaaagctcctgaggtcattccaatgtgcggccaaagttgagaactactggcctagggattagccacaaggacatggacttggaggcaaattctgcaggtgtatgtgattctcaggcctagagagctaagacacaaagacctccacatctgtcgctgagagtcaagaacctgaacagagtttccatgaaggttctccaagcactagaagggagagtgtctaaacaatggttgaaaagcaaaggaaatataaaacagacacctctttccatttcctaaggtttctctctttattaagggtggactagtaataaaatataatattcttgctgcttatgcagctgacattgttgccctccctaaagcaaccaagtagcctttatttcccacagtgaaagaaaacgctggcctatcagttacattacaaaaggcagatttcaagaggattgagtaagtagttggatggctttcataaaaacaagaattcaagaagaggattcatgctttaagaaacatttgttatacattcctcacaaattatacctgggataaaaactatgtagcaggcagtgtgttttccttccatgtctctctgcactacctgcagtgtgtcctctgaggctgcaagtctgtcctatctgaattcccagcagaagcactaagaagctccaccctatcacctagcagataaaactatggggaaaacttaaatctgtgcatacatttctggatgcatttacttatctttaaaaaaaaaggaatcctatgacctgatttggccacaaaaataatcttgctgtacaatacaatctcttggaaattaagagatcctatggatttgatgactggtattagaggtgacaatgtaaccgattaacaacagacagcaataacttcgttttagaaacattcaagcaatagctttatagcttcaacatatggtacgttttaaccttgaaagttttgcaatgatgaaagcagtatttgtacaaatgaaaagcagaattctcttttatatggtttatactgttgatcagaaatgttgattgtgcattgagtattaaaaaattagatgtatattattcattgttctttactcctgagtaccttataataataataatgtattctttgttaacaa

SEQ ID NO: 490 - DNA, 2239 bp, Homo sapiens
ccccggcgcagcgcggccgcagcagcctccgccccccgcacggtgtgagcgcccgacgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacgggtcctaataaatcttcactgtctgactttagtctcccactaaaactgcatttcctttctacaatttcaatttctccctttgcttcaaataaagtcctgacactattcatttga

SEQ ID NO: 491 - DNA, 2864 bp, Homo sapiens
cccggcgcagcgcggccgcagcagcctccgccccccgcacggtgtgagcgcccgacgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacgggccaggaaatgagagtctcaaagccatgttattctgcctttttaaactatcatcctgtaatcaaagtaatgatggcagcgtgtcccaccagagcgggagcccagctgctcaggagtcatgcttaggatggatcccttctcttctgccgtcagagtttcagctgggttggggtggatgcagccacctccatgcctggccttctgcatctgtgatcatcacggcctcctcctgccactgagcctcatgccttcacgtgtctgttccccccgcttttcctttctgccacccctgcacgtgggccgccaggttcccaagagtatcctacccatttccttccttccactccctttgccagtgcctctcaccccaactagtagctaaccatcacccccaggactgacctcttcctcctcgctgccagatgattgttcaaagcacagaatttgtcagaaacctgcagggactccatgctgccagccttctccgtaattagcatggccccagtccatgcttctagccttggttccttctgcccctctgtttgaaattctagagccagctgtgggacaattatctgtgtcaaaagccagatgtgaaaacatctcaataacaaactggctgctttgttcaatgctagaacaacgcctgtcacagagtagaaactcaaaaatatttgctgagtgaatgaacaaatgaataaatgcataataaataattaaccaccaatccaacatccaga

SEQ ID NO: 492 - DNA, 5595 bp, Homo sapiens
ccccggcgcagcgcggccgcagcagcctccgccccccgcacggtgtgagcgcccgacgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtggtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatgggcctaagatcccgtccatcgccactgggatggtgggggccctcctcttgctgctggtggtggccctggggatcggcctcttcatgcgaaggcgccacatcgttcggaagcgcacgctgcggaggctgctgcaggagagggagcttgtggagcctcttacacccagtggagaagctcccaaccaagctctcttgaggatcttgaaggaaactgaattcaaaaagatcaaagtgctgggctccggtgcgttcggcacggtgtataagggactctggatcccagaaggtgagaaagttaaaattcccgtcgctatcaaggaattaagagaagcaacatctccgaaagccaacaaggaaatcctcgatgaagcctacgtgatggccagcgtggacaacccccacgtgtgccgcctgctgggcatctgcctcacctccaccgtgcagctcatcacgcagctcatgcccttcggctgcctcctggactatgtccgggaacacaaagacaatattggctcccagtacctgctcaactggtgtgtgcagatcgcaaagggcatgaactacttggaggaccgtcgcttggtgcaccgcgacctggcagccaggaacgtactggtgaaaacaccgcagcatgtcaagatcacagattttgggctggccaaactgctgggtgcggaagagaaagaataccatgcagaaggaggcaaagtgcctatcaagtggatggcattggaatcaattttacacagaatctatacccaccagagtgatgtctggagctacggggtgactgtttgggagttgatgacctttggatccaagccatatgacggaatccctgccagcgagatctcctccatcctggagaaaggagaacgcctccctcagccacccatatgtaccatcgatgtctacatgatcatggtcaagtgctggatgatagacgcagatagtcgcccaaagttccgtgagttgatcatcgaattctccaaaatggcccgagacccccagcgctaccttgtcattcagggggatgaaagaatgcatttgccaagtcctacagactccaacttctaccgtgccctgatggatgaagaagacatggacgacgtggtggatgccgacgagtacctcatcccacagcagggcttcttcagcagcccctccacgtcacggactcccctcctgagctctctgagtgcaaccagcaacaattccaccgtggcttgcattgatagaaatgggctgcaaagctgtcccatcaaggaagacagcttcttgcagcgatacagctcagaccccacaggcgccttgactgaggacagcatagacgacaccttcctcccagtgcctgaatacataaaccagtccgttcccaaaaggcccgctggctctgtgcagaatcctgtctatcacaatcagcctctgaaccccgcgcccagcagagacccacactaccaggacccccacagcactgcagtgggcaaccccgagtatctcaacactgtccagcccacctgtgtcaacagcacattcgacagccctgcccactgggcccagaaaggcagccaccaaattagcctggacaaccctgactaccagcaggacttctttcccaaggaagccaagccaaatggcatctttaagggctccacagctgaaaatgcagaatacctaagggtcgcgccacaaagcagtgaatttattggagcatgaccacggaggatagtatgagccctaaaaatccagactctttcgatacccaggaccaagccacagcaggtcctccatcccaacagccatgcccgcattagctcttagacccacagactggttttgcaacgtttacaccgactagccaggaagtacttccacctcgggcacattttgggaagttgcattcctttgtcttcaaactgtgaagcatttacagaaacgcatccagcaagaatattgtccctttgagcagaaatttatctttcaaagaggtatatttgaaaaaaaaaaaaagtatatgtgaggatttttattgattggggatcttggagtttttcattgtcgctattgatttttacttcaatgggctcttccaacaaggaagaagcttgctggtagcacttgctaccctgagttcatccaggcccaactgtgagcaaggagcacaagccacaagtcttccagaggatgcttgattccagtggttctgcttcaaggcttccactgcaaaacactaaagatccaagaaggccttcatggccccagcaggccggatcggtactgtatcaagtcatggcaggtacagtaggataagccactctgtcccttcctgggcaaagaagaaacggaggggatggaattcttccttagacttacttttgtaaaaatgtccccacggtacttactccccactgatggaccagtggtttccagtcatgagcgttagactgacttgtttgtcttccattccattgttttgaaactcagtatgctgcccctgtcttgctgtcatgaaatcagcaagagaggatgacacatcaaataataactcggattccagcccacattggattcatcagcatttggaccaatagcccacagctgagaatgtggaatacctaaggatagcaccgcttttgttctcgcaaaaacgtatctcctaatttgaggctcagatgaaatgcatcaggtcctttggggcatagatcagaagactacaaaaatgaagctgctctgaaatctcctttagccatcaccccaaccccccaaaattagtttgtgttacttatggaagatagttttctccttttacttcacttcaaaagctttttactcaaagagtatatgttccctccaggtcagctgcccccaaaccccctccttacgctttgtcacacaaaaagtgtctctgccttgagtcatctattcaagcacttacagctctggccacaacagggcattttacaggtgcgaatgacagtagcattatgagtagtgtggaattcaggtagtaaatatgaaactagggtttgaaattgataatgctttcacaacatttgcagatgttttagaaggaaaaaagttccttcctaaaataatttctctacaattggaagattggaagattcagctagttaggagcccaccttttttcctaatctgtgtgtgccctgtaacctgactggttaacagcagtcctttgtaaacagtgttttaaactctcctagtcaatatccaccccatccaatttatcaaggaagaaatggttcagaaaatattttcagcctacagttatgttcagtcacacacacatacaaaatgttccttttgcttttaaagtaatttttgactcccagatcagtcagagcccctacagcattgttaagaaagtatttgatttttgtctcaatgaaaataaaactatattcatttccactct

SEQ ID NO: 493 - DNA, 1570 bp, Homo sapiens
ccggcgcagcgcggccgcagcagcctccgccccccgcacggtgtgagcgcccgacgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacaggtttgagctgaattatcacatgaatataaatgggaaatcagtgttttagagagagaacttttcgacatatttcctgttcccttggaataaaaacatttcttctgaaattttaccgttaa

SEQ ID NO: 494 - DNA, 2529 bp, Homo sapiens
gccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatggaagctacatagtgtctcactttccaagatcattctacaagatgtcagtgcactgaaacatgcaggggcgtgttgagtgccaaggatcttgacaagttgttttgaagatggcattttgctaagtccctgagggtcactggtcctcaaagcggcatggcggcatggcgtggctggttctgccacatgccagctgtgtgacctctgagactccacttcttcagtgctgaaaataaagaaggagttttactaaggaccaaacaagataatgaatgtgaaactgctccacgaaccccaaagaattatgcacatagatgcgatcattaagatgcgaagccatcgagttaccacctggcatgcttaaactgtaaagagtgggtcaaagtaaactgaattggaaaatccaaagttatgcagaaaaacaataaagaggtcttacgtagcaataccgaac

SEQ ID NO: 495 - DNA, 3938 bp, Homo sapiens
actggacttcagaacaagagggagctctgggctgctggctggttgtgcatttgctgtgggttccctccggcaggcgacctctccgcgctgagaaggttatccggataaccaatttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatgggcctaagatcccgtccatcgccactgggatggtgggggccctcctcttgctgctggtggtggccctggggatcggcctcttcatgcgaaggcgccacatcgttcggaagcgcacgctgcggaggctgctgcaggagagggagcttgtggagcctcttacacccagtggagaagctcccaaccaagctctcttgaggatcttgaaggaaactgaattcaaaaagatcaaagtgctgggctccggtgcgttcggcacggtgtataagggactctggatcccagaaggtgagaaagttaaaattcccgtcgctatcaaggaattaagagaagcaacatctccgaaagccaacaaggaaatcctcgatgaagcctacgtgatggccagcgtggacaacccccacgtgtgccgcctgctgggcatctgcctcacctccaccgtgcagctcatcacgcagctcatgcccttcggctgcctcctggactatgtccgggaacacaaagacaatattggctcccagtacctgctcaactggtgtgtgcagatcgcaaagggcatgaactacttggaggaccgtcgcttggtgcaccgcgacctggcagccaggaacgtactggtgaaaacaccgcagcatgtcaagatcacagattttgggctggccaaactgctgggtgcggaagagaaagaataccatgcagaaggaggcaaagtgcctatcaagtggatggcattggaatcaattttacacagaatctatacccaccagagtgatgtctggagctacggggtgactgtttgggagttgatgacctttggatccaagccatatgacggaatccctgccagcgagatctcctccatcctggagaaaggagaacgcctccctcagccacccatatgtaccatcgatgtctacatgatcatggtcaagtgctggatgatagacgcagatagtcgcccaaagttccgtgagttgatcatcgaattctccaaaatggcccgagacccccagcgctaccttgtcattcagggggatgaaagaatgcatttgccaagtcctacagactccaacttctaccgtgccctgatggatgaagaagacatggacgacgtggtggatgccgacgagtacctcatcccacagcagggcttcttcagcagcccctccacgtcacggactcccctcctgagctctctgagtgcaaccagcaacaattccaccgtggcttgcattgatagaaatgggctgcaaagctgtcccatcaaggaagacagcttcttgcagcgatacagctcagaccccacaggcgccttgactgaggacagcatagacgacaccttcctcccagtgcctgaatacataaaccagtccgttcccaaaaggcccgctggctctgtgcagaatcctgtctatcacaatcagcctctgaaccccgcgcccagcagagacccacactaccaggacccccacagcactgcagtgggcaaccccgagtatctcaacactgtccagcccacctgtgtcaacagcacattcgacagccctgcccactgggcccagaaaggcagccaccaaattagcctggacaaccctgactaccagcaggacttctttcccaaggaagccaagccaaatggcatctttaagggctccacagctgaaaatgcagaatacctaagggtcgcgccacaaagcagtgaatttattggagcatgaccacggaggatagtatgagccctaaaaatccagactctttcgatacccaggaccaagccacagcaggtcctccatcccaacagccatgcccgcattagctcttagacccacagactggttttgcaacgtttacaccgactagccaggaagtacttccacctcgggcacattttgggaagttgcattcctttgtcttcaaactgtgaagcatttacagaaacgcatccagcaagaatattgtccctttgagcagaaatttatctttcaaagaggtatatttg

SEQ ID NO: 496 - DNA, 3844 bp, Homo sapiens
gtccgggcagcccccggcgcagcgcggccgcagcagcctccgccccccgcacggtgtgagcgcccgacgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacagggccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatgggcctaagatcccgtccatcgccactgggatggtgggggccctcctcttgctgctggtggtggccctggggatcggcctcttcatgcgaaggcgccacatcgttcggaagcgcacgctgcggaggctgctgcaggagagggagcttgtggagcctcttacacccagtggagaagctcccaaccaagctctcttgaggatcttgaaggaaactgaattcaaaaagatcaaagtgctgggctccggtgcgttcggcacggtgtataagggactctggatcccagaaggtgagaaagttaaaattcccgtcgctatcaaggaattaagagaagcaacatctccgaaagccaacaaggaaatcctcgatgaagcctacgtgatggccagcgtggacaacccccacgtgtgccgcctgctgggcatctgcctcacctccaccgtgcagctcatcacgcagctcatgcccttcggctgcctcctggactatgtccgggaacacaaagacaatattggctcccagtacctgctcaactggtgtgtgcagatcgcaaagggcatgaactacttggaggaccgtcgcttggtgcaccgcgacctggcagccaggaacgtactggtgaaaacaccgcagcatgtcaagatcacagattttgggctggccaaactgctgggtgcggaagagaaagaataccatgcagaaggaggcaaagtgcctatcaagtggatggcattggaatcaattttacacagaatctatacccaccagagtgatgtctggagctacggggtgactgtttgggagttgatgacctttggatccaagccatatgacggaatccctgccagcgagatctcctccatcctggagaaaggagaacgcctccctcagccacccatatgtaccatcgatgtctacatgatcatggtcaagtgctggatgatagacgcagatagtcgcccaaagttccgtgagttgatcatcgaattctccaaaatggcccgagacccccagcgctaccttgtcattcagggggatgaaagaatgcatttgccaagtcctacagactccaacttctaccgtgccctgatggatgaagaagacatggacgacgtggtggatgccgacgagtacctcatcccacagcagggcttcttcagcagcccctccacgtcacggactcccctcctgagctctctgagtgcaaccagcaacaattccaccgtggcttgcattgatagaaatgggctgcaaagctgtcccatcaaggaagacagcttcttgcagcgatacagctcagaccccacaggcgccttgactgaggacagcatagacgacaccttcctcccagtgcctggtgagtggcttgtctggaaacagtcctgctcctcaacctcctcgacccactcagcagcagccagtctccagtgtccaagccaggtgctccctccagcatctccagagggggaaacagtggcagatttgcagacacagtgaagggcgtaaggagcagataaacacatgaccgagcctgcacaagctctttgttgtgtctggttgtttgctgtacctctgttgtaagaatgaatctgcaaaatttctagcttatgaagcaaatcacggacatacacatctgtgtgtgtgagtgttcatgatgtgtgtacatctgtgtatgtgtgtgtgtgtatgtgtgtgtttgtgacagatttgatccctgttctctctgctggctctatcttgacctgtgaaacgtatatttaactaattaaatattagttaatattaataaattttaagctttatccaga

SEQ ID NO: 497 - DNA, 4735 bp, Homo sapiens
atgagttctctgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatgggcctaagatcccgtccatcgccactgggatggtgggggccctcctcttgctgctggtggtggccctggggatcggcctcttcatgcgaaggcgccacatcgttcggaagcgcacgctgcggaggctgctgcaggagagggagcttgtggagcctcttacacccagtggagaagctcccaaccaagctctcttgaggatcttgaaggaaactgaattcaaaaagatcaaagtgctgggctccggtgcgttcggcacggtgtataagggactctggatcccagaaggtgagaaagttaaaattcccgtcgctatcaaggaattaagagaagcaacatctccgaaagccaacaaggaaatcctcgatgaagcctacgtgatggccagcgtggacaacccccacgtgtgccgcctgctgggcatctgcctcacctccaccgtgcagctcatcacgcagctcatgcccttcggctgcctcctggactatgtccgggaacacaaagacaatattggctcccagtacctgctcaactggtgtgtgcagatcgcaaagggcatgaactacttggaggaccgtcgcttggtgcaccgcgacctggcagccaggaacgtactggtgaaaacaccgcagcatgtcaagatcacagattttgggctggccaaactgctgggtgcggaagagaaagaataccatgcagaaggaggcaaagtgcctatcaagtggatggcattggaatcaattttacacagaatctatacccaccagagtgatgtctggagctacggggtgactgtttgggagttgatgacctttggatccaagccatatgacggaatccctgccagcgagatctcctccatcctggagaaaggagaacgcctccctcagccacccatatgtaccatcgatgtctacatgatcatggtcaagtgctggatgatagacgcagatagtcgcccaaagttccgtgagttgatcatcgaattctccaaaatggcccgagacccccagcgctaccttgtcattcagggggatgaaagaatgcatttgccaagtcctacagactccaacttctaccgtgccctgatggatgaagaagacatggacgacgtggtggatgccgacgagtacctcatcccacagcagggcttcttcagcagcccctccacgtcacggactcccctcctgagctctctgagtgcaaccagcaacaattccaccgtggcttgcattgatagaaatgggctgcaaagctgtcccatcaaggaagacagcttcttgcagcgatacagctcagaccccacaggcgccttgactgaggacagcatagacgacaccttcctcccagtgcctgaatacataaaccagtccgttcccaaaaggcccgctggctctgtgcagaatcctgtctatcacaatcagcctctgaaccccgcgcccagcagagacccacactaccaggacccccacagcactgcagtgggcaaccccgagtatctcaacactgtccagcccacctgtgtcaacagcacattcgacagccctgcccactgggcccagaaaggcagccaccaaattagcctggacaaccctgactaccagcaggacttctttcccaaggaagccaagccaaatggcatctttaagggctccacagctgaaaatgcagaatacctaagggtcgcgccacaaagcagtgaatttattggagcatgaccacggaggatagtatgagccctaaaaatccagactctttcgatacccaggaccaagccacagcaggtcctccatcccaacagccatgcccgcattagctcttagacccacagactggttttgcaacgtttacaccgactagccaggaagtacttccacctcgggcacattttgggaagttgcattcctttgtcttcaaactgtgaagcatttacagaaacgcatccagcaagaatattgtccctttgagcagaaatttatctttcaaagaggtatatttgaaaaaaaaaaaaagtatatgtgaggatttttattgattggggatcttggagtttttcattgtcgctattgatttttacttcaatgggctcttccaacaaggaagaagcttgctggtagcacttgctaccctgagttcatccaggcccaactgtgagcaaggagcacaagccacaagtcttccagaggatgcttgattccagtggttctgcttcaaggcttccactgcaaaacactaaagatccaagaaggccttcatggccccagcaggccggatcggtactgtatcaagtcatggcaggtacagtaggataagccactctgtcccttcctgggcaaagaagaaacggaggggatggaattcttccttagacttacttttgtaaaaatgtccccacggtacttactccccactgatggaccagtggtttccagtcatgagcgttagactgacttgtttgtcttccattccattgttttgaaactcagtatgctgcccctgtcttgctgtcatgaaatcagcaagagaggatgacacatcaaataataactcggattccagcccacattggattcatcagcatttggaccaatagcccacagctgagaatgtggaatacctaaggatagcaccgcttttgttctcgcaaaaacgtatctcctaatttgaggctcagatgaaatgcatcaggtcctttggggcatagatcagaagactacaaaaatgaagctgctctgaaatctcctttagccatcaccccaaccccccaaaattagtttgtgttacttatggaagatagttttctccttttacttcacttcaaaagctttttactcaaagagtatatgttccctccaggtcagctgcccccaaaccccctccttacgctttgtcacacaaaaagtgtctctgccttgagtcatctattcaagcacttacagctctggccacaacagggcattttacaggtgcgaatgacagtagcattatgagtagtgtggaattcaggtagtaaatatgaaactagggtttgaaattgataatgctttcacaacatttgcagatgttttagaaggaaaaaagttccttcctaaaataatttctctacaattggaagattggaagattcagctagttaggagcccaccttttttcctaatctgtgtgtgccctgtaacctgactggttaacagcagtcctttgtaaacagtgttttaaactctcctagtcaatatccaccccatccaatttatcaaggaagaaatggttcagaaaatattttcagcctacagttatgttcagtcacacacacatacaaaatgttccttttgcttttaaagtaatttttgactcccagatcagtcagagcccctacagcattgttaagaaagtatttgatttttgtctcaatgaaaataaaactatattcatttccactct

SEQ ID NO: 498 - DNA, 4624 bp, Homo sapiens
ggaggaggtggaggaggagggctgcttgaggaagtataagaatgaagttgtgaagctgagattcccctccattgggaccggagaaaccaggggagccccccgggcagccgcgcgccccttcccacggggccctttactgcgccgcgcgcccggcccccacccctcgcagcaccccgcgccccgcgccctcccagccgggtccagccggagccatggggccggagccgcagtgagcaccatggagctggcggccttgtgccgctgggggctcctcctcgccctcttgccccccggagccgcgagcacccaagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgtccatcatctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaaggtgaaggtgcttggatctggcgcttttggcacagtctacaagggcatctggatccctgatggggagaatgtgaaaattccagtggccatcaaagtgttgagggaaaacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgttggatgattgactctgaatgtcggccaagattccgggagttggtgtctgaattctcccgcatggccagggacccccagcgctttgtggtcatccagaatgaggacttgggcccagccagtcccttggacagcaccttctaccgctcactgctggaggacgatgacatgggggacctggtggatgctgaggagtatctggtaccccagcagggcttcttctgtccagaccctgccccgggcgctgggggcatggtccaccacaggcaccgcagctcatctaccaggagtggcggtggggacctgacactagggctggagccctctgaagaggaggcccccaggtctccactggcaccctccgaaggggctggctccgatgtatttgatggtgacctgggaatgggggcagccaaggggctgcaaagcctccccacacatgaccccagccctctacagcggtacagtgaggaccccacagtacccctgccctctgagactgatggctacgttgcccccctgacctgcagcccccagcctgaatatgtgaaccagccagatgttcggccccagcccccttcgccccgagagggccctctgcctgctgcccgacctgctggtgccactctggaaaggcccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtgaaccagaaggccaagtccgcagaagccctgatgtgtcctcagggagcagggaaggcctgacttctgctggcatcaagaggtgggagggccctccgaccacttccaggggaacctgccatgccaggaacctgtcctaaggaaccttccttcctgcttgagttcccagatggctggaaggggtccagcctcgttggaagaggaacagcactggggagtctttgtggattctgaggccctgcccaatgagactctagggtccagtggatgccacagcccagcttggccctttccttccagatcctgggtactgaaagccttagggaagctggcctgagaggggaagcggccctaagggagtgtctaagaacaaaagcgacccattcagagactgtccctgaaacctagtactgccccccatgaggaaggaacagcaatggtgtcagtatccaggctttgtacagagtgcttttctgtttagtttttactttttttgttttgtttttttaaagatgaaataaagacccagggggagaatgggtgttgtatggggaggcaagtgtggggggtccttctccacacccactttgtccatttgcaaatatattttggaaaacagcta

SEQ ID NO: 499 - DNA, 4806 bp, Homo sapiens
gttcccggatttttgtgggcgcctgccccgcccctcgtccccctgctgtgtccatatatcgaggcgatagggttaagggaaggcggacgcctgatgggttaatgagcaaactgaagtgttttccatgatcttttttgagtcgcaattgaagtaccacctcccgagggtgattgcttccccatgcggggtagaacctttgctgtcctgttcaccactctacctccagcacagaatttggcttatgccaaatccgaaaatattgtgaccaggaaccattctgtccaactcttctatttcaggtggcaaagcaaagctatattcaagaccacatgcaaagctactccctgagcaaagagtcacagataaaacgggggcaccagtagaatggccaggacaaacgcagtgcagcacagagactcagaccctggcagccatgcctgcgcaggcagtgatgagagtgacatgtactgttgtggacatgcacaaaagtgagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgtccatcatctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaaggtgaaggtgcttggatctggcgcttttggcacagtctacaagggcatctggatccctgatggggagaatgtgaaaattccagtggccatcaaagtgttgagggaaaacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgttggatgattgactctgaatgtcggccaagattccgggagttggtgtctgaattctcccgcatggccagggacccccagcgctttgtggtcatccagaatgaggacttgggcccagccagtcccttggacagcaccttctaccgctcactgctggaggacgatgacatgggggacctggtggatgctgaggagtatctggtaccccagcagggcttcttctgtccagaccctgccccgggcgctgggggcatggtccaccacaggcaccgcagctcatctaccaggagtggcggtggggacctgacactagggctggagccctctgaagaggaggcccccaggtctccactggcaccctccgaaggggctggctccgatgtatttgatggtgacctgggaatgggggcagccaaggggctgcaaagcctccccacacatgaccccagccctctacagcggtacagtgaggaccccacagtacccctgccctctgagactgatggctacgttgcccccctgacctgcagcccccagcctgaatatgtgaaccagccagatgttcggccccagcccccttcgccccgagagggccctctgcctgctgcccgacctgctggtgccactctggaaaggcccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtgaaccagaaggccaagtccgcagaagccctgatgtgtcctcagggagcagggaaggcctgacttctgctggcatcaagaggtgggagggccctccgaccacttccaggggaacctgccatgccaggaacctgtcctaaggaaccttccttcctgcttgagttcccagatggctggaaggggtccagcctcgttggaagaggaacagcactggggagtctttgtggattctgaggccctgcccaatgagactctagggtccagtggatgccacagcccagcttggccctttccttccagatcctgggtactgaaagccttagggaagctggcctgagaggggaagcggccctaagggagtgtctaagaacaaaagcgacccattcagagactgtccctgaaacctagtactgccccccatgaggaaggaacagcaatggtgtcagtatccaggctttgtacagagtgcttttctgtttagtttttactttttttgttttgtttttttaaagatgaaataaagacccagggggagaatgggtgttgtatggggaggcaagtgtggggggtccttctccacacccactttgtccatttgcaaatatattttggaaaacagcta

SEQ ID NO: 500 - DNA, 3238 bp, Homo sapiens
gcgcttgctcccaatcacaggagaaggaggaggtggaggaggagggctgcttgaggaagtataagaatgaagttgtgaagctgagattcccctccattgggaccggagaaaccaggggagccccccgggcagccgcgcgccccttcccacggggccctttactgcgccgcgcgcccggcccccacccctcgcagcaccccgcgccccgcgccctcccagccgggtccagccggagccatggggccggagccgcagtgagcaccatggagctggcggccttgtgccgctgggggctcctcctcgccctcttgccccccggagccgcgagcacccaagacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgtccatcatctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaaggtgaaggtgcttggatctggcgcttttggcacagtctacaagggcatctggatccctgatggggagaatgtgaaaattccagtggccatcaaagtgttgagggaaaacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgttggatgattgactctgaatgtcggccaagattccgggagttggtgtctgaattctcccgcatggccagggacccccagcgctttgtggtcatccagaatgaggacttgggcccagccagtcccttggacagcaccttctaccgctcactgctggaggacgatgacatgggggacctggtggatgctgaggagtatctggtaccccagcagggcttcttctgtccagaccctgccccgggcgctgggggcatggtccaccacaggcaccgcagctcatctaccaggagtggcggtggggacctgacactagggctggagccctctgaagaggaggcccccaggtctccactggcaccctccgaaggggctggctccgatgtatttgatggtgacctgggaatgggggcagccaaggggctgcaaagcctccccacacatgaccccagccctctacagcggtacagtgaggaccccacagtacccctgccctctgagactgatggctacgttgcccccctgacctgcagcccccagcctgaatatgtgaaccagccagatgttcggccccagcccccttcgccccgagagggccctctgcctgctgcccgacctgctggtgccactctggaaaggcccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtgaaccagaaggccaagtccgcagaagccctgatgtgt

SEQ ID NO: 501 - DNA, 2147 bp, Homo sapiens
gaatgcacagggtgggcctagtcagaagaagcctttcccctgaaatccctctacttcccaagcacgcaagctttctcctgctgttaaacctgcagtgtgcaagggacatgggcggaggggtccttcagtcaggcttctccctgtctgagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcgtgagtccaacggtcttttctgcagaaaggaggactttcctttcaggggtctttctggggctcttactataaaaggggaccaactctccctttgtcatatcttgtttctgatgacaaaaataacacattgttaaaattgtaaaattaaaacatgaaatataaattaatgccct

SEQ ID NO: 502 - DNA, 4624 bp, Homo sapiens; identical to SEQ ID NO: 498

SEQ ID NO: 503 - DNA, 4341 bp, Homo sapiens
atgccccgggggtcctggaagccacaagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgtccatcatctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaaggtgaaggtgcttggatctggcgcttttggcacagtctacaagggcatctggatccctgatggggagaatgtgaaaattccagtggccatcaaagtgttgagggaaaacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgttggatgattgactctgaatgtcggccaagattccgggagttggtgtctgaattctcccgcatggccagggacccccagcgctttgtggtcatccagaatgaggacttgggcccagccagtcccttggacagcaccttctaccgctcactgctggaggacgatgacatgggggacctggtggatgctgaggagtatctggtaccccagcagggcttcttctgtccagaccctgccccgggcgctgggggcatggtccaccacaggcaccgcagctcatctaccaggagtggcggtggggacctgacactagggctggagccctctgaagaggaggcccccaggtctccactggcaccctccgaaggggctggctccgatgtatttgatggtgacctgggaatgggggcagccaaggggctgcaaagcctccccacacatgaccccagccctctacagcggtacagtgaggaccccacagtacccctgccctctgagactgatggctacgttgcccccctgacctgcagcccccagcctgaatatgtgaaccagccagatgttcggccccagcccccttcgccccgagagggccctctgcctgctgcccgacctgctggtgccactctggaaaggcccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtgaaccagaaggccaagtccgcagaagccctgatgtgtcctcagggagcagggaaggcctgacttctgctggcatcaagaggtgggagggccctccgaccacttccaggggaacctgccatgccaggaacctgtcctaaggaaccttccttcctgcttgagttcccagatggctggaaggggtccagcctcgttggaagaggaacagcactggggagtctttgtggattctgaggccctgcccaatgagactctagggtccagtggatgccacagcccagcttggccctttccttccagatcctgggtactgaaagccttagggaagctggcctgagaggggaagcggccctaagggagtgtctaagaacaaaagcgacccattcagagactgtccctgaaacctagtactgccccccatgaggaaggaacagcaatggtgtcagtatccaggctttgtacagagtgcttttctgtttagtttttactttttttgttttgtttttttaaagatgaaataaagacccagggggagaatgggtgttgtatggggaggcaagtgtggggggtccttctccacacccactttgtccatttgcaaatatattttggaaaacagcta

SEQ ID NO: 504 - DNA, 5919 bp, Homo sapiens
attacccttccctggatctgggggctttcggaatctcgacctccccttggcctatctcctgcagaaaaattagggtgagccccatcctcgatctgctccgccaagttgcgggaccgcggggcgtggcacgctcggggcaggcggtccgaggctccgcaatccctactccagcctcgcgcgggagggggcgcggccgtgactcacccccttccctctgcgttcctccctccctctctctctctctctcacacacacacacccctcccctgccatccctccccggactccggctccggctccgattgcaatttgcaacctccgctgccgtcgccgcagcagccaccaattcgccagcggttcaggtggctcttgcctcgatgtcctagcctaggggcccccgggccggacttggctgggctcccttcaccctctgcggagtcatgagggcgaacgacgctctgcaggtgctgggcttgcttttcagcctggcccggggctccgaggtgggcaactctcaggcagtgtgtcctgggactctgaatggcctgagtgtgaccggcgatgctgagaaccaataccagacactgtacaagctctacgagaggtgtgaggtggtgatggggaaccttgagattgtgctcacgggacacaatgccgacctctccttcctgcagtggattcgagaagtgacaggctatgtcctcgtggccatgaatgaattctctactctaccattgcccaacctccgcgtggtgcgagggacccaggtctacgatgggaagtttgccatcttcgtcatgttgaactataacaccaactccagccacgctctgcgccagctccgcttgactcagctcaccgagattctgtcagggggtgtttatattgagaagaacgataagctttgtcacatggacacaattgactggagggacatcgtgagggaccgagatgctgagatagtggtgaaggacaatggcagaagctgtcccccctgtcatgaggtttgcaaggggcgatgctggggtcctggatcagaagactgccagacattgaccaagaccatctgtgctcctcagtgtaatggtcactgctttgggcccaaccccaaccagtgctgccatgatgagtgtgccgggggctgctcaggccctcaggacacagactgctttgcctgccggcacttcaatgacagtggagcctgtgtacctcgctgtccacagcctcttgtctacaacaagctaactttccagctggaacccaatccccacaccaagtatcagtatggaggagtttgtgtagccagctgtccccataactttgtggtggatcaaacatcctgtgtcagggcctgtcctcctgacaagatggaagtagataaaaatgggctcaagatgtgtgagccttgtgggggactatgtcccaaagcctgtgagggaacaggctctgggagccgcttccagactgtggactcgagcaacattgatggatttgtgaactgcaccaagatcctgggcaacctggactttctgatcaccggcctcaatggagacccctggcacaagatccctgccctggacccagagaagctcaatgtcttccggacagtacgggagatcacaggttacctgaacatccagtcctggccgccccacatgcacaacttcagtgttttttccaatttgacaaccattggaggcagaagcctctacaaccggggcttctcattgttgatcatgaagaacttgaatgtcacatctctgggcttccgatccctgaaggaaattagtgctgggcgtatctatataagtgccaataggcagctctgctaccaccactctttgaactggaccaaggtgcttcgggggcctacggaagagcgactagacatcaagcataatcggccgcgcagagactgcgtggcagagggcaaagtgtgtgacccactgtgctcctctgggggatgctggggcccaggccctggtcagtgcttgtcctgtcgaaattatagccgaggaggtgtctgtgtgacccactgcaactttctgaatggggagcctcgagaatttgcccatgaggccgaatgcttctcctgccacccggaatgccaacccatggagggcactgccacatgcaatggctcgggctctgatacttgtgctcaatgtgcccattttcgagatgggccccactgtgtgagcagctgcccccatggagtcctaggtgccaagggcccaatctacaagtacccagatgttcagaatgaatgtcggccctgccatgagaactgcacccaggggtgtaaaggaccagagcttcaagactgtttaggacaaacactggtgctgatcggcaaaacccatctgacaatggctttgacagtgatagcaggattggtagtgattttcatgatgctgggcggcacttttctctactggcgtgggcgccggattcagaataaaagggctatgaggcgatacttggaacggggtgagagcatagagcctctggaccccagtgagaaggctaacaaagtcttggccagaatcttcaaagagacagagctaaggaagcttaaagtgcttggctcgggtgtctttggaactgtgcacaaaggagtgtggatccctgagggtgaatcaatcaagattccagtctgcattaaagtcattgaggacaagagtggacggcagagttttcaagctgtgacagatcatatgctggccattggcagcctggaccatgcccacattgtaaggctgctgggactatgcccagggtcatctctgcagcttgtcactcaatatttgcctctgggttctctgctggatcatgtgagacaacaccggggggcactggggccacagctgctgctcaactggggagtacaaattgccaagggaatgtactaccttgaggaacatggtatggtgcatagaaacctggctgcccgaaacgtgctactcaagtcacccagtcaggttcaggtggcagattttggtgtggctgacctgctgcctcctgatgataagcagctgctatacagtgaggccaagactccaattaagtggatggcccttgagagtatccactttgggaaatacacacaccagagtgatgtctggagctatggtgtgacagtttgggagttgatgaccttcggggcagagccctatgcagggctacgattggctgaagtaccagacctgctagagaagggggagcggttggcacagccccagatctgcacaattgatgtctacatggtgatggtcaagtgttggatgattgatgagaacattcgcccaacctttaaagaactagccaatgagttcaccaggatggcccgagacccaccacggtatctggtcataaagagagagagtgggcctggaatagcccctgggccagagccccatggtctgacaaacaagaagctagaggaagtagagctggagccagaactagacctagacctagacttggaagcagaggaggacaacctggcaaccaccacactgggctccgccctcagcctaccagttggaacacttaatcggccacgtgggagccagagccttttaagtccatcatctggatacatgcccatgaaccagggtaatcttggggagtcttgccaggagtctgcagtttctgggagcagtgaacggtgcccccgtccagtctctctacacccaatgccacggggatgcctggcatcagagtcatcagaggggcatgtaacaggctctgaggctgagctccaggagaaagtgtcaatgtgtaggagccggagcaggagccggagcccacggccacgcggagatagcgcctaccattcccagcgccacagtctgctgactcctgttaccccactctccccacccgggttagaggaagaggatgtcaacggttatgtcatgccagatacacacctcaaaggtactccctcctcccgggaaggcaccctttcttcagtgggtctcagttctgtcctgggtactgaagaagaagatgaagatgaggagtatgaatacatgaaccggaggagaaggcacagtccacctcatccccctaggccaagttcccttgaggagctgggttatgagtacatggatgtggggtcagacctcagtgcctctctgggcagcacacagagttgcccactccaccctgtacccatcatgcccactgcaggcacaactccagatgaagactatgaatatatgaatcggcaacgagatggaggtggtcctgggggtgattatgcagccatgggggcctgcccagcatctgagcaagggtatgaagagatgagagcttttcaggggcctggacatcaggccccccatgtccattatgcccgcctaaaaactctacgtagcttagaggctacagactctgcctttgataaccctgattactggcatagcaggcttttccccaaggctaatgcccagagaacgtaactcctgctccctgtggcactcagggagcatttaatggcagctagtgcctttagagggtaccgtcttctccctattccctctctctcccaggtcccagccccttttccccagtcccagacaattccattcaatctttggaggcttttaaacattttgacacaaaattcttatggtatgtagccagctgtgcactttcttctctttcccaaccccaggaaaggttttccttattttgtgtgctttcccagtcccattcctcagcttcttcacaggcactcctggagatatgaaggattactctccatatcccttcctctcaggctcttgactacttggaactaggctcttatgtgtgcctttgtttcccatcagactgtcaagaagaggaaagggaggaaacctagcagaggaaagtgtaattttggtttatgactcttaaccccctagaaagacagaagcttaaaatctgtgaagaaagaggttaggagtagatattgattactatcataattcagcacttaactatgagccaggcatcatactaaacttcacctacattatctcacttagtcctttatcatccttaaaacaattctgtgacatacatattatctcattttacacaaagggaagtcgggcatggtggctcatgcctgtaatctcagcactttgggaggctgaggcagaaggattacctgaggcaaggagtttgagaccagcttagccaacatagtaagacccccatctctttaaaaaaaaaaaaaaaaaaaaaaaaaaaactttagaactgggtgcagtggctcatgcctgtaatcccagccagcactttgggaggctgagatgggaagatcacttgagcccagaattagagataagcctatggaaacatagcaagacactgtctctacaggggaaaaaaaaaaaagaaactgagccttaaagagatgaaataaattaagcagtagatccaggatgcaaaatcctcccaattcctgtgcatgtgctcttattgtaaggtgccaagaaaaactgatttaagttacagcccttgtttaaggggcactgtttcttgtttttgcactgaatcaagtctaaccccaacagccacatcctcctatacctagacatctcatctcaggaagtggtggtgggggtagtcagaaggaaaaataactggacatctttgtgtaaaccataatccacatgtgccgtaaatgatcttcactccttatccgagggcaaattcacaaggatccccaagatccacttttagaagccattctcatccagcagtgagaagcttccaggtaggacagaaaaaagatccagcttcagctgcacacctctgtccccttggatggggaactaagggaaaacgtctgttgtatcactgaagttttttgttttgtttttatacgtgtctgaataaaaatgccaaagttttttttca

SEQ ID NO: 505 - DNA, 1186 bp, Homo sapiens
acacacacacacccctcccctgccatccctccccggactccggctccggctccgattgcaatttgcaacctccgctgccgtcgccgcagcagccaccaattcgccagcggttcaggtggctcttgcctcgatgtcctagcctaggggcccccgggccggacttggctgggctcccttcaccctctgcggagtcatgagggcgaacgacgctctgcaggtgctgggcttgcttttcagcctggcccggggctccgaggtgggcaactctcaggcagtgtgtcctgggactctgaatggcctgagtgtgaccggcgatgctgagaaccaataccagacactgtacaagctctacgagaggtgtgaggtggtgatggggaaccttgagattgtgctcacgggacacaatgccgacctctccttcctgcagtggattcgagaagtgacaggctatgtcctcgtggccatgaatgaattctctactctaccattgcccaacctccgcgtggtgcgagggacccaggtctacgatgggaagtttgccatcttcgtcatgttgaactataacaccaactccagccacgctctgcgccagctccgcttgactcagctcaccgagattctgtcagggggtgtttatattgagaagaacgataagctttgtcacatggacacaattgactggagggacatcgtgagggaccgagatgctgagatagtggtgaaggacaatggcagaagctgtcccccctgtcatgaggtttgcaaggggcgatgctggggtcctggatcagaagactgccagacattgaccaagaccatctgtgctcctcagtgtaatggtcactgctttgggcccaaccccaaccagtgctgccatgatgagtgtgccgggggctgctcaggccctcaggacacagactgctttgcctgccggcacttcaatgacagtggagcctgtgtacctcgctgtccacagcctcttgtctacaacaagctaactttccagctggaacccaatccccacaccaagtatcagtatggaggagtttgtgtagccagctgtccccataactttgtggtggatcaaacatcctgtgtcagggcctgtcctcctgacaagatggaagtagataaaaatgggctcaagatgtgtgagccttgtgggggactatgtcccaaagttttc

SEQ ID NO: 506 - DNA, 1020 bp, Homo sapiens
tccccggactccggctccggctccgattgcaatttgcaacctccgctgccgtcgccgcagcagccaccaattcgccagcggttcaggtggctcttgcctcgatgtcctagcctaggggcccccgggccggacttggctgggctcccttcaccctctgcggagtcatgagggcgaacgacgctctgcaggtgctgggcttgcttttcagcctggcccggggctccgaggtgggcaactctcaggcagtgtgtcctgggactctgaatggcctgagtgtgaccggcgatgctgagaaccaataccagacactgtacaagctctacgagaggtgtgaggtggtgatggggaaccttgagattgtgctcacgggacacaatgccgacctctccttcctgcagtggattcgagaagtgacaggctatgtcctcgtggccatgaatgaattctctactctaccattgcccaacctccgcgtggtgcgagggacccaggtctacgatgggaagtttgccatcttcgtcatgttgaactataacaccaactccagccacgctctgcgccagctccgcttgactcagctcaccggtcagttcccgatggttccttctggcctcacccctcagccagcccaagactggtacctccttgatgatgacccaagactgctcactctaagtgcctcttccaaggtgcctgtcaccttggccgctgtctaaaggtccattgctccctaagcaatagagggcccccagtagggggagctaggggcatctgctccagggaaaggaaccctgtgtccttgtggggctggagtcagagctggatctgttaaccgtttttctaatttcaaagtacagtgtaccggaggccaggcctgatggcttacacctgtaatcccagcattttgggaggccaaggagggcagatcacttgagatcaggagtttgagaccagcctggccaacatggcgaaaccctgtctctactaaaaatacaaaaaaataaaataaaataaaaaatt

SEQ ID NO: 507 - DNA, 4353 bp, Homo sapiens
atttattccaggacctagagagaggcaggatgagggtagagaattaaccccttagtacccaaaagaagcacagaggggtcccaggttgaaaaaggaaatcttttcaccttcccattcatggaatgtgtgtcctgggactctgaatggcctgagtgtgaccggcgatgctgagaaccaataccagacactgtacaagctctacgagaggtgtgaggtggtgatggggaaccttgagattgtgctcacgggacacaatgccgacctctccttcctgcagtggattcgagaagtgacaggctatgtcctcgtggccatgaatgaattctctactctaccattgcccaacctccgcgtggtgcgagggacccaggtctacgatgggaagtttgccatcttcgtcatgttgaactataacaccaactccagccacgctctgcgccagctccgcttgactcagctcaccgagattctgtcagggggtgtttatattgagaagaacgataagctttgtcacatggacacaattgactggagggacatcgtgagggaccgagatgctgagatagtggtgaaggacaatggcagaagctgtcccccctgtcatgaggtttgcaaggggcgatgctggggtcctggatcagaagactgccagacattgaccaagaccatctgtgctcctcagtgtaatggtcactgctttgggcccaaccccaaccagtgctgccatgatgagtgtgccgggggctgctcaggccctcaggacacagactgctttgcctgccggcacttcaatgacagtggagcctgtgtacctcgctgtccacagcctcttgtctacaacaagctaactttccagctggaacccaatccccacaccaagtatcagtatggaggagtttgtgtagccagctgtccccataactttgtggtggatcaaacatcctgtgtcagggcctgtcctcctgacaagatggaagtagataaaaatgggctcaagatgtgtgagccttgtgggggactatgtcccaaagcctgtgagggaacaggctctgggagccgcttccagactgtggactcgagcaacattgatggatttgtgaactgcaccaagatcctgggcaacctggactttctgatcaccggcctcaatggagacccctggcacaagatccctgccctggacccagagaagctcaatgtcttccggacagtacgggagatcacaggttacctgaacatccagtcctggccgccccacatgcacaacttcagtgttttttccaatttgacaaccattggaggcagaagcctctacaaccggggcttctcattgttgatcatgaagaacttgaatgtcacatctctgggcttccgatccctgaaggaaattagtgctgggcgtatctatataagtgccaataggcagctctgctaccaccactctttgaactggaccaaggtgcttcgggggcctacggaagagcgactagacatcaagcataatcggccgcgcagagactgcgtggcagagggcaaagtgtgtgacccactgtgctcctctgggggatgctggggcccaggccctggtcagtgcttgtcctgtcgaaattatagccgaggaggtgtctgtgtgacccactgcaactttctgaatggggagcctcgagaatttgcccatgaggccgaatgcttctcctgccacccggaatgccaacccatggagggcactgccacatgcaatggctcgggctctgatacttgtgctcaatgtgcccattttcgagatgggccccactgtgtgagcagctgcccccatggagtcctaggtgccaagggcccaatctacaagtacccagatgttcagaatgaatgtcggccctgccatgagaactgcacccaggggtgtaaaggaccagagcttcaagactgtttaggacaaacactggtgctgatcggcaaaacccatctgacaatggctttgacagtgatagcaggattggtagtgattttcatgatgctgggcggcacttttctctactggcgtgggcgccggattcagaataaaagggctatgaggcgatacttggaacggggtgagagcatagagcctctggaccccagtgagaaggctaacaaagtcttggccagaatcttcaaagagacagagctaaggaagcttaaagtgcttggctcgggtgtctttggaactgtgcacaaaggagtgtggatccctgagggtgaatcaatcaagattccagtctgcattaaagtcattgaggacaagagtggacggcagagttttcaagctgtgacagatcatatgctggccattggcagcctggaccatgcccacattgtaaggctgctgggactatgcccagggtcatctctgcagcttgtcactcaatatttgcctctgggttctctgctggatcatgtgagacaacaccggggggcactggggccacagctgctgctcaactggggagtacaaattgccaagggaatgtactaccttgaggaacatggtatggtgcatagaaacctggctgcccgaaacgtgctactcaagtcacccagtcaggttcaggtggcagattttggtgtggctgacctgctgcctcctgatgataagcagctgctatacagtgaggccaagactccaattaagtggatggcccttgagagtatccactttgggaaatacacacaccagagtgatgtctggagctatggtgtgacagtttgggagttgatgaccttcggggcagagccctatgcagggctacgattggctgaagtaccagacctgctagagaagggggagcggttggcacagccccagatctgcacaattgatgtctacatggtgatggtcaagtgttggatgattgatgagaacattcgcccaacctttaaagaactagccaatgagttcaccaggatggcccgagacccaccacggtatctggtcataaagagagagagtgggcctggaatagcccctgggccagagccccatggtctgacaaacaagaagctagaggaagtagagctggagccagaactagacctagacctagacttggaagcagaggaggacaacctggcaaccaccacactgggctccgccctcagcctaccagttggaacacttaatcggccacgtgggagccagagccttttaagtccatcatctggatacatgcccatgaaccagggtaatcttggggagtcttgccaggagtctgcagtttctgggagcagtgaacggtgcccccgtccagtctctctacacccaatgccacggggatgcctggcatcagagtcatcagaggggcatgtaacaggctctgaggctgagctccaggagaaagtgtcaatgtgtaggagccggagcaggagccggagcccacggccacgcggagatagcgcctaccattcccagcgccacagtctgctgactcctgttaccccactctccccacccgggttagaggaagaggatgtcaacggttatgtcatgccagatacacacctcaaaggtactccctcctcccgggaaggcaccctttcttcagtgggtctcagttctgtcctgggtactgaagaagaagatgaagatgaggagtatgaatacatgaaccggaggagaaggcacagtccacctcatccccctaggccaagttcccttgaggagctgggttatgagtacatggatgtggggtcagacctcagtgcctctctgggcagcacacagagttgcccactccaccctgtacccatcatgcccactgcaggcacaactccagatgaagactatgaatatatgaatcggcaacgagatggaggtggtcctgggggtgattatgcagccatgggggcctgcccagcatctgagcaagggtatgaagagatgagagcttttcaggggcctggacatcaggccccccatgtccattatgcccgcctaaaaactctacgtagcttagaggctacagactctgcctttgataaccctgattactggcatagcaggcttttccccaaggctaatgcccagagaacgtaactcctgctccctgtggcactcagggagcatttaatggcagctagtgcctttagagggtaccgtcttctccctattccctctctctcccaggtcccagccccttttccccagtcccagacaattccattcaatctttggaggcttttaaacattttgacacaaaattcttatggtatgtagccagctgtgcactttcttctctttcccaaccccaggaaaggttttccttattttgtgtgctttcccagtcccattcctcagcttcttcacaggcactcctg

SEQ ID NO: 508 - DNA, 2723 bp, Homo sapiens
aatttgcaacctccgctgccgtcgccgcagcagccaccaattcgccagcggttcaggtggctcttgcctcgatgtcctagcctaggggcccccgggccggacttggctgggctcccttcaccctctgcggagtcatgagggcgaacgacgctctgcaggtgccaagggcccaatctacaagtacccagatgttcagaatgaatgtcggccctgccatgagaactgcacccaggggtgtaaaggaccagagcttcaagactgtttaggacaaacactggtgctgatcggcaaaacccatctgacaatggctttgacagtgatagcaggattggtagtgattttcatgatgctgggcggcacttttctctactggcgtgggcgccggattcagaataaaagggctatgaggcgatacttggaacggggtgagagcatagagcctctggaccccagtgagaaggctaacaaagtcttggccagaatcttcaaagagacagagctaaggaagcttaaagtgcttggctcgggtgtctttggaactgtgcacaaaggagtgtggatccctgagggtgaatcaatcaagattccagtctgcattaaagtcattgaggacaagagtggacggcagagttttcaagctgtgacagatcatatgctggccattggcagcctggaccatgcccacattgtaaggctgctgggactatgcccagggtcatctctgcagcttgtcactcaatatttgcctctgggttctctgctggatcatgtgagacaacaccggggggcactggggccacagctgctgctcaactggggagtacaaattgccaagggaatgtactaccttgaggaacatggtatggtgcatagaaacctggctgcccgaaacgtgctactcaagtcacccagtcaggttcaggtggcagattttggtgtggctgacctgctgcctcctgatgataagcagctgctatacagtgaggccaagactccaattaagtggatggcccttgagagtatccactttgggaaatacacacaccagagtgatgtctggagctatggtgtgacagtttgggagttgatgaccttcggggcagagccctatgcagggctacgattggctgaagtaccagacctgctagagaagggggagcggttggcacagccccagatctgcacaattgatgtctacatggtgatggtcaagtgttggatgattgatgagaacattcgcccaacctttaaagaactagccaatgagttcaccaggatggcccgagacccaccacggtatctggtcataaagagagagagtgggcctggaatagcccctgggccagagccccatggtctgacaaacaagaagctagaggaagtagagctggagccagaactagacctagacctagacttggaagcagaggaggacaacctggcaaccaccacactgggctccgccctcagcctaccagttggaacacttaatcggccacgtgggagccagagccttttaagtccatcatctggatacatgcccatgaaccagggtaatcttggggagtcttgccaggagtctgcagtttctgggagcagtgaacggtgcccccgtccagtctctctacacccaatgccacggggatgcctggcatcagagtcatcagaggggcatgtaacaggctctgaggctgagctccaggagaaagtgtcaatgtgtaggagccggagcaggagccggagcccacggccacgcggagatagcgcctaccattcccagcgccacagtctgctgactcctgttaccccactctccccacccgggttagaggaagaggatgtcaacggttatgtcatgccagatacacacctcaaaggtactccctcctcccgggaaggcaccctttcttcagtgggtctcagttctgtcctgggtactgaagaagaagatgaagatgaggagtatgaatacatgaaccggaggagaaggcacagtccacctcatccccctaggccaagttcccttgaggagctgggttatgagtacatggatgtggggtcagacctcagtgcctctctgggcagcacacagagttgcccactccaccctgtacccatcatgcccactgcaggcacaactccagatgaagactatgaatatatgaatcggcaacgagatggaggtggtcctgggggtgattatgcagccatgggggcctgcccagcatctgagcaagggtatgaagagatgagagcttttcaggggcctggacatcaggccccccatgtccattatgcccgcctaaaaactctacgtagcttagaggctacagactctgcctttgataaccctgattactggcatagcaggcttttccccaaggctaatgcccagagaacgtaactcctgctccctgtggcactcagggagcatttaatggcagctagtgcctttagagggtaccgtcttctccctattccctctctctcccaggtcccagccccttttccccagtcccagacaattccattcaatctttggaggcttttaaacattttgacacaaaattcttatggtatgtagccagctgtgcactttcttctctttcccaaccccaggaaaggttttccttattttgtgtgctttcccagtcccattcctcagcttcttcacaggcactcctggagatatgaaggattactctccatatcccttcctctca

SEQ ID NO: 509 - DNA, 561 bp, Homo sapiens
attcattacccttccctggatctgggggctttcggaatctcgacctccccttggcctatctcctgcagaaaaattaggcagccaccaattcgccagcggttcaggtggctcttgcctcgatgtcctagcctaggggcccccgggccggacttggctgggctcccttcaccctctgcggagtcatgagggcgaacgacgctctgcaggtgctgggcttgcttttcagcctggcccggggctccgaggtgggcaactctcaggcagtgtgtcctgggactctgaatggcctgagtgtgaccggcgatgctgagaaccaataccagacactgtacaagctctacgagaggtgtgaggtggtgatggggaaccttgagattgtgctcacgggacacaatgccgacctctccttcctgcagtggattcgagaagtgacaggctatgtcctcgtggccatgaatgaattctctactctaccattgcccaacctccgcgtggtgcgagggacccaggtctacgatgggaagtttgccatcttcgtcatgttgaactataacaccaact

SEQ ID NO: 510 - DNA, 4382 bp, Homo sapiens
atttgcaacctccgctgccgtcgccgcagcagccaccaattcgccagcggttcaggtggctcttgcctcgatgtcctagcctaggggcccccgggccggacttggctgggctcccttcaccctctgcggagtcatgagggcgaacgacgctctgcaggtgctgggcttgcttttcagcctggcccggggctccgaggtgggcaactctcaggcagtgtgtcctgggactctgaatggcctgagtgtgaccggcgatgctgagaaccaataccagacactgtacaagctctacgagaggtgtgaggtggtgatggggaaccttgagattgtgctcacgggacacaatgccgacctctccttcctgcagtggattcgagaagtgacaggctatgtcctcgtggccatgaatgaattctctactctaccattgcccaacctccgcgtggtgcgagggacccaggtctacgatgggaagtttgccatcttcgtcatgttgaactataacaccaactccagccacgctctgcgccagctccgcttgactcagctcaccgagattctgtcagggggtgtttatattgagaagaacgataagctttgtcacatggacacaattgactggagggacatcgtgagggaccgagatgctgagatagtggtgaaggacaatggcagaagctgtcccccctgtcatgaggtttgcaaggggcgatgctggggtcctggatcagaagactgccagacattgaccaagaccatctgtgctcctcagtgtaatggtcactgctttgggcccaaccccaaccagtgctgccatgatgagtgtgccgggggctgctcaggccctcaggacacagactgctttgcctgccggcacttcaatgacagtggagcctgtgtacctcgctgtccacagcctcttgtctacaacaagctaactttccagctggaacccaatccccacaccaagtatcagtatggaggagtttgtgtagccagctgtccccataactttgtggtggatcaaacatcctgtgtcagggcctgtcctcctgacaagatggaagtagataaaaatgggctcaagatgtgtgagccttgtgggggactatgtcccaaagcctgtgagggaacaggctctgggagccgcttccagactgtggactcgagcaacattgatggatttgtgaactgcaccaagatcctgggcaacctggactttctgatcaccggcctcaatggagacccctggcacaagatccctgccctggacccagagaagctcaatgtcttccggacagtacgggagatcacaggttacctgaacatccagtcctggccgccccacatgcacaacttcagtgttttttccaatttgacaaccattggaggcagaagcctctacaaccggggcttctcattgttgatcatgaagaacttgaatgtcacatctctgggcttccgatccctgaaggaaattagtgctgggcgtatctatataagtgccaataggcagctctgctaccaccactctttgaactggaccaaggtgcttcgggggcctacggaagagcgactagacatcaagcataatcggccgcgcagagactgcgtggcagagggcaaagtgtgtgacccactgtgctcctctgggggatgctggggcccaggccctggtcagtgcttgtcctgtcgaaattatagccgaggaggtgtctgtgtgacccactgcaactttctgaatggggagcctcgagaatttgcccatgaggccgaatgcttctcctgccacccggaatgccaacccatggagggcactgccacatgcaatggctcgggctctgatacttgtgctcaatgtgcccattttcgagatgggccccactgtgtgagcagctgcccccatggagtcctaggtgccaagggcccaatctacaagtacccagatgttcagaatgaatgtcggccctgccatgagaactgcacccaggggtgtaaaggaccagagcttcaagactgtttaggacaaacactggtgctgatcggcaaaacccatctgacaatggctttgacagtgatagcaggattggtagtgattttcatgatgctgggcggcacttttctctactggcgtgggcgccggattcagaataaaagggctatgaggcgatacttggaacggggtgagagcatagagcctctggaccccagtgagaaggctaacaaagtcttggccagaatcttcaaagagacagagctaaggaagcttaaagtgcttggctcgggtgtctttggaactgtgcacaaaggagtgtggatccctgagggtgaatcaatcaagattccagtctgcattaaagtcattgaggacaagagtggacggcagagttttcaagctgtgacagatcatatgctggccattggcagcctggaccatgcccacattgtaaggctgctgggactatgcccagggtcatctctgcagcttgtcactcaatatttgcctctgggttctctgctggatcatgtgagacaacaccggggggcactggggccacagctgctgctcaactggggagtacaaattgccaagggaatgtactaccttgaggaacatggtatggtgcatagaaacctggctgcccgaaacgtgctactcaagtcacccagtcaggttcaggtggcagattttggtgtggctgacctgctgcctcctgatgataagcagctgctatacagtgaggccaagactccaattaagtggatggcccttgagagtatccactttgggaaatacacacaccagagtgatgtctggagctatggtcagtgcatctggatgccctctctaccatcactggccccagtttcaaatttaccttttgagaccccctcttagaatctctaagcacttcagatttttgtgttagatcaggttctgccttcccttcacttcatgcccatgtctactattttgccagtgactagtccatgtcttcctgcaacaggtgtgacagtttgggagttgatgaccttcggggcagagccctatgcagggctacgattggctgaagtaccagacctgctagagaagggggagcggttggcacagccccagatctgcacaattgatgtctacatggtgatggtcaagtgttggatgattgatgagaacattcgcccaacctttaaagaactagccaatgagttcaccaggatggcccgagacccaccacggtatctggtcataaagagagagagtgggcctggaatagcccctgggccagagccccatggtctgacaaacaagaagctagaggaagtagagctggagccagaactagacctagacctagacttggaagcagaggaggacaacctggcaaccaccacactgggctccgccctcagcctaccagttggaacacttaatcggccacgtgggagccagagccttttaagtccatcatctggatacatgcccatgaaccagggtaatcttggggagtcttgccaggagtctgcagtttctgggagcagtgaacggtgcccccgtccagtctctctacacccaatgccacggggatgcctggcatcagagtcatcagaggggcatgtaacaggctctgaggctgagctccaggagaaagtgtcaatgtgtaggagccggagcaggagccggagcccacggccacgcggagatagcgcctaccattcccagcgccacagtctgctgactcctgttaccccactctccccacccgggttagaggaagaggatgtcaacggttatgtcatgccagatacacacctcaaaggtactccctcctcccgggaaggcaccctttcttcagtgggtctcagttctgtcctgggtactgaagaagaagatgaagatgaggagtatgaatacatgaaccggaggagaaggcacagtccacctcatccccctaggccaagttcccttgaggagctgggttatgagtacatggatgtggggtcagacctcagtgcctctctgggcagcacacagagttgcccactccaccctgtacccatcatgcccactgcaggcacaactccagatgaagactatgaatatatgaatcggcaacgagatggaggtggtcctgggggtgattatgcagccatgggggcctgcccagcatctgagcaagggtatgaagagatgagagcttttcaggggcctggacatcaggccccccatgtccattatgcccgcctaaaaactctacgtagcttagaggctacagactctgcctttgataaccctgattactggcatagcaggcttttccccaaggctaatgcccagagaacgtaactcctgctccctgtggcactcagggagcatttaatgg

SEQ ID NO: 511 - DNA, 11022 bp, Homo sapiens
aggcaatcggtccgagtggctgtcggctcttcagctctcccgctcggcgtcttccttcctcctcccggtcagcgtcggcggctgcaccggcggcggcgcagtccctgcgggaggggcgacaagagctgagcggcggccgccgagcgtcgagctcagcgcggcggaggcggcggcggcccggcagccaacatggcggcggcggcggcggcgggcgcgggcccggagatggtccgcgggcaggtgttcgacgtggggccgcgctacaccaacctctcgtacatcggcgagggcgcctacggcatggtgtgctctgcttatgataatgtcaacaaagttcgagtagctatcaagaaaatcagcccctttgagcaccagacctactgccagagaaccctgagggagataaaaatcttactgcgcttcagacatgagaacatcattggaatcaatgacattattcgagcaccaaccatcgagcaaatgaaagatgtatatatagtacaggacctcatggaaacagatctttacaagctcttgaagacacaacacctcagcaatgaccatatctgctattttctctaccagatcctcagagggttaaaatatatccattcagctaacgttctgcaccgtgacctcaagccttccaacctgctgctcaacaccacctgtgatctcaagatctgtgactttggcctggcccgtgttgcagatccagaccatgatcacacagggttcctgacagaatatgtggccacacgttggtacagggctccagaaattatgttgaattccaagggctacaccaagtccattgatatttggtctgtaggctgcattctggcagaaatgctttctaacaggcccatctttccagggaagcattatcttgaccagctgaaccacattttgggtattcttggatccccatcacaagaagacctgaattgtataataaatttaaaagctaggaactatttgctttctcttccacacaaaaataaggtgccatggaacaggctgttcccaaatgctgactccaaagctctggacttattggacaaaatgttgacattcaacccacacaagaggattgaagtagaacaggctctggcccacccatatctggagcagtattacgacccgagtgacgagcccatcgccgaagcaccattcaagttcgacatggaattggatgacttgcctaaggaaaagctcaaagaactaatttttgaagagactgctagattccagccaggatacagatcttaaatttgtcaggacaagggctcagaggactggacgtgctcagacatcggtgttcttcttcccagttcttgacccctggtcctgtctccagcccgtcttggcttatccactttgactcctttgagccgtttggaggggcggtttctggtagttgtggcttttatgctttcaaagaatttcttcagtccagagaattcctcctggcagccctgtgtgtgtcacccattggtgacctgcggcagtatgtacttcagtgcacctactgcttactgttgctttagtcactaattgctttctggtttgaaagatgcagtggttcctccctctcctgaatccttttctacatgatgccctgctgaccatgcagccgcaccagagagagattcttccccaattggctctagtcactggcatctcactttatgatagggaaggctactacctagggcactttaagtcagtgacagccccttatttgcacttcaccttttgaccataactgtttccccagagcaggagcttgtggaaataccttggctgatgttgcagcctgcagcaagtgcttccgtctccggaatccttggggagcacttgtccacgtcttttctcatatcatggtagtcactaacatatataaggtatgtgctattggcccagcttttagaaaatgcagtcatttttctaaataaaaaggaagtactgcacccagcagtgtcactctgtagttactgtggtcacttgtaccatatagaggtgtaacacttgtcaagaagcgttatgtgcagtacttaatgtttgtaagacttacaaaaaaagatttaaagtggcagcttcactcgacatttggtgagagaagtacaaaggttgcagtgctgagctgtgggcggtttctggggatgtcccagggtggaactccacatgctggtgcatatacgcccttgagctacttcaaatgtgggtgtttcagtaaccacgttccatgcctgaggatttagcagagaggaacactgcgtctttaaatgagaaagtatacaattctttttccttctacagcatgtcagcatctcaagttcatttttcaacctacagtataacaatttgtaataaagcctccaggagctcatgacgtgaagcactgttctgtcctcaagtactcaaatatttctgatactgctgagtcagactgtcagaaaaagctagcactaactcgtgtttggagctctatccatattttactgatctctttaagtatttgttcctgccactgtgtactgtggagttgactcggtgttctgtcccagtgcggtgcctcctcttgacttccccactgctctctgtggtgagaaatttgccttgttcaataattactgtaccctcgcatgactgttacagctttctgtgcagagatgactgtccaagtgccacatgcctacgattgaaatgaaaactctattgttacctctgagttgtgttccacggaaaatgctatccagcagatcatttaggaaaaataattctatttttagcttttcatttctcagctgtccttttttcttgtttgatttttgacagcaatggagaatgggttatataaagactgcctgctaatatgaacagaaatgcatttgtaattcatgaaaataaatgtacatcttctatcttcacattcatgttaagattcagtgttgctttcctctggatcagcgtgtctgaatggacagtcaggttcaggttgtgctgaacacagaaatgctcacaggcctcactttgccgcccaggcactggcccagcacttggatttacataagatgagttagaaaggtacttctgtagggtcctttttacctctgctcggcagagaatcgatgctgtcatgttcctttattcacaatcttaggtctcaaatattctgtcaaaccctaacaaagaagccccgacatctcaggttggattccctggttctctctaaagagggcctgcccttgtgccccagaggtgctgctgggcacagccaagagttgggaagggccgccccacagtacgcagtcctcaccacccagcccagggtgctcacgctcaccactcctgtggctgaggaaggatagctggctcatcctcggaaaacagacccacatctctattcttgccctgaaatacgcgcttttcacttgcgtgctcagagctgccgtctgaaggtccacacagcattgacgggacacagaaatgtgactgttaccggataacactgattagtcagttttcatttataaaaaagcattgacagttttattactcttgtttctttttaaatggaaagttactattataaggttaatttggagtcctcttctaaatagaaaaccatatccttggctactaacatctggagactgtgagctccttcccattccccttcctggtactgtggagtcagattggcatgaaaccactaacttcattctagaatcattgtagccataagttgtgtgctttttattaatcatgccaaacataatgtaactgggcagagaatggtcctaaccaaggtacctatgaaaagcgctagctatcatgtgtagtagatgcatcattttggctcttcttacatttgtaaaaatgtacagattaggtcatcttaattcatattagtgacacggaacagcacctccactatttgtatgttcaaataagctttcagactaatagcttttttggtgtctaaaatgtaagcaaaaaattcctgctgaaacattccagtcctttcatttagtataaaagaaatactgaacaagccagtgggatggaattgaaagaactaatcatgaggactctgtcctgacacaggtcctcaaagctagcagagatacgcagacattgtggcatctgggtagaagaatactgtattgtgtgtgcagtgcacagtgtgtggtgtgtgcacactcattccttctgctcttgggcacaggcagtgggtgtagaggtaaccagtagctttgagaagctacatgtagctcaccagtggttttctctaaggaatcacaaaagtaaactacccaaccacatgccacgtaatatttcagccattcagaggaaactgttttctctttatttgcttatatgttaatatggtttttaaattggtaacttttatatagtatggtaacagtatgttaatacacacatacatacgcacacatgctttgggtccttccataatacttttatatttgtaaatcaatgttttggagcaatcccaagtttaagggaaatatttttgtaaatgtaatggttttgaaaatctgagcaatccttttgcttatacatttttaaagcatttgtgctttaaaattgttatgctggtgtttgaaacatgatactcctgtggtgcagatgagaagctataacagtgaatatgtggtttctcttacgtcatccaccttgacatgatgggtcagaaacaaatggaaatccagagcaagtcctccagggttgcaccaggtttacctaaagcttgttgccttttcttgtgctgtttatgcgtgtagagcactcaagaaagttctgaaactgctttgtatctgctttgtactgttggtgccttcttggtattgtaccccaaaattctgcatagattatttagtataatggtaagttaaaaaatgttaaaggaagattttattaagaatctgaatgtttattcattatattgttacaatttaacattaacatttatttgtggtatttgtgatttggttaatctgtataaaaattgtaagtagaaaggtttatatttcatcttaattcttttgatgttgtaaacgtactttttaaaagatggattatttgaatgtttatggcacctgacttgtaaaaaaaaaaaactacaaaaaaatccttagaatcattaaattgtgtccctgtattaccaaaataacacagcaccgtgcatgtatagtttaattgcagtttcatctgtgaaaacgtgaaattgtctagtccttcgttatgttccccagatgtcttccagatttgctctgcatgtggtaacttgtgttagggctgtgagctgttcctcgagttgaatggggatgtcagtgctcctagggttctccaggtggttcttcagaccttcacctgtgggggggggggtaggcggtgcccacgcccatctcctcatcctcctgaacttctgcaaccccactgctgggcagacatcctgggcaaccccttttttcagagcaagaagtcataaagataggatttcttggacatttggttcttatcaatattgggcattatgtaatgacttatttacaaaacaaagatactggaaaatgttttggatgtggtgttatggaaagagcacaggccttggacccatccagctgggttcagaactaccccctgcttataactgcggctggctgtgggccagtcattctgcgtctctgctttcttcctctgcttcagactgtcagctgtaaagtggaagcaatattacttgccttgtatatggtaaagattataaaaatacatttcaactgttcagcatagtacttcaaagcaagtactcagtaaatagcaagtctttttaaatgctgctttatttcactaaattttgttgtgaggtgtcactaaaatgcctgcaaacaaacgtaactgctaatctgagaggaaaccctcttactaatcagagaagaaaccctcctgtcagaaaccttcagggaagtgagctgatcacacctaaactgggagtttgcaatggggtatttgaagcactgtgggagtattccactggccctctccctgagagacttaacagtcttccctgttgtccagattctgtataaggcaatcagaataatcatcttccttgttcagcagaggagcctggtcccattttccccactttgtgatgggcttctctcagcggtagctcagcagttccagatggcagtttggaccagcatctaggctggccagttcgctgtgtttacttagaaccaacacgttcagagctggcctggaccatctgaggggaacaggaaacacccctaggctgtggaagcaagtgcagacccccacccccggccctgaagccaagggggcagggtttgggagtggccaaagagaagcagtgcagggatgggttttcctagggacaggcttagcattcctgactctaggaagaaggagcagtgaggcggagaaacagtggaggggatggtggcattgggccccatggggccgagatggacacagggctcgttctcttgagtctggtgccaaggacagctgaagacgacatcattttcaggtggagaggagagagtggagggagatcatgccctgtgatgtgtcttttgcaggtgaaggtgggagacaaggtctctgctgacgatgaggcagagccaccgtgaaagttgtaataggaggactgcccgccgctggaagggcctgcagtgacgctaggacaccctctgcctgcatgtcacgttagctgggctgggcgaagtagaagaccaaggggaagaggtgcagtggggagaccaggtgggatgcaaccacaggaccagtggaggggctgtggcacgtgggcggagactgagtggctgggcatgtgttgtggctgagcatgtggtgtgggcagtggtcctagaccccgccatgtccggacaatgatatagagcgtctcagcatcgccagtctagactgtctatggagagcagaaagttgtctggggctgcctggggaactgtgaggccagctatatcaccgtcgctgatggtgacattacggtggtggcaggagcaaggagagagggaagaaggaccccgtccagctttagtcacaaaatacccaatggaagatgccagtgccaatcctgtgggtttccttgggacttcacactggctttcttatctgctccagatccattcagtagtcactgagttcctgccaaatactttgtagcgccagaagccaggagcggggtctgcagcagggcagtccccattttcaggaaatgcctggagctgctggtccctgagagaaaggaaaacatctttcagccgtacgcaggccaagaaggccaatgtccagtagctttgtgattttttttatatttttttatttatttatttttgagatagagtcttgctctgtcgctcaggctggagtgcagtggcgtgatctccactcactgcaacttccgcctcctggggtcaagcagttctgcctcagcctcccgagtagctgggattacaggcacacgccaccacacccagctaatttttgtgtttttagtagagacggtttcaccatgtcggccaggctggtctcaaactcctgacctcagatgattcagcctcccaaagtgctgggattacaggtgtgagccactgcacccagcctgtgatgtttctgtggggttccacaaatgtgtgtgtgtgtaaaagctgatgattacagcaagaatgtgaacagtagcagttttccatttgaaggcaagttttgtctttatctgggtatcagaaggaccctctgggccattgtcgcttcctgtactcagagccaccctagtactacgggcacacacagaaaacagcagcctgcgtactttcaaaggaaaggcatctttaatcaccaatgcctggaaaaattattttgtttccctcttccttccgtcttgtttcctaacttcttaccaaagtttagagtctgagtttttcgtataataatgtcccacatccacacatcgggcctacagatgctctcccttgaatcgactggaaacatgacaccggttccatgctctggaactgtcacctgtgatgtgctgggctgtgtcccaagcacaggaatcccagcagtttcagctcgatgcagaaccaccatgctccagacacaggcttgggaaagacacgtcaaaattaaaatactaggtaagagaagcacctgattgggtagaagttggagaggaatcctggaattttgtggccagaaggagccactgccccttttgtttagtaagactagacagtaacagaagccagttgtcagctatgaaagtggtgggtgaagcaggggaggctcctctatggtgggaccctggacaagggaagccgaatgtgtgaagaaggggtgcgggggtgtgcggtgccctaggacactagggcaaaggtttcaaacctggaacaaggcactggaggaagatctgctgccagtcagcagtgcgggccctcgagttagcagtccgtgcgcagaggggccagttctgagaccagtttggagagtcaggcagtgacccattggccatgtcataattccttcagcctgcctcctctttaatcccagagagtgctctttcttcatacttcctttaaaatactaaattgttcccattccatggggagctggctaggctttacaggctaggaaatgtaggttttctgagatggaaccatctacacaaggaggaggaaggcactaagactacagatgagacccatgacagggctgagcatttggaagccaaccctggttgcttttcaagaattgctttgtggctgggtgcagtggttcacacctgtaattgcagcactttgggaggctgaggcaggtggattgcttgaacccaggagttcgagaccagcctgggcaacatatgggacaccccaccgcccccggctctgcaaaaaaattaaaaattagccaggcgtggtgtcatgagcctgtggtctcaactactcaggaggctgaggctggaggatcgcttgaacctgggaggtcaaggctccagtgaaccataattgtgccactgcactgcagcctgggcgacaatttgttttctaaattgcttttgaaagtctactgcattacatattccaaaaagcagtggttttcaaatacttttatcaccgatatccttttatgaaatgaaatcagtagaactttctctgctctgaataagcaagggtgggaacctgtctacctcccacagatagcataatgtgcctgccatagaggagccaaaaaatggtgatgggaactgagaggagagcaaatgtcacaaaagactgagcaattgagaaaacaaaacaagaccacagatgactgttaacgcctccacagtggaccaagaaaggacagagagctggcagcatgggcatcactgtctggtcggcagcaggaaggcctcgctagggaattgagtacagtcatctaactagtttaaaagtacaggaaggatgattaaggctattggagaggtcatacaaataggggaggggcaggcaatggctgataagacatgaatttgtaaggcgatgagtattgcagtcagcaaaacaaacgagactgctctcccaacacataactcagcagggaggccaggcattggtttaaccatttaatataaagaagttaaaattacaaatgcgctaagtgcctaaagaagaataagtgcaggaatgagagcagcatggactgccacagttttagaataagcactgtcactgctagattggaaacaaaaatccataaatttggcccggtgtggtggcggacgcctgtagtcccagctacttggaggctgaggcgtgagaatcgcttgaacccgggaggcggaggttgcagtgagccgagatggcgccactgcactccagcctgggcgtcagagtgagaactctgtatcaaaaaataaaaataaaaaaaagtccataaatctgcaatgtctcagttaagaaagaaagactgggccaatgcagatttcaaaccggagaaagtcatactgtcagtgaaggccgcctgtggccggaaggcgccaggggattagcaccctggactcagtgttgctgggaaacagggccccaaggctgggagcacagtgtttaaagggcatctacccaagaagggagcacagggcaaggaggagctgcaggggggcttggctgccaaagtgaattctgaggagagagctattgctgcctacgatatgcaggctgcacagaacacaagtggaatcagcaggcaggagaggcagctaacgacgcagcccgtttcttatttctgttttctcacaagcgatgaaagtggaaaagagggtgagcaggtggcccacacatgtgcctccagtgctgcggcccctccggggaccatcagccaggccccggggagggagccagccacagtgtgtccggctcttctctgaagggaagagagccttgaatagactgaagcgaagacggttctgcaaggacaaggcagaccgaaggcattggttttttttttcagataaggagaattagactcccaagtagacaccagagtcactgtttggttggtgggtgatagtggggtcacagtggctgcctgtgctcccccagggtgagcgtgactgtgctaacctgggtggggcagcatgcacacccctctggcagccctttgttgctcgctgatgacaagtttggatgatcccgccaaacagcttgctaagatgtagtccccagtgttggaggtggggcctgatgggaggtgctacccttgtgagataaggttgtgtaaaagcctgtggcacctccccacactgacgctctcacccctgctctggccatgtgccgcgcctgctcccacttccccttctgccaggagtaaaagcccccgagacctcccagaagccaagcagatgctagtgccatgcttcctctgcagcctgcagaactgtgagccaattaaacctcttttctctataaa

SEQ ID NO: 512 - DNA, 1861 bp, Homo sapiens
ctgcgggtgacaggcaggcgggaaggggcggggcctcgggcggggccgccgtggggaggagggcggtgggaggggaggagtggagatggcggcggcggcggctcaggggggcgggggcggggagccccgtagaaccgagggggtcggcccgggggtcccgggggaggtggagatggtgaaggggcagccgttcgacgtgggcccgcgctacacgcagttgcagtacatcggcgagggcgcgtacggcatggtcagctcggcctatgaccacgtgcgcaagactcgcgtggccatcaagaagatcagccccttcgaacatcagacctactgccagcgcacgctccgggagatccagatcctgctgcgcttccgccatgagaatgtcatcggcatccgagacattctgcgggcgtccaccctggaagccatgagagatgtctacattgtgcaggacctgatggagactgacctgtacaagttgctgaaaagccagcagctgagcaatgaccatatctgctacttcctctaccagatcctgcggggcctcaagtacatccactccgccaacgtgctccaccgagatctaaagccctccaacctgctcatcaacaccacctgcgaccttaagatttgtgatttcggcctggcccggattgccgatcctgagcatgaccacaccggcttcctgacggagtatgtggctacgcgctggtaccgggccccagagatcatgctgaactccaagggctataccaagtccatcgacatctggtctgtgggctgcattctggctgagatgctctctaaccggcccatcttccctggcaagcactacctggatcagctcaaccacattctgggcatcctgggctccccatcccaggaggacctgaattgtatcatcaacatgaaggcccgaaactacctacagtctctgccctccaagaccaaggtggcttgggccaagcttttccccaagtcagactccaaagcccttgacctgctggaccggatgttaacctttaaccccaataaacggatcacagtggaggaagcgctggctcacccctacctggagcagtactatgacccgacggatgagccagtggccgaggagcccttcaccttcgccatggagctggatgacctacctaaggagcggctgaaggagctcatcttccaggagacagcacgcttccagcccggagtgctggaggccccctagcccagacagacatctctgcaccctggggcctggacctgcctcctgcctgcccctctcccgccagactgttagaaaatggacactgtgcccagcccggaccttggcagcccaggccggggtggagcatgggcctggccacctctctcctttgctgaggcctccagcttcaggcaggccaaggccttctcctccccacccgccctccccacggggcctcgggacctcaggtggccccagttcaatctcccgctgctgctgctgcgcccttaccttccccagcgtcccagtctctggcagttctggaatggaagggttctggctgccccaacctgctgaagggcagaggtggagggtggggggcgctgagtagggactcagggccatgcctgcccccctcatctcattcaaaccccaccctagtttccctgaaggaacattccttagtctcaagggctagcatccctgaggagccaggccgggccgaatcccctccctgtcaaagctgtcacttcgcgtgccctcgctgcttctgtgtgtggtgagcagaagtggagctggggggcgtggagagcccggcgcccctgccacctccctgacccgtctaatatataaatatagagatgtgtctatggctga

SEQ ID NO: 513 - DNA, 1743 bp, Homo sapiens
ctggcgcgcgcggccctgcgggtgacaggcaggcgggaaggggcggggcctcgggcggggccgccgtggggaggagggcggtgggaggggaggagtggagatggcggcggcggcggctcaggggggcgggggcggggagccccgtagaaccgagggggtcggcccgggggtcccgggggaggtggagatggtgaaggggcagccgttcgacgtgggcccgcgctacacgcagttgcagtacatcggcgagggcgcgtacggcatggtcagctcggcctatgaccacgtgcgcaagactcgcgtggccatcaagaagatcagccccttcgaacatcagacctactgccagcgcacgctccgggagatccagatcctgctgcgcttccgccatgagaatgtcatcggcatccgagacattctgcgggcgtccaccctggaagccatgagagatgtctacattgtgcaggacctgatggagactgacctgtacaagttgctgaaaagccagcagctgagcaatgaccatatctgctacttcctctaccagatcctgcggggcctcaagtacatccactccgccaacgtgctccaccgagatctaaagccctccaacctgctcatcaacaccacctgcgaccttaagatttgtgatttcggcctggcccggattgccgatcctgagcatgaccacaccggcttcctgacggagtatgtggctacgcgctggtaccgggccccagagatcatgctgaactccaagggctataccaagtccatcgacatctggtctgtgggctgcattctggctgagatgctctctaaccggcccatcttccctggcaagcactacctggatcagctcaaccacattctggcccttgacctgctggaccggatgttaacctttaaccccaataaacggatcacagtggaggaagcgctggctcacccctacctggagcagtactatgacccgacggatgagccagtggccgaggagcccttcaccttcgccatggagctggatgacctacctaaggagcggctgaaggagctcatcttccaggagacagcacgcttccagcccggagtgctggaggccccctagcccagacagacatctctgcaccctggggcctggacctgcctcctgcctgcccctctcccgccagactgttagaaaatggacactgtgcccagcccggaccttggcagcccaggccggggtggagcatgggcctggccacctctctcctttgctgaggcctccagcttcaggcaggccaaggccttctcctccccacccgccctccccacggggcctcgggacctcaggtggccccagttcaatctcccgctgctgctgctgcgcccttaccttccccagcgtcccagtctctggcagttctggaatggaagggttctggctgccccaacctgctgaagggcagaggtggagggtggggggcgctgagtagggactcagggccatgcctgcccccctcatctcattcaaaccccaccctagtttccctgaaggaacattccttagtctcaagggctagcatccctgaggagccaggccgggccgaatcccctccctgtcaaagctgtcacttcgcgtgccctcgctgcttctgtgtgtggtgagcagaagtggagctggggggcgtggagagcccggcgcccctgccacctccctgacccgtctaatatataaatatagagatgtgtctatggctg

SEQ ID NO: 514 - DNA, 997 bp, Homo sapiens
cggcccgggggtcccgggggaggtggagatggtgaaggggcagccgttcgacgtgggcccgcgctacacgcagttgcagtacatcggcgagggcgcgtacggcatggtcagctcggcctatgaccacgtgcgcaagactcgcgtggccatcaagaagatcagccccttcgaacatcagacctactgccagcgcacgctccgggagatccagatcctgctgcgcttccgccatgagaatgtcatcggcatccgagacattctgcgggcgtccaccctggaagccatgagagatgtctacattgtgcaggacctgatggagactgacctgtacaagttgctgaaaagccagcagctgagcaatgaccatatctgctacttcctctaccagatcctgcggggcctcaagtacatccactccgccaacgtgctccaccgagatctaaagccctccaacctgctcatcaacaccacctgcgaccttaagggctataccaagtccatcgacatctggtctgtgggctgcattctggctgagatgctctctaaccggcccatcttccctggcaagcactacctggatcagctcaaccacattctgggcatcctgggctccccatcccaggaggacctgaattgtatcatcaacatgaaggcccgaaactacctacagtctctgccctccaagaccaaggtggcttgggccaagcttttccccaagtcagactccaaagcccttgacctgctggaccggatgttaacctttaaccccaataaacggatcacagtggaggaagcgctggctcacccctacctggagcagtactatgacccgacggatgagccagtggccgaggagcccttcaccttcgccatggagctggatgacctacctaaggagcggctgaaggagctcatcttccaggagacagcacgcttccagcccggagtgctggaggccccctagcccagacagacatctctgcaccctggggcctgg

SEQ ID NO: 515 - DNA, 1008 bp, Homo sapiens
atggcggcggcggcggctcaggggggcgggggcggggagccccgtagaaccgagggggtcggcccgggggtcccgggggaggtggagatggtgaaggggcagccgttcgacgtgggcccgcgctacacgcagttgcagtacatcggcgagggcgcgtacggcatggtcagctcggcctatgaccacgtgcgcaagactcgcgtggccatcaagaagatcagccccttcgaacatcagacctactgccagcgcacgctccgggagatccagatcctgctgcgcttccgccatgagaatgtcatcggcatccgagacattctgcgggcgtccaccctggaagccatgagagatgtctacattgtgcaggacctgatggagactgacctgtacaagttgctgaaaagccagcagctgagcaatgaccatatctgctacttcctctaccagatcctgcggggcctcaagtacatccactccgccaacgtgctccaccgagatctaaagccctccaacctgctcatcaacaccacctgcgaccttaagatttgtgatttcggcctggcccggattgccgatcctgagcatgaccacaccggcttcctgacggagtatgtggctacgcgctggtaccgggccccagagatcatgctgaactccaagggctataccaagtccatcgacatctggtctgtgggctgcattctggctgagatgctctctaaccggcccatcttccctggcaagcactacctggatcagctcaaccacattctggcccttgacctgctggaccggatgttaacctttaaccccaataaacggatcacagtggaggaagcgctggctcacccctacctggagcagtactatgacccgacggatgagccagtggccgaggagcccttcaccttcgccatggagctggatgacctacctaaggagcggctgaaggagctcatcttccaggagacagcacgcttccagcccggagtgctggaggccccctag

SEQ ID NO: 516 - DNA, 1487 bp, Homo sapiens
gcccctccctccgcccgcccgccggcccgcccgtcagtctggcaggcaggcaggcaatcggtccgagtggctgtcggctcttcagctctcccgctcggcgtcttccttcctcctcccggtcagcgtcggcggctgcaccggcggcggcgcagtccctgcgggaggggcgacaagagctgagcggcggccgccgagcgtcgagctcagcgcggcggaggcggcggcggcccggcagccaacatggcggcggcggcggcggcgggcgcgggcccggagatggtccgcgggcaggtgttcgacgtggggccgcgctacaccaacctctcgtacatcggcgagggcgcctacggcatggtgtgctctgcttatgataatgtcaacaaagttcgagtagctatcaagaaaatcagcccctttgagcaccagacctactgccagagaaccctgagggagataaaaatcttactgcgcttcagacatgagaacatcattggaatcaatgacattattcgagcaccaaccatcgagcaaatgaaagatgtatatatagtacaggacctcatggaaacagatctttacaagctcttgaagacacaacacctcagcaatgaccatatctgctattttctctaccagatcctcagagggttaaaatatatccattcagctaacgttctgcaccgtgacctcaagccttccaacctgctgctcaacaccacctgtgatctcaagatctgtgactttggcctggcccgtgttgcagatccagaccatgatcacacagggttcctgacagaatatgtggccacacgttggtacagggctccagaaattatgttgaattccaagggctacaccaagtccattgatatttggtctgtaggctgcattctggcagaaatgctttctaacaggcccatctttccagggaagcattatcttgaccagctgaaccacattttgggtattcttggatccccatcacaagaagacctgaattgtataataaatttaaaagctaggaactatttgctttctcttccacacaaaaataaggtgccatggaacaggctgttcccaaatgctgactccaaagctctggacttattggacaaaatgttgacattcaacccacacaagaggattgaagtagaacaggctctggcccacccatatctggagcagtattacgacccgagtgacgagcccatcgccgaagcaccattcaagttcgacatggaattggatgacttgcctaaggaaaagctcaaagaactaatttttgaagagactgctagattccagccaggatacagatcttaaatttgtcaggtacctggagtttaatacagtgagctctagcaagggaggcgctgccttttgtttctagaatattatgttcctcaaggtccattattttgtattcttttccaagctccttattggaaggtatttttttaaatttagaattaaaaattatttagaaa

SEQ ID NO: 517 - DNA, 1978 bp, Homo sapiens
ctggcgcgcgcggccctgcgggtgacaggcaggcgggaaggggcggggcctcgggcggggccgccgtggggaggagggcggtgggaggggaggagtggagatggcggcggcggcggctcaggggggcgggggcggggagccccgtagaaccgagggggtcggcccgggggtcccgggggaggtggagatggtgaaggggcagccgttcgacgtgggcccgcgctacacgcagttgcagtacatcggcgagggcgcgtacggcatggtcagctcggcctatgaccacgtgcgcaagactcgcgtggccatcaagaagatcagccccttcgaacatcagacctactgccagcgcacgctccgggagatccagatcctgctgcgcttccgccatgagaatgtcatcggcatccgagacattctgcgggcgtccaccctggaagccatgagagatgtctacattgtgcaggacctgatggagactgacctgtacaagttgctgaaaagccagcagctgagcaatgaccatatctgctacttcctctaccagatcctgcggggcctcaagtacatccactccgccaacgtgctccaccgagatctaaagccctccaacctgctcatcaacaccacctgcgaccttaagatttgtgatttcggcctggcccggattgccgatcctgagcatgaccacaccggcttcctgacggagtatgtggctacgcgctggtaccgggccccagagatcatgctgaactccaagggctataccaagtccatcgacatctggtctgtgggctgcattctggctgagatgctctctaaccggcccatcttccctggcaagcactacctggatcagctcaaccacattctgggcatcctgggctccccatcccaggaggacctgaattgtatcatcaacatgaaggcccgaaactacctacagtctctgccctccaagaccaaggtggcttgggccaagcttttccccaagtcagactccaaagcccttgacctgctggaccggatgttaacctttaaccccaataaacggatcacagtggaggaagcgctggctcacccctacctggagcagtactatgacccgacggatgaggtgggccagtccccagcagcagtggggctgggggcaggggagcaggggggcacgtaggcatcccccatgccaggcctgagccttgctgtctctaccaccccagccagtggccgaggagcccttcaccttcgccatggagctggatgacctacctaaggagcggctgaaggagctcatcttccaggagacagcacgcttccagcccggagtgctggaggccccctagcccagacagacatctctgcaccctggggcctggacctgcctcctgcctgcccctctcccgccagactgttagaaaatggacactgtgcccagcccggaccttggcagcccaggccggggtggagcatgggcctggccacctctctcctttgctgaggcctccagcttcaggcaggccaaggccttctcctccccacccgccctccccacggggcctcgggacctcaggtggccccagttcaatctcccgctgctgctgctgcgcccttaccttccccagcgtcccagtctctggcagttctggaatggaagggttctggctgccccaacctgctgaagggcagaggtggagggtggggggcgctgagtagggactcagggccatgcctgcccccctcatctcattcaaaccccaccctagtttccctgaaggaacattccttagtctcaagggctagcatccctgaggagccaggccgggccgaatcccctccctgtcaaagctgtcacttcgcgtgccctcgctgcttctgtgtgtggtgagcagaagtggagctggggggcgtggagagcccggcgcccctgccacctccctgacccgtctaatatataaatatagagatgtgtctatggctg

SEQ ID NO: 518 - DNA, 1480 bp, Homo sapiens
gtcagtctggcaggcaggcaggcaatcggtccgagtggctgtcggctcttcagctctcccgctcggcgtcttccttcctcctcccggtcagcgtcggcggctgcaccggcggcggcgcagtccctgcgggaggggcgacaagagctgagcggcggccgccgagcgtcgagctcagcgcggcggaggcggcggcgggcgcgggcccggagatggtccgcgggcaggtgttcgacgtggggccgcgctacaccaacctctcgtacatcggcgagggcgcctacggcatggtgtgctctgcttatgataatgtcaacaaagttcgagtagctatcaagaaaatcagcccctttgagcaccagacctactgccagagaaccctgagggagataaaaatcttactgcgcttcagacatgagaacatcattggaatcaatgacattattcgagcaccaaccatcgagcaaatgaaagatgtatatatagtacaggacctcatggaaacagatctttacaagctcttgaagacacaacacctcagcaatgaccatatctgctattttctctaccagatcctcagagggttaaaatatatccattcagctaacgttctgcaccgtgacctcaagccttccaacctgctgctcaacaccacctgtgatctcaagatctgtgactttggcctggcccgtgttgcagatccagaccatgatcacacagggttcctgacagaatatgtggccacacgttggtacagggctccagaaattatgttgaattccaagggctacaccaagtccattgatatttggtctgtaggctgcattctggcagaaatgctttctaacaggcccatctttccagggaagcattatcttgaccagctgaaccacattttgggtattcttggatccccatcacaagaagacctgaattgtataataaatttaaaagctaggaactatttgctttctcttccacacaaaaataaggtgccatggaacaggctgttcccaaatgctgactccaaagctctggacttattggacaaaatgttgacattcaacccacacaagaggattgaagtagaacaggctctggcccacccatatctggagcagtattacgacccgagtgacgagcccatcgccgaagcaccattcaagttcgacatggaattggatgacttgcctaaggaaaagctcaaagaactaatttttgaagagactgctagattccagccaggatacagatcttaaatttgtcaggacaagggctcagaggactggacgtgctcagacatcggtgttcttcttcccagttcttgacccctggtcctgtctccagcccgtcttggcttatccactttgactcctttgagccgtttggaggggcggtttctggtagttgtggcttttatgctttcaaagaatttcttcagtccagagaattcctcctggcagccctgtgtgtgtcacccatt

SEQ ID NO: 519 - DNA, 2567 bp, Homo sapiens
gagcgctttccgggacgtggagacgcggagcgtcccgaggaggcaggagactcgggatgatcgggagcgtcccagggagggggcccctgagtgctttctgggggagggggcgctgcctacgtcctcaggggagcaggcttggaggctttgagtccacccttctgtaatgatgggaggggcatccgagtgcatgtgggggcccgcggggaccctagtgacacggggcgaggcccagaggatgagtactctcggggaggcgacatccttagtgaagaggcagtggagggcccgttttgggggaaagggtgtcttggattccccctgtgaggcagtgccagggagcctgggggagaagagccgagatcagggtggggcagggctttggccccaccaccccaggggcccagagagagatgaggcggccaggagtgccacctgcatgttttgggaggggtctgtgagtgcccccggccccaccgtgtgctctgggcctctatccctctgggacagccccgctgcccggatccctcaccctgggaccctcccctgccctgtccattctctcctgcccctcccctggctgccaccttcccagtatttgccccatggtgtgtccccagcatctgcacccccggacctgtcttgggttaaggagcctttcctgggaatgggggcgaagggttcagggccagtagaatggaaggggattgaggagaggggaagtcagtgagcggtcagtctcttcctctgtttgtaaagtcaccgaagggccgcctggctggtccccagctttctctctggagatcccaggcctccacagcaggaaggaaccagcattgtttatgatttgaccagagccagctcctgctctctcccctccctgccaaggcctgggtggggccaccaggcccggactccccctttgtaaggccacagcagcagcctctctccggtcccctcagctcggcctatgaccacgtgcgcaagactcgcgtggccatcaagaagatcagccccttcgaacatcagacctactgccagcgcacgctccgggagatccagatcctgctgcgcttccgccatgagaatgtcatcggcatccgagacattctgcgggcgtccaccctggaagccatgagagatgtctacattgtgcaggacctgatggagactgacctgtacaagttgctgaaaagccagcagctgagcaatgaccatatctgctacttcctctaccagatcctgcggggcctcaagtacatccactccgccaacgtgctccaccgagatctaaagccctccaacctgctcatcaacaccacctgcgaccttaagatttgtgatttcggcctggcccggattgccgatcctgagcatgaccacaccggcttcctgacggagtatgtggctacgcgctggtaccgggccccagagatcatgctgaactccaagggctataccaagtccatcgacatctggtctgtgggctgcattctggctgagatgctctctaaccggcccatcttccctggcaagcactacctggatcagctcaaccacattctgggcatcctgggctccccatcccaggaggacctgaattgtatcatcaacatgaaggcccgaaactacctacagtctctgccctccaagaccaaggtggcttgggccaagcttttccccaagtcagactccaaagcccttgacctgctggaccggatgttaacctttaaccccaataaacggatcacagtggaggaagcgctggctcacccctacctggagcagtactatgacccgacggatgagccagtggccgaggagcccttcaccttcgccatggagctggatgacctacctaaggagcggctgaaggagctcatcttccaggagacagcacgcttccagcccggagtgctggaggccccctagcccagacagacatctctgcaccctggggcctggacctgcctcctgcctgcccctctcccgccagactgttagaaaatggacactgtgcccagcccggaccttggcagcccaggccggggtggagcatgggcctggccacctctctcctttgctgaggcctccagcttcaggcaggccaaggccttctcctccccacccgccctccccacggggcctcgggacctcaggtggccccagttcaatctcccgctgctgctgctgcgcccttaccttccccagcgtcccagtctctggcagttctggaatggaagggttctggctgccccaacctgctgaagggcagaggtggagggtggggggcgctgagtagggactcagggccatgcctgcccccctcatctcattcaaaccccaccctagtttccctgaaggaacattccttagtctcaagggctagcatccctgaggagccaggccgggccgaatcccctccctgtcaaagctgtcacttcgcgtgccctcgctgcttctgtgtgtggtgagcagaagtggagctggggggcgtggagagcccggcgcccctgccacctccctgacccgtctaatatataaatatagagatgtgtctatggctg

SEQ ID NO: 520 - DNA, 951 bp, Homo sapiens
atggcggcggcggcggcggcgggcgcgggcccggagatggtccgcgggcaggtgttcgacgtggggccgcgctacaccaacctctcgtacatcggcgagggcgcctacggcatggtgtgctctgcttatgataatgtcaacaaagttcgagtagctatcaagaaaatcagcccctttgagcaccagacctactgccagagaaccctgagggagataaaaatcttactgcgcttcagacatgagaacatcattggaatcaatgacattattcgagcaccaaccatcgagcaaatgaaagatgtatatatagtacaggacctcatggaaacagatctttacaagctcttgaagacacaacacctcagcaatgaccatatctgctattttctctaccagatcctcagagggttaaaatatatccattcagctaacgttctgcaccgtgacctcaagccttccaacctgctgctcaacaccacctgtgatctcaagatctgtgactttggcctggcccgtgttgcagatccagaccatgatcacacagggttcctgacagaatatgtggccacacgttggtacagggctccagaaattatgttgaattccaagggctacaccaagtccattgatatttggtctgtaggctgcattctggcagaaatgctttctaacaggcccatctttccagggaagcattatcttgaccagctgaaccacattttggctctggacttattggacaaaatgttgacattcaacccacacaagaggattgaagtagaacaggctctggcccacccatatctggagcagtattacgacccgagtgacgagcccatcgccgaagcaccattcaagttcgacatggaattggatgacttgcctaaggaaaagctcaaagaactaatttttgaagagactgctagattccagccaggatacagatcttaa

SEQ ID NO: 521 - DNA, 1841 bp, Homo sapiens
gacgatacgccgggcgcaggcgcagaagccgcgcccgtccgcggcgccgccagccagggcggaaacggctgcggcttcgctagggacgcatgcgcgggtcccttagttttcgcgagataacggtcgaaaacgcgctcttgtcgatttcctgtagtgaatcaggcaccggagtgcaggttcgggggtggaatccttgggccgctgggcaagcggcgagacctggccagggccagcgagccgaggacagagggcgcacggagggccgggccgcagccccggccgcttgcagaccccgccatggacccgttcctggtgctgctgcactcggtgtcgtccagcctgtcgagcagcgagctgaccgagctcaagttcctatgcctcgggcgcgtgggcaagcgcaagctggagcgcgtgcagagcggcctagacctcttctccatgctgctggagcagaacgacctggagcccgggcacaccgagctcctgcgcgagctgctcgcctccctgcggcgccacgacctgctgcggcgcgtcgacgacttcgaggcgggggcggcggccggggccgcgcctggggaagaagacctgtgtgcagcatttaacgtcatatgtgataatgtggggaaagattggagaaggctggctcgtcagctcaaagtctcagacaccaagatcgacagcatcgaggacagatacccccgcaacctgacagagcgtgtgcgggagtcactgagaatctggaagaacacagagaaggagaacgcaacagtggcccacctggtgggggctctcaggtcctgccagatgaacctggtggctgacctggtacaagaggttcagcaggcccgtgacctccagaacaggagtggggccatgtccccgatgtcatggaactcagacgcatctacctccgaagcgtcctgatgggccgctgctttgcgctggtggaccacaggcatctacacagcctggactttggttctctccaggaaggtagcccagcactgtgaagacccagcaggaagccaggctgagtgagccacagaccacctgcttctgaactcaagctgcgtttattaatgcctctcccgcaccaggccgggcttgggccctgcacagatatttccatttcttcctcactatgacactgagcaagatcttgtctccactaaatgagctcctgcgggagtagttggaaagttggaaccgtgtccagcacagaaggaatctgtgcagatgagcagtcacactgttactccacagcggaggagaccagctcagaggcccaggaatcggagcgaagcagagaggtggagaactgggatttgaacccccgccatccttcaccagagcccatgctcaaccactgtggcgttctgctgcccctgcagttggcagaaaggatgttttgtcccatttccttggaggccaccgggacagacctggacactagggtcaggcggggtgctgtggtggggagaggcatggctggggtgggggtggggagacctggttggccgtggtccagctcttggcccctgtgtgagttgagtctcctctctgagactgctaagtaggggcagtgatggttgccaggacgaattgagataatatctgtgaggtgctgatgagtgattgacacacagcactctctaaatcttccttgtgaggattatgggtcctgcaattctacagtttcttactgttttgtatcaaaatcactatctttctgataacagaattgccaaggcagcgggatctcgtatctttaaaaagcagtcctcttattcctaaggtaatcctattaaaacacagctttacaacttccatactacaaaaaa

SEQ ID NO: 522 - DNA, 6719 bp, Homo sapiens
gttgtcgtaggggcccggtccgtgagggactgctaaggaagaggctgcatggcgcggtagtcccccgagtggaggtcggctgcccctgggaaaccagagagtcggagggagtccatctggagcggccaagtaggtcggggaagggccgcgcctgacgtctggccgcaggtggtgactctcaaaaggaaataggatcatggcagcagatgatgacaatggtgatggaacaagtttatttgatgtcttttctgcttctcctcttaagaacaatgatgaaggctcactggacatatacgctgggttggacagtgctgtttctgacagcgcttccaaatcctgtgtaccatcaagaaattgtttggacttatatgaagagatcctgactgaagaaggaactgcaaaggaggcaacatataatgatttgcaagtagaatatggaaaatgtcaactacaaatgaaagagctgatgaaaaaatttaaagaaatacagacacagaatttcagcttaataaacgaaaaccagtctcttaagaagaatatttcagcacttatcaaaactgccagagtggaaataaaccgcaaggatgaagaaataagtaatcttcaccaaagattgtctgagtttccacattttcgaaataatcataaaactgcaaggacatttgatacagttaaaacaaaagatcttaaatctagatctccacatttggatgattgttcaaagactgatcacagagctaaaagtgatgtttctaaagatgtacatcatagcacttcactgccaaatctggaaaaggaaggaaaaccacattctgataaaaggagtacttcacatttacctacatctgttgagaaacactgcactaatggtgtttggtcacgttctcattatcaggttggcgagggtagctcaaatgaggatagtagaagaggaagaaaagatattagacatagccagtttaacagaggaactgaaagagtacgaaaagacttaagtactggctgtggtgatggtgaaccaaggatattggaggctagtcaaaggctacaaggacatcctgagaaatatggtaaaggtgaaccaaagactgaaagcaaaagttcgaagtttaaaagtaactcagattctgactataaaggtgaacgcattaactcttcttgggagaaagagacccctggagaaaggtcacacagtcgagtagactctcaaagtgacaaaaaactagaaagacaaagtgaaagatcacaaaatataaataggaaagaagttaaatcacaagacaaagaagaaagaaaagttgatcaaaaacctaaatcagtagtaaaggaccaagatcactggagaagatctgaacgagcatcacttcctcattccaagaatgaaataacattttctcataattcaagtaaataccatctagaagagagaagaggatgggaagattgtaaaagagacaagagtgtaaacagtcatagttttcaagatggaagatgtccatcttctctttcaaacagtagaactcacaaaaacattgactctaaggaagttgatgccatgcatcagtgggaaaatacacctttaaaagcagaaagacatagaactgaagataagaggaaaagagaacaagaaagcaaagaagaaaataggcatattagaaatgaaaaaagagtacctacagaacatttgcagaagactaataaggaaactaagaaaaccactactgatttaaagaaacagaatgaaccaaagactgataagggagaagtccttgataatggtgtttctgaaggagcagataataaagagcttgcaatgaaagctgagagtggtccaaatgaaacaaaaaacaaggacctaaaattgagttttatgaaaaaattgaacttaactctttctcctgctaaaaagcaacctgtttcccaggataatcagcataaaataactgatattcccaagtccagtggtgtatgtgattcagagtcttcaatgcaagttaaaacagtggcatatgttccctccataagtgaacatatcttgggggaagcagctgtcagtgaacataccatgggggaaaccaagtcaacgttattggaaccaaaggttgctcttctagcagtgactgaacccaggatcggtatctcagaaaccaacaaggaagacgaaaatagtttgttagttaggtctgttgacaatactatgcattgtgaagagcccatttgtggtacagagacttccttcccatctcctatggaaatacaacagacagaatccttgtttccatcaacaggaatgaaacaaaccattaataatggaagggcagcagctcctgtggtaatggatgtattacaaacagatgtgtctcaaaactttggcttggaattggataccaaaagaaatgataattcagattattgtggtatttctgaaggtatggagatgaaggtggcactttcaacaacagtgagtgaaaccactgaaagcattttgcagccttcaattgaggaagctgatattttgccaataatgctttcagaagataataacccaaaatttgagccttctgttatagttacaccactggttgagagtaagtcgtgtcatctggagccttgcttacctaaagagactctagattcttcacttcagcagactgagttaatggaccacagaatggcaactggtgaaacaaactcagtatatcatgatgatgataactcggttttgagcattgaccttaatcacctgagacctattccagaagccatcagtcctctgaatagtccagtgagacctgtagcaaaagttcttagaaatgaaagcccacctcaagttccagtgtataataacagtcataaagatgtgtttttaccaaattcagctcattctacctctaagagtcagtctgatctcaataaggaaaatcaaaagccaatttacaaatctgacaaatgtacagaagcagacacatgtaagaattcaccattagatgaattagaagaaggagaaattagaagtgatagtgaaacatctaaaccacaagaaagttttgaaaaaaattccaaacgtagagtgtcagctgatgtgcggaagtcaaagactatcccacgacgtgggaaaagtactgtgtgtttagataaagacagtaggaaaacacatgtaagaatccatcagaccaataacaaatggaataaaagacctgataaatctagcagatcttcaaaaacagagaagaaagataaagtgatgagcacttccagcttggaaaaaatagttccaattattgctgtaccctcttctgaacaagagatcatgcacatgttacgaatgataagaaaacatgtaagaaaaaattatatgaaattcaaggcaaaattttcattaatacaatttcacagaattattgagtcagcaattttgagttttacatctttaattaaacatctcaacttacacaaaatctctaagtcagtgactaccttacagaagaatctctgtgatattatagagtctaaacttaagcaagttaaaaagaatggcatagttgatcgtttatttgaacagcaactaccagatatgaaaaaaaaattgtggaagtttgtagatgaccaacttgattatttgtttgcaaagcttaagaaaatcttagtatgtgattccaaaagctttggaagagatagtgatgaaggcaaacttgaaaaaacaagtaaacagaatgcacagtattcaaatagtcagaaaaggagtgtggacaactccaacagagaattgctgaaagaaaaattatcaaaatcagaagaccctgttcattataagtctttagtgggatgtaaaaaatctgaggaaaattatcaagaccaaaataactccagtattaacactgtaaagcatgacattaaaaaaaattttaacatctgctttgataatataaagaactctcaatccgaagagcgctccttggaagtacactgtccaagcaccccaaagtcagaaaaaaacgaaggaagcagcatagaggatgcacagacatcccagcatgcaactttgaagccagaacgaagtttcgagattcttaccgaacagcaagcatcgagccttacttttaatttagtgagtgatgcacaaatgggtgaaatatttaaaagtttgttgcaaggttctgatcttttagacagcagtgttaactgtactgaaaaaagtgagtgggagttaaagactccagagaagcagctgctagagactcttaagtgcgagtctataccagcttgtacaacagaagagctagtttcaggggtggcttctccatgtcctaaaatgattagtgatgataattggtcattattatcatctgaaaaaggtccatctctgtcttcagggctttcattgccggttcatcctgatgtgttggatgaaagttgtatgtttgaagtgtctactaacctacctttaagtaaagataatgtgtgtagtgtagaaaagagcaagccctgcgtttcttccatacttcttgaagatctagcagtctctttaacagtaccatcgcctctgaagtcagatggtcatctcagttttttaaagcctgatatgtcgtccagttcaactcctgaagaagtcattagtgctcattttagtgaagatgccttacttgaggaagaggatgcatctgagcaagatattcatttagctctggagtctgataattcaagcagtaaatcaagttgttcttcttcctggacaagccgatctgttgctccaggctttcagtaccaccctaatctacctatgcatgccgtcataatggaaaagtccaatgatcatttcattgtgaaaatacgacgtgcaacaccatctacctcttctggccttaaacagagtatgatgcctgatgaattattgacatctttgcccagacatggaaaggaagctgatgaaggaccagagaaagaatatatttcatgtcagaacacagtttttaaatctgtggaggaattggaaaactccaacaaaaatgttgatggcagcaagtcaactcatgaagaacagagctctatgatacaaacacaggttcctgatatatatgaatttcttaaagatgcttcagataagatgggtcatagtgatgaagtggctgatgaatgtttcaaattgcatcaagtatgggaaacaaaagtgcctgaaagcattgaagaattgccttcaatggaagaaatctcacactctgttggggaacatcttccaaacacatacgtagatctaacgaaagatccagtcactgaaaccaaaaacttgggggaattcatagaagtaacagttttacatattgatcagttgggatgttctggaggcaatttaaatcagagtgctcaaatattagacaattctttgcaggctgatactgtaggtgcttttattgatttgacacaagatgcttcaagtgaggctaaaagtgaaggtaatcatcctgcattagctgtggaagacttgggatgtggggtgatacaggtagatgaagataattgtaaggaagaaaaggcacaagtggcaaacaggcctttaaaatgcattgttgaggaaacctatatcgacttgaccacagaatctcccagttcatgtgaagtaaaaaaagatgagttaaaatcagagccaggatcaaattgtgataactcggagttgcctgggactttgcataattctcacaaaaagagaagaaacatttctgatctaaatcatcctcataaaaaacaaagaaaggaaacagacttaactaataaggaaaagaccaagaaacctacccaagattcttgtgagaatactgaagctcaccaaaagaaagccagtaagaagaaggcccctcctgtgactaaagatccctcatcattaaaggcaaccccagggattaaggattcatcagcagcacttgccacttctacaagtctttctgcaaaaaatgttattaaaaagaagggagaaattatcattttatggacaagaaatgatgaccgggaaattttattggagtgtcagaaaagagggccatcatttaaaacatttgcatatttagccgccaagttggataaaaatccaaatcagataagttgctgaattcctgggactcttaactgatattgcatactacacagaagcttcaaattcctcatgttttaaatgagcactagagggaggtttatcacctttttggttaccagatgataatctatatttgttattactcagtgactctctaatttcacatcagcatgttcagcttgtgctagtcatcattctgatttgcttatctgtttttggtcaaaatatttatttttaaacatgttagaacttaccaaaatgaaagcaacagtgatgtattgaaatcttagttttgatattttaaagaaatgactttctagattaaaaaaatagttttgtagcattttaaacttagtgactatttagttcaattgttcatccattttttatttgcttttataattgcctccttgttttggtatattgtaaaataatttaaataatgtatttataaatatgtataattatgatgtaaaataccgtgtgtatatgtatgtatgtgtgtttctgtatatgcacacacataaacggctttgcctagccaaggattttttttatctgtataaaactttttgtataaagtttgctttcaataacagtaatgtataataaaaccatgtaaagttttgttgta

SEQ ID NO: 523 - DNA, 1280 bp, Homo sapiens
aaaggaaccgggttgtcttgggccgggcagggcgggtaagttgtcgtaggggcccggtccgtgagggactgctaaggaagaggctgcatggcgcggtagtcccccgagtggaggtcggctgcccctgggaaaccagagagtcggagggagtccatctggagcggccaagtggtgactctcaaaaggaaataggatcatggcagcagatgatgacaatggtgatggaacaagtttatttgatgtcttttctgcttctcctcttaagaacaatgatgaaggctcactggacatatacgctgggttggacagtgctgtttctgacagcgcttccaaatcctgtgtaccatcaagaaattgtttggacttatatgaagagatcctgactgaagaaggaactgcaaaggaggcaacatataatgatttgcaagtagaatatggaaaatgtcaactacaaatgaaagagctgatgaaaaaatttaaagaaatacagacacagaatttcagcttaataaacgaaaaccagtctcttaagaagaatatttcagcacttatcaaaactgccagagtggaaataaaccgcaaggatgaagaaataagtaatcttcaccaaagattgtctgagtttccacattttcgaaataatcataaaactgcaaggacatttgatacagttaaaacaaaagatcttaaatctagatctccacatttggatgattgttcaaagactgatcacagagctaaaagtgatgtttctaaagatgtacatcatagcacttcactgccaaatctggaaaaggaaggaaaaccacattctgataaaaggagtacttcacatttacctacatctgttgagaaacactgcactaatggtgtttggtcacgttctcattatcaggttggcgagggtagctcaaatgaggatagtagaagaggaagaaaagatattagacatagccagtttaacagaggaactgaaagagtacgaaaagacttaagtactggctgtggtgatggtgaaccaaggatattggaggctagtcaaaggctacaaggacatcctgagaaatatggtaaaggtgaaccaaagactgaaagcaaaagttcgaagtttaaaagtaactcagattctgactataaaggtgaacgcattaactcttcttgggagaaagagacccctggagaaaggtcacacagtcgagtagactctcaaagtgacaaaaaactagaaagacaaagtgaaagatcacaaaatataaataggaaagaagttaaatcacaag

SEQ ID NO: 524 - DNA, 3385 bp, Homo sapiens
gcgggtaagttgtcgtaggggcccggtccgtgagggactgctaaggaagaggctgcatggcgcggtagtcccccgagtggaggtcggctgcccctgggaaaccagagagtcggagggagtccatctggagcggccaagtaggtcggggaagggccgcgcctgacgtctggccgcaggtagccacgttccctccgcccccggtgcagcttcagggcttgcaccctgcgtccctctgtggtccttcgagagggtctgggcggggactatgggtgggcgcgcccaggaattgtcccttcggcctctcgtcctgcccctcccccccaccatccagtctctccttggaatatactcttaaaatctttcggatggagttctttggagaaatgggtttcctggagtgtcaggtgatcattgatgttgattgtttctgaaatgtttatttaggcatcaaaccaacatgcctaaataagtttttcatttctacagcgcctagattcattcctagcacatagtaggccctaactcagatgtgaatgtaggattcgtaggagctgagcatttgtgcttcaggcatcaagttgtctttgactcttcgactcttccttggtctttttccattctccacacctccagcagcaaacctttcgcctctcctcaaggcctttcccccccatctccctcagcgcctctttgactggagggggacagaggctttcatggcagggattctcccatctcccttcctatccccgctatgccctccaattatcttttcctggcgttccgttttacaagagatggccttctttccaaaaacatttatattgtattgaatattcttgattttggccatcttgctttacagacagacctggggtctaatttcagctctgccacttaccaggtggttgccttgtgcaaatttcttgatcgtctgtgttttcctcatctgtaaaatggggaaaagaataatatggacctcatagaactctggggaggatttaaactaagtgaataatgtatttagatcatttaggttagtgcctggaacatagtaaatgtgccgtatatgatagcttttgttagtatttgccccttacctcttcttctggggtcttgctgtattagcctttcccatgagtgtaaaaatacactgtcttctctggctttttcctgtttttctctacaaatgcttgtgtttttctctaaattttattttttgtcttttagcgtctacattaaggacacattctcagtttcgtaatgatttttctttttcttttttcctttttttttgagactatagcccaggctggagtgcaatggcaagatctcggcttactacaggtttgacctcctgtgctcaagcaatcctcccacctcagccttccaagtagctggaactacaggtggtgactctcaaaaggaaataggatcatggcagcagatgatgacaatggtgatggaacaagtttatttgatgtcttttctgcttctcctcttaagaacaatgatgaaggctcactggacatatacgctgggttggacagtgctgtttctgacagcgcttccaaatcctgtgtaccatcaagaaattgtttggacttatatgaagagatcctgactgaagaaggaactgcaaaggaggcaacatataatgatttgcaagtagaatatggaaaatgtcaactacaaatgaaagagctgatgaaaaaatttaaagaaatacagacacagaatttcagcttaataaacgaaaaccagtctcttaagaagaatatttcagcacttatcaaaactgccagagtggaaataaaccgcaaggatgaagaaataagtaatcttcaccaaaggtattactgagcggtgtagctgttataaattacgtgggtattgatatgtggaatatttttaacttttagaggaaagatgaaaataatgtatttttattttttattttttaatttttttttttttttagagacagggtctcattttgtcactcaggctggtcttgaactcctgacctcaggtgagccacccaccttggcctcccaaagtgctgggatttcaggcgtgagccactgtgcccagacttttttttttttttggcagagtcttgctctgttgcccaggctggagtgcagtggtgtgatctcagctcattgcaacctttgcctgctgggttcaagcgatcctcccacctcagtctcccgagtagctgggattacaggcatgcaccacctgtaaaaaaaaatttaaaaaaaaaaaaagatttttttgtatttttagtagacggggtttcaccattttggccaggctggtctcaaactcctgatctcaagtgatctgcccgcctggccctccaaagtactgggattacaggtatgagccactgcacccagcttcaagggtgttccttttgtggttagtgcttttcgtgtttacatttccccaatgatctcaaaggtatctaccaacagttggtcggttgagtcagtatctatattagtttcctaggcttagtgtaacaaaactaccagaaatgggtggcctaaacaaccaaaatttgtctcacagtcctggaggctagaagtccaaaatgaaagtgtcagcaaagttagtttcttttgagagctctgaaggaaggatctgattcaggcctctgtactcttagatggttgtctacttcctatgtctctttatatcctctttctaaatgtatctctgtgtccaaatttccccctttttataagaacaccagtaatattgcatgcccaccttgaggacatcactttaacttgattatttctgtaaagaccctttaaataaggtcatattctgaagaacaatgggttagaacttcaaattatgaatttggtcaggagaggggacacaatccataacagggttcatatgaggcttacatattgttttaggttgtgtgtttttctaatcctctcttataacaatctgcctatatttctgagttttttaagttttgggtttttctacacatttgctactgattagaaaaagatatatgaaatttcagagaaattatggaatttctggaagatgaagttattaccagaagccaatataggccaggcacagtggctcacgcctgtaaccccagtactttgggaggcgaaggcaggagaattgcttgagtccaggagtttgagaccagcctgcgcagcatagtgagatcccatctctacgaaaaattaaaaattagctgggcatggtggcttgtacctgtagtcccagctacttggaaggttgaagtgagaggattgcttgagcctaggacatcaaggctgcagtgagccatgatcattccgctgtactcagcctgggtgaaagagggagaccctgtctc

SEQ ID NO: 525 - DNA, 2003 bp, Homo sapiens
gcgggtaagttgtcgtaggggcccggtccgtgagggactgctaaggaagaggctgcatggcgcggtagtcccccgagtggaggtcggctgcccctgggaaaccagagagtcggagggagtccatctggagcggccaagtaggtcggggaagggccgcgcctgacgtctggccgcaggtagccacgttccctccgcccccggtgcagcttcagggcttgcaccctgcgtccctctgtggtccttcgagagggtctgggcggggactatgggtgggcgcgcccaggaattgtcccttcggcctctcgtcctgcccctcccccccaccatccagtctctccttggaatatactcttaaaatctttcggatggagttctttggagaaatgggtttcctggagtgtcaggtgatcattgatgttgattgtttctgaaatgtttatttaggcatcaaaccaacatgcctaaataagtttttcatttctacagcgcctagattcattcctagcacatagtaggccctaactcagatgtgaatgtaggattcgtaggagctgagcatttgtgcttcaggcatcaagttgtctttgactcttcgactcttccttggtctttttccattctccacacctccagcagcaaacctttcgcctctcctcaaggcctttcccccccatctccctcagcgcctctttgactggagggggacagaggctttcatggcagggattctcccatctcccttcctatccccgctatgccctccaattatcttttcctggcgttccgttttacaagagatggccttctttccaaaaacatttatattgtattgaatattcttgattttggccatcttgctttacagacagacctggggtctaatttcagctctgccacttaccaggtggttgccttgtgcaaatttcttgatcgtctgtgttttcctcatctgtaaaatggggaaaagaataatatggacctcatagaactctggggaggatttaaactaagtgaataatgtatttagatcatttaggttagtgcctggaacatagtaaatgtgccgtatatgatagcttttgttagtatttgccccttacctcttcttctggggtcttgctgtattagcctttcccatgagtgtaaaaatacactgtcttctctggctttttcctgtttttctctacaaatgcttgtgtttttctctaaattttattttttgtcttttagcgtctacattaaggacacattctcagtttcgtaatgatttttctttttcttttttcctttttttttgagactatagcccaggctggagtgcaatggcaagatctcggcttactacaggtttgacctcctgtgctcaagcaatcctcccacctcagccttccaagtagctggaactacaggtggtgactctcaaaaggaaataggatcatggcagcagatgatgacaatggtgatggaacaagtttatttgatgtcttttctgcttctcctcttaagaacaatgatgaaggctcactggacatatacgctgggttggacagtgctgtttctgacagcgcttccaaatcctgtgtaccatcaagaaattgtttggacttatatgaagagatcctgactgaagaaggaactgcaaaggaggcaacatataatgatttgcaagtagaatatggaaaatgtcaactacaaatgaaagagctgatgaaaaaatttaaagaaatacagacacagaatttcagcttaataaacgaaaaccagtctcttaagaagaatatttcagcacttatcaaaactgccagagtggaaataaaccgcaaggatgaagaaataagtaatcttcaccaaaggtattactgagcggtgtagctgttataaattacgtgggtattgatatgtggaatatttttaacttttagaggaaagatgaaaataatgtatttttattttttattttttaatttttttttttttttagagacagggtctcattttgtcac

SEQ ID NO: 526 - DNA, 1300 bp, Homo sapiens
tgtcgtaggggcccggtccgtgagggactgctaaggaagaggctgcatggcgcggtagtcccccgagtggaggtcggctgcccctgggaaaccagagagtcggagggagtccatctggagcggccaagtggtgactctcaaaaggaaataggatcatggcagcagatgatgacaatggtgatggaacaagtttatttgatgtcttttctgcttctcctcttaagaacaatgatgaaggctcactggacatatacgctgggttggacagtgctgtttctgacagcgcttccaaatcctgtgtaccatcaagaaattgtttggacttatatgaagagatcctgactgaagaaggaactgcaaaggaggcaacatataatgatttgcaagtagaatatggaaaatgtcaactacaaatgaaagagctgatgaaaaaatttaaagaaatacagacacagaatttcagcttaataaacgaaaaccagtctcttaagaagaatatttcagcacttatcaaaactgccagagtggaaataaaccgcaaggatgaagaaataagtaatcttcaccaaagaaatgatgaccgggaaattttattggagtgtcagaaaagagggccatcatttaaaacatttgcatatttagccgccaagttggataaaaatccaaatcagataagttgctgaattcctgggactcttaactgatattgcatactacacagaagcttcaaattcctcatgttttaaatgagcactagagggaggtttatcacctttttggttaccagatgataatctatatttgttattactcagtgactctctaatttcacatcagcatgttcagcttgtgctagtcatcattctgatttgcttatctgtttttggtcaaaatatttatttttaaacatgttagaacttaccaaaatgaaagcaacagtgatgtattgaaatcttagttttgatattttaaagaaatgactttctagattaaaaaaatagttttgtagcattttaaacttagtgactatttagttcaattgttcatccattttttatttgcttttataattgcctccttgttttggtatattgtaaaataatttaaataatgtatttataaatatgtataattatgatgtaaaataccgtgtgtatatgtatgtatgtgtgtttctgtatatgcacacacataaacggctttgcctagccaaggattttttttatctgtataaaactttttgtataaagtttgctttcaataacagtaatgtataataaaaccatgtaaagttttgttg

SEQ ID NO: 527 - DNA, 7344 bp, Homo sapiens
gcgggtaagttgtcgtaggggcccggtccgtgagggactgctaaggaagaggctgcatggcgcggtagtcccccgagtggaggtcggctgcccctgggaaaccagagagtcggagggagtccatctggagcggccaagtaggtcggggaagggccgcgcctgacgtctggccgcaggtagccacgttccctccgcccccggtgcagcttcagggcttgcaccctgcgtccctctgtggtccttcgagagggtctgggcggggactatgggtgggcgcgcccaggaattgtcccttcggcctctcgtcctgcccctcccccccaccatccagtctctccttggaatatactcttaaaatctttcggatggagttctttggagaaatgggtttcctggagtgtcaggtgatcattgatgttgattgtttctgaaatgtttatttaggcatcaaaccaacatgcctaaataagtttttcatttctacagcgcctagattcattcctagcacatagtaggccctaactcagatgtgaatgtaggattcgtaggagctgagcatttgtgcttcaggcatcaagttgtctttgactcttcgactcttccttggtctttttccattctccacacctccagcagcaaacctttcgcctctcctcaaggcctttcccccccatctccctcagcgcctctttgactggagggggacagaggctttcatggcagggattctcccatctcccttcctatccccgctatgccctccaattatcttttcctggcgttccgttttacaagagatggccttctttccaaaaacatttatattgtattgaatattcttgattttggccatcttgctttacagacagacctggggtctaatttcagctctgccacttaccaggtggttgccttgtgcaaatttcttgatcgtctgtgttttcctcatctgtaaaatggggaaaagaataatatggacctcatagaactctggggaggatttaaactaagtgaataatgtatttagatcatttaggttagtgcctggaacatagtaaatgtgccgtatatgatagcttttgttagtatttgccccttacctcttcttctggggtcttgctgtattagcctttcccatgagtgtaaaaatacactgtcttctctggctttttcctgtttttctctacaaatgcttgtgtttttctctaaattttattttttgtcttttagcgtctacattaaggacacattctcagtttcgtaatgatttttctttttcttttttcctttttttttgagactatagcccaggctggagtgcaatggcaagatctcggcttactacaggtttgacctcctgtgctcaagcaatcctcccacctcagccttccaagtagctggaactacaggtggtgactctcaaaaggaaataggatcatggcagcagatgatgacaatggtgatggaacaagtttatttgatgtcttttctgcttctcctcttaagaacaatgatgaaggctcactggacatatacgctgggttggacagtgctgtttctgacagcgcttccaaatcctgtgtaccatcaagaaattgtttggacttatatgaagagatcctgactgaagaaggaactgcaaaggaggcaacatataatgatttgcaagtagaatatggaaaatgtcaactacaaatgaaagagctgatgaaaaaatttaaagaaatacagacacagaatttcagcttaataaacgaaaaccagtctcttaagaagaatatttcagcacttatcaaaactgccagagtggaaataaaccgcaaggatgaagaaataagtaatcttcaccaaagattgtctgagtttccacattttcgaaataatcataaaactgcaaggacatttgatacagttaaaacaaaagatcttaaatctagatctccacatttggatgattgttcaaagactgatcacagagctaaaagtgatgtttctaaagatgtacatcatagcacttcactgccaaatctggaaaaggaaggaaaaccacattctgataaaaggagtacttcacatttacctacatctgttgagaaacactgcactaatggtgtttggtcacgttctcattatcaggttggcgagggtagctcaaatgaggatagtagaagaggaagaaaagatattagacatagccagtttaacagaggaactgaaagagtacgaaaagacttaagtactggctgtggtgatggtgaaccaaggatattggaggctagtcaaaggctacaaggacatcctgagaaatatggtaaaggtgaaccaaagactgaaagcaaaagttcgaagtttaaaagtaactcagattctgactataaaggtgaacgcattaactcttcttgggagaaagagacccctggagaaaggtcacacagtcgagtagactctcaaagtgacaaaaaactagaaagacaaagtgaaagatcacaaaatataaataggaaagaagttaaatcacaagacaaagaagaaagaaaagttgatcaaaaacctaaatcagtagtaaaggaccaagatcactggagaagatctgaacgagcatcacttcctcattccaagaatgaaataacattttctcataattcaagtaaataccatctagaagagagaagaggatgggaagattgtaaaagagacaagagtgtaaacagtcatagttttcaagatggaagatgtccatcttctctttcaaacagtagaactcacaaaaacattgactctaaggaagttgatgccatgcatcagtgggaaaatacacctttaaaagcagaaagacatagaactgaagataagaggaaaagagaacaagaaagcaaagaagaaaataggcatattagaaatgaaaaaagagtacctacagaacatttgcagaagactaataaggaaactaagaaaaccactactgatttaaagaaacagaatgaaccaaagactgataagggagaagtccttgataatggtgtttctgaaggagcagataataaagagcttgcaatgaaagctgagagtggtccaaatgaaacaaaaaacaaggacctaaaattgagttttatgaaaaaattgaacttaactctttctcctgctaaaaagcaacctgtttcccaggataatcagcataaaataactgatattcccaagtccagtggtgtatgtgattcagagtcttcaatgcaagttaaaacagtggcatatgttccctccataagtgaacatatcttgggggaagcagctgtcagtgaacataccatgggggaaaccaagtcaacgttattggaaccaaaggttgctcttctagcagtgactgaacccaggatcggtatctcagaaaccaacaaggaagacgaaaatagtttgttagttaggtctgttgacaatactatgcattgtgaagagcccatttgtggtacagagacttccttcccatctcctatggaaatacaacagacagaatccttgtttccatcaacaggaatgaaacaaaccattaataatggaagggcagcagctcctgtggtaatggatgtattacaaacagatgtgtctcaaaactttggcttggaattggataccaaaagaaatgataattcagattattgtggtatttctgaaggtatggagatgaaggtggcactttcaacaacagtgagtgaaaccactgaaagcattttgcagccttcaattgaggaagctgatattttgccaataatgctttcagaagataataacccaaaatttgagccttctgttatagttacaccactggttgagagtaagtcgtgtcatctggagccttgcttacctaaagagactctagattcttcacttcagcagactgagttaatggaccacagaatggcaactggtgaaacaaactcagtatatcatgatgatgataactcggttttgagcattgaccttaatcacctgagacctattccagaagccatcagtcctctgaatagtccagtgagacctgtagcaaaagttcttagaaatgaaagcccacctcaagttccagtgtataataacagtcataaagatgtgtttttaccaaattcagctcattctacctctaagagtcagtctgatctcaataaggaaaatcaaaagccaatttacaaatctgacaaatgtacagaagcagacacatgtaagaattcaccattagatgaattagaagaaggagaaattagaagtgatagtgaaacatctaaaccacaagaaagttttgaaaaaaattccaaacgtagagtgtcagctgatgtgcggaagtcaaagactatcccacgacgtgggaaaagtactgtgtgtttagataaagacagtaggaaaacacatgtaagaatccatcagaccaataacaaatggaataaaagacctgataaatctagcagatcttcaaaaacagagaagaaagataaagtgatgagcacttccagcttggaaaaaatagttccaattattgctgtaccctcttctgaacaagagatcatgcacatgttacgaatgataagaaaacatgtaagaaaaaattatatgaaattcaaggcaaaattttcattaatacaatttcacagaattattgagtcagcaattttgagttttacatctttaattaaacatctcaacttacacaaaatctctaagtcagtgactaccttacagaagaatctctgtgatattatagagtctaaacttaagcaagttaaaaagaatggcatagttgatcgtttatttgaacagcaactaccagatatgaaaaaaaaattgtggaagtttgtagatgaccaacttgattatttgtttgcaaagcttaagaaaatcttagtatgtgattccaaaagctttggaagagatagtgatgaaggcaaacttgaaaaaacaagtaaacagaatgcacagtattcaaatagtcagaaaaggagtgtggacaactccaacagagaattgctgaaagaaaaattatcaaaatcagaagaccctgttcattataagtctttagtgggatgtaaaaaatctgaggaaaattatcaagaccaaaataactccagtattaacactgtaaagcatgacattaaaaaaaattttaacatctgctttgataatataaagaactctcaatccgaagagcgctccttggaagtacactgtccaagcaccccaaagtcagaaaaaaacgaaggaagcagcatagaggatgcacagacatcccagcatgcaactttgaagccagaacgaagtttcgagattcttaccgaacagcaagcatcgagccttacttttaatttagtgagtgatgcacaaatgggtgaaatatttaaaagtttgttgcaaggttctgatcttttagacagcagtgttaactgtactgaaaaaagtgagtgggagttaaagactccagagaagcagctgctagagactcttaagtgcgagtctataccagcttgtacaacagaagagctagtttcaggggtggcttctccatgtcctaaaatgattagtgatgataattggtcattattatcatctgaaaaaggtccatctctgtcttcagggctttcattgccggttcatcctgatgtgttggatgaaagttgtatgtttgaagtgtctactaacctacctttaagtaaagataatgtgtgtagtgtagaaaagagcaagccctgcgtttcttccatacttcttgaagatctagcagtctctttaacagtaccatcgcctctgaagtcagatggtcatctcagttttttaaagcctgatatgtcgtccagttcaactcctgaagaagtcattagtgctcattttagtgaagatgccttacttgaggaagaggatgcatctgagcaagatattcatttagctctggagtctgataattcaagcagtaaatcaagttgttcttcttcctggacaagccgatctgttgctccaggctttcagtaccaccctaatctacctatgcatgccgtcataatggaaaagtccaatgatcatttcattgtgaaaatacgacgtgcaacaccatctacctcttctggccttaaacagagtatgatgcctgatgaattattgacatctttgcccagacatggaaaggaagctgatgaaggaccagagaaagaatatatttcatgtcagaacacagtttttaaatctgtggaggaattggaaaactccaacaaaaatgttgatggcagcaagtcaactcatgaagaacagagctctatgatacaaacacaggttcctgatatatatgaatttcttaaagatgcttcagataagatgggtcatagtgatgaagtggctgatgaatgtttcaaattgcatcaagtatgggaaacaaaagtgcctgaaagcattgaagaattgccttcaatggaagaaatctcacactctgttggggaacatcttccaaacacatacgtagatctaacgaaagatccagtcactgaaaccaaaaacttgggggaattcatagaagtaacagttttacatattgatcagttgggatgttctggaggcaatttaaatcagagtgctcaaatattagacaattctttgcaggctgatactgtaggtgcttttattgatttgacacaagatgcttcaagtgaggctaaaagtgaaggtaatcatcctgcattagctgtggaagacttgggatgtggggtgatacaggtagatgaagataattgtaaggaagaaaaggcacaagtggcaaacaggcctttaaaatgcattgttgaggaaacctatatcgacttgaccacagaatctcccagttcatgtgaagtaaaaaaagatgagttaaaatcagagccaggatcaaattgtgataactcggagttgcctgggactttgcataattctcacaaaaagagaagaaacatttctgatctaaatcatcctcataaaaaacaaagaaaggaaacagacttaactaataaggaaaagaccaagaaacctacccaagattcttgtgagaatactgaagctcaccaaaagaaagccagtaagaagaaggcccctcctgtgactaaagatccctcatcattaaaggcaaccccagggattaaggattcatcagcagcacttgccacttctacaagtctttctgcaaaaaatgttattaaaaagaagggagaaattatcattttatggacaagaaatgatgaccgggaaattttattggagtgtcagaaaagagggccatcatttaaaacatttgcatatttagccgccaagttggataaaaatccaaatcaggtaactacccaattt

SEQ ID NO: 528 - DNA, 1153 bp, Homo sapiens
gggcagaaaggaaccgggttgtcttgggccgggcagggcgggtggtgactctcaaaaggaaataggatcatggcagcagatgatgacaatggtgatggaacaagtttatttgatgtcttttctgcttctcctcttaagaacaatgatgaaggctcactggacatatacgctgggttggacagtgctgtttctgacagcgcttccaaatcctgtgtaccatcaagaaattgtttggacttatatgaagagatcctgactgaagaaggaactgcaaaggaggcaacatataatgatttgcaagtagaatatggaaaatgtcaactacaaatgaaagagctgatgaaaaaatttaaagaaatacagacacagaatttcagcttaataaacgaaaaccagtctcttaagaagaatatttcagcacttatcaaaactgccagagtggaaataaaccgcaaggatgaagaaataagtaatcttcaccaaagattgtctgagtttccacattttcgaaataatcataaaactgcaaggacatttgatacagttaaaacaaaagatcttaaatctagatctccacatttggatgattgttcaaagactgatcacagagctaaaagtgatgtttctaaagatgtacatcatagcacttcactgccaaatctggaaaaggaaggaaaaccacattctgataaaaggagtacttcacatttacctacatctgttgagaaacactgcactaatggtgtttggtcacgttctcattatcaggttggcgagggtagctcaaatgaggatagtagaagaggaagaaaagatattagacatagccagtttaacagaggaactgaaagagtacgaaaagacttaagtactggctgtggtgatggtgaaccaaggatattggaggctagtcaaaggctacaaggacatcctgagaaatatggtaaaggtgaaccaaagactgaaagcaaaagttcgaagtttaaaagtaactcagattctgactataaaggtgaacgcattaactcttcttgggagaaagagacccctggagaaaggtcacacagtcgagtagactctcaaagtgacaaaaaactagaaagacaaagtgaaagatcacaaaatataaataggaaagaagttaaatcacaag

SEQ ID NO: 529 - DNA, 1033 bp, Homo sapiens
aaggcgggggcgggggcggggcggcggccgtgggtccctgccggccggcggcgggcgcagacagcggcgggcgcaggacgtgcactatggctcggggctcgctgcgccggttgctgcggctcctcgtgctggggctctggctggcgttgctgcgctccgtggccggggagcaagcgccaggcaccgccccctgctcccgcggcagctcctggagcgcggacctggacaagtgcatggactgcgcgtcttgcagggcgcgaccgcacagcgacttctgcctgggctgcgctgcagcacctcctgcccccttccggctgctttggcccatccttgggggcgctctgagcctgaccttcgtgctggggctgctttctggctttttggtctggagacgatgccgcaggagagagaagttcaccacccccatagaggagaccggcggagagggctgcccagctgtggcgctgatccagtgacaatgtgccccctgccagccggggctcgcccactcatcattcattcatccattctagagccagtctctgcctcccagacgcggcgggagccaagctcctccaaccacaaggggggtggggggcggtgaatcacctctgaggcctgggcccagggttcaggggaaccttccaaggtgtctggttgccctgcctctggctccagaacagaaagggagcctcacgctggctcacacaaaacagctgacactgactaaggaactgcagcatttgcacaggggaggggggtgccctccttcctagaggccctgggggccaggctgacttggggggcagacttgacactaggccccactcactcagatgtcctgaaattccaccacgggggtcaccctggggggttagggacctatttttaacactagggggctggcccactaggagggctggccctaagatacagacccccccaactccccaaagcggggaggagatatttattttggggagagtttggaggggagggagaatttattaataaaagaatctttaactttaaa

SEQ ID NO: 530 - DNA, 839 bp, Homo sapiens
atggctcggggctcgctgcgccggttgctgcggctcctcgtgctggggctctggctggcgttgctgcgctccgtggccggggagcaagcgccaggcgctgcagcacctcctgcccccttccggctgctttggcccatccttgggggcgctctgagcctgaccttcgtgctggggctgctttctggctttttggtctggagacgatgccgcaggagagagaagttcaccacccccatagaggagaccggcggagagggctgcccagctgtggcgctgatccagtgacaatgtgccccctgccagccggggctcgcccactcatcattcattcatccattctagagccagtctctgcctcccagacgcggcgggagccaagctcctccaaccacaaggggggtggggggcggtgaatcacctctgaggcctgggcccagggttcaggggaaccttccaaggtgtctggttgccctgcctctggctccagaacagaaagggagcctcacgctggctcacacaaaacagctgacactgactaaggaactgcagcatttgcacaggggaggggggtgccctccttcctagaggccctgggggccaggctgacttggggggcagacttgacactaggccccactcactcagatgtcctgaaattccaccacgggggtcaccctggggggttagggacctatttttaacactagggggctggcccactaggagggctggccctaagatacagacccccccaactccccaaagcggggaggagatatttattttggggagagtttggaggggagggagaatttattaataaaagaatctttaacttt

SEQ ID NO: 531 - DNA, 2955 bp, Homo sapiens
cagagccacgggcgcccgccccgccccgcgccgccccgcgccggctccgcagctcgcgcccgcccgcctgccggcccgcccggcgccgggccatggcgctgctgcgggatgtgtcgctgcaggacccgcgggaccgcttcgagctgctgcagcgcgtgggggccgggacctatggcgacgtctacaaggcccgcgacacggtcacgtccgaactggccgccgtgaagatagtcaagctagacccaggggacgacatcagctccctccagcaggaaatcaccatcctgcgtgagtgccgccaccccaatgtggtggcctacattggcagctacctcaggaatgaccgcttgtggatctgcatggagttctgcggagggggctccctgcaggagatttaccatgccactgggcccctggaggagcggcagattgcctacgtctgccgagaggcactgaaggggctccaccacctgcattctcaggggaagatccacagagacatcaagggagccaaccttctcctcactctccagggagatgtcaaactggctgactttggggtgtcaggcgagctgacagcgtctgtggccaagaggaggtctttcattgggactccctactggatggctcccgaggtggctgctgtggagcgcaaaggtggctacaatgagctatgtgacgtctgggccctgggcatcactgccattgagctgggcgagctgcagccccctctgttccacctgcaccccatgagggccctgatgctcatgtcgaagagcagcttccagccgcccaaactgagagataagactcgctggacccagaatttccaccactttctcaaactggccctgaccaagaatcctaagaagaggccgacagcagagaagctcctgcagcacccgttcacgactcagcagctccctcgggccctcctcacacagctgctggacaaagccagtgaccctcatctggggaccccctcccctgaggactgtgagctggagacctatgacatgtttccagacaccattcactcccgggggcagcacggcccagccgagaggaccccctcggagatccagtttcaccaggtgaaatttggcgccccacgcaggaaggaaactgacccactgaatgagccgtgggaggaagagtggacactactgggaaaggaagagttgagtgggagcctgctgcagtcggtccaggaggccctggaggaaaggagtctgactattcggtcagcctcagaattccaggagctggactccccagacgataccatgggaaccatcaagcgggccccgttcctagggccactccccactgaccctccagcagaggagcctctgtccagtcccccaggaaccctgcccccacctccttcaggccccaacagctccccactgctgcccacggcctgggccaccatgaagcagcgggaggatcctgagaggtcatcctgccacgggctccccccaactcccaaggtgcatatgggcgcctgcttctccaaggtcttcaatggctgccccctgcggatccacgctgctgtcacctggattcaccctgttactcgggaccagttcctggtggtaggggccgaggaaggcatctacacactcaacctgcatgaactgcatgaggatacgctggagaagctgatttcacatcgctgctcctggctctactgcgtgaacaacgtgctgctgtcactctcagggaaatccacgcacatctgggcccatgacctcccaggcctgtttgagcagcggaggctacagcaacaggttcccctctccatccccaccaaccgcctcacccagcgcatcatccccaggcgctttgctctgtccaccaagattcctgacaccaaaggctgcttgcagtgtcgtgtggtgcggaacccctacacgggtgccaccttcctgctggccgccctgcccaccagcctgctcctgctgcagtggtatgagccgctgcagaagtttctgctgctgaagaacttctccagccctctgcccagcccagctgggatgctggagccgctggtgctggatgggaaggagctgccgcaggtgtgtgttggggccgaggggcctgaggggcccggctgccgcgtcctgttccatgtcctgcccctggaggctggcctgacgcccgacatcctcatcccacctgaggggatcccaggctcggcccagcaggtgatccaggtggacagggacacaatcctagtcagctttgaacgctgtgtgaggattgtcaacatgcagggcgagcccacggccacactggcacctgagctgacctttgatttccccatcgagactgtggtgtgcctgcaggacagtgtgctggccttctggagccatgggatgcaaggccgaagcctggataccaatgaggtgacccaggagatcacagatgaaacaaggatcttccgagtgcttggggcccacagagacatcatcctggagagcattcccactgacaacccagaggcgcacagcaacctctacatcctcacgggccaccagagcacctactaagagcagcgggcctgtccaggggctccccgccccaccccacgccttagctgcaggcccttttgggcaaaggggcccatcctagaccagaggagcccaggccctggccctgctggggctgaaggtcagaagtaatcctgagaaatgtttcaggcctggggagggaggggagcccccgacgcctctgcaataactggaccagggggagctgctgtcactcccccatccccgaggcagcccagtccctagtgcccaaggcagggaccctgggcctgggccatccattccattttgttccacatttcctttctactctttctgccaagagcctgcccctgcatttgtcctgggaaacacggtatttaagagagaactatattggtattaaagctggtttgtttta

SEQ ID NO: 532 - DNA, 3181 bp, Homo sapiens
aagttctcgcgggacaccgacggggagcggaagccaggaggtattgctgcttcggcgaccgggcggcggcagcggcggcggcggctgtggcagagtctgtgcctgtggcggtgacggcggcgggagcaagcgctgccctcgcagagcagccttggggtcgccggccgctcgcagcgttgtggaggggcgggccggacgctgagcggagcagctgcgccacgggtggcattgtgtgtcccagagtgccggagcgagtcccagaagagaggcgaggctaagcccagagcgctgggttgcttcagcagggaagactcccttccccctgcttcaggctgctgagcactgagcagcgctcagaatggaagccatcgccaaatatgacttcaaagctactgcagacgacgagctgagcttcaaaaggggggacatcctcaaggttttgaacgaagaatgtgatcagaactggtacaaggcagagcttaatggaaaagacggcttcattcccaagaactacatagaaatgaaaccacatccgtttggaaacgatgtgcagcacttcaaggtgctccgagatggagccgggaagtacttcctctgggtggtgaagttcaattctttgaatgagctggtggattatcacagatctacatctgtctccagaaaccagcagatattcctgcgggacatagaacaggtgccacagcagccgacatacgtccaggccctctttgactttgatccccaggaggatggagagctgggcttccgccggggagattttatccatgtcatggataactcagaccccaactggtggaaaggagcttgccacgggcagaccggcatgtttccccgcaattatgtcacccccgtgaaccggaacgtctaagagtcaagaagcaattatttaaagaaagtgaaaaatgtaaaacacatacaaaagaattaaacccacaagctgcctctgacagcagcctgtgagggagtgcagaacacctggccgggtcaccctgtgaccctctcactttggttggaactttagggggtgggagggggcgttggatttaaaaatgccaaaacttacctataaattaagaagagtttttattacaaattttcactgctgctcctctttcccctcctttgtcttttttttcatccttttttctcttctgtccatcagtgcatgacgtttaaggccacgtatagtcctagctgacgccaataataaaaaacaagaaaccaagtgggctggtattctctctatgcaaaatgtctgttttagttggaatgactgaaagaagaacagctgttcctgtgttcttcgtatatacacacaaaaaggagcgggcagggccgctcgatgcctttgctgtttagcttcctccagaggaggggacttgtaggaatctgccttccagcccagacccccagtgtattttgtccaagttcacagtagagtagggtagaaggaaagcatgtctctgcttccatggcttcctgagaaagcccacctgggctgggcgcggtggctcacgcctgtaatcccagcactttgggaggccaaggtgggcggatcacaaggtcaggagttcgagaccaacctagccaacatggtgaaaccccgtctctactaaaaataagaaattagccgggtgtggcacgcacctgtagtcccagctacttgggagcctgaggcaggagaatcgcttgaacctgggaagtggaggttgagtgagccgggaccgtgccattgtactccagcctgggtgacagagcgagattccgtctcaaaaaaaaaaaaaaaaagcccacctgaaagcctgtctctttccactttgttggcccttccagtgggattatcgagcatgttgttttttcatagtgcctttttccttatttcaagggttgcttctgagtggtgttttttttttttttttaatttgttttgttttaaaataagttaaaggcagtccagagcttttcagccaatttgtctcctactctgtgtaaatatttttccctccgggcaggggagccagggtagagcaaaggagacaaagcaggagtggaaggtgaggcgttctcctgcttgtactaagccaggaggctttaagctccagctttaagggttgtgagccccttgggggttcagggaactgcttgcccagggtgcagtgtgagtgtgatgggccaccggggcaagagggaaggtgaccgcccagctctcccacatcccactggatctggcttacaggggggtcggaagcctgtcctcaccgtctcgggggttgtggcccccgccccctccctatatgcacccctggaaccagcaagtcccagacaaggagagcggaggaggaagtcatgggaacgcagcctccagttgtagcaggtttcactattcctatgctggggtacacagtgagagtactcacttttcacttgtcttgctcttagattgggccatggctttcatcctgtgtcccctgacctgtccaggtgagtgtgagggcagcactgggaagctggagtgctgcttgtgcctcccttcccagtgggctgtgttgactgctgctccccacccctaccgatggtcccaggaagcagggagagttggggaaggcaagattggaaagacaggaagaccaaggcctcggcagaactctctgtcttctctccacttctggtcccctgtggtgatgtgcctgtaatctttttctccacccaaaccccttcccacgacaaaaacaagactgcctccctctcttccgggagctggtgacagccttgggcctttcagtcccaaagcggccgatgggagtctccctccgactccagatatgaacagggcccaggcctggagcgtttgctgtgccaggaggcggcagctcttctgggcagagcctgtccccgccttccctcactcttcctcatcctgcttctcttttcctcgcagatgataaaaggaatctggcattctacacctggaccatttgattgttttattttggaattggtgtatatcatgaagccttgctgaactaagttttgtgtgtatatatttaaaaaaaaaatcagtgtttaaataaagacctatgtacttaatcctttaactctgcggatagcatttggtaggtagtgattaactgtgaataataaatacacaatgaattcttca

SEQ ID NO: 533 - DNA, 3248 bp, Homo sapiens
gaccgggcggcggcagcggcggcggcggctgtggcagagtctgtgcctgtggcggtgacggcggcgggagcaagcgctgccctcgcagagcagccttggggtcgccggccgctcgcagcgttgtggaggggcgggccggacgctgagcggagcagctgcgccacgggtggcattgtgtgtcccagagtgccggagcgagtcccagaagagaggcgaggctaagcccagagcgctgggttgcttcagcagggaagactcccttccccctgcttcaggctgctgagcactgagcagcgctcagaatggaagccatcgccaaatatgacttcaaagctactgcagacgacgagctgagcttcaaaaggggggacatcctcaaggttttgaacgaagaatgtgatcagaactggtacaaggcagagcttaatggaaaagacggcttcattcccaagaactacatagaaatgaaaccacatccgtggttttttggcaaaatccccagagccaaggcagaagaaatgcttagcaaacagcggcacgatggggcctttcttatccgagagagtgagagcgctcctggggacttctccctctctgtcaagtttggaaacgatgtgcagcacttcaaggtgctccgagatggagccgggaagtacttcctctgggtggtgaagttcaattctttgaatgagctggtggattatcacagatctacatctgtctccagaaaccagcagatattcctgcgggacatagaacaggtgccacagcagccgacatacgtccaggccctctttgactttgatccccaggaggatggagagctgggcttccgccggggagattttatccatgtcatggataactcagaccccaactggtggaaaggagcttgccacgggcagaccggcatgtttccccgcaattatgtcacccccgtgaaccggaacgtctaagagtcaagaagcaattatttaaagaaagtgaaaaatgtaaaacacatacaaaagaattaaacccacaagctgcctctgacagcagcctgtgagggagtgcagaacacctggccgggtcaccctgtgaccctctcactttggttggaactttagggggtgggagggggcgttggatttaaaaatgccaaaacttacctataaattaagaagagtttttattacaaattttcactgctgctcctctttcccctcctttgtcttttttttcatccttttttctcttctgtccatcagtgcatgacgtttaaggccacgtatagtcctagctgacgccaataataaaaaacaagaaaccaagtgggctggtattctctctatgcaaaatgtctgttttagttggaatgactgaaagaagaacagctgttcctgtgttcttcgtatatacacacaaaaaggagcgggcagggccgctcgatgcctttgctgtttagcttcctccagaggaggggacttgtaggaatctgccttccagcccagacccccagtgtattttgtccaagttcacagtagagtagggtagaaggaaagcatgtctctgcttccatggcttcctgagaaagcccacctgggctgggcgcggtggctcacgcctgtaatcccagcactttgggaggccaaggtgggcggatcacaaggtcaggagttcgagaccaacctagccaacatggtgaaaccccgtctctactaaaaataagaaattagccgggtgtggcacgcacctgtagtcccagctacttgggagcctgaggcaggagaatcgcttgaacctgggaagtggaggttgagtgagccgggaccgtgccattgtactccagcctgggtgacagagcgagattccgtctcaaaaaaaaaaaaaaaaagcccacctgaaagcctgtctctttccactttgttggcccttccagtgggattatcgagcatgttgttttttcatagtgcctttttccttatttcaagggttgcttctgagtggtgttttttttttttttttaatttgttttgttttaaaataagttaaaggcagtccagagcttttcagccaatttgtctcctactctgtgtaaatatttttccctccgggcaggggagccagggtagagcaaaggagacaaagcaggagtggaaggtgaggcgttctcctgcttgtactaagccaggaggctttaagctccagctttaagggttgtgagccccttgggggttcagggaactgcttgcccagggtgcagtgtgagtgtgatgggccaccggggcaagagggaaggtgaccgcccagctctcccacatcccactggatctggcttacaggggggtcggaagcctgtcctcaccgtctcgggggttgtggcccccgccccctccctatatgcacccctggaaccagcaagtcccagacaaggagagcggaggaggaagtcatgggaacgcagcctccagttgtagcaggtttcactattcctatgctggggtacacagtgagagtactcacttttcacttgtcttgctcttagattgggccatggctttcatcctgtgtcccctgacctgtccaggtgagtgtgagggcagcactgggaagctggagtgctgcttgtgcctcccttcccagtgggctgtgttgactgctgctccccacccctaccgatggtcccaggaagcagggagagttggggaaggcaagattggaaagacaggaagaccaaggcctcggcagaactctctgtcttctctccacttctggtcccctgtggtgatgtgcctgtaatctttttctccacccaaaccccttcccacgacaaaaacaagactgcctccctctcttccgggagctggtgacagccttgggcctttcagtcccaaagcggccgatgggagtctccctccgactccagatatgaacagggcccaggcctggagcgtttgctgtgccaggaggcggcagctcttctgggcagagcctgtccccgccttccctcactcttcctcatcctgcttctcttttcctcgcagatgataaaaggaatctggcattctacacctggaccatttgattgttttattttggaattggtgtatatcatgaagccttgctgaactaagttttgtgtgtatatatttaaaaaaaaaatcagtgtttaaataaagacctatgtacttaatcctttaactctgcggatagcatttggtaggtagtgattaactgtgaataataaatacacaatgaattcttca

SEQ ID NO: 534 - DNA, 3729 bp, Homo sapiens
gagtacgggaggctgcgctcggcgcctctctcgtgccttttcctcttggctctacagcgggagtgggccccgggggaaccgggaccggccccggggttcgcgtcggggcggcgaggcttgggacgtggagcgcaatccccggggctccggactctacgtttccccttttggggcgcttccttcctggggaccgtcctcctccggctcttggctctgggcagtccgggggaagaggtcggggttctctggcgaggtcccctgccttcatcgggagggtttgcacggaaggggcccgggaagcccaggcgggccgaacgccgaccgagtcagtctacccgagcctggcggcgggggactggtgtgggctgcagctgtggtgattgatgtgccttcgacctgcacggcaaccacgtcaccatctcctggcgtctttgggcttaattttgtgcgggaatccactttggggtggaacgtttgctgctggagccgggggagatacctttattctgacacttaaaaaaaaaaactatttgaaaaatatttgtcaagaaaaattcagcagtagcaggttggactgcaccgaggaaggattgcggcgagagcgggcgctggtaattttcatttgcagcgcgccctctctatgattggtggcattgtgtgtcccagagtgccggagcgagtcccagaagagaggcgaggctaagcccagagcgctgggttgcttcagcagggaagactcccttccccctgcttcaggctgctgagcactgagcagcgctcagaatggaagccatcgccaaatatgacttcaaagctactgcagacgacgagctgagcttcaaaaggggggacatcctcaaggttttgaacgaagaatgtgatcagaactggtacaaggcagagcttaatggaaaagacggcttcattcccaagaactacatagaaatgaaaccacatccgtggttttttggcaaaatccccagagccaaggcagaagaaatgcttagcaaacagcggcacgatggggcctttcttatccgagagagtgagagcgctcctggggacttctccctctctgtcaagtttggaaacgatgtgcagcacttcaaggtgctccgagatggagccgggaagtacttcctctgggtggtgaagttcaattctttgaatgagctggtggattatcacagatctacatctgtctccagaaaccagcagatattcctgcgggacatagaacaggtgccacagcagccgacatacgtccaggccctctttgactttgatccccaggaggatggagagctgggcttccgccggggagattttatccatgtcatggataactcagaccccaactggtggaaaggagcttgccacgggcagaccggcatgtttccccgcaattatgtcacccccgtgaaccggaacgtctaagagtcaagaagcaattatttaaagaaagtgaaaaatgtaaaacacatacaaaagaattaaacccacaagctgcctctgacagcagcctgtgagggagtgcagaacacctggccgggtcaccctgtgaccctctcactttggttggaactttagggggtgggagggggcgttggatttaaaaatgccaaaacttacctataaattaagaagagtttttattacaaattttcactgctgctcctctttcccctcctttgtcttttttttcatccttttttctcttctgtccatcagtgcatgacgtttaaggccacgtatagtcctagctgacgccaataataaaaaacaagaaaccaagtgggctggtattctctctatgcaaaatgtctgttttagttggaatgactgaaagaagaacagctgttcctgtgttcttcgtatatacacacaaaaaggagcgggcagggccgctcgatgcctttgctgtttagcttcctccagaggaggggacttgtaggaatctgccttccagcccagacccccagtgtattttgtccaagttcacagtagagtagggtagaaggaaagcatgtctctgcttccatggcttcctgagaaagcccacctgggctgggcgcggtggctcacgcctgtaatcccagcactttgggaggccaaggtgggcggatcacaaggtcaggagttcgagaccaacctagccaacatggtgaaaccccgtctctactaaaaataagaaattagccgggtgtggcacgcacctgtagtcccagctacttgggagcctgaggcaggagaatcgcttgaacctgggaagtggaggttgagtgagccgggaccgtgccattgtactccagcctgggtgacagagcgagattccgtctcaaaaaaaaaaaaaaaaagcccacctgaaagcctgtctctttccactttgttggcccttccagtgggattatcgagcatgttgttttttcatagtgcctttttccttatttcaagggttgcttctgagtggtgttttttttttttttttaatttgttttgttttaaaataagttaaaggcagtccagagcttttcagccaatttgtctcctactctgtgtaaatatttttccctccgggcaggggagccagggtagagcaaaggagacaaagcaggagtggaaggtgaggcgttctcctgcttgtactaagccaggaggctttaagctccagctttaagggttgtgagccccttgggggttcagggaactgcttgcccagggtgcagtgtgagtgtgatgggccaccggggcaagagggaaggtgaccgcccagctctcccacatcccactggatctggcttacaggggggtcggaagcctgtcctcaccgtctcgggggttgtggcccccgccccctccctatatgcacccctggaaccagcaagtcccagacaaggagagcggaggaggaagtcatgggaacgcagcctccagttgtagcaggtttcactattcctatgctggggtacacagtgagagtactcacttttcacttgtcttgctcttagattgggccatggctttcatcctgtgtcccctgacctgtccaggtgagtgtgagggcagcactgggaagctggagtgctgcttgtgcctcccttcccagtgggctgtgttgactgctgctccccacccctaccgatggtcccaggaagcagggagagttggggaaggcaagattggaaagacaggaagaccaaggcctcggcagaactctctgtcttctctccacttctggtcccctgtggtgatgtgcctgtaatctttttctccacccaaaccccttcccacgacaaaaacaagactgcctccctctcttccgggagctggtgacagccttgggcctttcagtcccaaagcggccgatgggagtctccctccgactccagatatgaacagggcccaggcctggagcgtttgctgtgccaggaggcggcagctcttctgggcagagcctgtccccgccttccctcactcttcctcatcctgcttctcttttcctcgcagatgataaaaggaatctggcattctacacctggaccatttgattgttttattttggaattggtgtatatcatgaagccttgctgaactaagttttgtgtgtatatatttaaaaaaaaaatcagtgtttaaataaagacctatgtacttaatcctttaactctgcggatagcatttggtaggtagtgattaactgtgaataataaatacacaatgaattcttca

SEQ ID NO: 535 - DNA, 3182 bp, Homo sapiens
gagccagggggcgtgggggctgggacagcaggccgattggcagggcggggttgccttcaatcctggccactgctcttaatcgtccctctcctgcttcagggtggcattgtgtgtcccagagtgccggagcgagtcccagaagagaggcgaggctaagcccagagcgctgggttgcttcagcagggaagactcccttccccctgcttcaggctgctgagcactgagcagcgctcagaatggaagccatcgccaaatatgacttcaaagctactgcagacgacgagctgagcttcaaaaggggggacatcctcaaggttttgaacgaagaatgtgatcagaactggtacaaggcagagcttaatggaaaagacggcttcattcccaagaactacatagaaatgaaaccacatccgtggttttttggcaaaatccccagagccaaggcagaagaaatgcttagcaaacagcggcacgatggggcctttcttatccgagagagtgagagcgctcctggggacttctccctctctgtcaagtttggaaacgatgtgcagcacttcaaggtgctccgagatggagccgggaagtacttcctctgggtggtgaagttcaattctttgaatgagctggtggattatcacagatctacatctgtctccagaaaccagcagatattcctgcgggacatagaacaggtgccacagcagccgacatacgtccaggccctctttgactttgatccccaggaggatggagagctgggcttccgccggggagattttatccatgtcatggataactcagaccccaactggtggaaaggagcttgccacgggcagaccggcatgtttccccgcaattatgtcacccccgtgaaccggaacgtctaagagtcaagaagcaattatttaaagaaagtgaaaaatgtaaaacacatacaaaagaattaaacccacaagctgcctctgacagcagcctgtgagggagtgcagaacacctggccgggtcaccctgtgaccctctcactttggttggaactttagggggtgggagggggcgttggatttaaaaatgccaaaacttacctataaattaagaagagtttttattacaaattttcactgctgctcctctttcccctcctttgtcttttttttcatccttttttctcttctgtccatcagtgcatgacgtttaaggccacgtatagtcctagctgacgccaataataaaaaacaagaaaccaagtgggctggtattctctctatgcaaaatgtctgttttagttggaatgactgaaagaagaacagctgttcctgtgttcttcgtatatacacacaaaaaggagcgggcagggccgctcgatgcctttgctgtttagcttcctccagaggaggggacttgtaggaatctgccttccagcccagacccccagtgtattttgtccaagttcacagtagagtagggtagaaggaaagcatgtctctgcttccatggcttcctgagaaagcccacctgggctgggcgcggtggctcacgcctgtaatcccagcactttgggaggccaaggtgggcggatcacaaggtcaggagttcgagaccaacctagccaacatggtgaaaccccgtctctactaaaaataagaaattagccgggtgtggcacgcacctgtagtcccagctacttgggagcctgaggcaggagaatcgcttgaacctgggaagtggaggttgagtgagccgggaccgtgccattgtactccagcctgggtgacagagcgagattccgtctcaaaaaaaaaaaaaaaaagcccacctgaaagcctgtctctttccactttgttggcccttccagtgggattatcgagcatgttgttttttcatagtgcctttttccttatttcaagggttgcttctgagtggtgttttttttttttttttaatttgttttgttttaaaataagttaaaggcagtccagagcttttcagccaatttgtctcctactctgtgtaaatatttttccctccgggcaggggagccagggtagagcaaaggagacaaagcaggagtggaaggtgaggcgttctcctgcttgtactaagccaggaggctttaagctccagctttaagggttgtgagccccttgggggttcagggaactgcttgcccagggtgcagtgtgagtgtgatgggccaccggggcaagagggaaggtgaccgcccagctctcccacatcccactggatctggcttacaggggggtcggaagcctgtcctcaccgtctcgggggttgtggcccccgccccctccctatatgcacccctggaaccagcaagtcccagacaaggagagcggaggaggaagtcatgggaacgcagcctccagttgtagcaggtttcactattcctatgctggggtacacagtgagagtactcacttttcacttgtcttgctcttagattgggccatggctttcatcctgtgtcccctgacctgtccaggtgagtgtgagggcagcactgggaagctggagtgctgcttgtgcctcccttcccagtgggctgtgttgactgctgctccccacccctaccgatggtcccaggaagcagggagagttggggaaggcaagattggaaagacaggaagaccaaggcctcggcagaactctctgtcttctctccacttctggtcccctgtggtgatgtgcctgtaatctttttctccacccaaaccccttcccacgacaaaaacaagactgcctccctctcttccgggagctggtgacagccttgggcctttcagtcccaaagcggccgatgggagtctccctccgactccagatatgaacagggcccaggcctggagcgtttgctgtgccaggaggcggcagctcttctgggcagagcctgtccccgccttccctcactcttcctcatcctgcttctcttttcctcgcagatgataaaaggaatctggcattctacacctggaccatttgattgttttattttggaattggtgtatatcatgaagccttgctgaactaagttttgtgtgtatatatttaaaaaaaaaatcagtgtttaaataaagacctatgtacttaatcctttaactctgcggatagcatttggtaggtagtgattaactgtgaataataaatacacaatgaattcttca

SEQ ID NO: 536 - DNA, 894 bp, Homo sapiens
cccgagccgcacccgccgcggacggagcccatgcgcggggcgaaccgcgcgcccccgcccccgccccgccccggcctcggccccggccctggccccgggggcagtcgcgcctgtgaacggtggggcaggagaccctgtaggaggaccccgggccgcaggcccctgaggagcgatgacggaatataagctggtggtggtgggcgccggcggtgtgggcaagagtgcgctgaccatccagctgatccagaaccattttgtggacgaatacgaccccactatagaggattcctaccggaagcaggtggtcattgatggggagacgtgcctgttggacatcctggataccgccggccaggaggagtacagcgccatgcgggaccagtacatgcgcaccggggagggcttcctgtgtgtgtttgccatcaacaacaccaagtcttttgaggacatccaccagtacagggagcagatcaaacgggtgaaggactcggatgacgtgcccatggtgctggtggggaacaagtgtgacctggctgcacgcactgtggaatctcggcaggctcaggacctcgcccgaagctacggcatcccctacatcgagacctcggccaagacccggcagggagtggaggatgccttctacacgttggtgcgtgagatccggcagcacaagctgcggaagctgaaccctcctgatgagagtggccccggctgcatgagctgcaagtgtgtgctctcctgacgcagcacaagctcaggacatggaggtgccggatgcaggaaggaggtgcagacggaaggaggaggaaggaaggacggaagcaaggaaggaaggaagggctgctggagcccagtcaccccgggaccgtgggccgaggtgactgcagaccctcc

SEQ ID NO: 537 - DNA, 1099 bp, Homo sapiens
gtggggcaggagaccctgtaggaggaccccgggccgcaggcccctgaggagcgatgacggaatataagctggtggtggtgggcgccggcggtgtgggcaagagtgcgctgaccatccagctgatccagaaccattttgtggacgaatacgaccccactatagaggattcctaccggaagcaggtggtcattgatggggagacgtgcctgttggacatcctggataccgccggccaggaggagtacagcgccatgcgggaccagtacatgcgcaccggggagggcttcctgtgtgtgtttgccatcaacaacaccaagtcttttgaggacatccaccagtacagggagcagatcaaacgggtgaaggactcggatgacgtgcccatggtgctggtggggaacaagtgtgacctggctgcacgcactgtggaatctcggcaggctcaggacctcgcccgaagctacggcatcccctacatcgagacctcggccaagacccggcagggcagccgctctggctctagctccagctccgggaccctctgggaccccccgggacccatgtgacccagcggcccctcgcgctggagtggaggatgccttctacacgttggtgcgtgagatccggcagcacaagctgcggaagctgaaccctcctgatgagagtggccccggctgcatgagctgcaagtgtgtgctctcctgacgcaggtgagggggactcccagggcggccgccacgcccaccggatgaccccggctccccgcccctgccggtctcctggcctgcggtcagcagcctcccttgtgccccgcccagcacaagctcaggacatggaggtgccggatgcaggaaggaggtgcagacggaaggaggaggaaggaaggacggaagcaaggaaggaaggaagggctgctggagcccagtcaccccgggaccgtgggccgaggtgactgcagaccctcccagggaggctgtgcacagactgtcttgaacatcccaaatgccaccggaaccccagcccttagctcccctcccaggcctctgtgggcccttgtcgggcacagatgggatcacagtaaattattggatggtcttga

SEQ ID NO: 538 - DNA, 1100 bp, Homo sapiens
gggggcgcggggccggcgggcgtaagcggcggcggcggcggcggcggcgggtgggtggggccgggcggggcccgcgggcacaggtggggcaggagaccctgtaggaggaccccgggccgcaggcccctgaggagcgatgacggaatataagctggtggtggtgggcgccggcggtgtgggcaagagtgcgctgaccatccagctgatccagaaccattttgtggacgaatacgaccccactatagaggattcctaccggaagcaggtggtcattgatggggagacgtgcctgttggacatcctggataccgccggccaggaggagtacagcgccatgcgggaccagtacatgcgcaccggggagggcttcctgtgtgtgtttgccatcaacaacaccaagtcttttgaggacatccaccagtacagggagcagatcaaacgggtgaaggactcggatgacgtgcccatggtgctggtggggaacaagtgtgacctggctgcacgcactgtggaatctcggcaggctcaggacctcgcccgaagctacggcatcccctacatcgagacctcggccaagacccggcagggagtggaggatgccttctacacgttggtgcgtgagatccggcagcacaagctgcggaagctgaaccctcctgatgagagtggccccggctgcatgagctgcaagtgtgtgctctcctgacgcaggtgagggggactcccagggcggccgccacgcccaccggatgaccccggctccccgcccctgccggtctcctggcctgcggtcagcagcctcccttgtgccccgcccagcacaagctcaggacatggaggtgccggatgcaggaaggaggtgcagacggaaggaggaggaaggaaggacggaagcaaggaaggaaggaagggctgctggagcccagtcaccccgggaccgtgggccgaggtgactgcagaccctcccagggaggctgtgcacagactgtcttgaacatcccaaatgccaccggaaccccagcccttagctcccctcccaggcctctgtgggcccttgtcgggcacagatgggatcacagtaaattattggatggtcttga

SEQ ID NO: 539 - DNA, 1233 bp, Homo sapiens
tgccctgcgcccgcaacccgagccgcacccgccgcggacggagcccatgcgcggggcgaaccgcgcgcccccgcccccgccccgccccggcctcggccccggccctggccccgggggcagtcgcgcctgtgaacggtggggcaggagaccctgtaggaggaccccgggccgcaggcccctgaggagcgatgacggaatataagctggtggtggtgggcgccggcggtgtgggcaagagtgcgctgaccatccagctgatccagaaccattttgtggacgaatacgaccccactatagaggattcctaccggaagcaggtggtcattgatggggagacgtgcctgttggacatcctggataccgccggccaggaggagtacagcgccatgcgggaccagtacatgcgcaccggggagggcttcctgtgtgtgtttgccatcaacaacaccaagtcttttgaggacatccaccagtacagggagcagatcaaacgggtgaaggactcggatgacgtgcccatggtgctggtggggaacaagtgtgacctggctgcacgcactgtggaatctcggcaggctcaggacctcgcccgaagctacggcatcccctacatcgagacctcggccaagacccggcagggcagccgctctggctctagctccagctccgggaccctctgggaccccccgggacccatgtgacccagcggcccctcgcgctggagtggaggatgccttctacacgttggtgcgtgagatccggcagcacaagctgcggaagctgaaccctcctgatgagagtggccccggctgcatgagctgcaagtgtgtgctctcctgacgcaggtgagggggactcccagggcggccgccacgcccaccggatgaccccggctccccgcccctgccggtctcctggcctgcggtcagcagcctcccttgtgccccgcccagcacaagctcaggacatggaggtgccggatgcaggaaggaggtgcagacggaaggaggaggaaggaaggacggaagcaaggaaggaaggaagggctgctggagcccagtcaccccgggaccgtgggccgaggtgactgcagaccctcccagggaggctgtgcacagactgtcttgaacatcccaaatgccaccggaaccccagcccttagctcccctcccaggcctctgtgggcccttgtcgggcacagatgggatcacagtaaattattggatggtcttg

SEQ ID NO: 540 - DNA, 1151 bp, Homo sapiens
tgccctgcgcccgcaacccgagccgcacccgccgcggacggagcccatgcgcggggcgaaccgcgcgcccccgcccccgccccgccccggcctcggccccggccctggccccgggggcagtcgcgcctgtgaacggtggggcaggagaccctgtaggaggaccccgggccgcaggcccctgaggagcgatgacggaatataagctggtggtggtgggcgccggcggtgtgggcaagagtgcgctgaccatccagctgatccagaaccattttgtggacgaatacgaccccactatagaggattcctaccggaagcaggtggtcattgatggggagacgtgcctgttggacatcctggataccgccggccaggaggagtacagcgccatgcgggaccagtacatgcgcaccggggagggcttcctgtgtgtgtttgccatcaacaacaccaagtcttttgaggacatccaccagtacagggagcagatcaaacgggtgaaggactcggatgacgtgcccatggtgctggtggggaacaagtgtgacctggctgcacgcactgtggaatctcggcaggctcaggacctcgcccgaagctacggcatcccctacatcgagacctcggccaagacccggcagggagtggaggatgccttctacacgttggtgcgtgagatccggcagcacaagctgcggaagctgaaccctcctgatgagagtggccccggctgcatgagctgcaagtgtgtgctctcctgacgcaggtgagggggactcccagggcggccgccacgcccaccggatgaccccggctccccgcccctgccggtctcctggcctgcggtcagcagcctcccttgtgccccgcccagcacaagctcaggacatggaggtgccggatgcaggaaggaggtgcagacggaaggaggaggaaggaaggacggaagcaaggaaggaaggaagggctgctggagcccagtcaccccgggaccgtgggccgaggtgactgcagaccctcccagggaggctgtgcacagactgtcttgaacatcccaaatgccaccggaaccccagcccttagctcccctcccaggcctctgtgggcccttgtcgggcacagatgggatcacagtaaattattggatggtcttg

SEQ ID NO: 541 - DNA, 1114 bp, Homo sapiens
gcaacccgagccgcacccgccgcggacggagcccatgcgcggggcgaaccgcgcgcccccgcccccgccccgccccggcctcggccccggccctggccccgggggcagtcgcgcctgtgaacggtggggcaggagaccctgtaggaggaccccgggccgcaggcccctgaggagcgatgacggaatataagctggtggtggtgggcgccggcggtgtgggcaagagtgcgctgaccatccagctgatccagaaccattttgtggacgaatacgaccccactatagaggattcctaccggaagcaggtggtcattgatggggagacgtgcctgttggacatcctggataccgccggccaggaggagtacagcgccatgcgggaccagtacatgcgcaccggggagggcttcctgtgtgtgtttgccatcaacaacaccaagtcttttgaggacatccaccagtacagggagcagatcaaacgggtgaaggactcggatgacgtgcccatggtgctggtggggaacaagtgtgacctggctgcacgcactgtggaatctcggcaggctcaggacctcgcccgaagctacggcatcccctacatcgagacctcggccaagacccggcagggcagccgctctggctctagctccagctccgggaccctctgggaccccccgggacccatgtgacccagcggcccctcgcgctggagtggaggatgccttctacacgttggtgcgtgagatccggcagcacaagctgcggaagctgaaccctcctgatgagagtggccccggctgcatgagctgcaagtgtgtgctctcctgacgcagcacaagctcaggacatggaggtgccggatgcaggaaggaggtgcagacggaaggaggaggaaggaaggacggaagcaaggaaggaaggaagggctgctggagcccagtcaccccgggaccgtgggccgaggtgactgcagaccctcccagggaggctgtgcacagactgtcttgaacatcccaaatgccaccggaaccccagcccttagctcccctcccaggcctctgtgggcccttgtcgggcacagatgggatcacagtaaattattggatggtcttga

SEQ ID NO: 542 - DNA, 697 bp, Homo sapiens
gaaacttggtgtccaggggaggcccccggcggctggagcgcggcggcagcgggcgcagaggccggagggagaggaggcgaggggcggcccgagcgcggggcgggagcgaggccagcggtcatgtgcccgtgccccctgcaccgcggccgcggccccccggccgtgtgcgcctgcagcgcgggtcgcctggggctgcgctcgtccgccgcgcagctcaccgccgcccggctcaaggcgctaggcgacgagctgcaccagcgcaccatgtggcggcgccgcgcgcggagccggagggcgccggcgcccggcgcgctccccacctactggccttggctgtgcgcggccgcgcaggtggcggcgctggcggcctggctgctcggcaggcggaacttgtaggaacgcggggcttcttggtggggccggagccgagacccagccggagcgagcaacaggttggtgaaaaccctgtgtccttggagaaagctggttcccgttttccagagggggagcccagagcttgaaaggccgcggttggcacttcgagaaggaagtggagagtaaagacagcgcctggagcgatcgtagaaacacagaatgggactggggaagccctttggaaatccagctgcagaaacagacaccccaatgctatttacatacagctctatatatataaaaaaagaaaatatgaatatta

SEQ ID NO: 543 - DNA, 909 bp, Homo sapiens
gctgggggaggagtgcatggggaggggcggccctcaaacgggtcattgccattaatagagacctcaaacaccgcctgctaaaaatacccgactggaggagcataaaagcgcagccgagcccagcgccccgcacttttctgagcagacgtccagagcagagtcagccagcatgaccgagcgccgcgtccccttctcgctcctgcggggccccagctgggaccccttccgcgactggtacccgcatagccgcctcttcgaccaggccttcgggctgccccggctgccggaggagtggtcgcagtggttaggcggcagcagctggccaggctacgtgcgccccctgccccccgccgccatcgagagccccgcagtggccgcgcccgcctacagccgcgcgctcagccggcaactcagcagcggggtctcggagatccggcacactgcggaccgctggcgcgtgtccctggatgtcaaccacttcgccccggacgagctgacggtcaagaccaaggatggcgtggtggagatcaccggcaagcacgaggagcggcaggacgagcatggctacatctcccggtgcttcacgcggaaatacacgctgccccccggtgtggaccccacccaagtttcctcctccctgtcccctgagggcacactgaccgtggaggcccccatgcccaagctagccacgcagtccaacgagatcaccatcccagtcaccttcgagtcgcgggcccagcttgggggcccagaagctgcaaaatccgatgagactgccgccaagtaaagccttagcccggatgcccacccctgctgccgccactggctgtgcctcccccgccacctgtgtgttcttttgatacatttatcttctgtttttctcaaataaagttcaaagcaaccacctgt

SEQ ID NO: 544 - DNA, 763 bp, Homo sapiens
gcattccgtgctatgattcaggcctaattaagtgattgcgtctgggcacggctataaaccactagctgcttcaactggtaatccagtcagtaggcaactgcaggggctcgccactgactgaaggcagtggaaggttggcagaaggaggctgttcaaggctgtttttgccttcactatggcaaaaatcattttgaggcacctcatagagattccagtgcgttaccaggaagagtttgaagctcgaggtctagaagactgcaggctggatcatgctttatatgcactgcctgggccaaccatcgtggacctgaggaaaaccagggcagcgcagtctcctccagtggactcagcggcagagacgccaccccgagaaggcaaatcccactttcagatcctgctggacgtggtccagttcctccctgaagacatcatcattcagaccttcgaaggctggctgctgataaaagcacaacacggaaccagaatggatgagcacggttttatctcaagaagcttcacccgacagtacaaactaccagatggtgtggaaatcaaagatttgtctgcagtcctctgtcatgatggaattttggtggtggaagtaaaggatccagttgggactaagtgacatcgtatcggttcctgttcagatgacatggggaagatgatggttcagccactggtactacgagaatgtttgtattacccacatttgaaatgatttgctatgatttttatgaagattaaaaatatatacacagtt

SEQ ID NO: 545 - DNA, 1335 bp, Homo sapiens
tgatggtcaacatgtcagcaccagccatctgcctcgtgccctgggttgacctgggtttaggagaggatcccacatctgggcagaaagaccccaccccctgaaaaaagagcaaacagatttcttgcatctttcgttctatgtggctctcagaacattaaatccaggagtgctttaggaattgggtgcacagtgcctgccaccgaagaggagaaaatgaggtgtggaaacgtgcaaaccgtttgtgagggtctcagcgaggcctcttcatgccccaggcaccaccagctccccctccccagctcgttcccagccaggaccctcagctgtcctctcaggccccctgcgacagctgaagagtgtgcgggggaggggactaggggtccgggcggcgctggtcacaccctcgttgctctcactcagggcccccactcccagcccctccccccccaagaggctcggcactattttgggtggtgtcgaccccgcccccacctcctatcgagccctggctctccgggcagctggaggggtcgcgctgcgcctgttggggctgcacctcggaccagggcttctgctgcatctgcagccatgtcgggccgctcagtgccacatgcccacccggccaccgccgagtacgaatttgccaacccgagccgcctgggtgagcagcgcttcggagaaggcctcctgccagaagagatcctgacccccacactctaccatggctactatgtccggcctcgggccgccccagctggggagggcagcagggcaggggcctccgagcttaggctcagtgagggcaagttccaggcatttctggatgtgagccactttaccccagacgaggtgactgtgaggactgtggataacctgctggaggtgtctgcccggcacccccagcgcctggaccgccacggcttcgtgtcccgagagttctgccgcacctatgtcctgcctgctgatgtcgacccctggcgagtccgagctgctctctcccatgatggcatcttaaacctggaagcacctcggggtggccgacatttggacacagaggtcaatgaggtctacatctccctgctccctgcgcctcctgatccagaggaagaggaggaggcagccatagttgagccctgattgccacagacccagcacccagcaaatccctctctacctcccaaggtgatatgggcagctgcccaccactccagaggtagcagcatccttgggggaagggaaaggtgcatggtccacaatgtatggtttggtcccatgggacatgtcatagccttggtttagttttgggtggagctgaataaacccaaatctcagggc

SEQ ID NO: 546 - DNA, 672 bp, Homo sapiens
gcacttttctgagcagacgtccagagcagagtcagccagcatgaccgagcgccgcgtccccttctcgctcctgcggggccccagctggccaggctacgtgcgccccctgccccccgccgccatcgagagccccgcagtggccgcgcccgcctacagccgcgcgctcagccggcaactcagcagcggggtctcggagatccggcacactgcggaccgctggcgcgtgtccctggatgtcaaccacttcgccccggacgagctgacggtcaagaccaaggatggcgtggtggagatcaccggcaagcacgaggagcggcaggacgagcatggctacatctcccggtgcttcacgcggaaatacacgctgccccccggtgtggaccccacccaagtttcctcctccctgtcccctgagggcacactgaccgtggaggcccccatgcccaagctagccacgcagtccaacgagatcaccatcccagtcaccttcgagtcgcgggcccagcttgggggcccagaagctgcaaaatccgatgagactgccgccaagtaaagccttagcccggatgcccacccctgctgccgccactggctgtgcctcccccgccacctgtgtgttcttttgatacatttatcttctgtttttctcaaataaagttcaaagcaaccacc

SEQ ID NO: 547 - DNA, 892 bp, Homo sapiens
cctatcgagccctggctctccgggcagctggaggggtcgcgctgcgcctgttggggctgcacctcggaccagggcttctgctgcatctgcagccatgtcgggccgctcagtgccacatgcccacccggccaccgccgagtacgaatttgccaacccgagccgcctgggtgagcagcgcttcggagaaggcctcctgccagaagagatcctgacccccacactctaccatggctactatgtccggcctcgggccgccccagctggggagggcagcagggcaggggcctccgagcttaggctcagtgagggcaagttccaggcatttctggatgtgagccactttaccccagacgaggtgactgtgaggactgtggataacctgctggaggtgtctgcccggcacccccagcgcctggaccgccacggcttcgtgtcccgagagttctgccgcacctatgtcctgcctgctgatgtcgacccctggcgagtccgagctgctctctcccatgatggcatcttaaacctggaagcacctcggggtggccgacatttggacacagaggtcaatgaggtctacatctccctgctccctgcgcctcctgatccagaggaagaggaggaggcagccatagttgagccctgattgccacagacccagcacccagcaaatccctctctacctcccaaggtgatatgggcagctgcccaccactccagaggtttctttttattgaagcttgaagctcaagttcatggcttcatcaaaagacgcttcaaatcctgaagttgagatagctctcacctggagcccgtgtgttgttctaccctttggctgggaacacagtcacctgggaatcattccagcaggtggcttcaaaagtccaacctgcta

SEQ ID NO: 548 - DNA, 2367 bp, Homo sapiens
tctggcagcgcgcagctgaccaggaagacgtggatcccgagaaagaggcgcaggacgaggaggcagaacccgactggcgcgtagagcagcagcacgagcagtaggaagcagtcacccggaagcctgggggcgagaggcgaagtggtcaggcgccgaaggccgagagcacgcggggatcggtctcttcccgccgggtctcttaccggtgcgagtcaaagagccgctccggccccggccctgagggaagctccataactgctgcttcaggagcgcccggccgtcgccgccgccgccattttcgcgcccggccgcaggggctcttgggaaggcggagtctttgggcatccgcccggggtgaggggacccgaagtcctgaggcgcgccggaagggctagcggtcccagcataccccgcggccccttgggccgtctcacaactcgcgtccggcggagaccacaattcccggcattcgtggggcagggaggagtcggcctcccggaatcctggtcccggcgtgcacttctgaaggacttcaggtaccggcgtgccccgcgtcctactgtccgcctgctcgcgtcctgggtgccgcctctgagtagggcgggcgaggaggcagccaaggcggagctgatggctgcgccgagggcggggcggggtgcaggctggagccttcgggcatggcgggctttggggggcattcgctgggggaggagaccccgtttgacccctgacctccgggccctgctgacgtcaggaacttctgacccccgggcccgagtgacttatgggacccccagtctctgggcccggttgtctgttggggtcactgaaccccgagcatgcctgacgtctgggaccccgggtccccgggcacaactgactgcggtgaccccagataccaggacccgggaggcctcagagaactctggaacccgttcgcgcgcgtggctggcggtggcgctgggcgctgggggggcagtgctgttgttgttgtggggcgggggtcggggtcctccggccgtcctcgccgccgtccctagcccgccgcccgcttctccccggagtcagtacaacttcatcgcagatgtggtggagaagacagcacctgccgtggtctatatcgagatcctggaccggcaccctttcttgggccgcgaggtccctatctcgaacggctcaggattcgtggtggctgccgatgggctcattgtcaccaacgcccatgtggtggctgatcggcgcagagtccgtgtgagactgctaagcggcgacacgtatgaggccgtggtcacagctgtggatcccgtggcagacatcgcaacgctgaggattcagactaaggagcctctccccacgctgcctctgggacgctcagctgatgtccggcaaggggagtttgttgttgccatgggaagtccctttgcactgcagaacacgatcacatccggcattgttagctctgctcagcgtccagccagagacctgggactcccccaaaccaatgtggaatacattcaaactgatgcagctattgattttggaaactctggaggtcccctggttaacctggatggggaggtgattggagtgaacaccatgaaggtcacagctggaatctcctttgccatcccttctgatcgtcttcgagagtttctgcatcgtggggaaaagaagaattcctcctccggaatcagtgggtcccagcggcgctacattggggtgatgatgctgaccctgagtcccagcatccttgctgaactacagcttcgagaaccaagctttcccgatgttcagcatggtgtactcatccataaagtcatcctgggctcccctgcacaccgggctggtctgcggcctggtgatgtgattttggccattggggagcagatggtacaaaatgctgaagatgtttatgaagctgttcgaacccaatcccagttggcagtgcagatccggcggggacgagaaacactgaccttatatgtgacccctgaggtcacagaatgaatagatcaccaagagtatgaggctcctgctctgatttcctccttgcctttctggctgaggttctgagggcaccgagacagagggttaaatgaaccagtgggggcaggtccctccaaccaccagcactgactcctgggctctgaagaatcacagaaacactttttatataaaataaaattatacctagcaacatattatagtaaaaaatgaggtgggagggctggatcttttcccccaccaaaaggctagaggtaaagctgtatccccctaaacttaggggagatactggagctgaccatcctgacctcctattaaagaaaatgagctgctgccatcttttgtgggcagttagtcaggtgc

SEQ ID NO: 549 - DNA, 1450 bp, Homo sapiens
cagccaaggcggagctgatggctgcgccgagggcggggcggggtgcaggctggagccttcgggcatggcgggctttggggggcattcgctgggggaggagaccccgtttgacccctgacctccgggccctgctgacgtcaggaacttctgacccccgggcccgagtgacttatgggacccccagtctctgggcccggttgtctgttggggtcactgaaccccgagcatgcctgacgtctgggaccccgggtccccgggcacaactgactgcggtgaccccagataccaggacccgggaggcctcagagaactctggaacccgttcgcgcgcgtggctggcggtggcgctgggcgctgggggggcagtgctgttgttgttgtggggcgggggtcggggtcctccggccgtcctcgccgccgtccctagcccgccgcccgcttctccccggagtcagtacaacttcatcgcagatgtggtggagaagacagcacctgccgtggtctatatcgagatcctggaccggcaccctttcttgggccgcgaggtccctatctcgaacggctcaggattcgtggtggctgccgatgggctcattgtcaccaacgcccatgtggtggctgatcggcgcagagtccgtgtgagactgctaagcggcgacacgtatgaggccgtggtcacagctgtggatcccgtggcagacatcgcaacgctgaggattcagactaagtttggaaactctggaggtcccctggttaacctggatggggaggtgattggagtgaacaccatgaaggtcacagctggaatctcctttgccatcccttctgatcgtcttcgagagtttctgcatcgtggggaaaagaagaattcctcctccggaatcagtgggtcccagcggcgctacattggggtgatgatgctgaccctgagtcccagggctggtctgcggcctggtgatgtgattttggccattggggagcagatggtacaaaatgctgaagatgtttatgaagctgttcgaacccaatcccagttggcagtgcagatccggcggggacgagaaacactgaccttatatgtgacccctgaggtcacagaatgaatagatcaccaagagtatgaggctcctgctctgatttcctccttgcctttctggctgaggttctgagggcaccgagacagagggttaaatgaaccagtgggggcaggtccctccaaccaccagcactgactcctgggctctgaagaatcacagaaacactttttatataaaataaaattatacctagcaacatattatagtaaaaaatgaggtgggagggctggatcttttcccccaccaaaaggctagaggtaaagctgtatccccctaaacttaggggagatactggagctgaccatcctgacctcctattaaagaaaatgagctgctgccatcttttgtgggca

SEQ ID NO: 550 - DNA, 1231 bp, Homo sapiens
tattgaactcctaacattacattagactaatctattacttaatagaagcaataatgttaatattagtaacacgaagacattctccattgcataagcttatatcaaaccagaatccactgatagttaacagcctaatattaataaagaataaataccctattatttataccattaatccaacacaggtatgctctaaggaaagattacaaaaagtataaggaactcgggaaatcttaccccacctgtttaccaaaaacatcacctctggcttcaccagtattagaggcaccgcctgcccagtgacatatgttcaacagctgcggtatcctgacattgtaaaggtagcataatcacttgttccctaaatagggacttgtatgaatggccacacaagggttcagctgtctcttactttcagtcagtgaaattgacctatccatgaagaggcagtataaacaaataagatgagaagactctatagagctttaattcattaatgcaaatagaaactcaaaaaaagcctacaggccctagcctactatctttgcattaaaaattttggttggggtgcccggcgtggtggctcacgcctataatcccagcactttgggaggctgagacaggcagatcacgaggtcaggagatcgagaccatcccggccaatatggtgaaatcccgtctctactaaaaatacaaaaattagctgggtgtggtggtatgtgcctgtaatcccagctactcaggagactgaggcaggagaatggctttaacccgggaggtggagatagcagtgagccaagatcgtgccactgcactccagcctggcaacagagccagactctgtcttaaaaaataaataaataaaaaacaaaaaaaataaaaattttcttttatttcagagcataattcaacctccaaactacctaaactaagaccgcactagtctaagcaagttaacacacactgacccaataatttgatcaacggaataagttatcctagggataacggcacaatcctattctagggtccatatcaacaacagggtttacagcttcaatgctggatcaggacatcctaatagtgtagccgctattaagggttcgttttttcaactattaaagtcccatgtgatctcagttcagatcggagtaatccaggtcggtttctaactatttaacatttctcctagtacaaaaggacaagagaagcagggcccatttcacaaagc

SEQ ID NO: 551 - DNA, 1739 bp, Homo sapiens
caaaccatttaccctcgacaaaagtataggagatagaaattacttattctggtgcaatagatatagtaccgtaagggaacaatgaaagaactatatcaagcaccaaaaagcaaagacaaatccttgcatcttttgaataatgaattaactagaataaacttcacaaagagagctctagccaagtcccccaaaatcagaggagcttctccagaacagctagaagagtacactcatttatgtggcaaaatagtgagaagattcattagtagcagtgacaagcctacggaggctggtgatagctgattgtccaaggtagaattttagttcaactttaaacttaacctacagaattacttaatcctcctgtaagtttaactgttaaagggggacggatcttcagatactagaaaataaccgtcctatagagagtaaaagattttaccaccataattggcctaaaagcagccaccaattaagaaagcgtttaagctcaacatctgactaacttcatttctaatcaccctgttaaactcctaatattacattggactaatctattattcagtagaagcaataatgttagtgtaagtaacattaagacattatccattgcataagcttacatcagaccagaataatccactgacagttaacaacctaatattaacaaatgattaatagacatcttattatctttattttaacccaatacagtcatgctctaaggaaagattacaaaaagtaaaaggaactcggcacatttcaccccatctctctaccaaaaacatcacccctagcattgctagtattagaggcactgcctgctcagtgacatatgtttaagggttgcggtatcctgaacttgcaaaggtagcataatcacttgttccctaagtagggacttgtatgaatggccacaccagggtttagctgtctcttactttcaaccagtgaaattgacctacctatgaagaggcgggtataaataaataggagaagaccctgtggagcttgaattcattaatgcaaatagattcaaacaagccaacaggccccaatgtatcatccctgcattaaaaattttggttggggtggccgggcacagtggctcacgcctgtaatcccagcactttgggaggccgaggtgggtggatcacgaggtcaggagatcgagaccatcctggctaacatagtaaaaccctgtatctactaaaaatacaaaaaattagccgggtgtggtggcacatgcctgtagtcccagctacccaggaggatgaggcaggagaatggcatgaacctgggaagcagagcttgcagtgagcggagatggtgccactgcactccagcctgagagacagagtgagactctgtcttaaaaaaaaaaaaaattggttggggtgaccttggagcataattcaacctccgaaacgacttaaactaagaccgcactagtgtaagtcagttattacacattgacccaataattctatcaacaggataagtgaccctagggttaagagtgcaatcctattctagcatccatatcaacaacagggtttacgaccttgatgttggatcgggacatcctaaatggtgtagccgctattaagggatcatttgttcaatgattaaagtccttcgtgatctgagttcagaccagagcaatccaggttggtttctatctatttagcatttttcccagtatgaaaggatatgagaaaccgggcccacttcacaaa

SEQ ID NO: 552 - DNA, 1290 bp, Homo sapiens
cccaaacccattccaccttactaccgaacagctttaaccaaatcatttacccaaataaagtataggcgatagaaattgtaaatcggcgcaatagatatagtaccgcaagggaaagatgaaaaattgcaaccaagcataatacagcaaggactaatccctgtaccttctgcataatgaattaactagaaataactttgcaaagagaaccaaagctaagacccccgaaaccagacgagctacctaagaacagctaaaagagcacacccgtctatgtagcaaaatagtgggaagattcgtaggtagaggcgacaaacctaccgagtctggtgatagctggttgtccaagacagaatcttagttcaactttaaatttacccacagaaccctccaaatccccctgtaaatttaactgttagtccaaagaggaacagctctttggacactaggaaaaaaccttgtaaagagagtaaaaaatttaatacccacagtaggcctaaaagcagccaccaattaagaaagcgttcaagctcgacacctgtcatctaaaaaatcccaaacacataactgaactccttgcacccaattggaccaatctattaccctatagaagagctaatgttagtataagtaacatgaaaacattctcctccgcataagcctacatcagaccaaaatattaaactgacaattaacagcccaatatctataaccaaccaacaagccattattacccccactgttaacccaacacaggcatgcccacaaggaaaggttaaaaaaagtaaaaggaactcggcaaatcttaccccgcctgtttaccaaaaacatcacctctagcattctcagtattagaggcaccgcctgcccagtgacatgcgtttaacggccgcggtaccctaactgtgcaaaggtagcataatcacttgttccttaaatagggacttgtatgaatggctccacgagggttcagctgtctcttactttcaaccagtgaaattgacctgcccgtgaagaggcgggcatagtataacaagacgagaagaccctatggagctttaattcattaacgcaaacaacacttaacaagtccacaggccctaaactatcaaacctgcgtgaaaaatttcggttggggcgacctcggagcacaatccgacctccgagcaacacatgccgagacttcaccagtcaaagcgaattaccacgtttaattgatccaataacttgaccaacggaacaagttaccctagggataacagcgcaatcctattctagagtccatatcaacaa

SEQ ID NO: 553 - DNA, 1555 bp, Homo sapiens
cccaaacccaactaattctactaccaaataacctcaactaaaacatttacccaaataaagtataggcgatagaaatgatatctcggcacaatagacataataccgcgatggaaagatgaaaaaacataaccaagcataaagtagcaaggacaaacccctataccttctgcataatgaattaactagaaataactttacaaagagaaccaaagccaagacccccgaaaccagacgagctacctaagaacagctgaaagagcacacccatctatgtagcaaaatagtgggaagattcataggtagaggtgacaagcctaccgagcctggtgatagctggttgtccaagatagaatcttagttcaactttaaatttatctacagaaccagctaatgcctttgtaaatttaactgttagtctaaagagggacagctctttagacactaggaaaaaaccttgtagagagagtaaaaaatataacttccaaagttggcctagaagaagcgatcaattaagaaggcgttcaagctcaacacccaaccacccaaaaaattccaaacacataactgaactcctcacatcacattggaccaatctatcatttcatagaagaaataatgttagtataagtgacatgcaaacattctcctccgcataagcctacatcagaccaaaatacttcactgacaattaacagcccaatatctataaataatcaatgaaaccattattacccacactgttaacccaacacaggcatgcttacaaggaaaggttaaaaaaagtaaaaggaactcagcgaatcttacccctcctgtttatcaaaaacatcacctctagcattaccagtactagaggcaccacctgcccagtgacatatgtttaatggctgcggtaccctaaccgtgtaaaggtagcataatcacttgttccttaaatagggacttgtctgaatggctccacgagggttcagctgtctcttactttcaaccagtgaaattgacctgcccgtgaagaggcggacataatacaacaagacgagaagaccctaaggagctttaatttatgaatgcaaacaagaccaaataggcccgcaggccctaaactaccagacctgcgttaaacatttcggttggggcgacctcggagtataacctaacctccgagcaacatatgctgagactataccagtcaaggcgaatatccacatacaattgacccaataatttgaccaacggaacaagttaccctagtgataacagtacaatcctattctagggtccacatcgacagtagcattaacgacctcgatgttggatcaggacatcccaatggtgcagccgctattaaaggttcgtttgttcaacgattagagtcctatgtgatctgagttcagaccggagtaatccaggttggtttctatctattctacatttcttccagtacgaaaggataagagaaatggggcccacttcataaagtgcccctgccccatagatgatattatctcagcattttactgtacccacacccacccaagaacagggtttgttaaga

SEQ ID NO: 554 - DNA, 1383 bp, Homo sapiens
caaagacaagcccttataccttctgcataatgcattaactagaaataactttacatagaactatggccaagtcccccgaaaccagacgagctacccaagaatagctgaaagagcacactcacctatgtggcaaaacagtgggaagattcatgagtagcggtgacacgcctaccgagcctggtgatagctggctggcttagttcaactttcaacttacccacagaattacttaaactccctgtaagtttaactgttagtctagagagacagacagctctttagacccttcctacagagagtaaaaaacattaccaccacagttggcccaaaagcagccactaattaagaaagcatttaagctcaatatctaactatcttaaattctaaccagtctactgaactcctaacatcacattggactaatctattacttaatagaagcagtaatgttaatgtaagtaagatgaagacattctccattgcataagcttacatcagacgggagtaacccactgacagttaacatcccaatattaataaatgatataataaacaccgtattatttgcactgttaacccaacacaggcatgctctaaggaaacattacaaaaaaataaaaggaactcagcaaatcttaccccgcctgtttaccaaaaacatcacctctagcattaccagtattagaggcactatctgcccagtgacatatattcaacagctgtggtatcctgaccgtgcgaaggtagcataatcacttgttctctaaatagggacttgaatgaatggccacacgaaggttcagctgtctcttactttcaaccagtgaaattgatctatccgtgaagaggcggatataaacaaataagacgagaaaaccttatggagctttaattcatcaatgcaaataaaaactccaacaagcctacaggccctagcctcctatccctgcattaaaaattttggttggggtgacctcggagcataattcaacctcctaacaacctaagaccacacaagtctaagtgagttattacacatcgacccaataatttgataaacggagtaagttaccctagggataacagcgcaatcctatactagagtccatatcgacaatagagtttacgacctcgatgttggatcaggacatcctaatggtgtagccgctattaagagtttgtttgttcaatgattaaagtcctatgtgatctcagttcagaccagagtaatccaggtcggtttctacctacttaacattcctcctactacgaaaggacaagagaaatagggcccacttcataaagtgccctcactccatagatgatgccatcccagtctcttaaatcatcacacatcctacccaagaacagggtttgttaaga

SEQ ID NO: 555 - DNA, 1494 bp, Homo sapiens
gtataggtgatagaaatttttagcctggcacaatagacttagtacagtaagggaaagatgaaagaactgtatcaagcactgaaaagcaaagacaagcccttatgccttctgcataatgtattaaccagaaataactttacacagagaactatagccaagtcccccaaaaccagccaagctacccaagaacagctgaaagagcacactcacctatgtggcaagatagtgggaagattcatgagtagaagtgacaaggctatggagcctggtgatagctggttgtccaagatagactcctagttcaactttaagcttatacacagaattacttaacctccctgtaagtttaactgttagtctaaagagggacagctctttagaccctaggaaacaaccttcctacagaaaataaaaaatattaccaccacagttggcccaaaagcagccaccaattaagaacatgtttaagttcaacatctatcttaaattctaatcactctactgaactcctaacatcacactggactaatctattacttaatagacacaataatgttagtataagtaacatgaagacattctccattgcataagcttacatcagaccagaataatccactgacagttaacagcctaatattaataaacaatataataaacaccctattatttacactgttaacccaacacaggtatgctctaaggaaagattacaaaaagtaaaaggaactcggcaaatcatactctgcctgtttaccaaaaacacacctctagcattaccagtatttgaggcactgcctgcccagtgacatttgttcaacagccacagtatcctgaccatgcaaaagtagcataatcacttgttccctaaatagggacttgtatgaatggccacaggagggttcggctgcctcttacttttaatcagggaaattgacctatccgtgaagaggcagatataaacaaataagatgagaagctccctatggagctttaattcattaatgcaaattaaaactcaaacaagcctacaggctctagcctactattcttgcattaaaaattttggttggggtgaccttggagcataattcaacctctgaacaacctacactaagactgcactagtctaagtgagttaatacatatggacccaataatttgatcaacagagtaaggtaccctagggataacagcacaatccattctacagttcatattgacaatagggtttatgaccttgatgttagatcaggacatcctaatggtgtaaccactgttaaggattcatttattcaatgattaaagtcaattaatgtgatctgagttcagactggagtaatccaggttggtttctatctatttaacatttctccaagtatgaaaggacaagagaaatagagtccctttcataaagtgccctcacttcatagaggatgctatctcaatctaaaaaatcatcaccaccctacccaagaacagggtttgttaaga

SEQ ID NO: 556 - DNA, 1121 bp, Homo sapiens
acagctctttagaccctaggaaacaaccttcctacagagagtaaaaaatatttccaccatagttggcccaaaagcaatcaccaattaagaaagcgtttaagctcaacatctatcttaaattctagtcactctactgaactcctaacatcacattggactaatctattacttaatagaagcaataatgttaatataagtaatatgaaaacattctccattgcataagcttacatcagactggaataacccactgacagttagcctaatattaataaacgatataataagctctttattatttacactgttaacccaacacaggtatgctctaaggaaagaatacaaaaagtaaaaggaactccgcaaattttaccccgcctgtttaccaaaaacatcacctctagcattaccagtattagaggcactgcctgcccagtgacatacgttcaatggccgcagtatcctgactgtgcaaaggtagcataatcacttgttccttaaataggaacttgtatgaatgaccacacgagggttcagctgtctcctacttttaatcagggaaattgacctatccgcgaagaggcggatataaacaaataagacgagaagaccctatgtatggagctttaatttattaatgcaaataaaaacttaagcctacaggccctagcctactatccctgcattaaaatttttggttggggtgacctcagagcataattcaacctccgagcaacctaaactaagactgcactagcctaagcaagttaatatatattgacccgataatttgatcaacggagtaagttaccctagggataacagcgcaatcctattctagagtccatatcaacaatagggtttacaatctcgatgttggatcaggacatcctaatggtgtcaccgctattaggggttcgtttgttcaacaattaaagtcctacgtgatgtgagttcagaccagagtaatccaggtcggtttctatctatttaacatttcccctagtatgaaaggacaagagaaatagggcccacttcataaagtgccctcgctccacagatgatgctatctcaatctaacaaatcatcacataccctacccaagaacagggtttgttaag

SEQ ID NO: 557 - DNA, 1395 bp, Homo sapiens
tactaccgaataaccttaatcaaaccatttacccaaacaaaagtataggcgaaagaaattttacccaggcgcagtggacgtagtactgcaaggtaaagatgaaaaagttaaccaagaataaaatagcaaggatagacccttataccttctgcgtaatgaattaactagaaataactttacacagagaaccaaagccaaggcccccaaaaccagacgagctacccaagaacagctaaaagaacacacccatctatgtagtaaaatagtggggagattcatgagtagtggtgataagcctactgagcctagtgatagctggttgtccaagatagaatcttagttcaactttaaatttacctacagagccacttaatccccctgtaaatttaactgttagtctaaagagggacagctctttagacattaggaaacaaccttcatgtagagagtaaaaaacattatccccatagttggcccgaaagcagccatcaattaagaaagcattcaagctcaacatccaaccactctaaattctaatcacaccactgaactcctaacaccacattggactaatctattactttatagatgcaataatattaatataagtaacatgaaatattctccactgcttaagcctacatcagaccagaataacccactgacaaattaacagcctaatattaataaacaactcaacaaatttattattaccgatactgttaatccaacacaggcatgctctaaggaaaggttaaaaaaaattaaaaggaactcggcaaattttaccctgcctgtttaccaaaaacatcacctctagcattattagtattagaggcaccacctgccagtgacatatgttcaacggccacagtaccctgaccatgcaaaggtagcataatcacttgttccttaaatagggacttgtatgaatgaccccacgagggttcagctgtctcttacttccaaccagtgaaactgacctgcctgtgaagaggcgaacatgaataaataagatgagaagatcctatggagctttaatttattaatgcaaacaaagctcagataagcccacaggccttaaactactgtccctgcattaaatattttggttggggtgacctcggagcataatttaacctccgagcaacctatgctaagactaaacaagtttaagcgaattactatacatatattgacccaataatttgatcaacggaacaagttaccctagggataacagcgcaatcctattctagagtccatattgacaatagggtttacgacctcgatgttggatcaggacatcctaatggtgtagctgctatcaagggttcatttgttcaatgattaaagtcctacgtggtctgagttcagaccggagcaagccaggtc

SEQ ID NO: 558 - DNA, 1403 bp, Homo sapiens
cgaaggtgggcaggtcccaccttgtggaggatggaggtgaccggggacgccggggtaccagaatctggcgagatccggactctaaagccgtgtctgctgcgccgcaactacagccgcgaacagcacggcgtggccgcctcctgcctcgaagacctgaggagcaaggcctgtgacattctggccattgataagtccctgacaccagtcaccctggtcctggcagaggatggcaccatagtggatgatgacgattactttctgtgtctaccttccaatactaagtttgtggcattggctagtaatgagaaatgggcatacaacaattcagatggaggtacagcttggatttcccaagagtcctttgatgtagatgaaacagacagcggggcagggttgaagtggaagaatgtggccaggcagctgaaagaagatctgtccagcatcatcctcctatcagaggaggacctccagatgcttgttgacgctccctgctcagacctggctcaggaactacgtcagagttgtgccaccgtccagcggctgcagcacacactccaacaggtgcttgaccaaagagaggaagtgcgtcagtccaagcagctcctgcagctgtacctccaggctttggagaaagagggcagcctcttgtcaaagcaggaagagtccaaagctgcctttggtgaggaggtggatgcagtagacacgggtatcagcagagagacctcctcggacgttgcgctggcgagccacatccttactgcactgagggagaagcaggctccagagctgagcttatctagtcaggatttggaggtgggcggaaaccagggtcactgagctacagaggaggacatgccctgggatgtagtagtatcatgcagaggtgtgtgggcccttttgttcacctctgcagactgtgaatcctagctgccagtttgcctattatatgccaaggcatttgcaaaaatctcattaatctaaatcaaaatagctttaaagaaaaatgcatacacttcctcagatcatcaaacagactctggtccaaggttggtaatgaaatgactgttcctgacagggaggaatagcagggcccaatcttctgagatggcttctgggtctttccatggtcagagaagatctatagtccgtcctgaggtctgtcaatgtcacaggaaaaggcaaacttgaggggatcgtcgcctgctggctaagaccagggagctaaaaacttgaggaagggaacctgcctgggtgggtgctacttctgattcattgtccttgtccctgtcataagtacctccctattgtagatagaagggaaggaaactgttgacttgagcttggctaaatttcctgaaggtggaggaccttagagttgctccaagtaaactttccaaggactt

SEQ ID NO: 559 - DNA, 6032 bp, Homo sapiens
gagtagaaggaccgccgctccggcctcccgcgacttctcgaaggtgggcaggtcccaccttgtggaggatggaggtgaccggggacgccggggtaccagaatctggcgagatccggactctaaagccgtgtctgctgcgccgcaactacagccgcgaacagcacggcgtggccgcctcctgcctcgaagacctgaggagcaaggcctgtgacattctggccattgataagtccctgacaccagtcaccctggtcctggcagaggatggcaccatagtggatgatgacgattactttctgtgtctaccttccaatactaagtttgtggcattggctagtaatgagaaatgggcatacaacaattcagatggaggtacagcttggatttcccaagagtcctttgatgtagatgaaacagacagcggggcagggttgaagtggaagaatgtggccaggcagctgaaagaagatctgtccagcatcatcctcctatcagaggaggacctccagatgcttgttgacgctccctgctcagacctggctcaggaactacgtcagagttgtgccaccgtccagcggctgcagcacacactccaacaggtgcttgaccaaagagaggaagtgcgtcagtccaagcagctcctgcagctgtacctccaggctttggagaaagagggcagcctcttgtcaaagcaggaagagtccaaagctgcctttggtgaggaggtggatgcagtagacacgggtatcagcagagagacctcctcggacgttgcgctggcgagccacatccttactgcactgagggagaagcaggctccagagctgagcttatctagtcaggatttggagttggttaccaaggaagaccccaaagcactggctgttgccttgaactgggacataaagaagacggagactgttcaggaggcctgtgagcgggagctcgccctgcgcctgcagcagacgcagagcttgcattctctccggagcatctcagcaagcaaggcctcaccacctggtgacctgcagaatcctaagcgagccagacaggatcccacatagcagcagcgggaagtgtgccaaggaagctctgtggcgttgtgttattggtagacaccctcagcctcatcatttgactacctatgtactactctaccccctgccttagagcaccttccagagaagctattccaggtctcaacatacgccgttccaccaattttttttttagccccaccagcttcaggacttctgccaattttgaatgatatagctgcaccaacaatatcccgcctcctctaattacatatgatgttctctgttcaaaagtaattggcagtgattggccaggcgcagtggctcacgcctgtaatcccagcactgggaggccgaggggggcggatcgtgaagtcaggagatcgagaccatcctggctaacatggtgaaaccctgtctctactaaaaatacaaaaaaaattagccagccatggtggcgggcgcctgtaatcccagctacttgggaggctgaggcaggagaatggcatgaacctgggaggcagagcttgcagtgagctgagattgcgccactgcactccagcctgggcaacagagcgagactccgtctcaaaaaaaaaaaaaaaaaaagtaattggcagtgactatgggcgcactgcctaacatttagccctgccccatatggaacatgttaaaaaaaaaaaaagccaggccgagcgtgttggctcacgcttgtaatcccagcactttgggaggccgaggcgggtggatcacgaggtcaggagatcgagaccatcctggctaacacagtgaaacgtgtttttactaaaagtacaaaaaactagctgggcgtggtggcaggagcctgtagtcccagctactcgggaggctgaggcaggagaattgcttgaaccggggaggcagaagttgcagtgagccgagattatgccactgtactccagcctgggtgacagagtgacactctgtctcaaaaaaaaaaaaaaaaaggacaggcacgacagtggctcacacctttgatcccagcactttggaggccgatgcaggcggatcacatgaggtcaggagttcaagaccaacctggccaatatggtgaaaccccgtctctactaaaaatacaaaaattagctgggcatgatggcgggtgcctgtaatcccagctactcggtaggcagaggttgcagtgagctgagagcgcaccactgcactccagcctgggtgacagagctagactccgtatctcaagaaaaaaaaaaagttttgttttgtttttttgagacagagtctcactctgtcacctagtctggagtgcagtggcacattctcggctcactgcaacccccacctcccaggttcaagcgattctcctgtttcagcctcctgagcagctgggattacaggcacgtgccaccatgcccggctaatttttgtatttttagtagagacagggttttgtcacattggccaggctggtctcaaactcctgacctcaggtgatccacccacctcagcctcccaaagtgctgggattacaggtgtgagccaccacccctggccagaaaaaaaagcttttaaataaagtaattgtcagcttaggcaacatagcaagaccctgtctctacaaaaaaaaaatttaagttagccaggcatggtggcactgacctataatcctagctactctggaggctaaggcgagagtatcacttgagcccaggagctcaaggctgatcatgccaccatactccagcctggatgatagagtaagaccctacttttttttttttttttttaaaaaggtaaccatcaagggcaatgaaaagaaatggtcgtatttccaattcattatccttattctgaagatagtacggcagaattttaagcagagatagtggtgaagatggtgacattatagagtgttgactatggccacaatcttgtttctccagttaatgaatttttttatgtgtttgtttaaagatacatattaagcttgtagaccatagggacatacggagagtccattgctaatatctcactcagtattgtgaaattctatctcaccaccgtgaaactcttcagttttctaattgctttatcagcagggggtataaaaggtcatgaaagcaatttccacatgctgtggctccaggtctctgggtgtgaagcagagcaagcctggtttgtcctcctcctgtctccacacagacggcttctgcaggtttggtaatctacagtacactccttgcagggaaaaggtgatgagtcatcatggacttatttgaccactttttatgcatgcttagaggaaaacagaatactgttaagagattcatctgctagttattaagtaaagaaatatcacaataggccgggcgcagtggctcacacctgtaatcccagcattttgggaggccaaggtgggcggatcacctgaggtcaggagttcgagaccagcctagccaacatggtgaaaccccgtctctactgaaattataaaaaattagccgggtgtagtggtacacgcctgtagtcccagttacttgggaggctgaggcatgagaattgcttgaacccaggaagtggaggtggaggtgagccgaaattgtgccactgtactccagcctgcaacagagtgagacactgtcacacaaaaaagaaagaaatatcacaatatgtcacaataggccgggcgcagtggctcacacctgcagtcccagcactttgggaggccaaggcagatggatcacctgaggtcaggagtttgagaccagcctggccaacgtgacaaaacccagtctactaaaaatacaaaaattagccaggcgtgatggtgggcacctgtaatcccagctactcaggaggctgagacatgagaatcgcttgaacccaggaggtggagattgcactgagctgagatcctgccactgggctccagcctgggtgacagaatgagactctgtctttaaaaaaaaaaaaaaaagaaaatcacaataagtcctagggtaaagatgggggtacagaaaacaattaaatagaacaaaaacaactgtttccttttcctgtgattcaagaagggcttagatcttctactcagcatccttttactaatgccctccattggctctcaccccaacatttccttttttatagcttattttgtaatgcctccttaattatcctttaatagaagccaccgctgataagctacctacactcatacagaagcattaatataatgccccagatgtactgtttcagggcaaaaaggaaaataatttccaacaaagtggtgtgtgtttcactgtcagatgcttgcacttacacacggaatcgctgtgcatccgacagaggctgattggcacatggggcacggggattgtcagctcaaacaccgtcagcagcgttgcccttggaaatgggatttcccagaacagtaaacgtgtctgtccttgatttacagagtagctacattcctaggaaatccagggtacattaaaactcaccatgttacccaggctggtctcaaactccaggcctcaagcaatcctcccacatcagcttcccagaattttgggattacaggcatgagccaccacacccagccagaatattttatttctgttagacacacagagcgttcgttgactcgtctgggcgttagtgttaatattctgtacttgaagcaagcccaccaagcggctgaactgggtggataatggaaaatgtcctgtggatttgggagtgagacaaaccggcttgagtctaacctctcagttagtctaaggctccaagcttgaaagggttaaatgaagtactatatttgttttgtttcgttttcgttttgtttgaggctttgctctgttgcccaggctggagtgtagtggcacaatctctgctcactgcaacctccatctcccaggttcaggcgattctcttgcctcagcctccagagtagctgggattacaggtgcccgccaccacacccggctaagttttttttggtatttttagtagacacagggtttcaccatgttggctagactggtctcaaactcctgacctcaagtgatccacctgccttggcctcccaaagtgctgggagtataggtggtgagccaccacgcctggcctaaatgaagtaccacatgaccgacagaccgacctggggaacatagcaagaccccatctctacaaaaatgtaaaaaataaaaattagccgggtgtagtggtacatgcctgtaatcctagatactcgggaggctaaggcagaaggatcacttgagcccaggagttcgaggctacaatgagctgtgatcgtgccactgcactccatcctgggtggcagagtgaggccctgtctcaaaataaataatccagtcccccccaagaaaggaatgaagtgctataatgagaaaaatcctagtacctaacatatagtagacagtggagagtggttctctttcgtttctcaggggcagacagatggggtgctggagtcctctatcaaagagtcagagctctatcccagatgtgtaatgaacgtggtcacagacatattgtcccattaccatttaccttccctataaccactgtgcctccagccttgtagaatagacacataggagcgcagcaatacgtctaaaaataggagtgagagagggcagggcatgcccgttcttgtggtagaagaaaagaatgtcaaagaaagcagctgggactaatgaactttacattagccatattccattatttcagcttaagtcaaatgtcggtcctcatgaggcaactggctttgacaggagctacgctaattaccacttaccaacctttaatttctgggtaaaagcaaaagagaaaaactaatggatttttcattttccagagagacaagaataaaataatagtagtctgtagaaaaaagaaaacctgcatcaattacaagaattattaatgtatctttaataaataaccacattatttagctgtttaatttcctaa

SEQ ID NO: 560 - DNA, 11803 bp, Homo sapiens
gggaaggagctcgccgcggcggcggcggcgctgagggaggaggcggcggcgagcggagccaggaggaggaggaggagggggagccgctcattcattttgactccgcgtttctgcccctcgccggcctcgcctgtgacccggacttcggggcgatcttgcgaactgcgtcgcgccctcccgcggcggaagctcgggcgtccggccgcctcccgcgcggccagggccgggcttgtttttcctcgcctaggcagatttgggctttgccccctttctttgcagttttccccccttcctgcctctccgggtttgaaaatggaggccgacgacgccgacagcccgccccggcgcgcctcgggttcccgactccgccgagccctgggccgctgctgccggcgctgaggggccgccccgcgccgcccgccccgtccgcgcacccggagggccccggcggcgccgccttcggagtattgtttccttcgcccttgtttttggagggggagcgaagactgagtttgagacttgtttcctttcatttcctttttttcttttcttttcttttttttttttttttttttttttgagaaaggggaatttcatcccaaataaaaggaatgaagtctggctccggaggagggtccccgacctcgctgtgggggctcctgtttctctccgccgcgctctcgctctggccgacgagtggagaaatctgcgggccaggcatcgacatccgcaacgactatcagcagctgaagcgcctggagaactgcacggtgatcgagggctacctccacatcctgctcatctccaaggccgaggactaccgcagctaccgcttccccaagctcacggtcattaccgagtacttgctgctgttccgagtggctggcctcgagagcctcggagacctcttccccaacctcacggtcatccgcggctggaaactcttctacaactacgccctggtcatcttcgagatgaccaatctcaaggatattgggctttacaacctgaggaacattactcggggggccatcaggattgagaaaaatgctgacctctgttacctctccactgtggactggtccctgatcctggatgcggtgtccaataactacattgtggggaataagcccccaaaggaatgtggggacctgtgtccagggaccatggaggagaagccgatgtgtgagaagaccaccatcaacaatgagtacaactaccgctgctggaccacaaaccgctgccagaaaatgtgcccaagcacgtgtgggaagcgggcgtgcaccgagaacaatgagtgctgccaccccgagtgcctgggcagctgcagcgcgcctgacaacgacacggcctgtgtagcttgccgccactactactatgccggtgtctgtgtgcctgcctgcccgcccaacacctacaggtttgagggctggcgctgtgtggaccgtgacttctgcgccaacatcctcagcgccgagagcagcgactccgaggggtttgtgatccacgacggcgagtgcatgcaggagtgcccctcgggcttcatccgcaacggcagccagagcatgtactgcatcccttgtgaaggtccttgcccgaaggtctgtgaggaagaaaagaaaacaaagaccattgattctgttacttctgctcagatgctccaaggatgcaccatcttcaagggcaatttgctcattaacatccgacgggggaataacattgcttcagagctggagaacttcatggggctcatcgaggtggtgacgggctacgtgaagatccgccattctcatgccttggtctccttgtccttcctaaaaaaccttcgcctcatcctaggagaggagcagctagaagggaattactccttctacgtcctcgacaaccagaacttgcagcaactgtgggactgggaccaccgcaacctgaccatcaaagcagggaaaatgtactttgctttcaatcccaaattatgtgtttccgaaatttaccgcatggaggaagtgacggggactaaagggcgccaaagcaaaggggacataaacaccaggaacaacggggagagagcctcctgtgaaagtgacgtcctgcatttcacctccaccaccacgtcgaagaatcgcatcatcataacctggcaccggtaccggccccctgactacagggatctcatcagcttcaccgtttactacaaggaagcaccctttaagaatgtcacagagtatgatgggcaggatgcctgcggctccaacagctggaacatggtggacgtggacctcccgcccaacaaggacgtggagcccggcatcttactacatgggctgaagccctggactcagtacgccgtttacgtcaaggctgtgaccctcaccatggtggagaacgaccatatccgtggggccaagagtgagatcttgtacattcgcaccaatgcttcagttccttccattcccttggacgttctttcagcatcgaactcctcttctcagttaatcgtgaagtggaaccctccctctctgcccaacggcaacctgagttactacattgtgcgctggcagcggcagcctcaggacggctacctttaccggcacaattactgctccaaagacaaaatccccatcaggaagtatgccgacggcaccatcgacattgaggaggtcacagagaaccccaagactgaggtgtgtggtggggagaaagggccttgctgcgcctgccccaaaactgaagccgagaagcaggccgagaaggaggaggctgaataccgcaaagtctttgagaatttcctgcacaactccatcttcgtgcccagacctgaaaggaagcggagagatgtcatgcaagtggccaacaccaccatgtccagccgaagcaggaacaccacggccgcagacacctacaacatcaccgacccggaagagctggagacagagtaccctttctttgagagcagagtggataacaaggagagaactgtcatttctaaccttcggcctttcacattgtaccgcatcgatatccacagctgcaaccacgaggctgagaagctgggctgcagcgcctccaacttcgtctttgcaaggactatgcccgcagaaggagcagatgacattcctgggccagtgacctgggagccaaggcctgaaaactccatctttttaaagtggccggaacctgagaatcccaatggattgattctaatgtatgaaataaaatacggatcacaagttgaggatcagcgagaatgtgtgtccagacaggaatacaggaagtatggaggggccaagctaaaccggctaaacccggggaactacacagcccggattcaggccacatctctctctgggaatgggtcgtggacagatcctgtgttcttctatgtccaggccaaaacaggatatgaaaacttcatccatctgatcatcgctctgcccgtcgctgtcctgttgatcgtgggagggttggtgattatgctgtacgtcttccatagaaagagaaataacagcaggctggggaatggagtgctgtatgcctctgtgaacccggagtacttcagcgctgctgatgtgtacgttcctgatgagtgggaggtggctcgggagaagatcaccatgagccgggaacttgggcaggggtcgtttgggatggtctatgaaggagttgccaagggtgtggtgaaagatgaacctgaaaccagagtggccattaaaacagtgaacgaggccgcaagcatgcgtgagaggattgagtttctcaacgaagcttctgtgatgaaggagttcaattgtcaccatgtggtgcgattgctgggtgtggtgtcccaaggccagccaacactggtcatcatggaactgatgacacggggcgatctcaaaagttatctccggtctctgaggccagaaatggagaataatccagtcctagcacctccaagcctgagcaagatgattcagatggccggagagattgcagacggcatggcatacctcaacgccaataagttcgtccacagagaccttgctgcccggaattgcatggtagccgaagatttcacagtcaaaatcggagattttggtatgacgcgagatatctatgagacagactattaccggaaaggagggaaagggctgctgcccgtgcgctggatgtctcctgagtccctcaaggatggagtcttcaccacttactcggacgtctggtccttcggggtcgtcctctgggagatcgccacactggccgagcagccctaccagggcttgtccaacgagcaagtccttcgcttcgtcatggagggcggccttctggacaagccagacaactgtcctgacatgctgtttgaactgatgcgcatgtgctggcagtataaccccaagatgaggccttccttcctggagatcatcagcagcatcaaagaggagatggagcctggcttccgggaggtctccttctactacagcgaggagaacaagctgcccgagccggaggagctggacctggagccagagaacatggagagcgtccccctggacccctcggcctcctcgtcctccctgccactgcccgacagacactcaggacacaaggccgagaacggccccggccctggggtgctggtcctccgcgccagcttcgacgagagacagccttacgcccacatgaacgggggccgcaagaacgagcgggccttgccgctgccccagtcttcgacctgctgatccttggatcctgaatctgtgcaaacagtaacgtgtgcgcacgcgcagcggggtggggggggagagagagttttaacaatccattcacaagcctcctgtacctcagtggatcttcagaactgcccttgctgcccgcgggagacagcttctctgcagtaaaacacatttgggatgttccttttttcaatatgcaagcagctttttattccctgcccaaacccttaactgacatgggcctttaagaaccttaatgacaacacttaatagcaacagagcacttgagaaccagtctcctcactctgtccctgtccttccctgttctccctttctctctcctctctgcttcataacggaaaaataattgccacaagtccagctgggaagccctttttatcagtttgaggaagtggctgtccctgtggccccatccaaccactgtacacacccgcctgacaccgtgggtcattacaaaaaaacacgtggagatggaaatttttacctttatctttcacctttctagggacatgaaatttacaaagggccatcgttcatccaaggctgttaccattttaacgctgcctaattttgccaaaatcctgaactttctccctcatcggcccggcgctgattcctcgtgtccggaggcatgggtgagcatggcagctggttgctccatttgagagacacgctggcgacacactccgtccatccgactgcccctgctgtgctgctcaaggccacaggcacacaggtctcattgcttctgactagattattatttgggggaactggacacaataggtctttctctcagtgaaggtggggagaagctgaaccggcttccctgccctgcctccccagccccctgcccaacccccaagaatctggtggccatgggccccgaagcagcctggcggacaggcttggagtcaaggggccccatgcctgcttctctcccagccccagctcccccgcccgcccccaaggacacagatgggaaggggtttccagggactcagccccactgttgatgcaggtttgcaaggaaagaaattcaaacaccacaacagcagtaagaagaaaagcagtcaatggattcaagcattctaagctttgttgacattttctctgttcctaggacttcttcatgggtcttacagttctatgttagaccatgaaacatttgcatacacatcgtctttaatgtcacttttataacttttttacggttcagatattcatctatacgtctgtacagaaaaaaaaaagctgctattttttttgttcttgatctttgtggatttaatctatgaaaaccttcaggtccaccctctcccctttctgctcactccaagaaacttcttatgctttgtactagagtgcgtgactttcttcctcttttcccggtaatggatacttctatcacataatttgccatgaactgttggatgcctttttataaatacatcccccatccctgctcccacctgcccctttagttgttttctaacccgtaggctctctgggcacgaggcagaaagcaggccgggcacccatcctgagagggccgcgctcctctccccagcctgccctcacagcattggagcctgttacagtgcaagacatgatacaaactcaggtcagaaaaacaaaggttaaatatttcacacgtctttgttcagtgtttccactcaccgtggttgagaagcctcaccctctctttcccttgcctttgcttaggttgtgacacacatatatatatatttttttaattcttgggtacaacagcagtgttaaccgcagacactaggcatttggattactatttttcttaatggctatttaatccttccatcccacgaaaaacagctgctgagtccaagggagcagcagagcgtggtccggcagggcctgttgtggccctcgccacccccctcaccggaccgactgacctgtctttggaaccagaacatcccaagggaactccttcgcactggcgttgagtgggaccccgggatccaggctggcccagggcggcaccctcagggctgtgcccgctggagtgctaggtggaggcagcacagacgccacggtggcccaagagcccctttgcttcttgctgggggaccagggctgtggtgctggcccactttccctcggccaggaatccaggtccttggggcccaggggtcttgtcttgtttcatttttagcacttctcaccagagagatgacagcacaagagttgcttctgggatagaaatgtttaggagtaagaacaaagctgggatacggtgattgctagttgtgactgaagattcaacacagaaaagaaagtttatacggcttttttgctggtcagcagtttgtcccactgctttctctagtctctatcccatagcgtgttccctttaaaaaaaaaaaaaaggtattatatgtaggagttttcttttaatttattttgtgataaattaccagtttcaatcactgtagaaaagccccattatgaatttaaatttcaaggaaagggtgtgtgtgtgtgtatgtgtggggtgtgtgtgtgtgagagtgatgggacagttcttgattttttgggttttttttcccccaaacatttatctacctcactcttattttttatatgtgtatatagacaaaagaatacatctcacctttctcagcacctgacaataggccgttgatactggtaacctcatccacgccacaggcgccacacccaggtgatgcagggggaagccaggctgtattccggggtcaaagcaacactaactcacctctctgctcatttcagacagcttgcctttttctgagatgtcctgttttgtgttgctttttttgttttgttttctatcttggtttccaccaaggtgttagatttctcctcctcctagccaggtggccctgtgaggccaacgagggcaccagagcacacctgggggagccaccaggctgtccctggctggttgtctttggaacaaactgcttctgtgcagatggaatgaccaacacatttcgtccttaagagagcagtggttcctcaggttctgaggagaggaaggtgtccaggcagcaccatctctgtgcgaatccccagggtaaaggcgtggggcattgggtttgctccccttgctgctgctccatccctgcaggaggctcgcgctgaggcaggaccgtgcggccatggctgctgcattcattgagcacaaaggtgcagctgcagcagcagctggagagcaagagtcacccagcctgtgcgccagaatgcagaggctcctgacctcacagccagtccctgatagaacacacgcaggagcagagtcccctccccctccaggctgccctctcaacttctccctcacctccttccctaggggtagacagagatgtaccaaaccttccggctggaaagcccagtggccggcgccgaggctcgtggcgtcacgccccccccgccagggctgtacctccgtctccctggtcctgctgctcacaggacagacggctcgctcccctcttccagcagctgctcttacaggcactgatgatttcgctgggaagtgtggcgggcagctttgcctaagcgtggatggctcctcggcaattccagcctaagtgaaggcgctcaggagcctcctgctggaacgcgacccatctctcccaggaccccggggatcttaaggtcattgagaaatactgttggatcagggttttgttcttccacactgtaggtgaccccttggaataacggcctctcctctcgtgcacatacctaccggtttccacaactggatttctacagatcattcagctggttataagggttttgtttaaactgtccgagttactgatgtcattttgtttttgttttatgtaggtagcttttaagtagaaaacactaacagtgtagtgcccatcatagcaaatgcttcagaaacacctcaataaaagagaaaacttggcttgtgtgatggtgcagtcactttactggaccaacccacccaccttgactataccaaggcatcatctatccacagttctagcctaacttcatgctgatttctctgcctcttgatttttctctgtgtgttccaaataatcttaagctgagttgtggcattttccatgcaacctccttctgccagcagctcacactgcttgaagtcatatgaaccactgaggcacatcatggaattgatgtgagcattaagacgttctcccacacagcccttccctgaggcagcaggagctggtgtgtactggagacactgttgaacttgatcaagacccagaccaccccaggtctccttcgtgggatgtcatgacgtttgacatacctttggaacgagcctcctccttggaagatggaagaccgtgttcgtggccgacctggcctctcctggcctgtttcttaagatgcggagtcacatttcaatggtacgaaaagtggcttcgtaaaatagaagagcagtcactgtggaactaccaaatggcgagatgctcggtgcacattggggtgctttgggataaaagatttatgagccaactattctctggcaccagattctaggccagtttgttccactgaagcttttcccacagcagtccacctctgcaggctggcagccgaatggcttgccagtggctctgtggcaagatcacactgagatcgatgggtgagaaggctaggatgcttgtctagtgttcttagctgtcacgttggctccttccagggtggccagacggtgttggccactcccttctaaaacacaggcgccctcctggtgacagtgacccgccgtggtatgccttggcccattccagcagtcccagttatgcatttcaagtttggggtttgttcttttcgttaatgttcctctgtgttgtcagctgtcttcatttcctgggctaagcagcattgggagatgtggaccagagatccactccttaagaaccagtggcgaaagacactttctttcttcactctgaagtagctggtggtacaaatgagaacttcaagagaggatgttatttagactgaacctctgttgccagagatgctgaagatacagaccttggacaggtcagagggtttcatttttggccttcatcttagatgactggttgcgtcatttggagaagtgagtgctccttgatggtggaatgaccgggtggtgggtacagaaccattgtcacagggatcctggcacagagaagagttacgagcagcagggtgcagggcttggaaggaatgtgggcaaggttttgaacttgattgttcttgaagctatcagaccacatcgaggctcagcagtcatccgtgggcatttggtttcaacaaagaaacctaacatcctactctggaaactgatctcggagttaaggcgaattgttcaagaacacaaactacatcgcactcgtcagttgtcagttctggggcatgactttagcgttttgtttctgcgagaacataacgatcactcatttttatgtcccacgtgtgtgtgtccgcatctttctggtcaacattgttttaactagtcactcattagcgttttcaatagggctcttaagtccagtagattacgggtagtcagttgacgaagatctggtttacaagaactaattaaatgtttcattgcatttttgtaagaacagaataattttataaaatgtttgtagtttataattgccgaaaataatttaaagacactttttttttctctgtgtgtgcaaatgtgtgtttgtgatccattttttttttttttttttaggacacctgtttactagctagctttacaatatgccaaaaaaggatttctccctgaccccatccgtggttcaccctcttttccccccatgctttttgccctagtttataacaaaggaatgatgatgatttaaaaagtagttctgtatcttcagtatcttggtcttccagaaccctctggttgggaaggggatcattttttactggtcatttccctttggagtgtagctactttaacagatggaaagaacctcattggccatggaaacagccgaggtgttggagcccagcagtgcatggcaccgttcggcatctggcttgattggtctggctgccgtcattgtcagcacagtgccatggacatgggaagacttgactgcacagccaatggttttcatgatgattacagcatacacagtgatcacataaacgatgacagctatggggcacacaggccatttgcttacatgcctcgtatcatgactgattactgctttgttagaacacagaagagaccctattttatttaaggcagaaccccgaagatacgtatttccaatacagaaaagaatttttaataaaaactataacatacacaaaaattggttttaaagttgactccacttcctctaactccagtggattgttggccatgtctccccaactccacaatatctctatcatgggaaacacctggggtttttgcgctacataggagaaagatctggaaactatttgggttttgttttcaacttttcatttggatgtttggcgttgcacacacacatccaccggtggaagagacgcccggtgaaaacacctgtctgctttctaagccagtgaggttgaggtgagaggtttgccagagtttgtctacctctgggtatccctttgtctgggataaaaaaaatcaaaccagaaggcgggatggaatggatgcaccgcaaataatgcattttctgagttttcttgttaaaaaaaaatttttttaagtaagaaaaaaaaaggtaataacatggccaatttgttacataaaatgactttctgtgtataaattattcctaaaaaatcctgtttatataaaaaatcagtagatgaaaaaaatttcaaaatgtttttgtatattctgttgtaagaatttattcctgttattgcgatatactctggattctttacataatggaaaaaagaaactgtctattttgaatggctgaagctaaggcaacgttagtttctcttactctgcttttttctagtaaagtactacatggtttaagttaaataaaataattctgtatgca

SEQ ID NO: 561 - DNA, 3625 bp, Homo sapiens
cgcgagaacaaagacgcgcgagcatcggcggcccggaaccggccttggaacaactgtggaacctgaggccgcttgccctcccgccccatggagcggcccccggggctgcggccgggcgcgggcgggccctgggagatgcgggagcggctgggcaccggcggcttcgggaacgtctgtctgtaccagcatcgggaacttgatctcaaaatagcaattaagtcttgtcgcctagagctaagtaccaaaaacagagaacgatggtgccatgaaatccagattatgaagaagttgaaccatgccaatgttgtaaaggcctgtgatgttcctgaagaattgaatattttgattcatgatgtgcctcttctagcaatggaatactgttctggaggagatctccgaaagctgctcaacaaaccagaaaattgttgtggacttaaagaaagccagatactttctttactaagtgatatagggtctgggattcgatatttgcatgaaaacaaaattatacatcgagatctaaaacctgaaaacatagttcttcaggatgttggtggaaagataatacataaaataattgatctgggatatgccaaagatgttgatcaaggaagtctgtgtacatcttttgtgggaacactgcagtatctggccccagagctctttgagaataagccttacacagccactgttgattattggagctttgggaccatggtatttgaatgtattgctggatataggccttttttgcatcatctgcagccatttacctggcatgagaagattaagaagaaggatccaaagtgtatatttgcatgtgaagagatgtcaggagaagttcggtttagtagccatttacctcaaccaaatagcctttgtagtttagtagtagaacccatggaaaactggctacagttgatgttgaattgggaccctcagcagagaggaggacctgttgaccttactttgaagcagccaagatgttttgtattaatggatcacattttgaatttgaagatagtacacatcctaaatatgacttctgcaaagataatttcttttctgttaccacctgatgaaagtcttcattcactacagtctcgtattgagcgtgaaactggaataaatactggttctcaagaacttctttcagagacaggaatttctctggatcctcggaaaccagcctctcaatgtgttctagatggagttagaggctgtgatagctatatggtttatttgtttgataaaagtaaaactgtatatgaagggccatttgcttccagaagtttatctgattgtgtaaattatattgtacaggacagcaaaatacagcttccaattatacagctgcgtaaagtgtgggctgaagcagtgcactatgtgtctggactaaaagaagactatagcaggctctttcagggacaaagggcagcaatgttaagtcttcttagatataatgctaacttaacaaaaatgaagaacactttgatctcagcatcacaacaactgaaagctaaattggagttttttcacaaaagcattcagcttgacttggagagatacagcgagcagatgacgtatgggatatcttcagaaaaaatgctaaaagcatggaaagaaatggaagaaaaggccatccactatgctgaggttggtgtcattggatacctggaggatcagattatgtctttgcatgctgaaatcatggagctacagaagagcccctatggaagacgtcagggagacttgatggaatctctggaacagcgtgccattgatctatataagcagttaaaacacagaccttcagatcactcctacagtgacagcacagagatggtgaaaatcattgtgcacactgtgcagagtcaggaccgtgtgctcaaggagctgtttggtcatttgagcaagttgttgggctgtaagcagaagattattgatctactccctaaggtggaagtggccctcagtaatatcaaagaagctgacaatactgtcatgttcatgcagggaaaaaggcagaaagaaatatggcatctccttaaaattgcctgtacacagagttctgcccggtcccttgtaggatccagtctagaaggtgcagtaacccctcagacatcagcatggctgcccccgacttcagcagaacatgatcattctctgtcatgtgtggtaactcctcaagatggggagacttcagcacaaatgatagaagaaaatttgaactgccttggccatttaagcactattattcatgaggcaaatgaggaacagggcaatagtatgatgaatcttgattggagttggttaacagaatgagttgtcacttgttcactgtccccaaacctatggaagttgttgctatacatgttggaaatgtgtttttcccccatgaaaccattcttcagacatcagtcaatggaagaaatggctatgaacagaaactacatttctactatgatcagaagaacatgattttacaagtataacagttttgagtaattcaagcctctaaacagacaggaatttagaaaaagtcaatgtacttgtttgaatatttgttttaataccacagctatttagaagcatcatcacgacacatttgccttcagtcttggtaaaacattacttatttaactgattaaaaataccttctatgtattagtgtcaacttttaacttttgggcgtaagaccaaatgtagttttgtatacagagaagaaaacctcaagtaataggcattttaagtaaaagtctacctgtgtttttttctaaaaaggctgctcacaagttctatttcttgaagaataaattctacctccttgtgttgcactgaacaggttctcttcctggcatcataaggagttggtgtaatcattttaaattccactgaaaatttaacagtatccccttctcatcgaagggattgtgtatctgtgcttctaatattagttggctttcataaatcatgttgttgtgtgtatatgtatttaagatgtacatttaataatatcaaagagaagatgcctgttaatttataatgtatttgaaaattacatgttttttcatttgtaaaaatgagtcatttgtttaaacaatctttcatgtcttgtcatacaaatttataaaggtctgcactcctttatctgtaattgtaattccaaaatccaaaaagctctgaaaacaaggtttccataagcttggtgacaaaattcatttgcttgcaatctaatctgaactgaccttgaatctttttatcccatttagtgtgaatattcctttattttgctgcttgatgatgagagggagggctgctgccacagactgtggtgagggctggttaatgtagtatggtatatgcacaaaactacttttctaaaatctaaaatttcataattctgaaacaacttgccccaagggtttcagagaaaggactgtggacctctatcatctgctaagtaatttagaagatattatttgtcttaaaaaatgtgaaatgcttttatattctaatagtttttcactttgtgtattaaatggtttttaaattactttcttgatctctattcattataaaaatcagattataataaaacagttgaatatggcttaggaaaata

SEQ ID NO: 562 - DNA, 2778 bp, Homo sapiens
agtgtttgaggaagtcgcgccgcgctgcccgcgttaagattcccgcattttaatgttttcaggggggtgtcatagccccgggtttggccgccccagccccgccttccccgccccggggagcccgccccctgccccgcgtccctgccgacagagttagcacgacatcagtatgagctggtcaccttccctgacaacgcagacatgtggggcctgggaaatgaaagagcgccttgggacagggggatttggaaatgtcatccgatggcacaatcaggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcacatcagataaactgctgctggcctggagggaaatggagcaggctgtggagctctgtgggcgggagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggccctagactggagctggttacagacggaagaagaagagcacagctgcctggagcaggcctcatgatgtggggggactcgaccccctgacatggggcagcccatagcaggccttgtgcagtggggggactcgaccccctgacatggggctgcctggagcaggccgcgtgacgtggggctgcctggccgcggctctcacatggtggttcctgctgcactgatggcccaggggtctctggtatccagatggagctctcgcttcctcagcagctgtgactttcacccaggacccaggacgcagccctccgtgggcactgccggcgccttgtctgcacactggaggtcctccattacagaggcccagcgcacatcgctggccccacaaacgttcaggggtacagccatggcagctccttcctctgccgtgagaaaagtgcttggagtacggtttgccacacacgtgactggacagtgtccaattcaaatctttcagggcagagtccgagcagcgcttggtgacagcctgtcctctcctgctctccaaaggccctgctccctgtcctctctcactttacagcttgtgtttcttctggattcagcttctcctaaacagacagtttaattatagttgcggcctggccccatcctcacttcctctttttatttcactgctgctaaaattgtgtttttacctactactttggtggttgtcctcttttcggcaaagttggagcgagtgccaagctctccatctgtggtcctttctgccaagagcgactcatagtaaccaggatgggagagcagctgccttattctgaatcccaaaaattacttgggggtgattgtcacagaggagggacagaaagggtatctgctgaccaccagcctgcctacccatgcccatgtctccattcctgctcaagcgtgtgtgctgggccggggagtccctgtctctcacagcatctagcagtattattaaatggattcatttt

SEQ ID NO: 563 - DNA, 2501 bp, Homo sapiens
ggaagtgtttgaggaagtcgcgccgcgctgcccgcgttaagattcccgcattttaatgttttcaggggggtgtcatagccccgggtttggccgccccagccccgccttccccgccccggggagcccgccccctgccccgcgtccctgccgacagagttagcacgacatcagtatgagctggtcaccttccctgacaacgcagacatgtggggcctgggaaatgaaagagcgccttgggacagggggatttggaaatgtcatccgatggcacaatcaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattgacctaggatatgccaaggagctggatcagggcagtctttgcacatcattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcacatcagataaactgctgctggcctggagggaaatggagcaggctgtggagctctgtgggcgggagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggccctagactggagctggttacagacggaagaagaagagcacagctgcctggagcaggcctcatgatgtggggggactcgaccccctgacatggggcagcccatagcaggccttgtgcagtggggggactcgaccccctgacatggggctgcctggagcaggccgcgtgacgtggggctgcctggccgcggctctcacatggtggttcctgctgcactg

SEQ ID NO: 564 - DNA, 3086 bp, Homo sapiens
gtgacgtcagagcaggaagtgtttgaggaagtcgcgccgcgctgcccgcgttaagattcccgcattttaatgttttcaggggggtgtcatagccccgggtttggccgccccagccccgccttccccgccccggggagcccgccccctgccccgcgtccctgccgacagagttagcacgacatcagtatgagctggtcaccttccctgacaacgcagacatgtggggcctgggaaatgaaagagcgccttgggacagggggatttggaaatgtcatccgatggcacaatcaggaaacaggtgagcagattgccatcaagcagtgccggcaggagctcagcccccggaaccgagagcggtggtgcctggagatccagatcatgagaaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattgacctaggatatgccaaggagctggatcagggcagtctttgcacatcattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcacatcagataaactgctgctggcctggagggaaatggagcaggctgtggagctctgtgggcgggagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggccctagactggagctggttacagacggaagaagaagagcacagctgcctggagcaggcctcatgatgtggggggactcgaccccctgacatggggcagcccatagcaggccttgtgcagtggggggactcgaccccctgacatggggctgcctggagcaggccgcgtgacgtggggctgcctggccgcggctctcacatggtggttcctgctgcactgatggcccaggggtctctggtatccagatggagctctcgcttcctcagcagctgtgactttcacccaggacccaggacgcagccctccgtgggcactgccggcgccttgtctgcacactggaggtcctccattacagaggcccagcgcacatcgctggccccacaaacgttcaggggtacagccatggcagctccttcctctgccgtgagaaaagtgcttggagtacggtttgccacacacgtgactggacagtgtccaattcaaatctttcagggcagagtccgagcagcgcttggtgacagcctgtcctctcctgctctccaaaggccctgctccctgtcctctctcactttacagcttgtgtttcttctggattcagcttctcctaaacagacagtttaattatagttgcggcctggccccatcctcacttcctctttttatttcactgctgctaaaattgtgtttttacctac

SEQ ID NO: 565 - DNA, 1751 bp, Homo sapiens
tggtagggaagggcgaccgcgaaactgggactttctcggagcgccggggccctaccagcgttcacagtccgccgctcccacccttctcacgtctgacggactctgctgacagcccttgccctgttggatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcggaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccaaacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtagggccggccagtgcaaggccactgcctgccgaggacgtgcccgggaccgtgcagtctgcgctttcctctcccgcctgcctagcccaggatgaagggctgggtggccacaactgggatgccacctggagccccacccaggagctggccgcggcaccttacgcttcagctgttgatccgctggtcccctcttttggggtagatgcggccccgatcaggcctgactcgctgctctttttgttcccttctgtctgctcgaaccacttgcctcgggctaatccctccctcttcctccacccggcactggggaagtcaagaatggggcctggggctctcagggagaactgcttcccctggcagagctgggtggcagctcttcctcccaccggacaccgacccgcccgctgctgtgccctgggagtgctgccctcttaccatgcacacgggtgctctccttttgggctgcatgctattccattttgcagccagaccgatgtgtatttaaccagtcactattgatg

SEQ ID NO: 566 - DNA, 2103 bp, Homo sapiens
agcccgttcctgctccgcgcttctggagcactggccaaggcgggccgattcaggacccaggttacttgggcggcgagctggactgtttctactcctccctcctcctccactgcggggtctgaccctactccttgtgtgaggactcctctagttcagagacatattctgttcaccaaacttgactgcgctctatcgaggtcgttaaattcttcggaaatgcctcacatatagtttggcagctagcccttgccctgttggatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccaaacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtagggccggccagtgcaaggccactgcctgccgaggacgtgcccgggaccgtgcagtctgcgctttcctctcccgcctgcctagcccaggatgaagggctgggtggccacaactgggatgccacctggagccccacccaggagctggccgcggcaccttacgcttcagctgttgatccgctggtcccctcttttggggtagatgcggccccgatcaggcctgactcgctgctctttttgttcccttctgtctgctcgaaccacttgcctcgggctaatccctccctcttcctccacccggcactggggaagtcaagaatggggcctggggctctcagggagaactgcttcccctggcagagctgggtggcagctcttcctcccaccggacaccgacccgcccgctgctgtgccctgggagtgctgccctcttaccatgcacacgggtgctctccttttgggctgcatgctattccattttgcagccagaccgatgtgtatttaaccagtcactattgatggacatttgggttgtttcccatctttttgttaccataaataatggcatagtaaaaatccttgtgcatta

SEQ ID NO: 567 - DNA, 2286 bp, Homo sapiens
gttcgcgggtcaagccggccctattgggcagtctcttcttgattcctcccccggagagggcggggcggccgagcgccccgaggctagacgccgccgtccgagagacgagggggcgtgtaggcggtgacgccctgcaaagtggccggcgtgcttatcattaccgagcttccgcgggcctgcagagcctggcggactcagacttctctccggagcgggatgcggccctaccgcggcctcacacttctcgccggcttcccgagttctcgggggcggggcttgtgtttttacttccggatcccacagctatgacaccggaagccggaagcgtggtagggaagggcgaccgcgaaactgggactttctcggagcgccggggccctaccagcgttcacagtccgccgctcccacccttctcacgtctgacggactctgctgacagcccttgccctgttggatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccaaacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtagggccggccagtgcaaggccactgcctgccgaggacgtgcccgggaccgtgcagtctgcgctttcctctcccgcctgcctagcccaggatgaagggctgggtggccacaactgggatgccacctggagccccacccaggagctggccgcggcaccttacgcttcagctgttgatccgctggtcccctcttttggggtagatgcggccccgatcaggcctgactcgctgctctttttgttcccttctgtctgctcgaaccacttgcctcgggctaatccctccctcttcctccacccggcactggggaagtcaagaatggggcctggggctctcagggagaactgcttcccctggcagagctgggtggcagctcttcctcccaccggacaccgacccgcccgctgctgtgccctgggagtgctgccctcttaccatgcacacgggtgctctccttttgggctgcatgctattccattttgcagccagaccgatgtgtatttaaccagtcactattgatggacatttgggttgtttcccatctttttgttaccataaataatggcatagtaaaaa

SEQ ID NO: 568 - DNA, 1972 bp, Homo sapiens
catggcccttgtgatccaggtggggaaactaaggcccagagaagtgaggaccccgcagactatcaatcccagtctcttcccctcactccctgtgaagctctccagcatcatcgaggtcccatcagcccttgccctgttggatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccaaacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtagggccggccagtgcaaggccactgcctgccgaggacgtgcccgggaccgtgcagtctgcgctttcctctcccgcctgcctagcccaggatgaagggctgggtggccacaactgggatgccacctggagccccacccaggagctggccgcggcaccttacgcttcagctgttgatccgctggtcccctcttttggggtagatgcggccccgatcaggcctgactcgctgctctttttgttcccttctgtctgctcgaaccacttgcctcgggctaatccctccctcttcctccacccggcactggggaagtcaagaatggggcctggggctctcagggagaactgcttcccctggcagagctgggtggcagctcttcctcccaccggacaccgacccgcccgctgctgtgccctgggagtgctgccctcttaccatgcacacgggtgctctccttttgggctgcatgctattccattttgcagccagaccgatgtgtatttaaccagtcactattgatggacatttgggttgtttcccatctttttgttaccataaataatggcatagtaaaaa

SEQ ID NO: 569 - DNA, 2056 bp, Homo sapiens
cctgaacgcccatcaagcccatggcccttgtgatccaggtggggaaactaaggcccagagaagtgaggaccccgcagactatcaatcccagtctcttcccctcactccctgtgaagctctccagcatcatcgaggtcccatcaggtggggaaagatgctgttccaggcgcacactagtctacaaggccagagctttctggaagggggcacccttgccctgttggatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccaaacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtagggccggccagtgcaaggccactgcctgccgaggacgtgcccgggaccgtgcagtctgcgctttcctctcccgcctgcctagcccaggatgaagggctgggtggccacaactgggatgccacctggagccccacccaggagctggccgcggcaccttacgcttcagctgttgatccgctggtcccctcttttggggtagatgcggccccgatcaggcctgactcgctgctctttttgttcccttctgtctgctcgaaccacttgcctcgggctaatccctccctcttcctccacccggcactggggaagtcaagaatggggcctggggctctcagggagaactgcttcccctggcagagctgggtggcagctcttcctcccaccggacaccgacccgcccgctgctgtgccctgggagtgctgccctcttaccatgcacacgggtgctctccttttgggctgcatgctattccattttgcagccagaccgatgtgtatttaaccagtcactattgatggacatttgggttgtttcccatctttttgttaccataaataatggcatagtaaaaa

SEQ ID NO: 570 - DNA, 940 bp, Homo sapiens
ccacgctccaggccgtttgttcctgctgctccctttgggattaactagagattgaaccggctcaccttgtttcagctcaggccctgcaaccgaccgaccgtctgctgggctccaagtcacctgagaggcgaggtgaggtggggaaactaaggcccagagaagtgaggaccccgcagactatcaatcccagtctcttcccctcactccctgtgaagctctccagcatcatcgaggtcccatcaggtggggaaagatgctgttccaggcgcacactagtctacaaggccagagctttctggaagggggcacccttgccctgttggatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcaggg

SEQ ID NO: 571 - DNA, 960 bp, Homo sapiens
acagactccagaaaggtactggtggcaggggactggtctgctgagtcacagcaaccccacgctccaggccgtttgttcctgctgctccctttgggattaactagagattgaaccggctcaccttgtttcagctcaggccctgcaaccgaccgaccgtctgctgggctccaagtcacctgagaggcgaggtgagcccttgccctgttggatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtggg

SEQ ID NO: 572 - DNA, 693 bp, Homo sapiens
gagctcaacttagcagagcctgtggggccctgcaacaattagttggaaaagctgaggcatggagcaggcacttcctggcttttaagattggggcctgggagatactcaccgatgcacccatgatgatgaatatgtgtgtatccgactgatggaaggcatcgccctggaaaagctcttcccgcaggatcccgcacacctgggtccggctcagggccacctgctctgccatgacgctgtctggtggaagaaaggctcgttaacaagcccttgccctgttggatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggac

SEQ ID NO: 573 - DNA, 1949 bp, Homo sapiens
gaagggcgaccgcgaaactgggactttctcggagcgccggggccctaccagcgttcacagtccgccgctcccacccttctcacgtctgacggactctgctgacagcccttgccctgttggatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccaaacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtagggccggccagtgcaaggccactgcctgccgaggacgtgcccgggaccgtgcagtctgcgctttcctctcccgcctgcctagcccaggatgaagggctgggtggccacaactgggatgccacctggagccccacccaggagctggccgcggcaccttacgcttcagctgttgatccgctggtcccctcttttggggtagatgcggccccgatcaggcctgactcgctgctctttttgttcccttctgtctgctcgaaccacttgcctcgggctaatccctccctcttcctccacccggcactggggaagtcaagaatggggcctggggctctcagggagaactgcttcccctggcagagctgggtggcagctcttcctcccaccggacaccgacccgcccgctgctgtgccctgggagtgctgccctcttaccatgcacacgggtgctctccttttgggctgcatgctattccattttgcagccagaccgatgtgtatttaaccagtcactattgatggacatttgggttgtttcccatctttttgttaccataaataatggcatagtaaaaa

SEQ ID NO: 574 - DNA, 3666 bp, Homo sapiens
gcgcaagatggcggcgggcccgggcaccgccccttccgccccgccgggcgtcgcacgaggccggctcgaaggggaagtgagtcagtgtccgcggacccggccggcccaggcccgcgcccgccgcggccctgagaggccccggcaggtcccggcccggcggcggcagccatggccggggggccgggcccgggggagcccgcagcccccggcgcccagcacttcttgtacgaggtgccgccctgggtcatgtgccgcttctacaaagtgatggacgccctggagcccgccgactggtgccagttcgccgccctgatcgtgcgcgaccagaccgagctgcggctgtgcgagcgctccgggcagcgcacggccagcgtcctgtggccctggatcaaccgcaacgcccgtgtggccgacctcgtgcacatcctcacgcacctgcagctgctccgtgcgcgggacatcatcacagcctggcaccctcccgccccgcttccgtccccaggcaccactgccccgaggcccagcagcatccctgcacccgccgaggccgaggcctggagcccccggaagttgccatcctcagcctccaccttcctctccccagcttttccaggctcccagacccattcagggcctgagctcggcctggtcccaagccctgcttccctgtggcctccaccgccatctccagccccttcttctaccaagccaggcccagagagctcagtgtccctcctgcagggagcccgcccctttccgttttgctggcccctctgtgagatttcccggggcacccacaacttctcggaggagctcaagatcggggagggtggctttgggtgcgtgtaccgggcggtgatgaggaacacggtgtatgctgtgaagaggctgaaggagaacgctgacctggagtggactgcagtgaagcagagcttcctgaccgaggtggagcagctgtccaggtttcgtcacccaaacattgtggactttgctggctactgtgctcagaacggcttctactgcctggtgtacggcttcctgcccaacggctccctggaggaccgtctccactgccagacccaggcctgcccacctctctcctggcctcagcgactggacatccttctgggtacagcccgggcaattcagtttctacatcaggacagccccagcctcatccatggagacatcaagagttccaacgtccttctggatgagaggctgacacccaagctgggagactttggcctggcccggttcagccgctttgccgggtccagccccagccagagcagcatggtggcccggacacagacagtgcggggcaccctggcctacctgcccgaggagtacatcaagacgggaaggctggctgtggacacggacaccttcagctttggggtggtagtgctagagaccttggctggtcagagggctgtgaagacgcacggtgccaggaccaagtatctgaaagacctggtggaagaggaggctgaggaggctggagtggctttgagaagcacccagagcacactgcaagcaggtctggctgcagatgcctgggctgctcccatcgccatgcagatctacaagaagcacctggaccccaggcccgggccctgcccacctgagctgggcctgggcctgggccagctggcctgctgctgcctgcaccgccgggccaaaaggaggcctcctatgacccaggtgtacgagaggctagagaagctgcaggcagtggtggcgggggtgcccgggcattcggaggccgccagctgcatccccccttccccgcaggagaactcctacgtgtccagcactggcagagcccacagtggggctgctccatggcagcccctggcagcgccatcaggagccagtgcccaggcagcagagcagctgcagagaggccccaaccagcccgtggagagtgacgagagcctaggcggcctctctgctgccctgcgctcctggcacttgactccaagctgccctctggacccagcacccctcagggaggccggctgtcctcagggggacacggcaggagaatcgagctgggggagtggcccaggatcccggcccacagccgtggaaggactggcccttggcagctctgcatcatcgtcgtcagagccaccgcagattatcatcaaccctgcccgacagaagatggtccagaagctggccctgtacgaggatggggccctggacagcctgcagctgctgtcgtccagctccctcccaggcttgggcctggaacaggacaggcaggggcccgaagaaagtgatgaatttcagagctgatgtgttcacctgggcagatcccccaaatccggaagtcaaagttctcatggtcagaagttctcatggtgcacgagtcctcagcactctgccggcagtgggggtgggggcccatgcccgcgggggagagaaggaggtggccctgctgttctaggctctgtgggcataggcaggcagagtggaaccctgcctccatgccagcatctgggggcaaggaaggctggcatcatccagtgaggaggctggcgcatgttgggaggctgctggctgcacagacccgtgaggggaggagaggggctgctgtgcaggggtgtggagtagggagctggctcccctgagagccatgcagggcgtctgcagcccaggcctctggcagcagctctttgcccatctctttggacagtggccaccctgcacaatggggccgacgaggcctagggccctcctacctgcttacaatttggaaaagtgtggccgggtgcggtggctcacgcctgtaatcccagcactttgggaggccaaggcaggaggatcgctggagcccagtaggtcaagaccagccagggcaacatgatgagaccctgtctctgccaaaaaattttttaaactattagcctggcgtggtagcgcacgcctgtggtcccagctgctggggaggctgaagtaggaggatcatttatgcttgggaggtcgaggctgcagtgagtcatgattgtatgactgcactccagcctgggtgacagagcaagaccctgtttcaaaaagaaaaaccctgggaaaagtgaagtatggctgtaagtctcatggttcagtcctagcaagaagcgagaattctgagatcctccagaaagtcgagcagcacccacctccaacctcgggccagtgtcttcaggctttactggggacctgcgagctggcctaatgtggtggcctgcaagccaggccatccctgggcgccacagacgagctccgagccaggtcaggcttcggaggccacaagctcagcctcaggcccaggcactgattgtggcagaggggccactacccaaggtctagctaggcccaagacctagttacccagacagtgagaagcccctggaaggcagaaaagttgggagcatggcagacagggaagggaaacattttcagggaaaagacatgtatcacatgtcttcagaagcaagtcaggtttcatgtaaccgagtgtcctcttgcgtgtccaaaagtagcccagggctgtagcacaggcttcacagtgattttgtgttcagccgtgagtcacactacatgcccccgtgaagctgggcattggtgacgtccaggttgtccttgagtaataaaaacgtatgttgcaatctcggg

SEQ ID NO: 575 - DNA, 3432 bp, Homo sapiens
atggccggggggccgggcccgggggagcccgcagcccccggcgcccagcacttcttgtacgaggtgccgccctgggtcatgtgccgcttctacaaagtgatggacgccctggagcccgccgactggtgccagttcggtgggtggcggcgggctgccggggggcgggaggcgcgcgggctcctggcgccgacgcctgacgccccccgccccgcagccgccctgatcgtgcgcgaccagaccgagctgcggctgtgcgagcgctccgggcagcgcacggccagcgtcctgtggccctggatcaaccgcaacgcccgtgtggccgacctcgtgcacatcctcacgcacctgcagctgctccgtgcgcgggacatcatcacagcctggcaccctcccgccccgcttccgtccccaggcaccactgccccgaggcccagcagcatccctgcacccgccgaggccgaggcctggagcccccggaagttgccatcctcagcctccaccttcctctccccagcttttccaggctcccagacccattcagggcctgagctcggcctggtcccaagccctgcttccctgtggcctccaccgccatctccagccccttcttctaccaagccaggcccagagagctcagtgtccctcctgcagggagcccgcccctttccgttttgctggcccctctgtgagatttcccggggcacccacaacttctcggaggagctcaagatcggggagggtggctttgggtgcgtgtaccgggcggtgatgaggaacacggtgtatgctgtgaagaggctgaaggagaacgctgacctggagtggactgcagtgaagcagagcttcctgaccgaggtggagcagctgtccaggtttcgtcacccaaacattgtggactttgctggctactgtgctcagaacggcttctactgcctggtgtacggcttcctgcccaacggctccctggaggaccgtctccactgccagacccaggcctgcccacctctctcctggcctcagcgactggacatccttctgggtacagcccgggcaattcagtttctacatcaggacagccccagcctcatccatggagacatcaagagttccaacgtccttctggatgagaggctgacacccaagctgggagactttggcctggcccggttcagccgctttgccgggtccagccccagccagagcagcatggtggcccggacacagacagtgcggggcaccctggcctacctgcccgaggagtacatcaagacgggaaggctggctgtggacacggacaccttcagctttggggtggtagtgctagagaccttggctggtcagagggctgtgaagacgcacggtgccaggaccaagtatctgaaagacctggtggaagaggaggctgaggaggctggagtggctttgagaagcacccagagcacactgcaagcaggtctggctgcagatgcctgggctgctcccatcgccatgcagatctacaagaagcacctgggccagctggcctgctgctgcctgcaccgccgggccaaaaggaggcctcctatgacccaggagaactcctacgtgtccagcactggcagagcccacagtggggctgctccatggcagcccctggcagcgccatcaggagccagtgcccaggcagcagagcagctgcagagaggccccaaccagcccgtggagagtgacgagagcctaggcggcctctctgctgccctgcgctcctggcacttgactccaagctgccctctggacccagcacccctcagggaggccggctgtcctcagggggacacggcaggagaatcgagctgggggagtggcccaggatcccggcccacagccgtggaaggactggcccttggcagctctgcatcatcgtcgtcagagccaccgcagattatcatcaaccctgcccgacagaagatggtccagaagctggccctgtacgaggatggggccctggacagcctgcagctgctgtcgtccagctccctcccaggcttgggcctggaacaggacaggcaggggcccgaagaaagtgatgaatttcagagctgatgtgttcacctgggcagatcccccaaatccggaagtcaaagttctcatggtcagaagttctcatggtgcacgagtcctcagcactctgccggcagtgggggtgggggcccatgcccgcgggggagagaaggaggtggccctgctgttctaggctctgtgggcataggcaggcagagtggaaccctgcctccatgccagcatctgggggcaaggaaggctggcatcatccagtgaggaggctggcgcatgttgggaggctgctggctgcacagacccgtgaggggaggagaggggctgctgtgcaggggtgtggagtagggagctggctcccctgagagccatgcagggcgtctgcagcccaggcctctggcagcagctctttgcccatctctttggacagtggccaccctgcacaatggggccgacgaggcctagggccctcctacctgcttacaatttggaaaagtgtggccgggtgcggtggctcacgcctgtaatcccagcactttgggaggccaaggcaggaggatcgctggagcccagtaggtcaagaccagccagggcaacatgatgagaccctgtctctgccaaaaaattttttaaactattagcctggcgtggtagcgcacgcctgtggtcccagctgctggggaggctgaagtaggaggatcatttatgcttgggaggtcgaggctgcagtgagtcatgattgtatgactgcactccagcctgggtgacagagcaagaccctgtttcaaaaagaaaaaccctgggaaaagtgaagtatggctgtaagtctcatggttcagtcctagcaagaagcgagaattctgagatcctccagaaagtcgagcagcacccacctccaacctcgggccagtgtcttcaggctttactggggacctgcgagctggcctaatgtggtggcctgcaagccaggccatccctgggcgccacagacgagctccgagccaggtcaggcttcggaggccacaagctcagcctcaggcccaggcactgattgtggcagaggggccactacccaaggtctagctaggcccaagacctagttacccagacagtgagaagcccctggaaggcagaaaagttgggagcatggcagacagggaagggaaacattttcagggaaaagacatgtatcacatgtcttcagaagcaagtcaggtttcatgtaaccgagtgtcctcttgcgtgtccaaaagtagcccagggctgtagcacaggcttcacagtgattttgtgttcagccgtgagtcacactacatgcccccgtgaagctgggcattggtgacgtccaggttgtccttgagtaataaaaacgtatgttgc

SEQ ID NO: 576 - DNA, 2049 bp, Homo sapiens
atggccggggggccgggcccgggggagcccgcagcccccggcgcccagcacttcttgtacgaggtgccgccctgggtcatgtgccgcttctacaaagtgatggacgccctggagcccgccgactggtgccagttcgccgccctgatcgtgcgcgaccagaccgagctgcggctgtgcgagcgctccgggcagcgcacggccagcgtcctgtggccctggatcaaccgcaacgcccgtgtggccgacctcgtgcacatcctcacgcacctgcagctgctccgtgcgcgggacatcatcacagcctggcaccctcccgccccgcttccgtccccaggcaccactgccccgaggcccagcagcatccctgcacccgccgaggccgaggcctggagcccccggaagttgccatcctcagcctccaccttcctctccccagcttttccaggctcccagacccattcagggcctgagctcggcctggtcccaagccctgcttccctgtggcctccaccgccatctccagccccttcttctaccaagccaggcccagagagctcagtgtccctcctgcagggagcccgcccctttccgttttgctggcccctctgtgagatttcccggggcacccacaacttctcggaggagctcaagatcggggagggtggctttgggtgcgtgtaccgggcggtgatgaggaacacggtgtatgctgtgaagaggctgaaggagaacgctgacctggagtggactgcagtgaagcagagcttcctgaccgaggtggagcagctgtccaggtttcgtcacccaaacattgtggactttgctggctactgtgctcagaacggcttctactgcctggtgtacggcttcctgcccaacggctccctggaggaccgtctccactgccagacccaggcctgcccacctctctcctggcctcagcgactggacatccttctgggtacagcccgggcaattcagtttctacatcaggacagccccagcctcatccatggagacatcaagagttccaacgtccttctggatgagaggctgacacccaagctgggagactttggcctggcccggttcagccgctttgccgggtccagccccagccagagcagcatggtggcccggacacagacagtgcggggcaccctggcctacctgcccgaggagtacatcaagacgggaaggctggctgtggacacggacaccttcagctttggggtggtagtgctagagaccttggctggtcagagggctgtgaagacgcacggtgccaggaccaagtatctgaaagacctggtggaagaggaggctgaggaggctggagtggctttgagaagcacccagagcacactgcaagcaggtctggctgcagatgcctgggctgctcccatcgccatgcagatctacaagaagcacctggaccccaggcccgggccctgcccacctgagctgggcctgggcctgggccagctggcctgctgctgcctgcaccgccgggccaaaaggaggcctcctatgacccaggagaactcctacgtgtccagcactggcagagcccacagtggggctgctccatggcagcccctggcagcgccatcaggagccagtgcccaggcagcagagcagctgcagagaggccccaaccagcccgtggagagtgacgagagcctaggcggcctctctgctgccctgcgctcctggcacttgactccaagctgccctctggacccagcacccctcagggaggccggctgtcctcagggggacacggcaggagaatcgagctgggggagtggcccaggatcccggcccacagccgtggaaggactggcccttggcagctctgcatcatcgtcgtcagagccaccgcagattatcatcaaccctgcccgacagaagatggtccagaagctggccctgtacgaggatggggccctggacagcctgcagctgctgtcgtccagctccctcccaggcttgggcctggaacaggacaggcaggggcccgaagaaagtgatgaatttcagagctga

SEQ ID NO: 577 - DNA, 2127 bp, Homo sapiens
atggccggggggccgggcccgggggagcccgcagcccccggcgcccagcacttcttgtacgaggtgccgccctgggtcatgtgccgcttctacaaagtgatggacgccctggagcccgccgactggtgccagttcggtgggtggcggcgggctgccggggggcgggaggcgcgcgggctcctggcgccgacgcctgacgccccccgccccgcagccgccctgatcgtgcgcgaccagaccgagctgcggctgtgcgagcgctccgggcagcgcacggccagcgtcctgtggccctggatcaaccgcaacgcccgtgtggccgacctcgtgcacatcctcacgcacctgcagctgctccgtgcgcgggacatcatcacagcctggcaccctcccgccccgcttccgtccccaggcaccactgccccgaggcccagcagcatccctgcacccgccgaggccgaggcctggagcccccggaagttgccatcctcagcctccaccttcctctccccagcttttccaggctcccagacccattcagggcctgagctcggcctggtcccaagccctgcttccctgtggcctccaccgccatctccagccccttcttctaccaagccaggcccagagagctcagtgtccctcctgcagggagcccgcccctttccgttttgctggcccctctgtgagatttcccggggcacccacaacttctcggaggagctcaagatcggggagggtggctttgggtgcgtgtaccgggcggtgatgaggaacacggtgtatgctgtgaagaggctgaaggagaacgctgacctggagtggactgcagtgaagcagagcttcctgaccgaggtggagcagctgtccaggtttcgtcacccaaacattgtggactttgctggctactgtgctcagaacggcttctactgcctggtgtacggcttcctgcccaacggctccctggaggaccgtctccactgccagacccaggcctgcccacctctctcctggcctcagcgactggacatccttctgggtacagcccgggcaattcagtttctacatcaggacagccccagcctcatccatggagacatcaagagttccaacgtccttctggatgagaggctgacacccaagctgggagactttggcctggcccggttcagccgctttgccgggtccagccccagccagagcagcatggtggcccggacacagacagtgcggggcaccctggcctacctgcccgaggagtacatcaagacgggaaggctggctgtggacacggacaccttcagctttggggtggtagtgctagagaccttggctggtcagagggctgtgaagacgcacggtgccaggaccaagtatctgaaagacctggtggaagaggaggctgaggaggctggagtggctttgagaagcacccagagcacactgcaagcaggtctggctgcagatgcctgggctgctcccatcgccatgcagatctacaagaagcacctggaccccaggcccgggccctgcccacctgagctgggcctgggcctgggccagctggcctgctgctgcctgcaccgccgggccaaaaggaggcctcctatgacccaggagaactcctacgtgtccagcactggcagagcccacagtggggctgctccatggcagcccctggcagcgccatcaggagccagtgcccaggcagcagagcagctgcagagaggccccaaccagcccgtggagagtgacgagagcctaggcggcctctctgctgccctgcgctcctggcacttgactccaagctgccctctggacccagcacccctcagggaggccggctgtcctcagggggacacggcaggagaatcgagctgggggagtggcccaggatcccggcccacagccgtggaaggactggcccttggcagctctgcatcatcgtcgtcagagccaccgcagattatcatcaaccctgcccgacagaagatggtccagaagctggccctgtacgaggatggggccctggacagcctgcagctgctgtcgtccagctccctcccaggcttgggcctggaacaggacaggcaggggcccgaagaaagtgatgaatttcagagctga

SEQ ID NO: 578 - DNA, 3483 bp, Homo sapiens
ttccccgccggtccgcccctggctagagaagccgcagcccgcagtgtccgacccagtcgtcccgcgccggagccggccccgtagcgtgccatggcctgctacatctaccagctgccctcctgggtgctggacgacctgtgccgcaacatggacgcgctcagcgagtgggactggatggagttcgcctcctacgtgatcacagacctgacccagctgcggaagatcaagtccatggagcgggtgcagggtgtgagcatcacgcgggagctgctgtggtggtggggcatgcggcaggccaccgtccagcaacttgtggacctcctgtgccgcctggagctctaccgggctgcccagatcatcctgaactggaaaccggctcctgaaatcaggtgtcccattccagccttccctgactctgtgaagccagaaaagcctttggcagcttctgtaagaaaggctgaggatgaacaggaagaggggcagcctgtgaggatggccacctttccaggcccagggtcctctccagccagagcccaccagccggcctttctccagcctcctgaagaagatgcccctcattccttgagaagcgacctccccacttcgtctgattcaaaggacttcagcacctccattcctaagcaggaaaaacttttgagcttggctggagacagccttttctggagtgaggcagacgtggtccaggcaaccgatgacttcaatcaaaaccgcaaaatcagccaggggacctttgctgacgtctacagagggcacaggcacgggaagccattcgtcttcaagaagctcagagagacagcctgttcaagtccaggatcaatcgaaagattcttccaggcagagttgcagatttgtcttagatgctgccaccccaatgtcttacctgtgctgggcttctgtgctgcaagacagtttcacagcttcatctacccctacatggcaaatggttccctacaggacagactgcagggtcagggtggctcggaccccctcccctggccccagcgtgtcagcatctgctcagggctgctctgtgccgtcgagtacctgcatggtctggagatcatccacagcaacgtcaagagctctaatgtcttgctggaccaaaatctcacccccaaacttgctcacccaatggctcatctgtgtcctgtcaacaaaaggtcaaaatacaccatgatgaagactcacctgctccggacgtcagccgcgtatctgccagaggatttcatccgggtggggcagctgacaaagcgagtggacatcttcagctgtggaatagtgttggccgaggtcctcacgggcatccctgcaatggataacaaccgaagcccggtttacctgaaggacttactcctcagtgatattccaagcagcaccgcctcgctctgctccaggaagacgggcgtggagaacgtgatggcaaaggagatctgccagaagtacctggagaagggcgcagggaggcttccggaggactgcgccgaggccctggccacggctgcctgcctgtgcctgcggaggcgtaacaccagcctgcaggaggtgtgtggctctgtggctgctgtggaagagcggctccgaggtcgggagacgttgctcccttggagtgggctttctgagggtacaggctcttcttccaacaccccagaggaaacagacgacgttgacaattccagccttgatgcctcctcctccatgagtgtggcaccctgggcaggggctgccaccccacttctccccacagagaatggggaaggaaggctgcgggtcatcgtgggaagggaggctgactcctcctctgaggcctgtgttggcctggagcctccccaggatgttacagaaacttcgtggcaaattgagatcaatgaggccaaaaggaaactgatggagaatattctgctctacaaagaggaaaaagtggacagcattgagctctttggcccctgatgaccggaacacagctgaggacccttgtcctcagttggaaagatgagcatcagatcaagaaaaaggtctgaggcagaatccaagatctgccaggaaacacacaacaaaacatctgctgtcctgggtgggagggaaacttcatttcactggaatgagttgggagagaaaggccctcagcttttagagacacaaaaatccatgaagtctcttcctttctgggctttgttagtcagagcaggggatcagaggagactgaagcagaaaccctgcacacgggcccaggatgtggctgattttgtggttccggggagtatgtgatgataatcacccccagcagattccattacctcagcagctcttgttcccccgccactggcagttctgcaatgccatagcattttccagagctaagatctctgggttgtatttgctgacagcctgcaagcttgcatgctctgaaagattttttttagtttttaatttttttgtagagatggggtctcgctttgttggcgcaatcctcccacctcagactcccaaagtgctggaattacagttgggagccactgtgcctggcctggaagactttcaacttgtgtctcagtgcagttcttgactcacctctctgggcctcaggttctacaaatgccagacacctagcgaagagctctgcaggctttccactgcctgtattggaaatcttgcaattcacataattattcagtcactgcctggtacctttatcttcccatcccactaatgttagtgttttttaatggagcttttattctgagaatatgtgtttgtctgtttgtttgttttttgagacagagtctcactttgtcacccaggctggagtgcagtggcacgatctcagctcactgcaagctctgcctctcaggttcaagtgattctcctgcctcagcctcctgagtagatgggactgtaggcacctgccactatgcctggctaatttttgtgtttttagtagagacagggtttcaccatattggccaggctggtctcgaactactgacctcgtgatctgcccgccttggcctatcaaagtgttgggattacaggcttgagccaccgcacccggccgagaatatgtgttgttatttatgactggattatgaagaatcaggagaatgcatttcatgtctgattctgctgctaattaagtcaatcatttaatttttgggacctcagtttctttgtaagtaaaataacacctgcttgttcttcatccctgggctgttgggaggaacagatgagacagtggctatagaagcacttggaaaatgcacttgtcctgttttgtaaaataaaaaggtattaaatgtgtatttctgccatgtacctaatgattattcagtgcgtatatatctgaaaagtcatgttgcaaatctttctgtgaaacagatgctattttaaattcactgggagaaatatcctatttaaagtaatctatagtaatttctttttatataataaaaatatatttgtaaagtc

SEQ ID NO: 579 - DNA, 5981 bp, Homo sapiens
cggcggcgcggtcggagggggccggcgcgcagagccagacgccgccgcttgttttggttggggctctcggcaactctccgaggaggaggaggaggagggaggaggggagaagtaactgcagcggcagcgcctcccgaggaacaggcgtcttccccgaacccttcccaaacctcccccatcccctctcgcccttgtcccctcccctcctccccagccgcctggagcgaggggcagggatgagtctgtccctccggccggtccccagctgcagtggctgcccggtatcgtttcgcatggaaaagccactttctccacccgccgagatgggcccggatgggggctgcagaggacgcgcccgcgggcggcggcagcagcagcagcagcagcagcagcaacagcaacagccgcagcgccgcggtctctgcgactgagctggtatttgggcggctggtggcggctgggacggttggggggtgggaggaggcgaaggaggagggagaaccccgtgcaacgttgggacttggcaacccgcctccccctgcccaaggatatttaatttgcctcgggaatcgctgcttccagaggggaactcaggagggaaggcgcgcgcgcgcgcgcgctcctggaggggcaccgcagggacccccgactgtcgcctccctgtgccggactccagccggggcgacgagagatgcatcttcgctccttcctggtggcggcggcggctgagaggagacttggctctcggaggatcggggctgccctcaccccggacgcactgcctccccgccgggcgtgaagcgcccgaaaactccggtcgggctctctcctgggctcagcagctgcgtcctccttcagctgcccctccccggcgcggggggcggcgtggatttcagagtcggggtttctgctgcctccagccctgtttgcatgtgccgggccgcggcgaggagcctccgccccccacccggttgtttttcggagcctccctctgctcagcgttggtggtggcggtggcagcatggcgagccctccggagagcgatggcttctcggacgtgcgcaaggtgggctacctgcgcaaacccaagagcatgcacaaacgcttcttcgtactgcgcgcggccagcgaggctgggggcccggcgcgcctcgagtactacgagaacgagaagaagtggcggcacaagtcgagcgcccccaaacgctcgatcccccttgagagctgcttcaacatcaacaagcgggctgactccaagaacaagcacctggtggctctctacacccgggacgagcactttgccatcgcggcggacagcgaggccgagcaagacagctggtaccaggctctcctacagctgcacaaccgtgctaagggccaccacgacggagctgcggccctcggggcgggaggtggtgggggcagctgcagcggcagctccggccttggtgaggctggggaggacttgagctacggtgacgtgcccccaggacccgcattcaaagaggtctggcaagtgatcctgaagcccaagggcctgggtcagacaaagaacctgattggtatctaccgcctttgcctgaccagcaagaccatcagcttcgtgaagctgaactcggaggcagcggccgtggtgctgcagctgatgaacatcaggcgctgtggccactcggaaaacttcttcttcatcgaggtgggccgttctgccgtgacggggcccggggagttctggatgcaggtggatgactctgtggtggcccagaacatgcacgagaccatcctggaggccatgcgggccatgagtgatgagttccgccctcgcagcaagagccagtcctcgtccaactgctctaaccccatcagcgtccccctgcgccggcaccatctcaacaatcccccgcccagccaggtggggctgacccgccgatcacgcactgagagcatcaccgccacctccccggccagcatggtgggcgggaagccaggctccttccgtgtccgcgcctccagtgacggcgaaggcaccatgtcccgcccagcctcggtggacggcagccctgtgagtcccagcaccaacagaacccacgcccaccggcatcggggcagcgcccggctgcaccccccgctcaaccacagccgctccatccccatgccggcttcccgctgctcgccttcggccaccagcccggtcagtctgtcgtccagtagcaccagtggccatggctccacctcggattgtctcttcccacggcgatctagtgcttcggtgtctggttcccccagcgatggcggtttcatctcctcggatgagtatggctccagtccctgcgatttccggagttccttccgcagtgtcactccggattccctgggccacaccccaccagcccgcggtgaggaggagctaagcaactatatctgcatgggtggcaaggggccctccaccctgaccgcccccaacggtcactacattttgtctcggggtggcaatggccaccgctgcaccccaggaacaggcttgggcacgagtccagccttggctggggatgaagcagccagtgctgcagatctggataatcggttccgaaagagaactcactcggcaggcacatcccctaccattacccaccagaagaccccgtcccagtcctcagtggcttccattgaggagtacacagagatgatgcctgcctacccaccaggaggtggcagtggaggccgactgccgggacacaggcactccgccttcgtgcccacccgctcctacccagaggagggtctggaaatgcaccccttggagcgtcggggggggcaccaccgcccagacagctccaccctccacacggatgatggctacatgcccatgtccccaggggtggccccagtgcccagtggccgaaagggcagtggagactatatgcccatgagccccaagagcgtatctgccccacagcagatcatcaatcccatcagacgccatccccagagagtggaccccaatggctacatgatgatgtcccccagcggtggctgctctcctgacattggaggtggccccagcagcagcagcagcagcagcaacgccgtcccttccgggaccagctatggaaagctgtggacaaacggggtagggggccaccactctcatgtcttgcctcaccccaaacccccagtggagagcagcggtggtaagctcttaccttgcacaggtgactacatgaacatgtcaccagtgggggactccaacaccagcagcccctccgactgctactacggccctgaggacccccagcacaagccagtcctctcctactactcattgccaagatcctttaagcacacccagcgccccggggagccggaggagggtgcccggcatcagcacctccgcctttccactagctctggtcgccttctctatgctgcaacagcagatgattcttcctcttccaccagcagcgacagcctgggtgggggatactgcggggctaggctggagcccagccttccacatccccaccatcaggttctgcagccccatctgcctcgaaaggtggacacagctgctcagaccaatagccgcctggcccggcccacgaggctgtccctgggggatcccaaggccagcaccttacctcgggcccgagagcagcagcagcagcagcagcccttgctgcaccctccagagcccaagagcccgggggaatatgtcaatattgaatttgggagtgatcagtctggctacttgtctggcccggtggctttccacagctcaccttctgtcaggtgtccatcccagctccagccagctcccagagaggaagagactggcactgaggagtacatgaagatggacctggggccgggccggagggcagcctggcaggagagcactggggtcgagatgggcagactgggccctgcacctcccggggctgctagcatttgcaggcctacccgggcagtgcccagcagccggggtgactacatgaccatgcagatgagttgtccccgtcagagctacgtggacacctcgccagctgcccctgtaagctatgctgacatgcgaacaggcattgctgcagaggaggtgagcctgcccagggccaccatggctgctgcctcctcatcctcagcagcctctgcttccccgactgggcctcaaggggcagcagagctggctgcccactcgtccctgctggggggcccacaaggacctgggggcatgagcgccttcacccgggtgaacctcagtcctaaccgcaaccagagtgccaaagtgatccgtgcagacccacaagggtgccggcggaggcatagctccgagactttctcctcaacacccagtgccacccgggtgggcaacacagtgccctttggagcgggggcagcagtagggggcggtggcggtagcagcagcagcagcgaggatgtgaaacgccacagctctgcttcctttgagaatgtgtggctgaggcctggggagcttgggggagcccccaaggagccagccaaactgtgtggggctgctgggggtttggagaatggtcttaactacatagacctggatttggtcaaggacttcaaacagtgccctcaggagtgcacccctgaaccgcagcctcccccacccccaccccctcatcaacccctgggcagcggtgagagcagctccacccgccgctcaagtgaggatttaagcgcctatgccagcatcagtttccagaagcagccagaggaccgtcagtagctcaactggacatcacagcagaatgaagacctaaatgacctcagcaaatcctcttctaactcatgggtacccagactctaaatatttcatgattcacaactaggacctcatatcttcctcatcagtagatggtacgatgcatccatttcagtttgtttactttatccaatcctcaggatttcattgactgaactgcacgttctatattgtgccaagcgaaaaaaaaaaatgcactgtgacaccagaataatgagtctgcataaacttcatcttcaaccttaaggacttagctggccacagtgagctgatgtgcccaccaccgtgtcatgagagaatgggtttactctcaatgcattttcaagatacatttcatctgctgctgaaactgtgtacgacaaagcatcattgtaaattatttcatacaaaactgttcacgttgggtggagagagtattaaatatttaacataggttttgatttatatgtgtaattttttaaatgaaaatgtaacttttcttacagcacatcttttttttggatgtgggatggaggtatacaatgttctgttgtaaagagtggagcaaatgcttaaaacaaggcttaaaagagtagaatagggtatgatccttgttttaagattgtaattcagaaaacataatataagaatcatagtgccatagatggttctcaattgtatagttatatttgctgatactatctcttgtcatataaacctgatgttgagctgagttccttataagaattaatcttaattttgtattttttcctgtaagacaataggccatgttaattaaactgaagaaggatatatttggctgggtgttttcaaatgtcagcttaaaattggtaattgaatggaagcaaaattataagaagaggaaattaaagtcttccattgcatgtattgtaaacagaaggagatgggtgattccttcaattcaaaagctctctttggaatgaacaatgtgggcgtttgtaaattctggaaatgtctttctattcataataaactagatactgttgatcttttcttctgtcccctccccccaccacttctgtaagtttcctgctctattcccaccatttttttctgtgcacacattatgatatatttcatttcctgcattgtcttgagaaagatggtaaggcaagtgagctgttgctaaccagaaattaaaattccagtaagtgtttttcattatgaccagggc

SEQ ID NO: 580 - DNA, 1402 bp, Homo sapiens
attaattgcttgccatcatgagcagaagcaagcgtgacaacaatttttatagtgtagagattggagattctacattcacagtcctgaaacgatatcagaatttaaaacctataggctcaggagctcaaggaatagtatgcgcagcttatgatgccattcttgaaagaaatgttgcaatcaagaagctaagccgaccatttcagaatcagactcatgccaagcgggcctacagagagctagttcttatgaaatgtgttaatcacaaaaatataattggccttttgaatgttttcacaccacagaaatccctagaagaatttcaagatgtttacatagtcatggagctcatggatgcaaatctttgccaagtgattcagatggagctagatcatgaaagaatgtcctaccttctctatcagatgctgtgtggaatcaagcaccttcattctgctggaattattcatcgggacttaaagcccagtaatatagtagtaaaatctgattgcactttgaagattcttgacttcggtctggccaggactgcaggaacgagttttatgatgacgccttatgtagtgactcgctactacagagcacccgaggtcatccttggcatgggctacaaggaaaacgtggatttatggtctgtggggtgcattatgggagaaatggtttgccacaaaatcctctttccaggaagggactatattgatcagtggaataaagttattgaacagcttggaacaccatgtcctgaattcatgaagaaactgcaaccaacagtaaggacttacgttgaaaacagacctaaatatgctggatatagctttgagaaactcttccctgatgtccttttcccagctgactcagaacacaacaaacttaaagccagtcaggcaagggatttgttatccaaaatgctggtaatagatgcatctaaaaggatctctgtagatgaagctctccaacacccgtacatcaatgtctggtatgatccttctgaagcagaagctccaccaccaaagatccctgacaagcagttagatgaaagggaacacacaatagaagagtggaaagaattgatatataaggaagttatggacttggaggagagaaccaagaatggagttatacgggggcagccctctcctttaggtgcagcagtgatcaatggctctcagcatccatcatcatcgtcgtctgtcaatgatgtgtcttcaatgtcaacagatccgactttggcctctgatacagacagcagtctagaagcagcagctgggcctctgggctgctgtagatgactacttgggccatcggggggtgggagggatggggagtcggttagtcattgatagaactactttgaaaacaattcagtggtcttatttttgggtgatttttc

SEQ ID NO: 581 - DNA, 739 bp, Homo sapiens
atgagcagaagcaagcgtgacaacaatttttatagtgtagagattggagattctacattcacagtcctgaaacgatatcagaatttaaaacctataggctcaggagctcaaggaatagtatgcgcagcttatgatgccattcttgaaagaaatgttgcaatcaagaagctaagccgaccatttcagaatcagactcatgccaagcgggcctacagagagctagttcttatgaaatgtgttaatcacaaaaatataattggccttttgaatgttttcacaccacagaaatccctagaagaatttcaagatgtttacatagtcatggagctcatggatgcaaatctttgccaagtgattcagatggagctagatcatgaaagaatgtcctaccttctctatcagatgctgtgtggaatcaagcaccttcattctgctggaattattcatcgggacttaaagcccagtaatatagtagtaaaatctgattgcactttgaagattcttgacttcggtctggccaggactgcaggaacgagttttatgatgacgccttatgtagtgactcgctactacagagcacccgaggtcatccttggcatgggctacaaggaaaacggaggaagaatgggaaaaggcatattcacaaggttacaataaggtgcctgtgagatataaaatttataactgccacatcctttcttaggaatttttaaatttctattttcttgtaatatgaata

SEQ ID NO: 582 - DNA, 5628 bp, Homo sapiens
attgcttgccatcatgagcagaagcaagcgtgacaacaatttttatagtgtagagattggagattctacattcacagtcctgaaacgatatcagaatttaaaacctataggctcaggagctcaaggaatagtatgcgcagcttatgatgccattcttgaaagaaatgttgcaatcaagaagctaagccgaccatttcagaatcagactcatgccaagcgggcctacagagagctagttcttatgaaatgtgttaatcacaaaaatataattggccttttgaatgttttcacaccacagaaatccctagaagaatttcaagatgtttacatagtcatggagctcatggatgcaaatctttgccaagtgattcagatggagctagatcatgaaagaatgtcctaccttctctatcagatgctgtgtggaatcaagcaccttcattctgctggaattattcatcgggacttaaagcccagtaatatagtagtaaaatctgattgcactttgaagattcttgacttcggtctggccaggactgcaggaacgagttttatgatgacgccttatgtagtgactcgctactacagagcacccgaggtcatccttggcatgggctacaaggaaaacgttgacatttggtcagttgggtgcatcatgggagaaatgatcaaaggtggtgttttgttcccaggtacagatcatattgatcagtggaataaagttattgaacagcttggaacaccatgtcctgaattcatgaagaaactgcaaccaacagtaaggacttacgttgaaaacagacctaaatatgctggatatagctttgagaaactcttccctgatgtccttttcccagctgactcagaacacaacaaacttaaagccagtcaggcaagggatttgttatccaaaatgctggtaatagatgcatctaaaaggatctctgtagatgaagctctccaacacccgtacatcaatgtctggtatgatccttctgaagcagaagctccaccaccaaagatccctgacaagcagttagatgaaagggaacacacaatagaagagtggaaagaattgatatataaggaagttatggacttggaggagagaaccaagaatggagttatacgggggcagccctctcctttaggtgcagcagtgatcaatggctctcagcatccatcatcatcgtcgtctgtcaatgatgtgtcttcaatgtcaacagatccgactttggcctctgatacagacagcagtctagaagcagcagctgggcctctgggctgctgtagatgactacttgggccatcggggggtgggagggatggggagtcggttagtcattgatagaactactttgaaaacaattcagtggtcttatttttgggtgatttttcaaaaaatgtagaattcattttgtagtaaagtagtttattttttttaatttcaagtgatgtaatttaaaacctaagttgtgtttcaaaacagcaacaaaactgtattgtattttttttgctgtaattaactgtataatgtaaacctaattattttatcatggtttaaattttttgcatatttgctttatcttatgctgctgatttttttaactgaatttgtaagattttgtttatcaaagcaactattatgtggtgacttgcctatatcatgaattatttaagatttttatagttttttttaattagaatttatttcagatgttttgttcatgatactatccttcagggttatgtgcttatcaatgaaataaccccagaggagtgagggaaaataacttgtagccagttatattcaggaataactactgtaaatgatgaacgtgttaggagacctccaatatttgctacttgccaatcctaatttagttacaagaattggtaggcaatcctacttaattttggcaaaagccccgtcatctaaatggcagaataactcagagcatgtctttgaagatgctgggcgtctaccaccaccttatgtccccaccctacccaacaaaaataagtaaaaagaatatggtgtattctacaaatttgtggcatgctcaaagtttatgatcacataaaggcaagaggatacttcatgaataatacatttcaatgcaaataaacagatggttcacttctactagctatgagcctgtttttgtatacactgagttaatctactcaggctgtaggtcccagcaatgttctagagtctggtctttccctttcctgcagcttcgggtccttggacctttcctgtttcctattacttggagtgtctgtcagttgagcaccagttgttctggtgtttcatttgattctacttgtagcataatcatttatacgagctattgggaggttccaaaccctacctagatttgtgtaggtgatgtatcaaatgagcaatataccgttcatctgaaaatagtagcacacagccatatataggatatcattttctaaggactgtttcttcacattgagcagagcaggcataaatggtggttatttagtctaagtcttttatttttttatacctgattttcaacataacacgcaatgtggatgtcgagtagtgttaagaatggtgctgctcctgacaagtgtatgttaactgtttacattttctatctgtagaattatttctctattactgaacttttcctaagtaaaatgtctttgaagtctcgttatttctgaaatacgttgtctgtaatagacccaggcaccttttaaattatctctggaacaagagggatttcatgtaatgaactaggaaatgcatactcacataagcaacaaggttctaggcagaaagccccttggaatttgtgaccaacaggagcaagaacaggtgcggctcaacatgcaatgtctgaaaatttgcttggcattttattcatatatttagtgcaaaattatttttgagtgagatattttacatcactgttaatgtgcaatatttaagattaaaatacattagcttttttatatactttgaagtagcaagtttgttttcgatggcttagagtcatgatttccagcttcccagcctttttatcagtcccttttctaatacaacaaggtgcattaatttgattaggcaaattagagttctaagacacttcttgaattgtagacagaaaatattggattcacaatttcagcagaaatttgagaatgagtgtgtttatattaatttcacaattagctgtattttctgtagcatagattatgtcactgttgcactttcacagcagacatgctttcagaaggttctcatattttatgtttgattgctgataagccatctctattgatacagattttggttaagtaaggaaaaccaggtgtgtgtctgtatcatttattgtaaatgccagctgccacttgccaaccatcatgttcagttcaattcaaagaaaacaaactctcattacttagtgtaaactaaaatacttaacaaattatatcctaaaaacaaggtctctttgttaaatgttgcatgccctaggttttaaattactacatccaaatacagttttcgtcttaaatttgttaagctaaatatatgttggttctttttattttggaatcctttaagcatcttaaacattttttttttgaagagaagttacaaataacatttctatcaggtagtacttgtatgaaaccacctttcttattctataattttgatttttcaattttatatacttaatatactcactgtcttactatcagaaagttattttgaccaagatttttattatcttcatagattcagaaagagatgctaattctgtaccaatgtcttcctggttactattctcttccctctaatatatactggccatttgtaaaaccattgtgttgttgggatcacttagttatactatacgcagatagagcatctcaactctgtcatagtgtttgctgaacagttttcagtgtcatgcacctttggctgctaattgttcctgacgtgcactcttccgagttggtaaaggcacagtgtgttcatgccagacttctaagagaaacaccagcctcttaaatcagaagcctacacacaacccccttaacaatccaaagaagcttgatggtgtgcaaagaagcatcctgccagccttgtcattgttctgttctatgctaatcctgctgtgttgtctaaaagatggagggaagaggacatcagtgtctgatagtgaaatcatcagcaggaaagtgaagctctttccttggttacagataagacttggtttacactattggccagtatctgctaaacatatgaagacttaactattcagtgttgcctaggcattcgcctgcacaacattttgaggttagaacatagaatattttcagaaatactgttgtagtttgtgagtgttgttcattagttacacattagctatagagtggatgcatgaagccccatgacaccagtaaacttctcttaccagtaggtaaaccaaacaccattctgtcattagcagccctcttaaatgttgcctctccgtatcctgttgcatttttgtgtgcattgtgtttctactgatctctcttaggtttttacggaatcaaaggaaactaatttttccttaatagcaagaaagatgaagaggtaaagggcattgaagcagaaatgtatagtttggggtacgattagaaaactcgtaaggaaaacagaagtcctaatttcaaactgactgctcttcgttaagtgctcttaaggagagtctagtaacagtaacactttctggccatttctagtttagattctcttcgttactgaaacttttgagaaatattacctgtggattaattttgcacaatgttctattctcataatgacttacaaattaaactaggtttttattgaactacctcacactaattttctatgctttcccaagtaagctgttgccctgttagatctttactgagtgaattataaatgtgtgttaaatactttctagccaatgttgacacaataccagtaagtatgtaaagtatataccttacatcagtaagagacacgtgtaaaatctttgactgtatgtcttgcaaaattgtgctcgttgacattattactgtttttgtaagtagaaacctgctcgtgatatcggtccatttacattttacaaaaggagtaaatcttagtaaaaattttacgaagaaataaattacttttgtaggcccaatatttggtatatttttgagaagctgttaatcttttagctgaataatgaagttagactgaattacgtgtctccctggactgtgacatctattttctcattacagtttatcctggtcagcagggtgtcacacctggaaacctgagtatgatagctgacatttgcttttctccctctgcgatgtcattcctcctccattcctctccttccctgtgttccgttccctctcctttcctctagacaaaacaaaatggggcactttttagggaatgctgagatcattattgtggtttttcatcattcatgccctagtcattaaacatgcaccactggaatgtaaacaatgttatctagtatgtcaattggttataatattttaaataaaaaagaaaaaagtggtatgaaaattatgaaa

SEQ ID NO: 583 - DNA, 5637 bp, Homo sapiens
attaattgcttgccatcatgagcagaagcaagcgtgacaacaatttttatagtgtagagattggagattctacattcacagtcctgaaacgatatcagaatttaaaacctataggctcaggagctcaaggaatagtatgcgcagcttatgatgccattcttgaaagaaatgttgcaatcaagaagctaagccgaccatttcagaatcagactcatgccaagcgggcctacagagagctagttcttatgaaatgtgttaatcacaaaaatataattggccttttgaatgttttcacaccacagaaatccctagaagaatttcaagatgtttacatagtcatggagctcatggatgcaaatctttgccaagtgattcagatggagctagatcatgaaagaatgtcctaccttctctatcagatgctgtgtggaatcaagcaccttcattctgctggaattattcatcgggacttaaagcccagtaatatagtagtaaaatctgattgcactttgaagattcttgacttcggtctggccaggactgcaggaacgagttttatgatgacgccttatgtagtgactcgctactacagagcacccgaggtcatccttggcatgggctacaaggaaaacgttgacatttggtcagttgggtgcatcatgggagaaatgatcaaaggtggtgttttgttcccaggtacagatcatattgatcagtggaataaagttattgaacagcttggaacaccatgtcctgaattcatgaagaaactgcaaccaacagtaaggacttacgttgaaaacagacctaaatatgctggatatagctttgagaaactcttccctgatgtccttttcccagctgactcagaacacaacaaacttaaagccagtcaggcaagggatttgttatccaaaatgctggtaatagatgcatctaaaaggatctctgtagatgaagctctccaacacccgtacatcaatgtctggtatgatccttctgaagcagaagctccaccaccaaagatccctgacaagcagttagatgaaagggaacacacaatagaagagtggaaagaattgatatataaggaagttatggacttggaggagagaaccaagaatggagttatacgggggcagccctctcctttagcacaggtgcagcagtgatcaatggctctcagcatccatcatcatcgtcgtctgtcaatgatgtgtcttcaatgtcaacagatccgactttggcctctgatacagacagcagtctagaagcagcagctgggcctctgggctgctgtagatgactacttgggccatcggggggtgggagggatggggagtcggttagtcattgatagaactactttgaaaacaattcagtggtcttatttttgggtgatttttcaaaaaatgtagaattcattttgtagtaaagtagtttattttttttaatttcaagtgatgtaatttaaaacctaagttgtgtttcaaaacagcaacaaaactgtattgtattttttttgctgtaattaactgtataatgtaaacctaattattttatcatggtttaaattttttgcatatttgctttatcttatgctgctgatttttttaactgaatttgtaagattttgtttatcaaagcaactattatgtggtgacttgcctatatcatgaattatttaagatttttatagttttttttaattagaatttatttcagatgttttgttcatgatactatccttcagggttatgtgcttatcaatgaaataaccccagaggagtgagggaaaataacttgtagccagttatattcaggaataactactgtaaatgatgaacgtgttaggagacctccaatatttgctacttgccaatcctaatttagttacaagaattggtaggcaatcctacttaattttggcaaaagccccgtcatctaaatggcagaataactcagagcatgtctttgaagatgctgggcgtctaccaccaccttatgtccccaccctacccaacaaaaataagtaaaaagaatatggtgtattctacaaatttgtggcatgctcaaagtttatgatcacataaaggcaagaggatacttcatgaataatacatttcaatgcaaataaacagatggttcacttctactagctatgagcctgtttttgtatacactgagttaatctactcaggctgtaggtcccagcaatgttctagagtctggtctttccctttcctgcagcttcgggtccttggacctttcctgtttcctattacttggagtgtctgtcagttgagcaccagttgttctggtgtttcatttgattctacttgtagcataatcatttatacgagctattgggaggttccaaaccctacctagatttgtgtaggtgatgtatcaaatgagcaatataccgttcatctgaaaatagtagcacacagccatatataggatatcattttctaaggactgtttcttcacattgagcagagcaggcataaatggtggttatttagtctaagtcttttatttttttatacctgattttcaacataacacgcaatgtggatgtcgagtagtgttaagaatggtgctgctcctgacaagtgtatgttaactgtttacattttctatctgtagaattatttctctattactgaacttttcctaagtaaaatgtctttgaagtctcgttatttctgaaatacgttgtctgtaatagacccaggcaccttttaaattatctctggaacaagagggatttcatgtaatgaactaggaaatgcatactcacataagcaacaaggttctaggcagaaagccccttggaatttgtgaccaacaggagcaagaacaggtgcggctcaacatgcaatgtctgaaaatttgcttggcattttattcatatatttagtgcaaaattatttttgagtgagatattttacatcactgttaatgtgcaatatttaagattaaaatacattagcttttttatatactttgaagtagcaagtttgttttcgatggcttagagtcatgatttccagcttcccagcctttttatcagtcccttttctaatacaacaaggtgcattaatttgattaggcaaattagagttctaagacacttcttgaattgtagacagaaaatattggattcacaatttcagcagaaatttgagaatgagtgtgtttatattaatttcacaattagctgtattttctgtagcatagattatgtcactgttgcactttcacagcagacatgctttcagaaggttctcatattttatgtttgattgctgataagccatctctattgatacagattttggttaagtaaggaaaaccaggtgtgtgtctgtatcatttattgtaaatgccagctgccacttgccaaccatcatgttcagttcaattcaaagaaaacaaactctcattacttagtgtaaactaaaatacttaacaaattatatcctaaaaacaaggtctctttgttaaatgttgcatgccctaggttttaaattactacatccaaatacagttttcgtcttaaatttgttaagctaaatatatgttggttctttttattttggaatcctttaagcatcttaaacattttttttttgaagagaagttacaaataacatttctatcaggtagtacttgtatgaaaccacctttcttattctataattttgatttttcaattttatatacttaatatactcactgtcttactatcagaaagttattttgaccaagatttttattatcttcatagattcagaaagagatgctaattctgtaccaatgtcttcctggttactattctcttccctctaatatatactggccatttgtaaaaccattgtgttgttgggatcacttagttatactatacgcagatagagcatctcaactctgtcatagtgtttgctgaacagttttcagtgtcatgcacctttggctgctaattgttcctgacgtgcactcttccgagttggtaaaggcacagtgtgttcatgccagacttctaagagaaacaccagcctcttaaatcagaagcctacacacaacccccttaacaatccaaagaagcttgatggtgtgcaaagaagcatcctgccagccttgtcattgttctgttctatgctaatcctgctgtgttgtctaaaagatggagggaagaggacatcagtgtctgatagtgaaatcatcagcaggaaagtgaagctctttccttggttacagataagacttggtttacactattggccagtatctgctaaacatatgaagacttaactattcagtgttgcctaggcattcgcctgcacaacattttgaggttagaacatagaatattttcagaaatactgttgtagtttgtgagtgttgttcattagttacacattagctatagagtggatgcatgaagccccatgacaccagtaaacttctcttaccagtaggtaaaccaaacaccattctgtcattagcagccctcttaaatgttgcctctccgtatcctgttgcatttttgtgtgcattgtgtttctactgatctctcttaggtttttacggaatcaaaggaaactaatttttccttaatagcaagaaagatgaagaggtaaagggcattgaagcagaaatgtatagtttggggtacgattagaaaactcgtaaggaaaacagaagtcctaatttcaaactgactgctcttcgttaagtgctcttaaggagagtctagtaacagtaacactttctggccatttctagtttagattctcttcgttactgaaacttttgagaaatattacctgtggattaattttgcacaatgttctattctcataatgacttacaaattaaactaggtttttattgaactacctcacactaattttctatgctttcccaagtaagctgttgccctgttagatctttactgagtgaattataaatgtgtgttaaatactttctagccaatgttgacacaataccagtaagtatgtaaagtatataccttacatcagtaagagacacgtgtaaaatctttgactgtatgtcttgcaaaattgtgctcgttgacattattactgtttttgtaagtagaaacctgctcgtgatatcggtccatttacattttacaaaaggagtaaatcttagtaaaaattttacgaagaaataaattacttttgtaggcccaatatttggtatatttttgagaagctgttaatcttttagctgaataatgaagttagactgaattacgtgtctccctggactgtgacatctattttctcattacagtttatcctggtcagcagggtgtcacacctggaaacctgagtatgatagctgacatttgcttttctccctctgcgatgtcattcctcctccattcctctccttccctgtgttccgttccctctcctttcctctagacaaaacaaaatggggcactttttagggaatgctgagatcattattgtggtttttcatcattcatgccctagtcattaaacatgcaccactggaatgtaaacaatgttatctagtatgtcaattggttataatattttaaataaaaaagaaaaaagtggtatgaaaattatgaaa

SEQ ID NO: 584 - DNA, 5638 bp, Homo sapiens
aattaattgcttgccatcatgagcagaagcaagcgtgacaacaatttttatagtgtagagattggagattctacattcacagtcctgaaacgatatcagaatttaaaacctataggctcaggagctcaaggaatagtatgcgcagcttatgatgccattcttgaaagaaatgttgcaatcaagaagctaagccgaccatttcagaatcagactcatgccaagcgggcctacagagagctagttcttatgaaatgtgttaatcacaaaaatataattggccttttgaatgttttcacaccacagaaatccctagaagaatttcaagatgtttacatagtcatggagctcatggatgcaaatctttgccaagtgattcagatggagctagatcatgaaagaatgtcctaccttctctatcagatgctgtgtggaatcaagcaccttcattctgctggaattattcatcgggacttaaagcccagtaatatagtagtaaaatctgattgcactttgaagattcttgacttcggtctggccaggactgcaggaacgagttttatgatgacgccttatgtagtgactcgctactacagagcacccgaggtcatccttggcatgggctacaaggaaaacgtggatttatggtctgtggggtgcattatgggagaaatggtttgccacaaaatcctctttccaggaagggactatattgatcagtggaataaagttattgaacagcttggaacaccatgtcctgaattcatgaagaaactgcaaccaacagtaaggacttacgttgaaaacagacctaaatatgctggatatagctttgagaaactcttccctgatgtccttttcccagctgactcagaacacaacaaacttaaagccagtcaggcaagggatttgttatccaaaatgctggtaatagatgcatctaaaaggatctctgtagatgaagctctccaacacccgtacatcaatgtctggtatgatccttctgaagcagaagctccaccaccaaagatccctgacaagcagttagatgaaagggaacacacaatagaagagtggaaagaattgatatataaggaagttatggacttggaggagagaaccaagaatggagttatacgggggcagccctctcctttagcacaggtgcagcagtgatcaatggctctcagcatccatcatcatcgtcgtctgtcaatgatgtgtcttcaatgtcaacagatccgactttggcctctgatacagacagcagtctagaagcagcagctgggcctctgggctgctgtagatgactacttgggccatcggggggtgggagggatggggagtcggttagtcattgatagaactactttgaaaacaattcagtggtcttatttttgggtgatttttcaaaaaatgtagaattcattttgtagtaaagtagtttattttttttaatttcaagtgatgtaatttaaaacctaagttgtgtttcaaaacagcaacaaaactgtattgtattttttttgctgtaattaactgtataatgtaaacctaattattttatcatggtttaaattttttgcatatttgctttatcttatgctgctgatttttttaactgaatttgtaagattttgtttatcaaagcaactattatgtggtgacttgcctatatcatgaattatttaagatttttatagttttttttaattagaatttatttcagatgttttgttcatgatactatccttcagggttatgtgcttatcaatgaaataaccccagaggagtgagggaaaataacttgtagccagttatattcaggaataactactgtaaatgatgaacgtgttaggagacctccaatatttgctacttgccaatcctaatttagttacaagaattggtaggcaatcctacttaattttggcaaaagccccgtcatctaaatggcagaataactcagagcatgtctttgaagatgctgggcgtctaccaccaccttatgtccccaccctacccaacaaaaataagtaaaaagaatatggtgtattctacaaatttgtggcatgctcaaagtttatgatcacataaaggcaagaggatacttcatgaataatacatttcaatgcaaataaacagatggttcacttctactagctatgagcctgtttttgtatacactgagttaatctactcaggctgtaggtcccagcaatgttctagagtctggtctttccctttcctgcagcttcgggtccttggacctttcctgtttcctattacttggagtgtctgtcagttgagcaccagttgttctggtgtttcatttgattctacttgtagcataatcatttatacgagctattgggaggttccaaaccctacctagatttgtgtaggtgatgtatcaaatgagcaatataccgttcatctgaaaatagtagcacacagccatatataggatatcattttctaaggactgtttcttcacattgagcagagcaggcataaatggtggttatttagtctaagtcttttatttttttatacctgattttcaacataacacgcaatgtggatgtcgagtagtgttaagaatggtgctgctcctgacaagtgtatgttaactgtttacattttctatctgtagaattatttctctattactgaacttttcctaagtaaaatgtctttgaagtctcgttatttctgaaatacgttgtctgtaatagacccaggcaccttttaaattatctctggaacaagagggatttcatgtaatgaactaggaaatgcatactcacataagcaacaaggttctaggcagaaagccccttggaatttgtgaccaacaggagcaagaacaggtgcggctcaacatgcaatgtctgaaaatttgcttggcattttattcatatatttagtgcaaaattatttttgagtgagatattttacatcactgttaatgtgcaatatttaagattaaaatacattagcttttttatatactttgaagtagcaagtttgttttcgatggcttagagtcatgatttccagcttcccagcctttttatcagtcccttttctaatacaacaaggtgcattaatttgattaggcaaattagagttctaagacacttcttgaattgtagacagaaaatattggattcacaatttcagcagaaatttgagaatgagtgtgtttatattaatttcacaattagctgtattttctgtagcatagattatgtcactgttgcactttcacagcagacatgctttcagaaggttctcatattttatgtttgattgctgataagccatctctattgatacagattttggttaagtaaggaaaaccaggtgtgtgtctgtatcatttattgtaaatgccagctgccacttgccaaccatcatgttcagttcaattcaaagaaaacaaactctcattacttagtgtaaactaaaatacttaacaaattatatcctaaaaacaaggtctctttgttaaatgttgcatgccctaggttttaaattactacatccaaatacagttttcgtcttaaatttgttaagctaaatatatgttggttctttttattttggaatcctttaagcatcttaaacattttttttttgaagagaagttacaaataacatttctatcaggtagtacttgtatgaaaccacctttcttattctataattttgatttttcaattttatatacttaatatactcactgtcttactatcagaaagttattttgaccaagatttttattatcttcatagattcagaaagagatgctaattctgtaccaatgtcttcctggttactattctcttccctctaatatatactggccatttgtaaaaccattgtgttgttgggatcacttagttatactatacgcagatagagcatctcaactctgtcatagtgtttgctgaacagttttcagtgtcatgcacctttggctgctaattgttcctgacgtgcactcttccgagttggtaaaggcacagtgtgttcatgccagacttctaagagaaacaccagcctcttaaatcagaagcctacacacaacccccttaacaatccaaagaagcttgatggtgtgcaaagaagcatcctgccagccttgtcattgttctgttctatgctaatcctgctgtgttgtctaaaagatggagggaagaggacatcagtgtctgatagtgaaatcatcagcaggaaagtgaagctctttccttggttacagataagacttggtttacactattggccagtatctgctaaacatatgaagacttaactattcagtgttgcctaggcattcgcctgcacaacattttgaggttagaacatagaatattttcagaaatactgttgtagtttgtgagtgttgttcattagttacacattagctatagagtggatgcatgaagccccatgacaccagtaaacttctcttaccagtaggtaaaccaaacaccattctgtcattagcagccctcttaaatgttgcctctccgtatcctgttgcatttttgtgtgcattgtgtttctactgatctctcttaggtttttacggaatcaaaggaaactaatttttccttaatagcaagaaagatgaagaggtaaagggcattgaagcagaaatgtatagtttggggtacgattagaaaactcgtaaggaaaacagaagtcctaatttcaaactgactgctcttcgttaagtgctcttaaggagagtctagtaacagtaacactttctggccatttctagtttagattctcttcgttactgaaacttttgagaaatattacctgtggattaattttgcacaatgttctattctcataatgacttacaaattaaactaggtttttattgaactacctcacactaattttctatgctttcccaagtaagctgttgccctgttagatctttactgagtgaattataaatgtgtgttaaatactttctagccaatgttgacacaataccagtaagtatgtaaagtatataccttacatcagtaagagacacgtgtaaaatctttgactgtatgtcttgcaaaattgtgctcgttgacattattactgtttttgtaagtagaaacctgctcgtgatatcggtccatttacattttacaaaaggagtaaatcttagtaaaaattttacgaagaaataaattacttttgtaggcccaatatttggtatatttttgagaagctgttaatcttttagctgaataatgaagttagactgaattacgtgtctccctggactgtgacatctattttctcattacagtttatcctggtcagcagggtgtcacacctggaaacctgagtatgatagctgacatttgcttttctccctctgcgatgtcattcctcctccattcctctccttccctgtgttccgttccctctcctttcctctagacaaaacaaaatggggcactttttagggaatgctgagatcattattgtggtttttcatcattcatgccctagtcattaaacatgcaccactggaatgtaaacaatgttatctagtatgtcaattggttataatattttaaataaaaaagaaaaaagtggtatgaaaattatgaaa

SEQ ID NO: 585 - DNA, 5796 bp, Homo sapiens
gcggccgaggccggacgacgcggcttggattgcggagccgcgagcagcgctgggtaacggccgcggcgaccaccccggacggcccctgtccccgctggcgggcttccctgtcgccgttcgctgcgctgccggcttcttggtgaatttttggatgaagccattaaattaattgcttgccatcatgagcagaagcaagcgtgacaacaatttttatagtgtagagattggagattctacattcacagtcctgaaacgatatcagaatttaaaacctataggctcaggagctcaaggaatagtatgcgcagcttatgatgccattcttgaaagaaatgttgcaatcaagaagctaagccgaccatttcagaatcagactcatgccaagcgggcctacagagagctagttcttatgaaatgtgttaatcacaaaaatataattggccttttgaatgttttcacaccacagaaatccctagaagaatttcaagatgtttacatagtcatggagctcatggatgcaaatctttgccaagtgattcagatggagctagatcatgaaagaatgtcctaccttctctatcagatgctgtgtggaatcaagcaccttcattctgctggaattattcatcgggacttaaagcccagtaatatagtagtaaaatctgattgcactttgaagattcttgacttcggtctggccaggactgcaggaacgagttttatgatgacgccttatgtagtgactcgctactacagagcacccgaggtcatccttggcatgggctacaaggaaaacgtggatttatggtctgtggggtgcattatgggagaaatggtttgccacaaaatcctctttccaggaagggactatattgatcagtggaataaagttattgaacagcttggaacaccatgtcctgaattcatgaagaaactgcaaccaacagtaaggacttacgttgaaaacagacctaaatatgctggatatagctttgagaaactcttccctgatgtccttttcccagctgactcagaacacaacaaacttaaagccagtcaggcaagggatttgttatccaaaatgctggtaatagatgcatctaaaaggatctctgtagatgaagctctccaacacccgtacatcaatgtctggtatgatccttctgaagcagaagctccaccaccaaagatccctgacaagcagttagatgaaagggaacacacaatagaagagtggaaagaattgatatataaggaagttatggacttggaggagagaaccaagaatggagttatacgggggcagccctctcctttaggtgcagcagtgatcaatggctctcagcatccatcatcatcgtcgtctgtcaatgatgtgtcttcaatgtcaacagatccgactttggcctctgatacagacagcagtctagaagcagcagctgggcctctgggctgctgtagatgactacttgggccatcggggggtgggagggatggggagtcggttagtcattgatagaactactttgaaaacaattcagtggtcttatttttgggtgatttttcaaaaaatgtagaattcattttgtagtaaagtagtttattttttttaatttcaagtgatgtaatttaaaacctaagttgtgtttcaaaacagcaacaaaactgtattgtattttttttgctgtaattaactgtataatgtaaacctaattattttatcatggtttaaattttttgcatatttgctttatcttatgctgctgatttttttaactgaatttgtaagattttgtttatcaaagcaactattatgtggtgacttgcctatatcatgaattatttaagatttttatagttttttttaattagaatttatttcagatgttttgttcatgatactatccttcagggttatgtgcttatcaatgaaataaccccagaggagtgagggaaaataacttgtagccagttatattcaggaataactactgtaaatgatgaacgtgttaggagacctccaatatttgctacttgccaatcctaatttagttacaagaattggtaggcaatcctacttaattttggcaaaagccccgtcatctaaatggcagaataactcagagcatgtctttgaagatgctgggcgtctaccaccaccttatgtccccaccctacccaacaaaaataagtaaaaagaatatggtgtattctacaaatttgtggcatgctcaaagtttatgatcacataaaggcaagaggatacttcatgaataatacatttcaatgcaaataaacagatggttcacttctactagctatgagcctgtttttgtatacactgagttaatctactcaggctgtaggtcccagcaatgttctagagtctggtctttccctttcctgcagcttcgggtccttggacctttcctgtttcctattacttggagtgtctgtcagttgagcaccagttgttctggtgtttcatttgattctacttgtagcataatcatttatacgagctattgggaggttccaaaccctacctagatttgtgtaggtgatgtatcaaatgagcaatataccgttcatctgaaaatagtagcacacagccatatataggatatcattttctaaggactgtttcttcacattgagcagagcaggcataaatggtggttatttagtctaagtcttttatttttttatacctgattttcaacataacacgcaatgtggatgtcgagtagtgttaagaatggtgctgctcctgacaagtgtatgttaactgtttacattttctatctgtagaattatttctctattactgaacttttcctaagtaaaatgtctttgaagtctcgttatttctgaaatacgttgtctgtaatagacccaggcaccttttaaattatctctggaacaagagggatttcatgtaatgaactaggaaatgcatactcacataagcaacaaggttctaggcagaaagccccttggaatttgtgaccaacaggagcaagaacaggtgcggctcaacatgcaatgtctgaaaatttgcttggcattttattcatatatttagtgcaaaattatttttgagtgagatattttacatcactgttaatgtgcaatatttaagattaaaatacattagcttttttatatactttgaagtagcaagtttgttttcgatggcttagagtcatgatttccagcttcccagcctttttatcagtcccttttctaatacaacaaggtgcattaatttgattaggcaaattagagttctaagacacttcttgaattgtagacagaaaatattggattcacaatttcagcagaaatttgagaatgagtgtgtttatattaatttcacaattagctgtattttctgtagcatagattatgtcactgttgcactttcacagcagacatgctttcagaaggttctcatattttatgtttgattgctgataagccatctctattgatacagattttggttaagtaaggaaaaccaggtgtgtgtctgtatcatttattgtaaatgccagctgccacttgccaaccatcatgttcagttcaattcaaagaaaacaaactctcattacttagtgtaaactaaaatacttaacaaattatatcctaaaaacaaggtctctttgttaaatgttgcatgccctaggttttaaattactacatccaaatacagttttcgtcttaaatttgttaagctaaatatatgttggttctttttattttggaatcctttaagcatcttaaacattttttttttgaagagaagttacaaataacatttctatcaggtagtacttgtatgaaaccacctttcttattctataattttgatttttcaattttatatacttaatatactcactgtcttactatcagaaagttattttgaccaagatttttattatcttcatagattcagaaagagatgctaattctgtaccaatgtcttcctggttactattctcttccctctaatatatactggccatttgtaaaaccattgtgttgttgggatcacttagttatactatacgcagatagagcatctcaactctgtcatagtgtttgctgaacagttttcagtgtcatgcacctttggctgctaattgttcctgacgtgcactcttccgagttggtaaaggcacagtgtgttcatgccagacttctaagagaaacaccagcctcttaaatcagaagcctacacacaacccccttaacaatccaaagaagcttgatggtgtgcaaagaagcatcctgccagccttgtcattgttctgttctatgctaatcctgctgtgttgtctaaaagatggagggaagaggacatcagtgtctgatagtgaaatcatcagcaggaaagtgaagctctttccttggttacagataagacttggtttacactattggccagtatctgctaaacatatgaagacttaactattcagtgttgcctaggcattcgcctgcacaacattttgaggttagaacatagaatattttcagaaatactgttgtagtttgtgagtgttgttcattagttacacattagctatagagtggatgcatgaagccccatgacaccagtaaacttctcttaccagtaggtaaaccaaacaccattctgtcattagcagccctcttaaatgttgcctctccgtatcctgttgcatttttgtgtgcattgtgtttctactgatctctcttaggtttttacggaatcaaaggaaactaatttttccttaatagcaagaaagatgaagaggtaaagggcattgaagcagaaatgtatagtttggggtacgattagaaaactcgtaaggaaaacagaagtcctaatttcaaactgactgctcttcgttaagtgctcttaaggagagtctagtaacagtaacactttctggccatttctagtttagattctcttcgttactgaaacttttgagaaatattacctgtggattaattttgcacaatgttctattctcataatgacttacaaattaaactaggtttttattgaactacctcacactaattttctatgctttcccaagtaagctgttgccctgttagatctttactgagtgaattataaatgtgtgttaaatactttctagccaatgttgacacaataccagtaagtatgtaaagtatataccttacatcagtaagagacacgtgtaaaatctttgactgtatgtcttgcaaaattgtgctcgttgacattattactgtttttgtaagtagaaacctgctcgtgatatcggtccatttacattttacaaaaggagtaaatcttagtaaaaattttacgaagaaataaattacttttgtaggcccaatatttggtatatttttgagaagctgttaatcttttagctgaataatgaagttagactgaattacgtgtctccctggactgtgacatctattttctcattacagtttatcctggtcagcagggtgtcacacctggaaacctgagtatgatagctgacatttgcttttctccctctgcgatgtcattcctcctccattcctctccttccctgtgttccgttccctctcctttcctctagacaaaacaaaatggggcactttttagggaatgctgagatcattattgtggtttttcatcattcatgccctagtcattaaacatgcaccactggaatgtaaacaatgttatctagtatgtcaattggttataatattttaaataaaaaagaaaaaagtggtatgaaaattatgaaa

SEQ ID NO: 586 - DNA, 927 bp, Homo sapiens
atgagcagaagcaagcgtgacaacaatttttatagtgtagagattggagattctacattcacagtcctgaaacgatatcagaatttaaaacctataggctcaggagctcaaggaatagtatgcgcagcttatgatgccattcttgaaagaaatgttgcaatcaagaagctaagccgaccatttcagaatcagactcatgccaagcgggcctacagagagctagttcttatgaaatgtgttaatcacaaaaatataattggccttttgaatgttttcacaccacagaaatccctagaagaatttcaagatgtttacatagtcatggagctcatggatgcaaatctttgccaagtgattcagatggagctagatcatgaaagaatgtcctaccttctctatcagatgctgtgtggaatcaagcaccttcattctgctggaattattcatcgggacttaaagcccagtaatatagtagtaaaatctgattgcactttgaagattcttgacttcggtctggccaggactgcaggaacgagttttatgatgacgccttatgtagtgactcgctactacagagcacccgaggtcatccttggcatgggctacaaggaaaacgctgactcagaacacaacaaacttaaagccagtcaggcaagggatttgttatccaaaatgctggtaatagatgcatctaaaaggatctctgtagatgaagctctccaacacccgtacatcaatgtctggtatgatccttctgaagcagaagctccaccaccaaagatccctgacaagcagttagatgaaagggaacacacaatagaagagtggaaagaattgatatataaggaagttatggacttggaggagagaaccaagaatggagttatacgggggcagccctctcctttagcacaggtgcagcagtga

SEQ ID NO: 587 - DNA, 860 bp, Homo sapiens
acctgggtgcgctccgctgcccgccagcccgcctgccgccgcgagccccgcccgcctgtcctctcgcgtcctcttcgcgtgggtcctgcctccgcggcgggagaagaaaatggagcggggggtcttgcagccttacagtcatttgtaatggttacctcagattcccctgctgtggttaacgttaaacctaggaggtcagatgctctaagtgaacatgtttagtgctgtgcctgacaaaagcaagcaatcaaaatgggacttccttgagggcaggcctgtcttgcatctgtttctccaccacctagcctggaatataactggccttatgggtttctagaaggaaaatcacagaggtaaagcatcatttcatcacatcctgtcaaggcttcttggtgaatttttggatgaagccattaaattaattgcttgccatcatgagcagaagcaagcgtgacaacaatttttatagtgtagagattggagattctacattcacagtcctgaaacgatatcagaatttaaaacctataggctcaggagctcaaggaatagtatgcgcagcttatgatgccattcttgaaagaaatgttgcaatcaagaagctaagccgaccatttcagaatcagactcatgccaagcgggcctacagagagctagttcttatgaaatgtgttaatcacaaaaatataattggccttttgaatgttttcacaccacagaaatccctagaagaatttcaagatgtttacatagtcatggagctcatggatgcaaatctttgccaagtgattcagatggagctagatcatgaaagaatgtcctaccttctctatcagatgctgtgtggaatcaagcacctt

SEQ ID NO: 588 - DNA, 603 bp, Homo sapiens
actcagccgagcggccgaggccggacgacgcggcttggattgcggagccgcgagcagcgctgggtaacggccgcggcgaccaccccggacggcccctgtccccgctggcgggcttccctgtcgccgttcgctgcgctgccggcttcttggtgaatttttggatgaagccattaaattaattgcttgccatcatgagcagaagcaagcgtgacaacaatttttatagtgtagagattggagattctacattcacagtcctgaaacgatatcagaatttaaaacctataggctcaggagctcaaggaatagtatgataattggccttttgaatgttttcacaccacagaaatccctagaagaatttcaagatgtttacatagtcatggagctcatggatgcaaatctttgccaagtgattcagatggagctagatcatgaaagaatgtcctaccttctctatcagatgctgtgtggaatcaagcaccttcattctgctggaattattcatcgggacttaaagcccagtaatatagtagtaaaatctgattgcactttgaagattcttgacttcggtctggccaggactgcaggaacgagttttat

SEQ ID NO: 589 - DNA, 907 bp, Homo sapiens
cgcggtgacggcccgcgtctctgttactcagccgagcggccgaggccggacgacgcggcttggattgcggagccgcgagcagcgctgggtaacggccgcggcgaccaccccggacggcccctgtccccgctggcgggcttccctgtcgccgttcgctgcgctgccggtcttgcagccttacagtcatttgtaatggttacctcagattcccctgctgtggttaacgttaaacctaggaggtcagatgctctaagtgaacatgtttagtgctgtgcctgacaaaagcaagcaatcaaaatgggacttccttgagggcaggcctgtcttgcatctgtttctccaccacctagcctggaatataactggccttatgggtttctagaaggaaaatcacagaggtaaagcatcatttcatcacatcctgtcaaggcttcttggtgaatttttggatgaagccattaaattaattgcttgccatcatgagcagaagcaagcgtgacaacaatttttatagtgtagagattggagattctacattcacagtcctgaaacgatatcagaatttaaaacctataggctcaggagctcaaggaatagtatgcgcagcttatgatgccattcttgaaagaaatgttgcaatcaagaagctaagccgaccatttcagaatcagactcatgccaagcgggcctacagagagctagttcttatgaaatgtgttaatcacaaaaatataattggccttttgaatgttttcacaccacagaaatccctagaagaatttcaagatgtttacatagtcatggagctcatggatgcaaatctttgccaagtgattcagatggagctagatcatgaaagaatgtcctaccttctctatcagatgctgtgtggaatcaagcaccttca

SEQ ID NO: 590 - DNA, 2672 bp, Homo sapiens
ggtaggttccacaatggtacaggcagcatcacgctgcacaatggtttccaggcagtgaaagagggtgattcagcaagccactcttcttctattttctttaacctccccttcactttttatttttatgggggtgggtggtgcttgctatatgcttacctttttcttttcttttttcatttttacaaatttccttttttgtcctcacccctcaattcctaggggcttgagtgagtttaagattgggttttcttggaaatcacctgtccatcgttaattttaaacaatctccatatctccaaagaatctcttccatgttagtctggaatgtggttaatgaaaaacaagtagggaggatttctggggcaaacactgccggatcaggatcgtagttctcaggcacggaatggctagtgtgagaaacaccaacagcaggcccatctcagatcttcactatggcaacttatgcaagaaactgttgaattagacccgtttcctatagatgagaaaccatacaagctgtggtatttatgagcctccatttcttatactactgcagtgaaccaacattggatgtgaaaattgccttttgtcagggattcgataaacaagtggatgtgtcatatattgccaaacattacaacatgagcaaaagcaaagttgacaaccagttctacagtgtggaagtgggagactcaaccttcacagttctcaagcgctaccagaatctaaagcctattggctctggggctcagggcatagtttgtgccgcgtatgatgctgtccttgacagaaatgtggccattaagaagctcagcagaccctttcagaaccaaacacatgccaagagagcgtaccgggagctggtcctcatgaagtgtgtgaaccataaaaacattattagtttattaaatgtcttcacaccccagaaaacgctggaggagttccaagatgtttacttagtaatggaactgatggatgccaacttatgtcaagtgattcagatggaattagaccatgagcgaatgtcttacctgctgtaccaaatgttgtgtggcattaagcacctccattctgctggaattattcacagggatttaaaaccaagtaacattgtagtcaagtctgattgcacattgaaaatcctggactttggactggccaggacagcaggcacaagcttcatgatgactccatatgtggtgacacgttattacagagcccctgaggtcatcctggggatgggctacaaggagaacgtggatatatggtctgtgggatgcattatgggagaaatggttcgccacaaaatcctctttccaggaagggactatattgaccagtggaataaggtaattgaacaactaggaacaccatgtccagaattcatgaagaaattgcaacccacagtaagaaactatgtggagaatcggcccaagtatgcgggactcaccttccccaaactcttcccagattccctcttcccagcggactccgagcacaataaactcaaagccagccaagccagggacttgttgtcaaagatgctagtgattgacccagcaaaaagaatatcagtggacgacgccttacagcatccctacatcaacgtctggtatgacccagccgaagtggaggcgcctccacctcagatatatgacaagcagttggatgaaagagaacacacaattgaagaatggaaagaacttatctacaaggaagtaatgaattcagaagaaaagactaaaaatggtgtagtaaaaggacagccttctccttcaggtgcagcagtgaacagcagtgagagtctccctccatcctcgtctgtcaatgacatctcctccatgtccaccgaccagaccctggcatctgacactgacagcagcctggaagcctcggcaggacccctgggttgttgcaggtgactagccgcctgcctgcgaaacccagcgttcttcaggagatgatgtgatggaacacacacacacgcagacacacacacacacacaaatgcagacacacaacatcaagaaaacagcaagggagagaatccaagcctaaaattaaataaatctttcagcctgcttcttccccagggttctgtattgcagctaagctcaaatgtatatttaacttctagttgctcttgctttggtcttcttccaatgatgcttactacagaaagcaaatcagacacaattagagaagccttttccataaagtgtaattttaatggctgcaaaaccggcaacctgtaactgcccttttaaatggcatgacaaggtgtgcagtggccccatccagcatgtgtgtgtctctatcttgcatctacctgctccttggcctagtcagatggatgtagatacagatccgcatgtgtctgtattcatacagcactacttacttagagatgctactgtcagtgtcctcagggctctaccaagacataatgcactggggtaccacatggtccatttcatgtgatctattactctgacataaacccatctgtaatatattgccagtatataagctgtttagtttgttaattgattaaactgtatgtcttataagaaaacatgtaaagggggaatatatggggggagtgagctctctcagacccttgaagatgtagcttccaaatttgaatggattaaatggcacctgtataccaa

SEQ ID NO: 591 - DNA, 2371 bp, Homo sapiens
agaaatggcgtggcaggggacccagcgagcccagagggattttgccgctgcttcctctacccctgtatttcacgcagctctctaaattgactcagctccaggctagtgtgagaaacaccaacagcaggcccatctcagatcttcactatggcaacttatgcaagaaactgttgaattagacccgtttcctatagatgagaaaccatacaagctgtggtatttatgagcctccatttcttatactactgcagtgaaccaacattggatgtgaaaattgccttttgtcagggattcgataaacaagtggatgtgtcatatattgccaaacattacaacatgagcaaaagcaaagttgacaaccagttctacagtgtggaagtgggagactcaaccttcacagttctcaagcgctaccagaatctaaagcctattggctctggggctcagggcatagtttgtgccgcgtatgatgctgtccttgacagaaatgtggccattaagaagctcagcagaccctttcagaaccaaacacatgccaagagagcgtaccgggagctggtcctcatgaagtgtgtgaaccataaaaacattattagtttattaaatgtcttcacaccccagaaaacgctggaggagttccaagatgtttacttagtaatggaactgatggatgccaacttatgtcaagtgattcagatggaattagaccatgagcgaatgtcttacctgctgtaccaaatgttgtgtggcattaagcacctccattctgctggaattattcacagggatttaaaaccaagtaacattgtagtcaagtctgattgcacattgaaaatcctggactttggactggccaggacagcaggcacaagcttcatgatgactccatatgtggtgacacgttattacagagcccctgaggtcatcctggggatgggctacaaggagaacgtggatatatggtctgtgggatgcattatgggagaaatggttcgccacaaaatcctctttccaggaagggactatattgaccagtggaataaggtaattgaacaactaggaacaccatgtccagaattcatgaagaaattgcaacccacagtaagaaactatgtggagaatcggcccaagtatgcgggactcaccttccccaaactcttcccagattccctcttcccagcggactccgagcacaataaactcaaagccagccaagccagggacttgttgtcaaagatgctagtgattgacccagcaaaaagaatatcagtggacgacgccttacagcatccctacatcaacgtctggtatgacccagccgaagtggaggcgcctccacctcagatatatgacaagcagttggatgaaagagaacacacaattgaagaatggaaagaacttatctacaaggaagtaatgaattcagaagaaaagactaaaaatggtgtagtaaaaggacagccttctccttcagcacaggtgcagcagtgaacagcagtgagagtctccctccatcctcgtctgtcaatgacatctcctccatgtccaccgaccagaccctggcatctgacactgacagcagcctggaagcctcggcaggacccctgggttgttgcaggtgactagccgcctgcctgcgaaacccagcgttcttcaggagatgatgtgatggaacacacacacacgcagacacacacacacacacaaatgcagacacacaacatcaagaaaacagcaagggagagaatccaagcctaaaattaaataaatctttcagcctgcttcttccccagggttctgtattgcagctaagctcaaatgtatatttaacttctagttgctcttgctttggtcttcttccaatgatgcttactacagaaagcaaatcagacacaattagagaagccttttccataaagtgtaattttaatggctgcaaaaccggcaacctgtaactgcccttttaaatggcatgacaaggtgtgcagtggccccatccagcatgtgtgtgtctctatcttgcatctacctgctccttggcctagtcagatggatgtagatacagatccgcatgtgtctgtattcatacagcactacttacttagagatgctactgtcagtgtcctcagggctctaccaagacataatgcactggggtaccacatggtccatttcatgtgatctattactctgacataaacccatctgtaatatattgccagtatataagctgtttagtttgttaattgattaaactgtatgtcttataagaaaacatgtaaagggggaatatatggggggagtgagctctctcagacccttgaagatgtagcttccaaatttgaatggattaaatggcacctgtatacca

SEQ ID NO: 592 - DNA, 1828 bp, Homo sapiens
gacagaaatgtggccattaagaagctcagcagaccctttcagaaccaaacacatgccaagagagcgtaccgggagctggtcctcatgaagtgtgtgaaccataaaaacttacttagtaatggaactgatggatgccaacttatgtcaagtgattcagatggaattagaccatgagcgaatgtcttacctgctgtaccaaatgttgtgtggcattaagcacctccattctgctggaattattcacagggatttaaaaccaagtaacattgtagtcaagtctgattgcacattgaaaatcctggactttggactggccaggacagcaggcacaagcttcatgatgactccatatgtggtgacacgttattacagagcccctgaggtcatcctggggatgggctacaaggagaacgtggatatatggtctgtgggatgcattatgggagaaatggttcgccacaaaatcctctttccaggaagggactatattgaccagtggaataaggtaattgaacaactaggaacaccatgtccagaattcatgaagaaattgcaacccacagtaagaaactatgtggagaatcggcccaagtatgcgggactcaccttccccaaactcttcccagattccctcttcccagcggactccgagcacaataaactcaaagccagccaagccagggacttgttgtcaaagatgctagtgattgacccagcaaaaagaatatcagtggacgacgccttacagcatccctacatcaacgtctggtatgacccagccgaagtggaggcgcctccacctcagatatatgacaagcagttggatgaaagagaacacacaattgaagaatggaaagaacttatctacaaggaagtaatgaattcagaagaaaagactaaaaatggtgtagtaaaaggacagccttctccttcaggtgcagcagtgaacagcagtgagagtctccctccatcctcgtctgtcaatgacatctcctccatgtccaccgaccagaccctggcatctgacactgacagcagcctggaagcctcggcaggacccctgggttgttgcaggtgactagccgcctgcctgcgaaacccagcgttcttcaggagatgatgtgatggaacacacacacacgcagacacacacacacacacaaatgcagacacacaacatcaagaaaacagcaagggagagaatccaagcctaaaattaaataaatctttcagcctgcttcttccccagggttctgtattgcagctaagctcaaatgtatatttaacttctagttgctcttgctttggtcttcttccaatgatgcttactacagaaagcaaatcagacacaattagagaagccttttccataaagtgtaattttaatggctgcaaaaccggcaacctgtaactgcccttttaaatggcatgacaaggtgtgcagtggccccatccagcatgtgtgtgtctctatcttgcatctacctgctccttggcctagtcagatggatgtagatacagatccgcatgtgtctgtattcatacagcactacttacttagagatgctactgtcagtgtcctcagggctctaccaagacataatgcactggggtaccacatggtccatttcatgtgatctattactctgacataaacccatctgtaatatattgccagtatataagctgtttagtttgttaattgattaaactgtatgtcttataagaaaacatgtaaagggggaatatatggggggagtgagctctctcagacccttgaagatgtagcttccaaatttgaatggattaaatggcacctgtataccaa

SEQ ID NO: 593 - DNA, 2154 bp, Homo sapiens
aattatatgctatattcttggcaagatctttttcttctcctttgccctcttctactccttccccccttctcctgtttctccttcttcccttcctccaactcttcttcatcctcctagcatgtagaatattcttatgccagtcactcatatctttacttaaagcctgattggcatgtgaccagagtagacagtatctaagattccgaaatagcattttctttaccagtatccttaatcaagtaggcaagagttctaaggaatcttttgttcttaattctgagttgctcttggatctctacagtgccgcgtatgatgctgtccttgacagaaatgtggccattaagaagctcagcagaccctttcagaaccaaacacatgccaagagagcgtaccgggagctggtcctcatgaagtgtgtgaaccataaaaacttacttagtaatggaactgatggatgccaacttatgtcaagtgattcagatggaattagaccatgagcgaatgtcttacctgctgtaccaaatgttgtgtggcattaagcacctccattctgctggaattattcacagggatttaaaaccaagtaacattgtagtcaagtctgattgcacattgaaaatcctggactttggactggccaggacagcaggcacaagcttcatgatgactccatatgtggtgacacgttattacagagcccctgaggtcatcctggggatgggctacaaggagaacgtggatatatggtctgtgggatgcattatgggagaaatggttcgccacaaaatcctctttccaggaagggactatattgaccagtggaataaggtaattgaacaactaggaacaccatgtccagaattcatgaagaaattgcaacccacagtaagaaactatgtggagaatcggcccaagtatgcgggactcaccttccccaaactcttcccagattccctcttcccagcggactccgagcacaataaactcaaagccagccaagccagggacttgttgtcaaagatgctagtgattgacccagcaaaaagaatatcagtggacgacgccttacagcatccctacatcaacgtctggtatgacccagccgaagtggaggcgcctccacctcagatatatgacaagcagttggatgaaagagaacacacaattgaagaatggaaagaacttatctacaaggaagtaatgaattcagaagaaaagactaaaaatggtgtagtaaaaggacagccttctccttcagcacaggtgcagcagtgaacagcagtgagagtctccctccatcctcgtctgtcaatgacatctcctccatgtccaccgaccagaccctggcatctgacactgacagcagcctggaagcctcggcaggacccctgggttgttgcaggtgactagccgcctgcctgcgaaacccagcgttcttcaggagatgatgtgatggaacacacacacacgcagacacacacacacacacaaatgcagacacacaacatcaagaaaacagcaagggagagaatccaagcctaaaattaaataaatctttcagcctgcttcttccccagggttctgtattgcagctaagctcaaatgtatatttaacttctagttgctcttgctttggtcttcttccaatgatgcttactacagaaagcaaatcagacacaattagagaagccttttccataaagtgtaattttaatggctgcaaaaccggcaacctgtaactgcccttttaaatggcatgacaaggtgtgcagtggccccatccagcatgtgtgtgtctctatcttgcatctacctgctccttggcctagtcagatggatgtagatacagatccgcatgtgtctgtattcatacagcactacttacttagagatgctactgtcagtgtcctcagggctctaccaagacataatgcactggggtaccacatggtccatttcatgtgatctattactctgacataaacccatctgtaatatattgccagtatataagctgtttagtttgttaattgattaaactgtatgtcttataagaaaacatgtaaagggggaatatatggggggagtgagctctctcagacccttgaagatgtagcttccaaatttgaatggattaaatggcacctgtatacc

SEQ ID NO: 594 - DNA, 1955 bp, Homo sapiens
ttcaccggaaaacacagtagctgtagctgcacatagacgcttcctctttctgtttccccctcatccccctccctagacctctctgggctttgacgtcatgtgtgctcctttcggttgccatagcaaccccattccccaagccctctgtccgtctcctctggtaggttccacaatggtacaggcagcatcacgctgcacaatggtttccaggcagtgaaagagggtgattcagcaagccactcttcttctattttctttaacctccccttcactttttatttttatgggggtgggtggtgcttgctatatgcttacctttttcttttcttttttcatttttacaaatttccttttttgtcctcacccctcaattcctaggggcttgagtgagtttaagattgggttttcttggaaatcacctgtccatcgttaattttaaacaatctccatatctccaaagaatctcttccatgttagtctggaatgtggttaatgaaaaacaagtagggaggatttctggggcaaacactgccggatcaggatcgtagttctcaggcacggaatggctagtgtgagaaacaccaacagcaggcccatctcagatcttcactatggcaacttatgcaagaaactgttgaattagacccgtttcctatagatgagaaaccatacaagctgtggtatttatgagcctccatttcttatactactgcagtgaaccaacattggatgtgaaaattgccttttgtcagggattcgataaacaagtggatgtgtcatatattgccaaacattacaacatgagcaaaagcaaagttgacaaccagttctacagtgtggaagtgggagactcaaccttcacagttctcaagcgctaccagaatctaaagcctattggctctggggctcagggcatagtttgtgccgcgtatgatgctgtccttgacagaaatgtggccattaagaagctcagcagaccctttcagaaccaaacacatgccaagagagcgtaccgggagctggtcctcatgaagtgtgtgaaccataaaaacattattagtttattaaatgtcttcacaccccagaaaacgctggaggagttccaagatgtttacttagtaatggaactgatggatgccaacttatgtcaagtgattcagatggaattagaccatgagcgaatgtcttacctgctgtaccaaatgttgtgtggcattaagcacctccattctgctggaattattcacagggatttaaaaccaagtaacattgtagtcaagtctgattgcacattgaaaatcctggactttggactggccaggacagcaggcacaagcttcatgatgactccatatgtggtgacacgttattacagagcccctgaggtcatcctggggatgggctacaaggagaacgtggatatatggtctgtgggatgcattatgggagaaatggttcgccacaaaatcctctttccaggaagggactatattgaccagtggaataaggtaattgaacaactaggaacaccatgtccagaattcatgaagaaattgcaacccacagtaagaaactatgtggagaatcggcccaagtatgcgggactcaccttccccaaactcttcccagattccctcttcccagcggactccgagcacaataaactcaaagccagccaagccagggacttgttgtcaaagatgctagtgattgacccagcaaaaagaatatcagtggacgacgccttacagcatccctacatcaacgtctggtatgacccagccgaagtggaggcgcctccacctcagatatatgacaagcagttggatgaaagagaacacacaattgaagaatggaaagaacttatctacaaggaagtaatgaattcagaagaaaagactaaaaatggtgtagtaaaaggacagccttctccttcagcacaggtgcagcagtga

SEQ ID NO: 595 - DNA, 3081 bp, Homo sapiens
attctgtgctgggatactgtgtcccctgcaaatgtcagagctcttttgaaaaaaaaatcagaaataagtatggcagtatatttgttagaatctatgtatttgtgccttcaacaaaataaatgtaatttactggaaaatctgtaagtaaatcaggctatagatattacaagaaaactatctatccatatatttttctcaccctccccaaacatttaaatctagagacctagtctctgcttttacccccttaaacagataacttcccagggtactgcaatttagccacagaaaaagaatggcttatgccacagcagtaggctctgaagcaatcacaaggttgtttacatgggctgcctttggtgcagagcctgacagtgtctgtacagcagccctgcctgcttctggccatgttgatgataacttttatgaacaaactgcaaggaagcaggctaagtcatatgggatagactacagttcaggtggaaggaaaacgagtgtaagtgcaccaggcattgccagcacaacatccaatatctccttctatccctcatcggctagttgtcggaccctggaagataacacagaatgcttatcaacatatttaaaatagttgcagtaaggaccatttctctcagagaagcttctgtgaattttctactttaggtgagcatatatgttacaaatatataacaaataaatatataagtatatcacaagcttctgactccacttcagaaccattagattttaggggctggatgctttggatgtagcggtttggctgcctctggctagtgtgagaaacaccaacagcaggcccatctcagatcttcactatggcaacttatgcaagaaactgttgaattagacccgtttcctatagatgagaaaccatacaagctgtggtatttatgagcctccatttcttatactactgcagtgaaccaacattggatgtgaaaattgccttttgtcaggtgtgtgttccttacaggtaaaacaagggattcgataaacaagtggatgtgtcatatattgccaaacattacaacatgagcaaaagcaaagttgacaaccagttctacagtgtggaagtgggagactcaaccttcacagttctcaagcgctaccagaatctaaagcctattggctctggggctcagggcatagtttgtgccgcgtatgatgctgtccttgacagaaatgtggccattaagaagctcagcagaccctttcagaaccaaacacatgccaagagagcgtaccgggagctggtcctcatgaagtgtgtgaaccataaaaacattattagtttattaaatgtcttcacaccccagaaaacgctggaggagttccaagatgtttacttagtaatggaactgatggatgccaacttatgtcaagtgattcagatggaattagaccatgagcgaatgtcttacctgctgtaccaaatgttgtgtggcattaagcacctccattctgctggaattattcacagggatttaaaaccaagtaacattgtagtcaagtctgattgcacattgaaaatcctggactttggactggccaggacagcaggcacaagcttcatgatgactccatatgtggtgacacgttattacagagcccctgaggtcatcctggggatgggctacaaggagaacgtggatatatggtctgtgggatgcattatgggagaaatggttcgccacaaaatcctctttccaggaagggactatattgaccagtggaataaggtaattgaacaactaggaacaccatgtccagaattcatgaagaaattgcaacccacagtaagaaactatgtggagaatcggcccaagtatgcgggactcaccttccccaaactcttcccagattccctcttcccagcggactccgagcacaataaactcaaagccagccaagccagggacttgttgtcaaagatgctagtgattgacccagcaaaaagaatatcagtggacgacgccttacagcatccctacatcaacgtctggtatgacccagccgaagtggaggcgcctccacctcagatatatgacaagcagttggatgaaagagaacacacaattgaagaatggaaagaacttatctacaaggaagtaatgaattcagaagaaaagactaaaaatggtgtagtaaaaggacagccttctccttcaggtgcagcagtgaacagcagtgagagtctccctccatcctcgtctgtcaatgacatctcctccatgtccaccgaccagaccctggcatctgacactgacagcagcctggaagcctcggcaggacccctgggttgttgcaggtgactagccgcctgcctgcgaaacccagcgttcttcaggagatgatgtgatggaacacacacacacgcagacacacacacacacacaaatgcagacacacaacatcaagaaaacagcaagggagagaatccaagcctaaaattaaataaatctttcagcctgcttcttccccagggttctgtattgcagctaagctcaaatgtatatttaacttctagttgctcttgctttggtcttcttccaatgatgcttactacagaaagcaaatcagacacaattagagaagccttttccataaagtgtaattttaatggctgcaaaaccggcaacctgtaactgcccttttaaatggcatgacaaggtgtgcagtggccccatccagcatgtgtgtgtctctatcttgcatctacctgctccttggcctagtcagatggatgtagatacagatccgcatgtgtctgtattcatacagcactacttacttagagatgctactgtcagtgtcctcagggctctaccaagacataatgcactggggtaccacatggtccatttcatgtgatctattactctgacataaacccatctgtaatatattgccagtatataagctgtttagtttgttaattgattaaactgtatgtcttataagaaaacatgtaaagggggaatatatggggggagtgagctctctcagacccttgaagatgtagcttccaaatttgaatggattaaatggcacctgtatacc

SEQ ID NO: 596 - DNA, 4107 bp, Homo sapiens
cctttcggttgccatagcaaccccattccccaagccctctgtccgtctcctctggtaggttccacaatggtacaggcagcatcacgctgcacaatggtttccaggcagtgaaagagggtgattcagcaagccactcttcttctattttctttaacctccccttcactttttatttttatgggggtgggtggtgcttgctatatgcttacctttttcttttcttttttcatttttacaaatttccttttttgtcctcacccctcaattcctaggggcttgagtgagtttaagattgggttttcttggaaatcacctgtccatcgttaattttaaacaatctccatatctccaaagaatctcttccatgttagtctggaatgtggttaatgaaaaacaagtagggaggatttctggggcaaacactgccggatcaggatcgtagttctcaggcacggaatggctagtgtgagaaacaccaacagcaggcccatctcagatcttcactatggcaacttatgcaagaaactgttgaattagacccgtttcctatagatgagaaaccatacaagctgtggtatttatgagcctccatttcttatactactgcagtgaaccaacattggatgtgaaaattgccttttgtcaggtgtgtgttccttacaggtaaaacaagggattcgataaacaagtggatgtgtcatatattgccaaacattacaacatgagcaaaagcaaagttgacaaccagttctacagtgtggaagtgggagactcaaccttcacagttctcaagcgctaccagaatctaaagcctattggctctggggctcagggcatagtttgtgccgcgtatgatgctgtccttgacagaaatgtggccattaagaagctcagcagaccctttcagaaccaaacacatgccaagagagcgtaccgggagctggtcctcatgaagtgtgtgaaccataaaaacattattagtttattaaatgtcttcacaccccagaaaacgctggaggagttccaagatgtttacttagtaatggaactgatggatgccaacttatgtcaagtgattcagatggaattagaccatgagcgaatgtcttacctgctgtaccaaatgttgtgtggcattaagcacctccattctgctggaattattcacagggatttaaaaccaagtaacattgtagtcaagtctgattgcacattgaaaatcctggactttggactggccaggacagcaggcacaagcttcatgatgactccatatgtggtgacacgttattacagagcccctgaggtcatcctggggatgggctacaaggagaacgtggatatatggtctgtgggatgcattatgggagaaatggttcgccacaaaatcctctttccaggaagggactatattgaccagtggaataaggtaattgaacaactaggaacaccatgtccagaattcatgaagaaattgcaacccacagtaagaaactatgtggagaatcggcccaagtatgcgggactcaccttccccaaactcttcccagattccctcttcccagcggactccgagcacaataaactcaaagccagccaagccagggacttgttgtcaaagatgctagtgattgacccagcaaaaagaatatcagtggacgacgccttacagcatccctacatcaacgtctggtatgacccagccgaagtggaggcgcctccacctcagatatatgacaagcagttggatgaaagagaacacacaattgaagaatggaaagaacttatctacaaggaagtaatgaattcagaagaaaagactaaaaatggtgtagtaaaaggacagccttctccttcaggtgcagcagtgaacagcagtgagagtctccctccatcctcgtctgtcaatgacatctcctccatgtccaccgaccagaccctggcatctgacactgacagcagcctggaagcctcggcaggacccctgggttgttgcaggtgactagccgcctgcctgcgaaacccagcgttcttcaggagatgatgtgatggaacacacacacacgcagacacacacacacacacaaatgcagacacacaacatcaagaaaacagcaagggagagaatccaagcctaaaattaaataaatctttcagcctgcttcttccccagggttctgtattgcagctaagctcaaatgtatatttaacttctagttgctcttgctttggtcttcttccaatgatgcttactacagaaagcaaatcagacacaattagagaagccttttccataaagtgtaattttaatggctgcaaaaccggcaacctgtaactgcccttttaaatggcatgacaaggtgtgcagtggccccatccagcatgtgtgtgtctctatcttgcatctacctgctccttggcctagtcagatggatgtagatacagatccgcatgtgtctgtattcatacagcactacttacttagagatgctactgtcagtgtcctcagggctctaccaagacataatgcactggggtaccacatggtccatttcatgtgatctattactctgacataaacccatctgtaatatattgccagtatataagctgtttagtttgttaattgattaaactgtatgtcttataagaaaacatgtaaagggggaatatatggggggagtgagctctctcagacccttgaagatgtagcttccaaatttgaatggattaaatggcacctgtataccaatttgtagaaagaacatatgtgatacttatgtaaagtgtggggcgagtgggtaacagttttcaggcacaaaatggtttggccttctgaaggcaggtgtgaataaaagctgagagtcttttctgtgacagtaaagagtaggagagactggagggtagtgtgtggtgtggactaagactgaaaggaggttattacccagatactaggagacactggtgtccctgttttagagatttggctctatacccatttgtcatttctcaattactggtcacaacaagaggccactggagaaagtggcaggtggtgaagcaaggttattgtgtgtgcttttgatgataagaatctctctctggaactgagcagaattgcctccatgtgaattccttcaacaaaaaaatgagcctgcctagactactttcagattgtggattgtgttttccatgtgtgggctgcttccctgattcatactctgccaaagttttattttgagaaataatattactttcctcttctgaaataaaataataataataataatgaaacccccaaaccacagtgtgagtctcaggttagcatttgaaaacatctccagagacattgttattcctcaggagtttccctgactccttaatgtggctgatgtttcatgtttatttatttattttaataagtatgagcaatcgaagggctgatcatctgagttttgtactgcagtagatgtaagagcaataactctgcccataaatttactgctgccaaatagttttagcaatatgagtttgtcttaaaagccatgaagcattaatgtcaatgtttagcaaaatctccagaatttagcttaaattaaattaaatgaaagtgctttcctgagcacttaaggaggcactgtgaaacatcttggttatgtacaaggcaataccaaggtgatctcagcaataatcaggcttcccttcttattcacttcgaagtatccatcacagttatttgcactctgaccatgttggtgctcactagagtggtgatatttcacctgaagaagtgaaagacaggaagtggatggttgatgagtgtgaactgattggcaaatagaatatccccaaaacagagcaaacaagaatgccagtgctctgaaaactgccttaaatataataatagggaactttctttctctcttcaagcaatagagaccacagggaactgcacccacctgcaccatcgccatgccagtggtgctgccattctgagattatttcacacagtcagattcagtacacgcagtcatttgtttaaaataaatagaagaacattcctttgtgcagcttgtcccctggaataaaaatggcccattttctcta

SEQ ID NO: 597 - DNA, 2382 bp, Homo sapiens
ctctcttttccattttgttacagaaccataattatcatgtgatctagacctgatacattgtagatgaagaaacatgtcgacagagccactatctgcccaacatctgatgggtagtcatagtcacagtggaactgagactaaggtttccatttttatttgactatgcttcttcccaaggctagtgtgagaaacaccaacagcaggcccatctcagatcttcactatggcaacttatgcaagaaactgttgaattagacccgtttcctatagatgagaaaccatacaagctgtggtatttatgagcctccatttcttatactactgcagtgaaccaacattggatgtgaaaattgccttttgtcagggattcgataaacaagtggatgtgtcatatattgccaaacattacaacatgagcaaaagcaaagttgacaaccagttctacagtgtggaagtgggagactcaaccttcacagttctcaagcgctaccagaatctaaagcctattggctctggggctcagggcatagtttgtgccgcgtatgatgctgtccttgacagaaatgtggccattaagaagctcagcagaccctttcagaaccaaacacatgccaagagagcgtaccgggagctggtcctcatgaagtgtgtgaaccataaaaacttacttagtaatggaactgatggatgccaacttatgtcaagtgattcagatggaattagaccatgagcgaatgtcttacctgctgtaccaaatgttgtgtggcattaagcacctccattctgctggaattattcacagggatttaaaaccaagtaacattgtagtcaagtctgattgcacattgaaaatcctggactttggactggccaggacagcaggcacaagcttcatgatgactccatatgtggtgacacgttattacagagcccctgaggtcatcctggggatgggctacaaggagaacgttgacatgtggtcagtagggtgcatcatgggagaaatgataaaaggtgcagtgctgtttcctggcactgatcatattgaccagtggaataaggtaattgaacaactaggaacaccatgtccagaattcatgaagaaattgcaacccacagtaagaaactatgtggagaatcggcccaagtatgcgggactcaccttccccaaactcttcccagattccctcttcccagcggactccgagcacaataaactcaaagccagccaagccagggacttgttgtcaaagatgctagtgattgacccagcaaaaagaatatcagtggacgacgccttacagcatccctacatcaacgtctggtatgacccagccgaagtggaggcgcctccacctcagatatatgacaagcagttggatgaaagagaacacacaattgaagaatggaaagaacttatctacaaggaagtaatgaattcagaagaaaagactaaaaatggtgtagtaaaaggacagccttctccttcaggtgcagcagtgaacagcagtgagagtctccctccatcctcgtctgtcaatgacatctcctccatgtccaccgaccagaccctggcatctgacactgacagcagcctggaagcctcggcaggacccctgggttgttgcaggtgactagccgcctgcctgcgaaacccagcgttcttcaggagatgatgtgatggaacacacacacacgcagacacacacacacacacaaatgcagacacacaacatcaagaaaacagcaagggagagaatccaagcctaaaattaaataaatctttcagcctgcttcttccccagggttctgtattgcagctaagctcaaatgtatatttaacttctagttgctcttgctttggtcttcttccaatgatgcttactacagaaagcaaatcagacacaattagagaagccttttccataaagtgtaattttaatggctgcaaaaccggcaacctgtaactgcccttttaaatggcatgacaaggtgtgcagtggccccatccagcatgtgtgtgtctctatcttgcatctacctgctccttggcctagtcagatggatgtagatacagatccgcatgtgtctgtattcatacagcactacttacttagagatgctactgtcagtgtcctcagggctctaccaagacataatgcactggggtaccacatggtccatttcatgtgatctattactctgacataaacccatctgtaatatattgccagtatataagctgtttagtttgttaattgattaaactgtatgtcttataagaaaacatgtaaagggggaatatatggggggagtgagctctctcagacccttgaagatgtagcttccaaatttgaatggattaaatggcacctgtatacc

SEQ ID NO: 598 - DNA, 563 bp, Homo sapiens
agtgccttgggcctggcttttcgcgttcttcggactagccagaggctcaggttggtgaccgagcggcagagttcctagcgcctgcagtgtggtgaactccaacttttaggccaagttgaaaatgcagccgacgacccccacacttctaacttcagaatcaaaactatgaccctagggagtgaggaggagagtgaaaaatgcgctagtgtgagaaacaccaacagcaggcccatctcagatcttcactatggcaacttatgcaagaaactgttgaattagacccgtttcctatagatgagaaaccatacaagctgtggtatttatgagcctccatttcttatactactgcagtgaaccaacattggatgtgaaaattgccttttgtcaggtgtgtgttccttacaggtaaaacaagggattcgataaacaagtggatgtgtcatatattgccaaacattacaacatgagcaaaagcaaagttgacaaccagttctacagtgtggaagtgggagactcaaccttcacagttctcaagcgctaccagaatctaaagcctattggct

SEQ ID NO: 599 - DNA, 581 bp, Homo sapiens
agctttcccagtgcctccagcagccctcctcaaggacccctgtgaggccaggcagaaatggcgtggcaggggacccagcgagcccagagggattttgccgctgcttcctctacccctgtatttcacgcagctctctaaattgactcagctccagagacaggatctagttctgtcacccaggctggatggagtgcagtggcattatcatagctcattgcagccagaaactcctgtgcttgagtgatcctcctgcctcagccttcccaatggctgggactacaggttcaaaccactaggacagcatttgccacattattgttccactaatgaaccacctcagtggctatggagatgaaattagaggcgcagggttggtgtgtggagatgggtattgacagtcaattctcccagataatataacaggtatttatgagcctccatttcttatactactgcagtgaaccaacattggatgtgaaaattgccttttgtcagggattcgataaacaagtggatgtgtcatatattgccaaacattacaacatgagcaaaagcaaagttgacaaccagttctacagtgt

SEQ ID NO: 600 - DNA, 562 bp, Homo sapiens
gtaagtgcaccaggcattgccagcacaacatccaatatctccttctatccctcatcggctagttgtcggaccctggaagataacacagaatgcttatcaacatatttaaaatagttgcagtaaggaccatttctctcagagaagcttctgtgaattttctactttaggctagtgtgagaaacaccaacagcaggcccatctcagatcttcactatggcaacttatgcaagaaactgttgaattagacccgtttcctatagatgagaaaccatacaagctgtggtatttatgagcctccatttcttatactactgcagtgaaccaacattggatgtgaaaattgccttttgtcagggattcgataaacaagtggatgtgtcatatattgccaaacattacaacatgagcaaaagcaaagttgacaaccagttctacagtgtggaagtgggagactcaaccttcacagttctcaagcgctaccagaatctaaagcctattggctctggggctcagggcatagtttgtgccgcgtatgatgctgtccttgacagaaatgtggcca

SEQ ID NO: 601 - DNA, 550 bp, Homo sapiens
atgctggaaggggatgtttatgaacagatcccagaggggctgagtgtgtttttgctgtcattgtctggctagtgtgagaaacaccaacagcaggcccatctcagatcttcactatggcaacttatgcaagaaactgttgaattagacccgtttcctatagatgagaaaccatacaagctgtggtatttatgagcctccatttcttatactactgcagtgaaccaacattggatgtgaaaattgccttttgtcaggtgtgtgttccttacaggtaaaacaagggattcgataaacaagtggatgtgtcatatattgccaaacattacaacatgagcaaaagcaaagttgacaaccagttctacagtgtggaagtgggagactcaaccttcacagttctcaagcgctaccagaatctaaagcctattggctctggggctcagggcatagtttgtgccgcgtatgatgctgtccttgacagaaatgtggccattaagaagctcagcagaccctttcagaaccaaacacatgccaagagagcgtaccgggagct

SEQ ID NO: 602 - DNA, 743 bp, Homo sapiens
ttcctctgctgttgcaaagtgtctttaatttgaggggctcctgttcttaaaaaatcctcacagtttcagtaaaacgattctggatagtgaggcagtaagaaattatatgtagagtgggaaaatcagctgcctccagcttcctgcctgctagccccagaacagcatctgctgttgagaggagtgtgtttgccatgctggaaggggatgtttatgaacagatcccagaggggctgagtgtgtttttgctgtcattgtctggctagtgtgagaaacaccaacagcaggcccatctcagatcttcactatggcaacttatgcaagaaactgttgaattagacccgtttcctatagatgagaaaccatacaagctgtggtatttatgagcctccatttcttatactactgcagtgaaccaacattggatgtgaaaattgccttttgtcagggattcgataaacaagtggatgtgtcatatattgccaaacattacaacatgagcaaaagcaaagttgacaaccagttctacagtgtggaagtgggagactcaaccttcacagttctcaagcgctaccagaatctaaagcctattggctctggggctcagggcatagtttgtgccgcgtatgatgctgtccttgacagaaatgtggccattaagaagctcagcagaccctttcagaaccaaacacatgccaagagagcgtaccgggagctggtcctcatgaagtgtgtgaaccataaaa

SEQ ID NO: 603 - DNA, 569 bp, Homo sapiens
tttcccagtgcctccagcagccctcctcaaggacccctgtgaggccaggcagaaatggcgtggcaggggacccagcgagcccagagggattttgccgctgcttcctctacccctgtatttcacgcagctctctaaattgactcagctccaggttcaaaccactaggacagcatttgccacattattgttccactaatgaaccacctcagtggtatttatgagcctccatttcttatactactgcagtgaaccaacattggatgtgaaaattgccttttgtcagggattcgataaacaagtggatgtgtcatatattgccaaacattacaacatgagcaaaagcaaagttgacaaccagttctacagtgtggaagtgggagactcaaccttcacagttctcaagcgctaccagaatctaaagcctattggctctggggctcagggcatagtttgtgccgcgtatgatgctgtccttgacagaaatgtggccattaagaagctcagcagaccctttcagaaccaaacacatgccaagagagcgtaccgggagctggtcctcatgaagtgtg

SEQ ID NO: 604 - DNA, 595 bp, Homo sapiens
attagattttaggggctggatgctttggatgtagcggtttggctgcctctggctagtgtgagaaacaccaacagcaggcccatctcagatcttcactatggcaacttatgcaagaaactgttgaattagacccgtttcctatagatgagaaaccatacaagctgtggtatttatgagcctccatttcttatactactgcagtgaaccaacattggatgtgaaaattgccttttgtcagggattcgataaacaagtggatgtgtcatatattgccaaacattacaacatgagcaaaagcaaagttgacaaccagttctacagtgtggaagtgggagactcaaccttcacagttctcaagcgctaccagaatctaaagcctattggctctggggctcagggcatagtttgtgccgcgtatgatgctgtccttgacagaaatgtggccattaagaagctcagcagaccctttcagaaccaaacacatgccaagagagcgtaccgggagctggtcctcatgaagtgtgtgaaccataaaaacattattagtttattaaatgtcttcacaccccagaaaacgctggaggagttccaagat

SEQ ID NO: 605 - DNA, 564 bp, Homo sapiens
ttagattttaggggctggatgctttggatgtagcggtttggctgcctctggctagtgtgagaaacaccaacagcaggcccatctcagatcttcactatggcaacttatgcaagaaactgttgaattagacccgtttcctatagatgagaaaccatacaagctgtggtatttatgagcctccatttcttatactactgcagtgaaccaacattggatgtgaaaattgccttttgtcaggtgtgtgttccttacaggtaaaacaagggattcgataaacaagtggatgtgtcatatattgccaaacattacaacatgagcaaaagcaaagttgacaaccagttctacagtgtggaagtgggagactcaaccttcacagttctcaagcgctaccagaatctaaagcctattggctctggggctcagggcatagtttgtgccgcgtatgatgctgtccttgacagaaatgtggccattaagaagctcagcagaccctttcagaaccaaacacatgccaagagagcgtaccgggagctggtcctcatgaagtgtgtgaaccataaaaac

SEQ ID NO: 606 - DNA, 1331 bp, Homo sapiens
aaatgtggccattaagaagctcagcagaccctttcagaaccaaacacatgccaagagagcgtaccgggagctggtcctcatgaagtgtgtgaaccataaaaacattattagtttattaaatgtcttcacaccccagaaaacgctggaggagttccaagatgtttacttagtaatggaactgatggatgccaacttatgtcaagtgattcagatggaattagaccatgagcgaatgtcttacctgctgtaccaaatgttgtgtggcattaagcacctccattctgctggaattattcacagggatttaaaaccaagtaacattgtagtcaagtctgattgcacattgaaaatcctggactttggactggccaggacagcaggcacaagcttcatgatgactccatatgtggtgacacgttattacagagcccctgaggtcatcctggggatgggctacaaggagaacgttgacatgtggtcagtagggtgcatcatgggagaaatgataaaaggtgcagtgctgtttcctggcactgatcatattgaccagtggaataaggtaattgaacaactaggaacaccatgtccagaattcatgaagaaattgcaacccacagtaagaaactatgtggagaatcggcccaagtatgcgggactcaccttccccaaactcttcccagattccctcttcccagcggactccgagcacaataaactcaaagccagccaagccagggacttgttgtcaaagatgctagtgattgacccagcaaaaagaatatcagtggacgacgccttacagcatccctacatcaacgtctggtatgacccagccgaagtggaggcgcctccacctcagatatatgacaagcagttggatgaaagagaacacacaattgaagaatggaaagaacttatctacaaggaagtaatgaattcagaagaaaagactaaaaatggtgtagtaaaaggacagccttctccttcagcacaggtgcagcagtgaacagcagtgagagtctccctccatcctcgtctgtcaatgacatctcctccatgtccaccgaccagaccctggcatctgacactgacagcagcctggaagcctcggcaggacccctgggttgttgcaggtgactagccgcctgcctgcgaaacccagcgttcttcaggagatgatgtgatggaacacacacacacgcagacacacacacacacacaaatgcagacacacaacatcaagaaaacagcaagggagagaatccaagcctaaaattaaataaatctttcagcctgcttcttccccagggttctgtattgcagctaagctc

SEQ ID NO: 607 - DNA, 2440 bp, Homo sapiens
gccacacaggataaaggagggaagggaaggagcagatcttttcggtaggaagacagattttgttgtcaggttcctgggagtgcaagagcaagtcaaaggagagagagaggagagaggaaaagccagagggagagagggggagaggggatctgttgcaggcaggggaaggcgtgacctgaatggagaatgccagccaattccagagacacacagggacctcagaacaaagataaggcatcacggacaccacaccgggcacgagctcacaggcaagtcaagctgggaggaccaaggccgggcagccgggagcacccaaggcaggaaaatgaggtggctgcttctctattatgctctgtgcttctccctgtcaaaggcttcagcccacaccgtggagctaaacaatatgtttggccagatccagtcgcctggttatccagactcctatcccagtgattcagaggtgacttggaatatcactgtcccagatgggtttcggatcaagctttacttcatgcacttcaacttggaatcctcctacctttgtgaatatgactatgtgaaggtagaaactgaggaccaggtgctggcaaccttctgtggcagggagaccacagacacagagcagactcccggccaggaggtggtcctctcccctggctccttcatgtccatcactttccggtcagatttctccaatgaggagcgtttcacaggctttgatgcccactacatggctgtggatgtggacgagtgcaaggagagggaggacgaggagctgtcctgtgaccactactgccacaactacattggcggctactactgctcctgccgcttcggctacatcctccacacagacaacaggacctgccgagtggagtgcagtgacaacctcttcactcaaaggactggggtgatcaccagccctgacttcccaaacccttaccccaagagctctgaatgcctgtataccatcgagctggaggagggtttcatggtcaacctgcagtttgaggacatatttgacattgaggaccatcctgaggtgccctgcccctatgactacatcaagatcaaagttggtccaaaagttttggggcctttctgtggagagaaagccccagaacccatcagcacccagagccacagtgtcctgatcctgttccatagtgacaactcgggagagaaccggggctggaggctctcatacagggctgcaggaaatgagtgcccagagctacagcctcctgtccatgggaaaatcgagccctcccaagccaagtatttcttcaaagaccaagtgctcgtcagctgtgacacaggctacaaagtgctgaaggataatgtggagatggacacattccagattgagtgtctgaaggatgggacgtggagtaacaagattcccacctgtaaaaaaaatgaaatcgatctggagagcgaactcaagtcagagcaagtgacagagtgaatgacgggaccccacacaatgcagacatccagaaatggatcactcccaagacccctggggcccagagctgcaccacccctccccacccacaacacccccgtgcccctttccatgtggattagaatgggtgctgaacaacatgatctcagcagttgaagctgctacgtgtgtgaaagcaaattctccacttgagggtttgcccatcattcaaacactattccagaaaataatgaaaaaaaaatgtgggatttattttagcacctctgagtggactgtacttttctcaacggaaaaaaaaaatgcccttggtccttgagacaaaagatttaatatacaaccatgtggcctcaggctgaccagatcaaagtggtttctaatccattctacatgtcaagtttaaatgaaccagactgcctgtgactttatgaatctgaaggtattacctgttgctgctttcttaaccaccatgagtaggtaaagcaaataataactcacagagtgtggatttttgagaatctgaatgttttctcattcacaaaagtatcccttctacccctatctggcgcagggctgaaatgtcatcattagaggttctgtcttctggggcttacaagttctatgtttcttaaaattcgctgattaaaaattttaaaaagataggatcacacctgaaagcagtggtcccagctctgtgctgtgggacatcacaggtcctaaacagtgatagagaaagggctggggagtggcagctggaatctctgcttccgtctgaacatctggacacacatgtcagagaatctttgcattaaatggactgcccgatctatttggtgattaaatggctgtgcggtgaggggagaaccctgggcagtctggagactgaggtgccattctcggctagagacaccacccaaagaagagatgggctggctactaaagacaagtgtcagttgaataaatgtctttaaacct

SEQ ID NO: 608 - DNA, 4015 bp, Homo sapiens
agagagagaggagagaggaaaagccagagggagagagggggagaggggatctgttgcaggcaggggaaggcgtgacctgaatggagaatgccagccaattccagagacacacagggacctcagaacaaagataaggcatcacggacaccacaccgggcacgagctcacaggcaagtcaagctgggaggaccaaggccgggcagccgggagcacccaaggcaggaaaatgaggtggctgcttctctattatgctctgtgcttctccctgtcaaaggcttcagcccacaccgtggagctaaacaatatgtttggccagatccagtcgcctggttatccagactcctatcccagtgattcagaggtgacttggaatatcactgtcccagatgggtttcggatcaagctttacttcatgcacttcaacttggaatcctcctacctttgtgaatatgactatgtgaaggtagaaactgaggaccaggtgctggcaaccttctgtggcagggagaccacagacacagagcagactcccggccaggaggtggtcctctcccctggctccttcatgtccatcactttccggtcagatttctccaatgaggagcgtttcacaggctttgatgcccactacatggctgtggatgtggacgagtgcaaggagagggaggacgaggagctgtcctgtgaccactactgccacaactacattggcggctactactgctcctgccgcttcggctacatcctccacacagacaacaggacctgccgagtggagtgcagtgacaacctcttcactcaaaggactggggtgatcaccagccctgacttcccaaacccttaccccaagagctctgaatgcctgtataccatcgagctggaggagggtttcatggtcaacctgcagtttgaggacatatttgacattgaggaccatcctgaggtgccctgcccctatgactacatcaagatcaaagttggtccaaaagttttggggcctttctgtggagagaaagccccagaacccatcagcacccagagccacagtgtcctgatcctgttccatagtgacaactcgggagagaaccggggctggaggctctcatacagggctgcaggaaatgagtgcccagagctacagcctcctgtccatgggaaaatcgagccctcccaagccaagtatttcttcaaagaccaagtgctcgtcagctgtgacacaggctacaaagtgctgaaggataatgtggagatggacacattccagattgagtgtctgaaggatgggacgtggagtaacaagattcccacctgtaaaattgtagactgtagagccccaggagagctggaacacgggctgatcaccttctctacaaggaacaacctcaccacatacaagtctgagatcaaatactcctgtcaggagccctattacaagatgctcaacaataacacaggtatatatacctgttctgcccaaggagtctggatgaataaagtattggggagaagcctacccacctgccttccagagtgtggtcagccctcccgctccctgccaagcctggtcaagaggatcattgggggccgaaatgctgagcctggcctcttcccgtggcaggccctgatagtggtggaggacacttcgagagtgccaaatgacaagtggtttgggagtggggccctgctctctgcgtcctggatcctcacagcagctcatgtgctgcgctcccagcgtagagacaccacggtgataccagtctccaaggagcatgtcaccgtctacctgggcttgcatgatgtgcgagacaaatcgggggcagtcaacagctcagctgcccgagtggtgctccacccagacttcaacatccaaaactacaaccacgatatagctctggtgcagctgcaggagcctgtgcccctgggaccccacgttatgcctgtctgcctgccaaggcttgagcctgaaggcccggccccccacatgctgggcctggtggccggctggggcatctccaatcccaatgtgacagtggatgagatcatcagcagtggcacacggaccttgtcagatgtcctgcagtatgtcaagttacccgtggtgcctcacgctgagtgcaaaactagctatgagtcccgctcgggcaattacagcgtcacggagaacatgttctgtgctggctactacgagggcggcaaagacacgtgccttggagatagcggtggggcctttgtcatctttgatgacttgagccagcgctgggtggtgcaaggcctggtgtcctgggggggacctgaagaatgcggcagcaagcaggtctatggagtctacacaaaggtctccaattacgtggactgggtgtgggagcagatgggcttaccacaaagtgttgtggagccccaggtggaacggtgagctgacttacttcctcggggcctgcctcccctgagcgaagctacaccgcacttccgacagcacactccacattacttatcagaccatatggaatggaacacactgacctagcggtggcttctcctaccgagacagcccccaggaccctgagaggcagagtgtggtatagggaaaaggctccaggcaggagacctgtgttcctgagcttgtccaagtctctttccctgtctgggcctcactctaccgagtaatacaatgcaggagctcaaccaaggcctctgtgccaatcccagcactcctttccaggccatgcttcttaccccagtggcctttattcactcctgaccacttatcaaacccatcggtcctactgttggtataactgagcttggacctgactattagaaaatggtttctaacattgaactgaatgccgcatctgtatattttcctgctctgccttctgggactagccttggcctaatccttcctctaggagaagagcattcaggttttgggagatggctcatagccaagcccctctctcttagtgtgatcccttggagcaccttcatgcctggggtttctctcccaaaagcttcttgcagtctaagccttatcccttatgttccccattaaaggaatttcaaaagacatggagaaagttgggaaggtttgtgctgactgctgggagcagaatagccgtgggaggcccaccaagcccttaaattcccattgtcaactcagaacacatttgggcccatatgccaccctggaacaccagctgacaccatgggcgtccacacctgctgctccagacaagcacaaagcaatctttcagccttgaaatgtattatctgaaaggctacctgaagcccaggcccgaatatggggacttagtcgattacctggaaaaagaaaagacccacactgtgtcctgctgtgcttttgggcaggaaaatggaagaaagagtggggtgggcacattagaagtcacccaaatcctgccaggctgcctggcatccctggggcatgagctgggcggagaatccaccccgcaggatgttcagagggacccactccttcatttttcagagtcaaaggaatcagaggctcacccatggcaggcagtgaaaagagccaggagtcctgggttctagtccctgctctgcccccaactggctgtataacctttgaaaaatcattttctttgtctgagtctctggttctccgtcagcaacaggctggcataaggtcccctgcaggttccttctagctggagcactcagagcttccctgactgctagcagcctctctggccctcacagggctgattgttctccttctccctggagctctctctcctgaaaatctccatcagagcaaggcagccagagaagcccctgagagggaatgattgggaagtgtccactttctcaaccggctcatcaaacacactcctttgtctatgaatggcacatgtaaatgatgttatattttgtatcttttatatcatatgcttcaccattctgtaaagggcctctgcattgttgctcccatcaggggtctcaagtggaaataaaccctcgtggataaccaaca

SEQ ID NO: 609 - DNA, 4407 bp, Homo sapiens
acacacagagtgatacaaatacctgcttgagcccctcagttattttctctcaagggctgaagtcagccacacaggataaaggagggaagggaaggagcagatcttttcggtaggaagacagattttgttgtcaggttcctgggagtgcaagagcaagtcaaaggagagagagaggagagaggaaaagccagagggagagagggggagaggggatctgttgcaggcaggggaaggcgtgacctgaatggagaatgccagccaattccagagacacacagggacctcagaacaaagataaggcatcacggacaccacaccgggcacgagctcacaggcaagtcaagctgggaggaccaaggccgggcagccgggagcacccaaggcaggaaaatgaggtggctgcttctctattatgctctgtgcttctccctgtcaaaggcttcagcccacaccgtggagctaaacaatatgtttggccagatccagtcgcctggttatccagactcctatcccagtgattcagaggtgacttggaatatcactgtcccagatgggtttcggatcaagctttacttcatgcacttcaacttggaatcctcctacctttgtgaatatgactatgtgaaggtagaaactgaggaccaggtgctggcaaccttctgtggcagggagaccacagacacagagcagactcccggccaggaggtggtcctctcccctggctccttcatgtccatcactttccggtcagatttctccaatgaggagcgtttcacaggctttgatgcccactacatggctgtggatgtggacgagtgcaaggagagggaggacgaggagctgtcctgtgaccactactgccacaactacattggcggctactactgctcctgccgcttcggctacatcctccacacagacaacaggacctgccgagtggagtgcagtgacaacctcttcactcaaaggactggggtgatcaccagccctgacttcccaaacccttaccccaagagctctgaatgcctgtataccatcgagctggaggagggtttcatggtcaacctgcagtttgaggacatatttgacattgaggaccatcctgaggtgccctgcccctatgactacatcaagatcaaagttggtccaaaagttttggggcctttctgtggagagaaagccccagaacccatcagcacccagagccacagtgtcctgatcctgttccatagtgacaactcgggagagaaccggggctggaggctctcatacagggctgcaggaaatgagtgcccagagctacagcctcctgtccatgggaaaatcgagccctcccaagccaagtatttcttcaaagaccaagtgctcgtcagctgtgacacaggctacaaagtgctgaaggataatgtggagatggacacattccagattgagtgtctgaaggatgggacgtggagtaacaagattcccacctgtaaaattgtagactgtagagccccaggagagctggaacacgggctgatcaccttctctacaaggaacaacctcaccacatacaagtctgagatcaaatactcctgtcaggagccctattacaagatgctcaacaataacacaggtatatatacctgttctgcccaaggagtctggatgaataaagtattggggagaagcctacccacctgccttccagtgtgtgggctccccaagttctcccggaagctgatggccaggatcttcaatggacgcccagcccagaaaggcaccactccctggattgccatgctgtcacacctgaatgggcagcccttctgcggaggctcccttctaggctccagctggatcgtgaccgccgcacactgcctccaccagtcactcgatccggaagatccgaccctacgtgattcagacttgctcagcccttctgacttcaaaatcatcctgggcaagcattggaggctccggtcagatgaaaatgaacagcatctcggcgtcaaacacaccactctccacccccagtatgatcccaacacattcgagaatgacgtggctctggtggagctgttggagagcccagtgctgaatgccttcgtgatgcccatctgtctgcctgagggaccccagcaggaaggagccatggtcatcgtcagcggctgggggaagcagttcttgcaaaggttcccagagaccctgatggagattgaaatcccgattgttgaccacagcacctgccagaaggcttatgccccgctgaagaagaaagtgaccagggacatgatctgtgctggggagaaggaagggggaaaggacgcctgtgcgggtgactctggaggccccatggtgaccctgaatagagaaagaggccagtggtacctggtgggcactgtgtcctggggtgatgactgtgggaagaaggaccgctacggagtatactcttacatccaccacaacaaggactggatccagagggtcaccggagtgaggaactgaatttggctcctcagccccagcaccaccagctgtgggcagtcagtagcagaggacgatcctccgatgaaagcagccatttctcctttccttcctcccatcccccctccttcggcctatccattactgggcaatagagcaggtatcttcacccccttttcactctctttaaagagatggagcaagagagtggtcagaacacaggccgaatccaggctctatcacttactagtttgcagtgctgggcaggtgacttcatctcttcgaacttcagtttcttcataagatggaaatgctataccttacctacctcgtaaaagtctgatgaggaaaagattaactaatagatgcatagcacttaacagagtgcatagcatacactgttttcaataaatgcaccttagcagaaggtcgatgtgtctaccaggcagacgaagctctcttacaaacccctgcctgggtcttagcattgatcagtgacacacctctcccctcaaccttgaccatctccatctgcccttaaatgctgtatgcttttttgccaccgtgcaacttgcccaacatcaatcttcaccctcatccctaaaaaagtaaaacagacaaggttctgagtcctgtggtatgtcccctagcaaatgtaactaggaacatgcactagatgacagattgcgggagggcctgagagaagcagggacaggagggagcctggggattgtggtttgggaaggcagacacctggttctagaactagctctgcccttagccccctgtatgaccctatgcaagtcctcctccctcatctcaaagggtcctcaaagctctgacgatctaagatacaatgaagccattttccccctgataagatgaggtaaagccaatgtaaccaaaaggcaaaaattacaatcggttcaaaggaactttgatgcagacaaaatgctgctgctgctgctcctgaaatacccacccctttccactacgggtgggttcccaaggacatgggacaggcaaagtgtgagccaaaggatccttccttattcctaagcagagcatctgctctgggccctggcctccttcccttcttgggaaactgggctgcatgaggtgggccctggtagtttgtaccccaggcccctatactcttccttcctatgtccacagctgaccccaagcagccgttccccgactcctcacccctgagcctcaccctgaactccctcatcttgcaaggccataagtgttttccaagcaaaatgcctctcccatcctctctcaggaagcttctagagactttatgccctccagagctccaagatataagccctccaagggatcagaagctccaagttcctgtcttctgttttatagaaattgatcttccctgggggactttaactcttgacctgtatgcagctgttggagtaattccaggtctcttgaaaaaaaagaggaagataatggagaatgagaacatatatatatatatattaagccccaggctgaatactcagggacagcaattcacagcctgcctctggttctataaacaagtcattctacctctttgtgccctgctgtttattctgtaaggggaaggtggcaatgggacccagctccatcagacacttgtcaagctagcagaaactccattttcaatgccaaagaagaactgtaatgctgttttggaatcatcccaaggcatcccaagacaccatatcttcccatttcaagcactgcctgggcacaccccaacatcccaggctgtggtggctcctgtgggaactacctagatgaagagagtatcatttataccttctaggagctcctattgggagacatgaaacatatgtaattgactaccatgtaatagaacaaaccctgccaagtgctgctttggaaagtcatggaggtaaaagaaagacc

SEQ ID NO: 610 - DNA, 3900 bp, Homo sapiens
tctctcaagggctgaagtcagccacacaggataaaggagggaagggaaggagcagatcttttcggtaggaagacagattttgttgtcaggttcctgggagtgcaagagcaagtcaaaggagagagagaggagagaggaaaagccagagggagagagggggagaggggatctgttgcaggcaggggaaggcgtgacctgaatggagaatgccagccaattccagagacacacagggacctcagaacaaagataaggcatcacggacaccacaccgggcacgagctcacaggcaagtcaagctgggaggaccaaggccgggcagccgggagcacccaaggcaggaaaatgaggtagaaactgaggaccaggtgctggcaaccttctgtggcagggagaccacagacacagagcagactcccggccaggaggtggtcctctcccctggctccttcatgtccatcactttccggtcagatttctccaatgaggagcgtttcacaggctttgatgcccactacatggctgtggatgtggacgagtgcaaggagagggaggacgaggagctgtcctgtgaccactactgccacaactacattggcggctactactgctcctgccgcttcggctacatcctccacacagacaacaggacctgccgagtggagtgcagtgacaacctcttcactcaaaggactggggtgatcaccagccctgacttcccaaacccttaccccaagagctctgaatgcctgtataccatcgagctggaggagggtttcatggtcaacctgcagtttgaggacatatttgacattgaggaccatcctgaggtgccctgcccctatgactacatcaagatcaaagttggtccaaaagttttggggcctttctgtggagagaaagccccagaacccatcagcacccagagccacagtgtcctgatcctgttccatagtgacaactcgggagagaaccggggctggaggctctcatacagggctgcaggaaatgagtgcccagagctacagcctcctgtccatgggaaaatcgagccctcccaagccaagtatttcttcaaagaccaagtgctcgtcagctgtgacacaggctacaaagtgctgaaggataatgtggagatggacacattccagattgagtgtctgaaggatgggacgtggagtaacaagattcccacctgtaaaattgtagactgtagagccccaggagagctggaacacgggctgatcaccttctctacaaggaacaacctcaccacatacaagtctgagatcaaatactcctgtcaggagccctattacaagatgctcaacaataacacaggtatatatacctgttctgcccaaggagtctggatgaataaagtattggggagaagcctacccacctgccttccagagtgtggtcagccctcccgctccctgccaagcctggtcaagaggatcattgggggccgaaatgctgagcctggcctcttcccgtggcaggccctgatagtggtggaggacacttcgagagtgccaaatgacaagtggtttgggagtggggccctgctctctgcgtcctggatcctcacagcagctcatgtgctgcgctcccagcgtagagacaccacggtgataccagtctccaaggagcatgtcaccgtctacctgggcttgcatgatgtgcgagacaaatcgggggcagtcaacagctcagctgcccgagtggtgctccacccagacttcaacatccaaaactacaaccacgatatagctctggtgcagctgcaggagcctgtgcccctgggaccccacgttatgcctgtctgcctgccaaggcttgagcctgaaggcccggccccccacatgctgggcctggtggccggctggggcatctccaatcccaatgtgacagtggatgagatcatcagcagtggcacacggaccttgtcagatgtcctgcagtatgtcaagttacccgtggtgcctcacgctgagtgcaaaactagctatgagtcccgctcgggcaattacagcgtcacggagaacatgttctgtgctggctactacgagggcggcaaagacacgtgccttggagatagcggtggggcctttgtcatctttgatgacttgagccagcgctgggtggtgcaaggcctggtgtcctgggggggacctgaagaatgcggcagcaagcaggtctatggagtctacacaaaggtctccaattacgtggactgggtgtgggagcagatgggcttaccacaaagtgttgtggagccccaggtggaacggtgagctgacttacttcctcggggcctgcctcccctgagcgaagctacaccgcacttccgacagcacactccacattacttatcagaccatatggaatggaacacactgacctagcggtggcttctcctaccgagacagcccccaggaccctgagaggcagagtgtggtatagggaaaaggctccaggcaggagacctgtgttcctgagcttgtccaagtctctttccctgtctgggcctcactctaccgagtaatacaatgcaggagctcaaccaaggcctctgtgccaatcccagcactcctttccaggccatgcttcttaccccagtggcctttattcactcctgaccacttatcaaacccatcggtcctactgttggtataactgagcttggacctgactattagaaaatggtttctaacattgaactgaatgccgcatctgtatattttcctgctctgccttctgggactagccttggcctaatccttcctctaggagaagagcattcaggttttgggagatggctcatagccaagcccctctctcttagtgtgatcccttggagcaccttcatgcctggggtttctctcccaaaagcttcttgcagtctaagccttatcccttatgttccccattaaaggaatttcaaaagacatggagaaagttgggaaggtttgtgctgactgctgggagcagaatagccgtgggaggcccaccaagcccttaaattcccattgtcaactcagaacacatttgggcccatatgccaccctggaacaccagctgacaccatgggcgtccacacctgctgctccagacaagcacaaagcaatctttcagccttgaaatgtattatctgaaaggctacctgaagcccaggcccgaatatggggacttagtcgattacctggaaaaagaaaagacccacactgtgtcctgctgtgcttttgggcaggaaaatggaagaaagagtggggtgggcacattagaagtcacccaaatcctgccaggctgcctggcatccctggggcatgagctgggcggagaatccaccccgcaggatgttcagagggacccactccttcatttttcagagtcaaaggaatcagaggctcacccatggcaggcagtgaaaagagccaggagtcctgggttctagtccctgctctgcccccaactggctgtataacctttgaaaaatcattttctttgtctgagtctctggttctccgtcagcaacaggctggcataaggtcccctgcaggttccttctagctggagcactcagagcttccctgactgctagcagcctctctggccctcacagggctgattgttctccttctccctggagctctctctcctgaaaatctccatcagagcaaggcagccagagaagcccctgagagggaatgattgggaagtgtccactttctcaaccggctcatcaaacacactcctttgtctatgaatggcacatgtaaatgatgttatattttgtatcttttatatcatatgcttcaccattctgtaaagggcctctgcattgttgctcccatcaggggtctcaagtggaaataaaccctcgtggataaccaa

SEQ ID NO: 611 - DNA, 2428 bp, Homo sapiens
aaagataaggcatcacggacaccacaccgggcacgagctcacaggcaagtcaagctgggaggaccaaggccgggcagccgggagcacccaaggcaggaaaatgaggtagaaactgaggaccaggtgctggcaaccttctgtggcagggagaccacagacacagagcagactcccggccaggaggtggtcctctcccctggctccttcatgtccatcactttccggtcagatttctccaatgaggagcgtttcacaggctttgatgcccactacatggctgtggatgtggacgagtgcaaggagagggaggacgaggagctgtcctgtgaccactactgccacaactacattggcggctactactgctcctgccgcttcggctacatcctccacacagacaacaggacctgccgagtggagtgcagtgacaacctcttcactcaaaggactggggtgatcaccagccctgacttcccaaacccttaccccaagagctctgaatgcctgtataccatcgagctggaggagggtttcatggtcaacctgcagtttgaggacatatttgacattgaggaccatcctgaggtgccctgcccctatgactacatcaagatcaaagttggtccaaaagttttggggcctttctgtggagagaaagccccagaacccatcagcacccagagccacagtgtcctgatcctgttccatagtgacaactcgggagagaaccggggctggaggctctcatacagggctgcaggaaatgagtgcccagagctacagcctcctgtccatgggaaaatcgagccctcccaagccaagtatttcttcaaagaccaagtgctcgtcagctgtgacacaggctacaaagtgctgaaggataatgtggagatggacacattccagattgagtgtctgaaggatgggacgtggagtaacaagattcccacctgtaaaattgtagactgtagagccccaggagagctggaacacgggctgatcaccttctctacaaggaacaacctcaccacatacaagtctgagatcaaatactcctgtcaggagccctattacaagatgctcaacaataacacaggtatatatacctgttctgcccaaggagtctggatgaataaagtattggggagaagcctacccacctgccttccagagtgtggtcagccctcccgctccctgccaagcctggtcaagaggatcattgggggccgaaatgctgagcctggcctcttcccgtggcaggccctgatagtggtggaggacacttcgagagtgccaaatgacaagtggtttgggagtggggccctgctctctgcgtcctggatcctcacagcagctcatgtgctgcgctcccagcgtagagacaccacggtgataccagtctccaaggagcatgtcaccgtctacctgggcttgcatgatgtgcgagacaaatcgggggcagtcaacagctcagctgcccgagtggtgctccacccagacttcaacatccaaaactacaaccacgatatagctctggtgcagctgcaggagcctgtgcccctgggaccccacgttatgcctgtctgcctgccaaggcttgagcctgaaggcccggccccccacatgctgggcctggtggccggctggggcatctccaatcccaatgtgacagtggatgagatcatcagcagtggcacacggaccttgtcagatgtcctgcagtatgtcaagttacccgtggtgcctcacgctgagtgcaaaactagctatgagtcccgctcgggcaattacagcgtcacggagaacatgttctgtgctggctactacgagggcggcaaagacacgtgccttggagatagcggtggggcctttgtcatctttgatgacttgagccagcgctgggtggtgcaaggcctggtgtcctgggggggacctgaagaatgcggcagcaagcaggtctatggagtctacacaaaggtctccaattacgtggactgggtgtgggagcagatgggcttaccacaaagtgttgtggagccccaggtggaacggtgagctgacttacttcctcggggcctgcctcccctgagcgaagctacaccgcacttccgacagcacactccacattacttatcagaccatatggaatggaacacactgacctagcggtggcttctcctaccgagacagcccccaggaccctgagaggcagagtgtggtatagggaaaaggctccaggcaggagacctgtgttcctgagcttgtccaagtctctttccctgtctgggcctcactctaccgagtaatacaatgcaggagctcaaccaaggcctctgtgccaatcccagcactcctttccaggccatgcttcttaccccagtggcctttattcactcctgaccacttatcaaacccatcggtcctactg

SEQ ID NO: 612 - DNA, 2169 bp, Homo sapiens
acacacagagtgatacaaatacctgcttgagcccctcagttattttctctcaagggctgaagtcagccacacaggataaaggagggaagggaaggagcagatcttttcggtaggaagacagattttgttgtcaggttcctgggagtgcaagagcaagtcaaaggagagagagaggagagaggaaaagccagagggagagagggggagaggggatctgttgcaggcaggggaaggcgtgacctgaatggagaatgccagccaattccagagacacacagggacctcagaacaaagataaggcatcacggacaccacaccgggcacgagctcacaggcaagtcaagctgggaggaccaaggccgggcagccgggagcacccaaggcaggaaaatgaggtggctgcttctctattatgctctgtgcttctccctgtcaaaggcttcagcccacaccgtggagctaaacaatatgtttggccagatccagtcgcctggttatccagactcctatcccagtgattcagaggtgacttggaatatcactgtcccagatgggtttcggatcaagctttacttcatgcacttcaacttggaatcctcctacctttgtgaatatgactatgtgaaggtagaaactgaggaccaggtgctggcaaccttctgtggcagggagaccacagacacagagcagactcccggccaggaggtggtcctctcccctggctccttcatgtccatcactttccggtcagatttctccaatgaggagcgtttcacaggctttgatgcccactacatggctgtggatgtggacgagtgcaaggagagggaggacgaggagctgtcctgtgaccactactgccacaactacattggcggctactactgctcctgccgcttcggctacatcctccacacagacaacaggacctgccgagtggagtgcagtgacaacctcttcactcaaaggactggggtgatcaccagccctgacttcccaaacccttaccccaagagctctgaatgcctgtataccatcgagctggaggagggtttcatggtcaacctgcagtttgaggacatatttgacattgaggaccatcctgaggtgccctgcccctatgactacatcaagatcaaagttggtccaaaagttttggggcctttctgtggagagaaagccccagaacccatcagcacccagagccacagtgtcctgatcctgttccatagtgacaactcgggagagaaccggggctggaggctctcatacagggctgcaggaaatgagtgcccagagctacagcctcctgtccatgggaaaatcgagccctcccaagccaagtatttcttcaaagaccaagtgctcgtcagctgtgacacaggctacaaagtgctgaaggataatgtggagatggacacattccagattgagtgtctgaaggatgggacgtggagtaacaagattcccacctgtaaaattgtagactgtagagccccaggagagctggaacacgggctgatcaccttctctacaaggaacaacctcaccacatacaagtctgagatcaaatactcctgtcaggagccctattacaagatgctcaacaataacacaggtatatatacctgttctgcccaaggagtctggatgaataaagtattggggagaagcctacccacctgccttccagagtgtggtcagccctcccgctccctgccaagcctggtcaagaggatcattgggggccgaaatgctgagcctggcctcttcccgtggcaggccctgatagtggtggaggacacttcgagagtgccaaatgacaagtggtttgggagtggggccctgctctctgcgtcctggatcctcacagcagctcatgtgctgcgctcccagcgtagagacaccacggtgataccagtctccaaggagcatgtcaccgtctacctgggcttgcatgatgtgcgagacaaatcgggggcagtcaacagctcagctgcccgagtggtgctccacccagacttcaacatccaaaactacaaccacgatatagctctggtgcagctgcaggagcctgtgcccctgggaccccacgttatgcctgtctgcctgccaaggcttgagcctcctggtggccggctggggcatctccaatcccaatgtgacagt

SEQ ID NO: 613 - DNA, 1110 bp, Homo sapiens
atgtttggcctcaaaagaaacgcggtaatcggactcaacctctactgtgggggggccggcttgggggccggcagcggcggcgccacccgcccgggagggcgacttttggctacggagaaggaggcctcggcccggcgagagatagggggaggggaggccggcgcggtgattggcggaagcgccggcgcaagccccccgtccaccctcacgccagactcccggagggtcgcgcggccgccgcccattggcgccgaggtccccgacgtcaccgcgacccccgcgaggctgcttttcttcgcgcccacccgccgcgcggcgccgcttgaggagatggaagccccggccgctgacgccatcatgtcgcccgaagaggagctggacgggtacgagccggagcctctcgggaagcggccggctgtcctgccgctgctggagttggtcggggaatctggtaataacaccagtacggacgggtcactaccctcgacgccgccgccagcagaggaggaggaggacgagttgtaccggcagtcgctggagattatctctcggtaccttcgggagcaggccaccggcgccaaggacacaaagccaatgggcaggtctggggccaccagcaggaaggcgctggagaccttacgacgggttggggatggcgtgcagcgcaaccacgagacggccttccaaggatgggtttgtggagttcttccatgtagaggacctagaaggtggcatcaggaatgtgctgctggcttttgcaggtgttgctggagtaggagctggtttggcatatctaataagatagccttactgtaagtgcaatagttgacttttaaccaaccaccaccaccaccaaaaccagtttatgcagttggactccaagctgtaacttcctagagttgcaccctagcaacctagccagaaaagcaagtggcaagaggattatggctaacaagaataaatacatgggaagagtgctccccattgattgaagagtcactgtctgaaagaagcaaagttcagtttcagcaacaaacaaactttgtttgggaagctatggaggaggacttttagatttagtgaagatggtagggtggaaagacttaattt

SEQ ID NO: 614 - DNA, 3932 bp, Homo sapiens
tccagtaaggagtcggggtcttccccagttttctcagccaggcggcggcggcgactggcaatgtttggcctcaaaagaaacgcggtaatcggactcaacctctactgtgggggggccggcttgggggccggcagcggcggcgccacccgcccgggagggcgacttttggctacggagaaggaggcctcggcccggcgagagatagggggaggggaggccggcgcggtgattggcggaagcgccggcgcaagccccccgtccaccctcacgccagactcccggagggtcgcgcggccgccgcccattggcgccgaggtccccgacgtcaccgcgacccccgcgaggctgcttttcttcgcgcccacccgccgcgcggcgccgcttgaggagatggaagccccggccgctgacgccatcatgtcgcccgaagaggagctggacgggtacgagccggagcctctcgggaagcggccggctgtcctgccgctgctggagttggtcggggaatctggtaataacaccagtacggacgggtcactaccctcgacgccgccgccagcagaggaggaggaggacgagttgtaccggcagtcgctggagattatctctcggtaccttcgggagcaggccaccggcgccaaggacacaaagccaatgggcaggtctggggccaccagcaggaaggcgctggagaccttacgacgggttggggatggcgtgcagcgcaaccacgagacggccttccaaggcatgcttcggaaactggacatcaaaaacgaagacgatgtgaaatcgttgtctcgagtgatgatccatgttttcagcgacggcgtaacaaactggggcaggattgtgactctcatttcttttggtgcctttgtggctaaacacttgaagaccataaaccaagaaagctgcatcgaaccattagcagaaagtatcacagacgttctcgtaaggacaaaacgggactggctagttaaacaaagaggctgggatgggtttgtggagttcttccatgtagaggacctagaaggtggcatcaggaatgtgctgctggcttttgcaggtgttgctggagtaggagctggtttggcatatctaataagatagccttactgtaagtgcaatagttgacttttaaccaaccaccaccaccaccaaaaccagtttatgcagttggactccaagctgtaacttcctagagttgcaccctagcaacctagccagaaaagcaagtggcaagaggattatggctaacaagaataaatacatgggaagagtgctccccattgattgaagagtcactgtctgaaagaagcaaagttcagtttcagcaacaaacaaactttgtttgggaagctatggaggaggacttttagatttagtgaagatggtagggtggaaagacttaatttccttgttgagaacaggaaagtggccagtagccaggcaagtcatagaattgattacccgccgaattcattaatttactgtagtgttaagagaagcactaagaatgccagtgacctgtgtaaaagttacaagtaatagaactatgactgtaagcctcagtactgtacaagggaagcttttcctctctctaattagctttcccagtatacttcttagaaagtccaagtgttcaggacttttatacctgttatactttggcttggtttccatgattcttactttattagcctagtttatcaccaataatacttgacggaaggctcagtaattagttatgaatatggatatcctcaattcttaagacagcttgtaaatgtatttgtaaaaattgtatatatttttacagaaagtctatttctttgaaacgaaggaagtatcgaatttacattagtttttttcatacccttttgaactttgcaacttccgtaattaggaacctgtttcttacagcttttctatgctaaactttgttctgttcagttctagagtgtatacagaacgaattgatgtgtaactgtatgcagactggttgtagtggaacaaatctgataactatgcaggtttaaattttcttatctgattttggtaagtattccttaggtttttctttgaaaacctgggattgagaggttgatgaatggaaattctttcacttcattatatgcaagttttcaataattaggtctaagtggagttttaaggttactgatgacttacaaataatgggctctgattgggcaatactcatttgagttccttccatttgacctaatttaactggtgaaatttaaagtgaattcatgggctcatctttaaagcttttactaaaagattttcagctgaatggaactcattagctgtgtgcatataaaaagatcacatcaggtggatggagagacatttgatcccttgtttgcttaataaattataaaatgatggcttggaaaagcaggctagtctaaccatggtgctattattaggcttgcttgttacacacacaggtctaagcctagtatgtcaataaagcaaatacttactgttttgtttctattaatgattcccaaaccttgttgcaagtttttgcattggcatctttggatttcagtcttgatgtttgttctatcagacttaaccttttatttcctgtccttccttgaaattgctgattgttctgctccctctacagatatttatatcaattcctacagctttcccctgccatccctgaactctttctagcccttttagattttggcactgtgaaacccctgctggaaacctgagtgaccctccctccccaccaagagtccacagacctttcatctttcacgaacttgatcctgttagcaggtggtaataccatgggtgctgtgacactaacagtcattgagaggtgggaggaagtcccttttccttggactggtatcttttcaactattgttttatcctgtctttgggggcaatgtgtcaaaagtcccctcaggaattttcagaggaaagaacattttatgaggctttctctaaagtttcctttgtataggagtatgctcacttaaatttacagaaagaggtgagctgtgttaaacctcagagtttaaaagctactgataaactgaagaaagtgtctatattggaactagggtcatttgaaagcttcagtctcggaacatgacctttagtctgtggactccatttaaaaataggtatgaataagatgactaagaatgtaatggggaagaactgccctgcctgcccatctcagagccataaggtcatctttgctagagctatttttacctatgtatttatcgttcttgatcataagccgcttatttatatcatgtatctctaaggacctaaaagcactttatgtagtttttaattaatcttaagatctggttacggtaactaaaaaagcctgtctgccaaatccagtggaaacaagtgcatagatgtgaattggtttttaggggccccacttcccaattcattaggtatgactgtggaaatacagacaaggatcttagttgatattttgggcttggggcagtgagggcttaggacaccccaagtggtttgggaaaggaggaggggagtggtgggtttatagggggaggaggaggcaggtggtctaagtgctgactggctacgtagttcgggcaaatcctccaaaagggaaagggaggatttgcttagaaggatggcgctcccagtgactactttttgacttctgtttgtcttacgcttctctcagggaaaaacatgcagtcctctagtgtttcatgtacattctgtggggggtgaacaccttggttctggttaaacagctgtacttttgatagctgtgccaggaagggttaggaccaactacaaattaatgttggttgtcaaatgtagtgtgtttccctaactttctgtttttcctgagaaaaaaaaataaatcttttattcaaata

SEQ ID NO: 615 - DNA, 1193 bp, Homo sapiens
gcttccttccagtaaggagtcggggtcttccccagttttctcagccaggcggcggcggcgactggcaatgtttggcctcaaaagaaacgcggtaatcggactcaacctctactgtgggggggccggcttgggggccggcagcggcggcgccacccgcccgggagggcgacttttggctacggagatggaagccccggccgctgacgccatcatgtcgcccgaagaggagctggacgggtacgagccggagcctctcgggaagcggccggctgtcctgccgctgctggagttggtcggggaatctggtaataacaccagtacggacgggtcactaccctcgacgccgccgccagcagaggaggaggaggacgagttgtaccggcagtcgctggagattatctctcggtaccttcgggagcaggccaccggcgccaaggacacaaagccaatgggcaggtctggggccaccagcaggaaggcgctggagaccttacgacgggttggggatggcgtgcagcgcaaccacgagacggccttccaaggcatgcttcggaaactggacatcaaaaacgaagacgatgtgaaatcgttgtctcgagtgatgatccatgttttcagcgacggcgtaacaaactggggcaggattgtgactctcatttcttttggtgcctttgtggctaaacacttgaagaccataaaccaagaaagctgcatcgaaccattagcagaaagtatcacagacgttctcgtaaggacaaaacgggactggctagttaaacaaagaggctgggatgggtttgtggagttcttccatgtagaggacctagaaggtggcatcaggaatgtgctgctggcttttgcaggtgttgctggagtaggagctggtttggcatatctaataagatagccttactgtaagtgcaatagttgacttttaaccaaccaccaccaccaccaaaaccagtttatgcagttggactccaagctgtaacttcctagagttgcaccctagcaacctagccagaaaagcaagtggcaagaggattatggctaacaagaataaatacatgggaagagtgctccccattgattgaagagtcactgtctgaaagaagcaaagttcagtttcagcaacaaacaaactttgtttgggaagctatggaggaggacttttagatttagtgaagatggta

SEQ ID NO: 616 - DNA, 11022 bp, Homo sapiens; identical to SEQ ID NO: 511

SEQ ID NO: 617 - DNA, 2642 bp, Homo sapiens
gaggcaataggggcggagccgagtgggagtgtggaaagcgccgcatcccgggtgggaggcgaggcttccccttccccgcccctcccccggcctccagtccctcccagggccgcttcgcagagcggctaggagcacggcggcggcggcactttccccggcaggagctggagctgggctctggtgcgcgcgcggctgtgccgcccgagccggagggactggttggttgagagagagagaggaagggaatcccgggctgccgaaccgcacgttcagcccgctccgctcctgcagggcagcctttcggctctctgcgcgcgaagccgagtcccgggcgggtggggcgggggtccactgagaccgctaccggcccctcggcgctgacgggaccgcgcggggcgcacccgctgaaggcagccccggggcccgcggcccggacttggtcctgcgcagcgggcgcggggcagcgcagcgggaggaagcgagaggtgctgccctccccccggagttggaagcgcgttacccgggtccaaaatgcccaagaagaagccgacgcccatccagctgaacccggcccccgacggctctgcagttaacgggaccagctctgcggagaccaacttggaggccttgcagaagaagctggaggagctagagcttgatgagcagcagcgaaagcgccttgaggcctttcttacccagaagcagaaggtgggagaactgaaggatgacgactttgagaagatcagtgagctgggggctggcaatggcggtgtggtgttcaaggtctcccacaagccttctggcctggtcatggccagaaagctaattcatctggagatcaaacccgcaatccggaaccagatcataagggagctgcaggttctgcatgagtgcaactctccgtacatcgtgggcttctatggtgcgttctacagcgatggcgagatcagtatctgcatggagcacatggatggaggttctctggatcaagtcctgaagaaagctggaagaattcctgaacaaattttaggaaaagttagcattgctgtaataaaaggcctgacatatctgagggagaagcacaagatcatgcacagagatgtcaagccctccaacatcctagtcaactcccgtggggagatcaagctctgtgactttggggtcagcgggcagctcatcgactccatggccaactccttcgtgggcacaaggtcctacatgtcgccagaaagactccaggggactcattactctgtgcagtcagacatctggagcatgggactgtctctggtagagatggcggttgggaggtatcccatccctcctccagatgccaaggagctggagctgatgtttgggtgccaggtggaaggagatgcggctgagaccccacccaggccaaggacccccgggaggccccttagctcatacggaatggacagccgacctcccatggcaatttttgagttgttggattacatagtcaacgagcctcctccaaaactgcccagtggagtgttcagtctggaatttcaagattttgtgaataaatgcttaataaaaaaccccgcagagagagcagatttgaagcaactcatggttcatgcttttatcaagagatctgatgctgaggaagtggattttgcaggttggctctgctccaccatcggccttaaccagcccagcacaccaacccatgctgctggcgtctaagtgtttgggaagcaacaaagagcgagtcccctgcccggtggtttgccatgtcgcttttgggcctccttcccatgcctgtctctgttcagatgtgcatttcacctgtgacaaaggatgaagaacacagcatgtgccaagattctactcttgtcatttttaatattactgtctttattcttattactattattgttcccctaagtggattggctttgtgcttggggctatttgtgtgtatgctgatgatcaaaacctgtgccaggctgaattacagtgaaattttggtgaatgtgggtagtcattcttacaattgcactgctgttcctgctccatgactggctgtctgcctgtattttcgggattctttgacatttggtggtactttattcttgctgggcatactttctctctaggagggagccttgtgagatccttcacaggcagtgcatgtgaagcatgctttgctgctatgaaaatgagcatcagagagtgtacatcatgttattttattattattatttgcttttcatgtagaactcagcagttgacatccaaatctagccagagcccttcactgccatgatagctggggcttcaccagtctgtctactgtggtgatctgtagacttctggttgtatttctatatttattttcagtatactgtgtgggatacttagtggtatgtctctttaagttttgattaatgtttcttaaatggaattattttgaatgtcacaaattgatcaagatattaaaatgtcggatttatctttccccatatccaagtaccaatgctgttgtaaacaacgtgtatagtgcctaaaattgtatgaaaatccttttaaccattttaacctagatgtttaacaaatctaatctcttattctaataaatatactatgaaataaaaaaaaaaggatgaaagcta

SEQ ID NO: 618 - DNA, 1480 bp, Homo sapiens; identical to SEQ ID NO: 518

SEQ ID NO: 619 - DNA, 951 bp, Homo sapiens; identical to SEQ ID NO: 520

SEQ ID NO: 620 - DNA, 1734 bp, Homo sapiens
cccctgcctctcggactcgggctgcggcgtcagccttcttcgggcctcggcagcggtagcggctcgctcgcctcagccccagcgcccctcggctaccctcggcccaggcccgcagcgccgcccgccctcggccgccccgacgccggcctgggccgcggccgcagccccgggctcgcgtaggcgccgaccgctcccggcccgccccctatgggccccggctagaggcgccgccgccgccggcccgcggagccccgatgctggcccggaggaagccggtgctgccggcgctcaccatcaaccctaccatcgccgagggcccatcccctaccagcgagggcgcctccgaggcaaacctggtggacctgcagaagaagctggaggagctggaacttgacgagcagcagaagaagcggctggaagcctttctcacccagaaagccaaggtcggcgaactcaaagacgatgacttcgaaaggatctcagagctgggcgcgggcaacggcggggtggtcaccaaagtccagcacagaccctcgggcctcatcatggccaggaagctgatccaccttgagatcaagccggccatccggaaccagatcatccgcgagctgcaggtcctgcacgaatgcaactcgccgtacatcgtgggcttctacggggccttctacagtgacggggagatcagcatttgcatggaacacatggacggcggctccctggaccaggtgctgaaagaggccaagaggattcccgaggagatcctggggaaagtcagcatcgcggttctccggggcttggcgtacctccgagagaagcaccagatcatgcaccgagatgtgaagccctccaacatcctcgtgaactctagaggggagatcaagctgtgtgacttcggggtgagcggccagctcatcgactccatggccaactccttcgtgggcacgcgctcctacatggctccggagcggttgcagggcacacattactcggtgcagtcggacatctggagcatgggcctgtccctggtggagctggccgtcggaaggtaccccatccccccgcccgacgccaaagagctggaggccatctttggccggcccgtggtcgacggggaagaaggagagcctcacagcatctcgcctcggccgaggccccccgggcgccccgtcagcggtcacgggatggatagccggcctgccatggccatctttgaactcctggactatattgtgaacgagccacctcctaagctgcccaacggtgtgttcacccccgacttccaggagtttgtcaataaatgcctcatcaagaacccagcggagcgggcggacctgaagatgctcacaaaccacaccttcatcaagcggtccgaggtggaagaagtggattttgccggctggttgtgtaaaaccctgcggctgaaccagcccggcacacccacgcgcaccgccgtgtgacagtggccgggctccctgcgtcccgctggtgacctgcccaccgtccctgtccatgccccgcccttccagctgaggacaggctggcgcctccacccaccctcctgcctcacccctgcggagagcaccgtggcggggcgacagcgcatgcaggaacgggggtctcctctcctgcccgtcctggccggggtgcctctggggacgggcgacgctgctgtgtgtggtctcagaggctctgcttccttaggttacaaaacaaaacagggagagaaaaagcaaa

SEQ ID NO: 621 - DNA, 3742 bp, Homo sapiens
ggccgtgcgagaggccgagcttgctgcattgcagccgccgcggcgccgctcggctcttcactcccaacaatggcggctccgagcccgagcggcggcggcggctccgggggcggcagcggcagcggcacccccggccccgtagggtccccggcgccaggccacccggccgtcagcagcatgcagggtaaacgcaaagcactgaagttgaattttgcaaatccacctttcaaatctacagcaaggtttactctgaatcccaatcctacaggagttcaaaacccacacatagagagactgagaacacacagcattgagtcatcaggaaaactgaagatctcccctgaacaacactgggatttcactgcagaggacttgaaagaccttggagaaattggacgaggagcttatggttctgtcaacaaaatggtccacaaaccaagtgggcaaataatggcagttaaaagaattcggtcaacagtggatgaaaaagaacaaaaacaacttcttatggatttggatgtagtaatgcggagtagtgattgcccatacattgttcagttttatggtgcactcttcagagagggtgactgttggatctgtatggaactcatgtctacctcgtttgataagttttacaaatatgtatatagtgtattagatgatgttattccagaagaaattttaggcaaaatcactttagcaactgtgaaagcactaaaccacttaaaagaaaacttgaaaattattcacagagatatcaaaccttccaatattcttctggacagaagtggaaatattaagctctgtgacttcggcatcagtggacagcttgtggactctattgccaagacaagagatgctggctgtaggccatacatggcacctgaaagaatagacccaagcgcatcacgacaaggatatgatgtccgctctgatgtctggagtttggggatcacattgtatgagttggccacaggccgatttccttatccaaagtggaatagtgtatttgatcaactaacacaagtcgtgaaaggagatcctccgcagctgagtaattctgaggaaagggaattctccccgagtttcatcaactttgtcaacttgtgccttacgaaggatgaatccaaaaggccaaagtataaagagcttctgaaacatccctttattttgatgtatgaagaacgtgccgttgaggtcgcatgctatgtttgtaaaatcctggatcaaatgccagctactcccagctctcccatgtatgtcgattgatatcgctgctacatcagactctagaaaaaagggctgagaggaagcaagacgtaaagaattttcatcccgtatcacagtgtttttattgctcgcccagacaccatgtgcaataagattggtgttcgtttccatcatgtctgtatactcctgtcacctagaacgtgcatccttgtaatacctgattgatcacacagtgttagtgctggtcagagagacctcatcctgctcttttgtgatgaacatattcatgaaatgtggaagtcagtacgatcaagttgttgactgtgattagatcacatcttaaattcatttctagactcaaaacctggagatgcagctactggaatggtgttttgtcagacttccaaatcctggaaggacacagtgatgaatgtactatgtctgaacatagaaactcgggcttgagtgagaagagcttgcacagccaacgagacacattgccttctggagctgggagacaaaggaggaatttactttcttcaccaagtgcaatagattactgatgtgatattctgttgctttacagttacagttgatgtttggggatcgatgtgctcagccaaatttcctgtttgaaatatcatgttaaattagaatgaatttatctttaccaaaaaccatgttgcgttcaaagaggtgaacattaaaatatagagacaggacagaatgtgttcttttctcctttaccagtcctatttttcaatgggaagactcaggagtctgccacttgtcaaagaaggtgctgatcctaagaatttttcattctcagaattcggtgtgctgccaacttgatgttccacctgccacaaaccaccaggactgaaagaagaaaacagtacagaaggcaaagtttacagatgtttttaattctagtattttatctggaacaacttgtagcagctatatatttccccttggtcccaagcctgatactttagccatcataactcactaacagggagaagtagctagtagcaatgtgccttgattgattagataaagatttctagtaggcagcaaaagaccaaatctcagttgtttgcttcttgccatcactggtccaggtcttcagtttccgaatctctttcccttcccctgtggtctattgtcgctatgtgacttgcgcttaatccaatattttgccttttttctatatcaaaaaacctttacagttagcagggatgttccttaccaaggatttttagccccaaatctctcatattcgctagtgtttaaaaggctaagaatagtggggcccagccgatgtggtaggtgataaagaggcatcttttctagagacacattggaccagatgaggatccgaaacggcagcctttacgttcatcacctgctagaacctctcgtagtccatcaccatttcttggcattggaattctactggaaaaaaatacaaaaagcaaaacaaaaccctcagcactgttacaagaggccatttaagtatcttgtgcttcttcacttacccattagccaggttctcattaggttttgcttgggcctccctggcactgaaccttaggctttgtatgacagtgaagcagcactgtgagtggttcaagcacactggaatataaaacagtcatggcctgagatgcaggtgatgccattacagaaccaaatcgtggcacgtattgctgtgtctcctctcagagtgacagtcataaatactgtcaaacaataaagggagaatggtgctgtttaaagtcacatccctgtaaattgcagaattcaaaagtgattatctctttgatctacttgcctcatttccctatcttctcccccacggtatcctaaactttagacttcccactgttctgaaaggagacattgctctatgtctgccttcgaccacagcaagccatcatcctccattgctcccggggactcaagaggaatctgtttctctgctgtcaacttcccatctggctcagcatagggtcactttgccattatgcaaatggagataaaagcaattctgactgtccaggagctaatctgaccgttctattgtgtggatgaccacataagaaggcaattttagtgtattaatcatagattattataaactataaacttaagggcaaggagtttattacaatgtatctttattaaaacaaaagggtgtatagtgttcacaaactgtgaaaatagtgtaagaactgtacattgtgagctctggttatttttctcttgtaccatagaaaaatgtataaaaattatcaaaaagctaatgtgcagggatattgccttatttgtctgtaaaaaatggagctcagtaacataactgcttcttggagctttggaatattttatcctgtattcttgtttgaattcctcctctatttaagatatatacatggaatcgaagtgtttatgtaatagttctatccttttgcctgcaggtcagttgtaataaatctaggatgtgatgatg

SEQ ID NO: 622 - DNA, 3772 bp, Homo sapiens
ggccgtgcgagaggccgagcttgctgcattgcagccgccgcggcgccgctcggctcttcactcccaacaatggcggctccgagcccgagcggcggcggcggctccgggggcggcagcggcagcggcacccccggccccgtagggtccccggcgccaggccacccggccgtcagcagcatgcagggctttcagataaacttctgtgaaaaggcacaaagtaaacgcaaagcactgaagttgaattttgcaaatccacctttcaaatctacagcaaggtttactctgaatcccaatcctacaggagttcaaaacccacacatagagagactgagaacacacagcattgagtcatcaggaaaactgaagatctcccctgaacaacactgggatttcactgcagaggacttgaaagaccttggagaaattggacgaggagcttatggttctgtcaacaaaatggtccacaaaccaagtgggcaaataatggcagttaaaagaattcggtcaacagtggatgaaaaagaacaaaaacaacttcttatggatttggatgtagtaatgcggagtagtgattgcccatacattgttcagttttatggtgcactcttcagagagggtgactgttggatctgtatggaactcatgtctacctcgtttgataagttttacaaatatgtatatagtgtattagatgatgttattccagaagaaattttaggcaaaatcactttagcaactgtgaaagcactaaaccacttaaaagaaaacttgaaaattattcacagagatatcaaaccttccaatattcttctggacagaagtggaaatattaagctctgtgacttcggcatcagtggacagcttgtggactctattgccaagacaagagatgctggctgtaggccatacatggcacctgaaagaatagacccaagcgcatcacgacaaggatatgatgtccgctctgatgtctggagtttggggatcacattgtatgagttggccacaggccgatttccttatccaaagtggaatagtgtatttgatcaactaacacaagtcgtgaaaggagatcctccgcagctgagtaattctgaggaaagggaattctccccgagtttcatcaactttgtcaacttgtgccttacgaaggatgaatccaaaaggccaaagtataaagagcttctgaaacatccctttattttgatgtatgaagaacgtgccgttgaggtcgcatgctatgtttgtaaaatcctggatcaaatgccagctactcccagctctcccatgtatgtcgattgatatcgctgctacatcagactctagaaaaaagggctgagaggaagcaagacgtaaagaattttcatcccgtatcacagtgtttttattgctcgcccagacaccatgtgcaataagattggtgttcgtttccatcatgtctgtatactcctgtcacctagaacgtgcatccttgtaatacctgattgatcacacagtgttagtgctggtcagagagacctcatcctgctcttttgtgatgaacatattcatgaaatgtggaagtcagtacgatcaagttgttgactgtgattagatcacatcttaaattcatttctagactcaaaacctggagatgcagctactggaatggtgttttgtcagacttccaaatcctggaaggacacagtgatgaatgtactatgtctgaacatagaaactcgggcttgagtgagaagagcttgcacagccaacgagacacattgccttctggagctgggagacaaaggaggaatttactttcttcaccaagtgcaatagattactgatgtgatattctgttgctttacagttacagttgatgtttggggatcgatgtgctcagccaaatttcctgtttgaaatatcatgttaaattagaatgaatttatctttaccaaaaaccatgttgcgttcaaagaggtgaacattaaaatatagagacaggacagaatgtgttcttttctcctttaccagtcctatttttcaatgggaagactcaggagtctgccacttgtcaaagaaggtgctgatcctaagaatttttcattctcagaattcggtgtgctgccaacttgatgttccacctgccacaaaccaccaggactgaaagaagaaaacagtacagaaggcaaagtttacagatgtttttaattctagtattttatctggaacaacttgtagcagctatatatttccccttggtcccaagcctgatactttagccatcataactcactaacagggagaagtagctagtagcaatgtgccttgattgattagataaagatttctagtaggcagcaaaagaccaaatctcagttgtttgcttcttgccatcactggtccaggtcttcagtttccgaatctctttcccttcccctgtggtctattgtcgctatgtgacttgcgcttaatccaatattttgccttttttctatatcaaaaaacctttacagttagcagggatgttccttaccaaggatttttagccccaaatctctcatattcgctagtgtttaaaaggctaagaatagtggggcccagccgatgtggtaggtgataaagaggcatcttttctagagacacattggaccagatgaggatccgaaacggcagcctttacgttcatcacctgctagaacctctcgtagtccatcaccatttcttggcattggaattctactggaaaaaaatacaaaaagcaaaacaaaaccctcagcactgttacaagaggccatttaagtatcttgtgcttcttcacttacccattagccaggttctcattaggttttgcttgggcctccctggcactgaaccttaggctttgtatgacagtgaagcagcactgtgagtggttcaagcacactggaatataaaacagtcatggcctgagatgcaggtgatgccattacagaaccaaatcgtggcacgtattgctgtgtctcctctcagagtgacagtcataaatactgtcaaacaataaagggagaatggtgctgtttaaagtcacatccctgtaaattgcagaattcaaaagtgattatctctttgatctacttgcctcatttccctatcttctcccccacggtatcctaaactttagacttcccactgttctgaaaggagacattgctctatgtctgccttcgaccacagcaagccatcatcctccattgctcccggggactcaagaggaatctgtttctctgctgtcaacttcccatctggctcagcatagggtcactttgccattatgcaaatggagataaaagcaattctgactgtccaggagctaatctgaccgttctattgtgtggatgaccacataagaaggcaattttagtgtattaatcatagattattataaactataaacttaagggcaaggagtttattacaatgtatctttattaaaacaaaagggtgtatagtgttcacaaactgtgaaaatagtgtaagaactgtacattgtgagctctggttatttttctcttgtaccatagaaaaatgtataaaaattatcaaaaagctaatgtgcagggatattgccttatttgtctgtaaaaaatggagctcagtaacataactgcttcttggagctttggaatattttatcctgtattcttgtttgaattcctcctctatttaagatatatacatggaatcgaagtgtttatgtaatagttctatccttttgcctgcaggtcagttgtaataaatctaggatgtgatg

SEQ ID NO: 623 - DNA, 3286 bp, Homo sapiens
atttgtgaaagaattcggtcaacagtggatgaaaaagaacaaaaacaacttcttatggatttggatgtagtaatgcggagtagtgattgcccatacattgttcagttttatggtgcactcttcagagagggtgactgttggatctgtatggaactcatgtctacctcgtttgataagttttacaaatatgtatatagtgtattagatgatgttattccagaagaaattttaggcaaaatcactttagcaactgtgaaagcactaaaccacttaaaagaaaacttgaaaattattcacagagatatcaaaccttccaatattcttctggacagaagtggaaatattaagctctgtgacttcggcatcagtggacagcttgtggactctattgccaagacaagagatgctggctgtaggccatacatggcacctgaaagaatagacccaagcgcatcacgacaaggatatgatgtccgctctgatgtctggagtttggggatcacattgtatgagttggccacaggccgatttccttatccaaagtggaatagtgtatttgatcaactaacacaagtcgtgaaaggagatcctccgcagctgagtaattctgaggaaagggaattctccccgagtttcatcaactttgtcaacttgtgccttacgaaggatgaatccaaaaggccaaagtataaagagcttctgaaacatccctttattttgatgtatgaagaacgtgccgttgaggtcgcatgctatgtttgtaaaatcctggatcaaatgccagctactcccagctctcccatgtatgtcgattgatatcgctgctacatcagactctagaaaaaagggctgagaggaagcaagacgtaaagaattttcatcccgtatcacagtgtttttattgctcgcccagacaccatgtgcaataagattggtgttcgtttccatcatgtctgtatactcctgtcacctagaacgtgcatccttgtaatacctgattgatcacacagtgttagtgctggtcagagagacctcatcctgctcttttgtgatgaacatattcatgaaatgtggaagtcagtacgatcaagttgttgactgtgattagatcacatcttaaattcatttctagactcaaaacctggagatgcagctactggaatggtgttttgtcagacttccaaatcctggaaggacacagtgatgaatgtactatgtctgaacatagaaactcgggcttgagtgagaagagcttgcacagccaacgagacacattgccttctggagctgggagacaaaggaggaatttactttcttcaccaagtgcaatagattactgatgtgatattctgttgctttacagttacagttgatgtttggggatcgatgtgctcagccaaatttcctgtttgaaatatcatgttaaattagaatgaatttatctttaccaaaaaccatgttgcgttcaaagaggtgaacattaaaatatagagacaggacagaatgtgttcttttctcctttaccagtcctatttttcaatgggaagactcaggagtctgccacttgtcaaagaaggtgctgatcctaagaatttttcattctcagaattcggtgtgctgccaacttgatgttccacctgccacaaaccaccaggactgaaagaagaaaacagtacagaaggcaaagtttacagatgtttttaattctagtattttatctggaacaacttgtagcagctatatatttccccttggtcccaagcctgatactttagccatcataactcactaacagggagaagtagctagtagcaatgtgccttgattgattagataaagatttctagtaggcagcaaaagaccaaatctcagttgtttgcttcttgccatcactggtccaggtcttcagtttccgaatctctttcccttcccctgtggtctattgtcgctatgtgacttgcgcttaatccaatattttgccttttttctatatcaaaaaacctttacagttagcagggatgttccttaccaaggatttttagccccaaatctctcatattcgctagtgtttaaaaggctaagaatagtggggcccagccgatgtggtaggtgataaagaggcatcttttctagagacacattggaccagatgaggatccgaaacggcagcctttacgttcatcacctgctagaacctctcgtagtccatcaccatttcttggcattggaattctactggaaaaaaatacaaaaagcaaaacaaaaccctcagcactgttacaagaggccatttaagtatcttgtgcttcttcacttacccattagccaggttctcattaggttttgcttgggcctccctggcactgaaccttaggctttgtatgacagtgaagcagcactgtgagtggttcaagcacactggaatataaaacagtcatggcctgagatgcaggtgatgccattacagaaccaaatcgtggcacgtattgctgtgtctcctctcagagtgacagtcataaatactgtcaaacaataaagggagaatggtgctgtttaaagtcacatccctgtaaattgcagaattcaaaagtgattatctctttgatctacttgcctcatttccctatcttctcccccacggtatcctaaactttagacttcccactgttctgaaaggagacattgctctatgtctgccttcgaccacagcaagccatcatcctccattgctcccggggactcaagaggaatctgtttctctgctgtcaacttcccatctggctcagcatagggtcactttgccattatgcaaatggagataaaagcaattctgactgtccaggagctaatctgaccgttctattgtgtggatgaccacataagaaggcaattttagtgtattaatcatagattattataaactataaacttaagggcaaggagtttattacaatgtatctttattaaaacaaaagggtgtatagtgttcacaaactgtgaaaatagtgtaagaactgtacattgtgagctctggttatttttctcttgtaccatagaaaaatgtataaaaattatcaaaaagctaatgtgcagggatattgccttatttgtctgtaaaaaatggagctcagtaacataactgcttcttggagctttggaatattttatcctgtattcttgtttgaattcctcctctatttaagatatatacatggaatcgaagtgtttatgtaatagttctatccttttgcctgcaggtcagttgtaataaatctaggatgtgatg

SEQ ID NO: 624 - DNA, 1401 bp, Homo sapiens
cttcactcccaacaatggcggctccgagcccgagcggcacccccgtcagcagcatgcagggtaaacgcaaagcactgaagttgaattttgcaaatccacctttcaaatctacagcaaggtttactctgaatcccaatcctacaggagttcaaaacccacacatagagagactgagaacacacagcattgagtcatcaggaaaactgaagatctcccctgaacaacactgggatttcactgcagaggacttgaaagaccttggagaaattggacgaggagcttatggttctgtcaacaaaatggtccacaaaccaagtgggcaaataatggcagttaaaagaattcggtcaacagtggatgaaaaagaacaaaaacaacttcttatggatttggatgtagtaatgcggagtagtgattgcccatacattgttcagttttatggtgcactcttcagagagggtgactgttggatctgtatggaactcatgtctacctcgtttgataagttttacaaatatgtatatagtgtattagatgatgttattccagaagaaattttaggcaaaatcactttagcaactgtgaaagcactaaaccacttaaaagaaaacttgaaaattattcacagagatatcaaaccttccaatattcttctggacagaagtggaaatattaagctctgtgacttcggcatcagtggacagcttgtggactctattgccaagacaagagatgctggctgtaggccatacatggcacctgaaagaatagacccaagcgcatcacgacaaggatatgatgtccgctctgatgtctggagtttggggatcacattgtatgagttggccacaggccgatttccttatccaaagtggaatagtgtatttgatcaactaacacaagtcgtgaaaggagatcctccgcagctgagtaattctgaggaaagggaattctccccgagtttcatcaactttgtcaacttgtgccttacgaaggatgaatccaaaaggccaaagtataaagagcttctgaaacatccctttattttgatgtatgaagaacgtgccgttgaggtcgcatgctatgtttgtaaaatcctggatcaaatgccagctactcccagctctcccatgtatgtcgattgatatcgctgctacatcagactctagaaaaaagggctgagaggaagcaagacgtaaagaattttcatcccgtatcacagtgtttttattgctcgcccagacaccatgtgcaataagattggtgttcgtttccatcatgtctgtatactcctgtcacctagaacgtgcatccttgtaatacctgattgatcacacagtgttagtgctggtcagagagacctcatcctgctcttttgtgatgaacatattcatgaaatgt

SEQ ID NO: 625 - DNA, 7011 bp, Homo sapiens
atggcggcggcggcggggaatcgcgcctcgtcgtcgggattcccgggcgccagggctacgagccctgaggcaggcggcggcggaggagccctcaaggcgagcagcgcgcccgcggctgccgcgggactgctgcgggaggcgggcagcgggggccgcgagcgggcggactggcggcggcggcagctgcgcaaagtgcggagtgtggagctggaccagctgcctgagcagccgctcttccttgccgcctcaccgccggcctcctcgacttccccgtcgccggagcccgcggacgcagcggggagtgggaccggcttccagcctgtggcggtgccgccgccccacggagccgcgagccgcggcggcgcccaccttaccgagtcggtggcggcgccggacagcggcgcctcgagtcccgcagcggccgagcccggggagaagcgggcgcccgccgccgagccgtctcctgcagcggcccccgccggtcgtgagatggagaataaagaaactctcaaagggttgcacaagatggatgatcgtccagaggaacgaatgatcagggagaaactgaaggcaacctgtatgccagcctggaagcacgaatggttggaaaggagaaataggcgagggcctgtggtggtaaaaccaatcccagttaaaggagatggatctgaaatgaatcacttagcagctgagtctccaggagaggtccaggcaagtgcggcttcaccagcttccaaaggccgacgcagtccttctcctggcaactccccatcaggtcgcacagtgaaatcagaatctccaggagtaaggagaaaaagagtttccccagtgccttttcagagtggcagaatcacaccaccccgaagagccccttcaccagatggcttctcaccatatagccctgaggaaacaaaccgccgtgttaacaaagtgatgcgggccagactgtacttactgcagcagatagggcctaactctttcctgattggaggagacagcccagacaataaataccgggtgtttattgggcctcagaactgcagctgtgcacgtggaacattctgtattcatctgctatttgtgatgctccgggtgtttcaactagaaccttcagacccaatgttatggagaaaaactttaaagaattttgaggttgagagtttgttccagaaatatcacagtaggcgtagctcaaggatcaaagctccatctcgtaacaccatccagaagtttgtttcacgcatgtcaaattctcatacattgtcatcatctagtacttctacgtctagttcagaaaacagcataaaggatgaagaggaacagatgtgtcctatttgcttgttgggcatgcttgatgaagaaagtcttacagtgtgtgaagacggctgcaggaacaagctgcaccaccactgcatgtcaatttgggcagaagagtgtagaagaaatagagaacctttaatatgtcccctttgtagatctaagtggagatctcatgatttctacagccacgagttgtcaagtcctgtggattccccttcttccctcagagctgcacagcagcaaaccgtacagcagcagcctttggctggatcacgaaggaatcaagagagcaattttaaccttactcattatggaactcagcaaatccctcctgcttacaaagatttagctgagccatggattcaggtgtttggaatggaactcgttggctgcttattttctagaaactggaatgtgagagagatggccctcaggcgtctttcccatgatgtcagtggggccctgctgttggcaaatggggagagcactggaaattctgggggcagcagtggaagcagcccgagtgggggagccaccagtgggtcttcccagaccagtatctcaggagatgtggtggaggcatgctgcagcgttctgtcaatggtctgtgctgaccctgtctacaaagtgtacgttgctgctttaaaaacattgagagccatgctggtatatactccttgccacagtttagcggaaagaatcaaacttcagagacttctccagccagttgtagacaccatcctagtcaaatgtgcagatgccaatagccgcacaagtcagctgtccatatcaacactgttggaactgtgcaaaggccaagcaggagagttggcagttggcagagaaatactaaaagctggatccattggtattggtggtgttgattatgtcttaaattgtattcttggaaaccaaactgaatcaaacaattggcaagaacttcttggccgcctttgtcttatagatagactgttgttggaatttcctgctgaattttatcctcatattgtcagtactgatgtttcacaagctgagcctgttgaaatcaggtataagaagctgctgtccctcttaacctttgctttgcagtccattgataattcccactcaatggttggcaaactttccagaaggatctacttgagttctgcaagaatggttactacagtaccccatgtgttttcaaaactgttagaaatgctgagtgtttccagttccactcacttcaccaggatgcgtcgccgtttgatggctattgcagatgaggtggaaattgccgaagccatccagttgggcgtagaagacactttggatggtcaacaggacagcttcttgcaggcatctgttcccaacaactatctggaaaccacagagaacagttcccctgagtgcacagtccatttagagaaaactggaaaaggattatgtgctacaaaattgagtgccagttcagaggacatttctgagagactggccagcatttcagtaggaccttctagttcaacaacaacaacaacaacaacaacagagcaaccaaagccaatggttcaaacaaaaggcagaccccacagtcagtgtttgaactcctctcctttatctcatcattcccaattaatgtttccagccttgtcaaccccttcttcttctaccccatctgtaccagctggcactgcaacagatgtctctaagcatagacttcagggattcattccctgcagaataccttctgcatctcctcaaacacagcgcaagttttctctacaattccacagaaactgtcctgaaaacaaagactcagataaactttccccagtctttactcagtcaagacccttgccctccagtaacatacacaggccaaagccatctagacctaccccaggtaatacaagtaaacagggagatccctcaaaaaatagcatgacacttgatctgaacagtagttccaaatgtgatgacagctttggctgtagcagcaatagtagtaatgctgttatacccagtgacgagacagtgttcaccccagtagaggagaaatgcagattagatgtcaatacagagctcaactccagtattgaggaccttcttgaagcatctatgccttcaagtgatacaacagtaacttttaagtcagaagttgctgtcctgtctcctgaaaaggctgaaaatgatgatacctacaaagatgatgtgaatcataatcaaaagtgcaaagagaagatggaagctgaagaagaagaagctttagcaattgccatggcaatgtcagcgtctcaggatgccctccccatagttcctcagctgcaggttgaaaatggagaagatatcatcattattcaacaggatacaccagagactctaccaggacataccaaagcaaaacaaccgtatagagaagacactgaatggctgaaaggtcaacagataggccttggagcattttcttcttgttatcaggctcaagatgtgggaactggaactttaatggctgttaaacaggtgacttatgtcagaaacacatcttctgagcaagaagaagtagtagaagcactaagagaagagataagaatgatgagccatctgaatcatccaaacatcattaggatgttgggagccacgtgtgagaagagcaattacaatctcttcattgaatggatggcagggggatcggtggctcatttgctgagtaaatatggagccttcaaagaatcagtagttattaactacactgaacagttactccgtggcctttcgtatctccatgaaaaccaaatcattcacagagatgtcaaaggtgccaatttgctaattgacagcactggtcagagactaagaattgcagattttggagctgcagccaggttggcatcaaaaggaactggtgcaggagagtttcagggacaattactggggacaattgcatttatggcacctgaggtactaagaggtcaacagtatggaaggagctgtgatgtatggagtgttggctgtgctattatagaaatggcttgtgcaaaaccaccatggaatgcagaaaaacactccaatcatcttgctttgatatttaagattgctagtgcaactactgctccatcgatcccttcacatttgtctcctggtttacgagatgtggctcttcgttgtttagaacttcaacctcaggacagacctccatcaagagagctactgaagcatccagtctttcgtactacatggtagccaattatgcagatcaactacagtagaaacaggatgctcaacaagagaaaaaaaacttgtggggaaccacattgatattctactggccatgatgccactgaacagctatgaacgaggccagtggggaacccttacctaagtatgtgattgacaaatcatgatctgtacctaagctcagtatgcaaaagcccaaactagtgcagaaactgtaaactgtgcctttcaaagaactggccctaggtgaacaggaaaacaatgaagtttgcatgactaaattgcagaagcataattttatttttttggagcactttttcagcaatattagcggctgaggggctcaggatctattttaatatttcaattattcttccatttcatatagtgatcacaagcagggggttctgcaattccgttcaaattttttgtcactggctataaaatcagtatctgcctcttttaggtcagagtatgctatgagtagcaatacatacatatatttttaaaagttgatacttctttatgacccacagttgacctttattttcttaaataccagggcagttgtggctcattgtgcattttactgttggcccattcatttcgtttttggaaattatggttttgtattttcatgtttatttacattcatttttgtttattcagggaaagctgatctttttttcaaaccagaaaaaaaaaatgaactagatatgaagtagagttcattaaatatcttgctattgtcagagtttttaaaatatagacttaattttgtttttttaaattggaatacaataaagtactacctacatttgagtcagtcaccactcttattgtgcaggttaagtacaagttaactaaaaataaactgtcctctctggtgcaactcacaaccaagatcaagattaccttaaaatttatttgaattttttagatgttttggttgtcaaactgtaggaaacttcacaacatttaagtcttactctgtatgtaacaatccatcattcaccttcactactggtagtaacatagagctgccattttccttttaccatgcatcatctctttacagtaggcctggcagatcattttttaaaaagattattcaactaccaatcagtaatgtttttaaacagtacatttgctttgaacttggaaaatgtgttcagaaagaaaaatggaattgaatttcatttatacactaattccttggattttgcacagttacctaacggttttagtctggagttaaattcagatgcatggaatcctgaaggaaaatggtagctttttaatctttttgtgtgtgtgtgagtcttttaaatcaagtactgattaactattaagtacaactttgagattttagttttaactcttcagaagccagtgtgaaatagaattggttattctcaaagactcaggataaactaaataagctatatatagagtacatttaaaatgtacaacacaaattggaaataaaataagttacaagataagtttacagggatatattgcttacaatttttaaaaggcagtttgttttttatgtgaatatgtttcttagtgaaattttacattcctttgttttggaagattggcgatatttgaagagttaaaaatagtacagaaatgtgaagtttggtatctctaaatgtgttgtacttgactttcttttttattttgtttttttttttttttgactacttagaattttcacaattctaataagattgtttccaagtctctcatgtgcaagctttaaaggatgcactcttgccattttatgtactggaagatcattggtcagatgaatactgtgtctgacaaaaatgtaaactgtataaactgaggaacctcagctaatcagtattactttgtagatcaccatgcccaccacatttcaaactcaaactatctgtagatttcaaaatccattgtgtttgagtttgtttgcagttccctcagcttgctggtaattgtggtgttttgttttttgttttgttttcaatgcaaatgtgatgtaatattcttattttctttggatcaaagctggactggaaattgtatcgtgtaattatttttgtgttcttaatgttatttggtactcaagttgtaaataacgtctactactgtttattccagtttctactacctcaggtgtcctatagatttttcttctaccaaagttcactttcacaatgaaattatatttgctgtgtgactatgattcctaagatttccagggcttaagggctaacttctattagcaccttactgtgtaagcaaatgttacaaaaaaaaaaaaaaaaaatctctgggttaagaaaatttggcttaaatgtatcctttgttattttaaatatattgagatattttaattaaaatttttaccccattgaaccgattttatagtatttgtacctattttggtgtttttgtctttatagtaaataaaagtttttgaacaaa

SEQ ID NO: 626 - DNA, 884 bp, Homo sapiens
accccatcccccactcctataccggtcctccattttggtgcctgcaaagctctgggaaagaatcccgggaaacgaaaaatggtgggtttgggggaagggaggtaaggggagaaagctggagggaggggctttaattggaggccccgtagaggacgcgcggaacttctaaggtgggaaaaaacgaaattaaaaaatcctttgatatcagggctctgaatcctgctggtcagagcaccaagcattcagtctctctccttgcctttgtcttacttgtgttcaaagaaaaacaaccagaaaaaaaaaatctcatcatggcaaatattcaccaggaaaacgaagagatggagcagcctatgcagaatggagaggaagaccgccctttgggaggaggtgaaggccaccagcctgcaggaaatcgacggggacaggctcgccgacttgcccctaattttcgatgggccatacccaataggcagatcaatgatgggatgggtggagatggagatgatatggaaatattcatggaggagatgagagaaatcagaagaaaacttagggagctgcagttgaggaattgtctgcgtatccttatgggggagctctctaatcaccatgaccatcatgatgaattttgccttatgccttgactcctgccatttatcatgagattaatactgtgattcccgctgttttctttttccttgcattttcctaatatgcctttactgatccgtttgctgtgaaccctatgttatttccatgtgtcaagtgggtcttgtgttgccagcttctatttgaagattgcctttgcactcagtgtaagtttctgtcagcagtagtttcacccatttgcatggaaaaatttaaagctaataaagcaattt

SEQ ID NO: 627 - DNA, 921 bp, Homo sapiens
ggctgtgcgctctggggcacctcatgcagacgggagtagggaggctgttttttgcgcgtgcatatggcggtggcgggtggggggaagggggagatcctgctgcactggccgcccaagttggggggcgagctcggtggtgacgcgcggccctcacgtgacccagagctgcagagcgacgcagccttcggtgcagtcgtcactcgcgtctggctaccagctccccgctgccctgagctcggcgggctggcattcggcccggggaaaagcggagcaggtctgcgaggctaagtgtctccgcggcgcacctcgcggcgagaatccggaggagaaggagactgcaaggataggcccaggaaaacgaagagatggagcagcctatgcagaatggagaggaagaccgccctttgggaggaggtgaaggccaccagcctgcaggaaatcgacggggacaggctcgccgacttgcccctaattttcgatgggccatacccaataggcagatcaatgatgggatgggtggagatggagatgatatggaaatattcatggaggagatgagagaaatcagaagaaaacttagggagctgcagttgaggaattgtctgcgtatccttatgggggagctctctaatcaccatgaccatcatgatgaattttgccttatgccttgactcctgccatttatcatgagattaatactgtgattcccgctgttttctttttccttgcattttcctaatatgcctttactgatccgtttgctgtgaaccctatgttatttccatgtgtcaagtgggtcttgtgttgccagcttctatttgaagattgcctttgcactcagtgtaagtttctgtcagcagtagtttcacccatttgcatggaaaaatttaaagctaataaagcaatttaaaaagcaatcta

SEQ ID NO: 628 - DNA, 753 bp, Homo sapiens
gaggggagcccgggctcggagcacggaaagggccgggcggcggcgggtcttcgctagcgttccgctgcagcagcccccaccccccacaacccccaccccggctcgactgcaggtctgcgaggctaagtgtctccgcggcgcacctcgcggcgagaatccggaggagaaggagactgcaaggataggcccaggaaaacgaagagatggagcagcctatgcagaatggagaggaagaccgccctttgggaggaggtgaaggccaccagcctgcaggaaatcgacggggacaggctcgccgacttgcccctaattttcgatgggccatacccaataggcagatcaatgatgggatgggtggagatggagatgatatggaaatattcatggaggagatgagagaaatcagaagaaaacttagggagctgcagttgaggaattgtctgcgtatccttatgggggagctctctaatcaccatgaccatcatgatgaattttgccttatgccttgactcctgccatttatcatgagattaatactgtgattcccgctgttttctttttccttgcattttcctaatatgcctttactgatccgtttgctgtgaaccctatgttatttccatgtgtcaagtgggtcttgtgttgccagcttctatttgaagattgcctttgcactcagtgtaagtttctgtcagcagtagtttcacccatttgcatggaaaaatttaaagctaataaagcaatttaaaaagc

SEQ ID NO: 629 - DNA, 805 bp, Homo sapiens
cggtggcgggtggggggaagggggagatcctgctgcactggccgcccaagttggggggcgagctcggtggtgacgcgcggccctcacgtgacccagagctgcagagcgacgcagccttcggtgcagtcgtcactcgcgtctggctaccagctccccgctgccctgagctcggcgggctggcattcggcccggggaaaagcggagcagaaaaacaaccagaaaaaaaaaatctcatcatggcaaatattcaccaggaaaacgaagagatggagcagcctatgcagaatggagaggaagaccgccctttgggaggaggtgaaggccaccagcctgcaggaaatcgacggggacaggctcgccgacttgcccctaattttcgatgggccatacccaataggcagatcaatgatgggatgggtggagatggagatgatatggaaatattcatggaggagatgagagaaatcagaagaaaacttagggagctgcagttgaggaattgtctgcgtatccttatgggggagctctctaatcaccatgaccatcatgatgaattttgccttatgccttgactcctgccatttatcatgagattaatactgtgattcccgctgttttctttttccttgcattttcctaatatgcctttactgatccgtttgctgtgaaccctatgttatttccatgtgtcaagtgggtcttgtgttgccagcttctatttgaagattgcctttgcactcagtgtaagtttctgtcagcagtagtttcacccatttgcatggaaaaatttaaagctaataaagca

SEQ ID NO: 630 - DNA, 913 bp, Homo sapiens
gcgtgcatatggcggtggcgggtggggggaagggggagatcctgctgcactggccgcccaagttggggggcgagctcggtggtgacgcgcggccctcacgtgacccagagctgcagagcgacgcagccttcggtgcagtcgtcactcgcgtctggctaccagctccccgctgccctgagctcggcgggctggcattcggcccggggaaaagcggagcaggtctgcgaggctaagtgtctccgcggcgcacctcgcggcgagaatccggaggagaaggagactgcaaggataggcccagaaaaacaaccagaaaaaaaaaatctcatcatggcaaatattcaccaggaaaacgaagagatggagcagcctatgcagaatggagaggaagaccgccctttgggaggaggtgaaggccaccagcctgcaggaaatcgacggggacaggctcgccgacttgcccctaattttcgatgggccatacccaataggcagatcaatgatgggatgggtggagatggagatgatatggaaatattcatggaggagatgagagaaatcagaagaaaacttagggagctgcagttgaggaattgtctgcgtatccttatgggggagctctctaatcaccatgaccatcatgatgaattttgccttatgccttgactcctgccatttatcatgagattaatactgtgattcccgctgttttctttttccttgcattttcctaatatgcctttactgatccgtttgctgtgaaccctatgttatttccatgtgtcaagtgggtcttgtgttgccagcttctatttgaagattgcctttgcactcagtgtaagtttctgtcagcagtagtttcacccatttgcatggaaaaatttaaagctaataaagcaatttaaaaagcaatcta

SEQ ID NO: 631 - DNA, 1047 bp, Homo sapiens
agagagcgctgggagccggaggggagcgcagcgagttttggccagtggtcgtgcagtccaaggggctggatggcatgctggacccaagctcagctcagcgtccggacccaataacagttttaccaagggagcagctttctatcctggccacactgaggtgcatagcgtaatgtccatgttgttctacactctgatcacagcttttctgatcggcatacaggcggaaccacactcagagagcaatgtccctgcaggacacaccatcccccaagcccactggactaaacttcagcattcccttgacactgcccttcgcagagcccgcagcgccccggcagcggcgatagctgcacgcgtggcggggcagacccgcaacattactgtggaccccaggctgtttaaaaagcggcgactccgttcaccccgtgtgctgtttagcacccagcctccccgtgaagctgcagacactcaggatctggacttcgaggtcggtggtgctgcccccttcaacaggactcacaggagcaagcggtcatcatcccatcccatcttccacaggggcgaattctcggtgtgtgacagtgtcagcgtgtgggttggggataagaccaccgccacagacatcaagggcaaggaggtgatggtgttgggagaggtgaacattaacaacagtgtattcaaacagtacttttttgagaccaagtgccgggacccaaatcccgttgacagcgggtgccggggcattgactcaaagcactggaactcatattgtaccacgactcacacctttgtcaaggcgctgaccatggatggcaagcaggctgcctggcggtttatccggatagatacggcctgtgtgtgtgtgctcagcaggaaggctgtgagaagagcctgacctgccgacacgctccctccccctgccccttctacactctcctgggcccctccctacctcaacctgtaaattattttaaattataaggactgcatggtaatttatagtttatacagttttaaagaatcattatttattaaatttttggaagc

SEQ ID NO: 632 - DNA, 3417 bp, Homo sapiens
agagcgagccgagccgcggccagctccggcgggcagggggggcgctggagcgcagcgcagcgcagccccatcagtccgcaaagcggaccgagctggaagtcgagcgctgccgcgggaggcgggcgatgggggcaggtgccaccggccgcgccatggacgggccgcgcctgctgctgttgctgcttctgggggtgtcccttggaggtgccaaggaggcatgccccacaggcctgtacacacacagcggtgagtgctgcaaagcctgcaacctgggcgagggtgtggcccagccttgtggagccaaccagaccgtgtgtgagccctgcctggacagcgtgacgttctccgacgtggtgagcgcgaccgagccgtgcaagccgtgcaccgagtgcgtggggctccagagcatgtcggcgccgtgcgtggaggccgacgacgccgtgtgccgctgcgcctacggctactaccaggatgagacgactgggcgctgcgaggcgtgccgcgtgtgcgaggcgggctcgggcctcgtgttctcctgccaggacaagcagaacaccgtgtgcgaggagtgccccgacggcacgtattccgacgaggccaaccacgtggacccgtgcctgccctgcaccgtgtgcgaggacaccgagcgccagctccgcgagtgcacacgctgggccgacgccgagtgcgaggagatccctggccgttggattacacggtccacacccccagagggctcggacagcacagcccccagcacccaggagcctgaggcacctccagaacaagacctcatagccagcacggtggcaggtgtggtgaccacagtgatgggcagctcccagcccgtggtgacccgaggcaccaccgacaacctcatccctgtctattgctccatcctggctgctgtggttgtgggccttgtggcctacatagccttcaagaggtggaacagctgcaagcagaacaagcaaggagccaacagccggccagtgaaccagacgcccccaccagagggagaaaaactccacagcgacagtggcatctccgtggacagccagagcctgcatgaccagcagccccacacgcagacagcctcgggccaggccctcaagggtgacggaggcctctacagcagcctgcccccagccaagcgggaggaggtggagaagcttctcaacggctctgcgggggacacctggcggcacctggcgggcgagctgggctaccagcccgagcacatagactcctttacccatgaggcctgccccgttcgcgccctgcttgcaagctgggccacccaggacagcgccacactggacgccctcctggccgccctgcgccgcatccagcgagccgacctcgtggagagtctgtgcagtgagtccactgccacatccccggtgtgagcccaaccggggagcccccgccccgccccacattccgacaaccgatgctccagccaacccctgtggagcccgcacccccaccctttggggggggcccgcctggcagaactgagctcctctgggcaggacctcagagtccaggccccaaaaccacagccctgtcagtgcagcccgtgtggccccttcacttctgaccacacttcctgtccagagagagaagtgcccctgctgcctccccaaccctgcccctgccccgtcaccatctcaggccacctgcccccttctcccacactgctaggtgggccagcccctcccaccacagcaggtgtcatatatggggggccaacaccagggatggtactagggggaagtgacaaggccccagagactcagagggaggaatcgaggaaccagagccatggactctacactgtgaacttggggaacaagggtggcatcccagtggcctcaaccctccctcagcccctcttgccccccaccccagcctaagatgaagaggatcggaggcttgtcagagctgggaggggttttcgaagctcagcccacccccctcattttggatataggtcagtgaggcccagggagaggccatgattcgcccaaagccagacagcaacggggaggccaagtgcaggctggcaccgccttctctaaatgaggggcctcaggtttgcctgagggcgaggggagggtggcaggtgaccttctgggaaatggcttgaagccaagtcagctttgccttccacgctgtctccagacccccaccccttccccactgcctgcccacccgtggagatgggatgcttgcctagggcctggtccatgatggagtcaggtttggggttcgtggaaagggtgctgcttccctctgcctgtccctctcaggcatgcctgtgtgacatcagtggcatggctccagtctgctgccctccatcccgacatggacccggagctaacactggcccctagaatcagcctaggggtcagggaccaaggacccctcaccttgcaacacacagacacacgcacacacacacacaggaggagaaatctcacttttctccatgagttttttctcttgggctgagactggatactgcccggggcagctgccagagaagcatcggagggaattgaggtctgctcggccgtcttcactcgcccccgggtttggcgggccaaggactgccgaccgaggctggagctggcgtctgtcttcaagggcttacacgtggaggaatgctcccccatcctccccttccctgcaaacatggggttggctgggcccagaaggttgtgatgaagaaaagtgggccagtgtgggaatgcggcaagaaggaattgacttcgactgtgacctgtggggatttctcccagctctagacaaccctgcaaaggactgttttttcctgagcttggccagaagggggccatgaggcctcagtggactttccaccccctccctggcctgttctgttttgcctgaagttggagtgagtgtggctcccctctatttagcatgacaagccccaggcaggctgtgcgctgacaaccaccgctccccagcccagggttcccccagccctgtggaagggactaggagcactgtagtaaatggcaattctttgacctcaacctgtgatgaggggaggaaactcacctgctggcccctcacctgggcacctggggagtgggacagagtctgggtgtatttattttcctccccagcaggtggggagggggtttgggggcttgcaagtatgttttagcatgtgtttggttctggggcccctttttactccccttgagctgagatggaacccttttggcccccgagctgggggccatgagctccagacccccagcaaccctcctatcacctcccctccttgcctcctgtgtaatcatttcttgggccctcctgaaacttacacacaaaacgttaagtgatgaacattaaatagcaaagaaagaaaaatagtacaaa

SEQ ID NO: 633 - DNA, 1840 bp, Homo sapiens
gtagaccaggagagcggggaggagggaccggatcccagaggggcaacgacttgggctccgggtctgggcaagagcgagggtccccgcgcgaagacccaaggaaggaggggagctgggcgtggaggacctgggcgcttgggaaggtgtaccccgacaggaacctgccgtctgcagcccctgcggctcccgcctccgcctcggcgcgcggctgctcggtctgggatggctgtgcgcggtccgagtttcttcctgggccgcggtgtcccttggaggtgccaaggaggcatgccccacaggcctgtacacacacagcggtgagtgctgcaaagcctgcaacctgggcgagggtgtggcccagccttgtggagccaaccagaccgtgtgtgagccctgcctggacagcgtgacgttctccgacgtggtgagcgcgaccgagccgtgcaagccgtgcaccgagtgcgtggggctccagagcatgtcggcgccgtgcgtggaggccgacgacgccgtgtgccgctgcgcctacggctactaccaggatgagacgactgggcgctgcgaggcgtgccgcgtgtgcgaggcgggctcgggcctcgtgttctcctgccaggacaagcagaacaccgtgtgcgaggagtgccccgacggcacgtattccgacgaggccaaccacgtggacccgtgcctgccctgcaccgtgtgcgaggacaccgagcgccagctccgcgagtgcacacgctgggccgacgccgagtgcgaggagatccctggccgttggattacacggtccacacccccagagggctcggacagcacagcccccagcacccaggagcctgaggcacctccagaacaagacctcatagccagcacggtggcaggtgtggtgaccacagtgatgggcagctcccagcccgtggtgacccgaggcaccaccgacaacctcatccctgtctattgctccatcctggctgctgtggttgtgggccttgtggcctacatagccttcaagaggtggaacagctgcaagcagaacaagcaaggagccaacagccggccagtgaaccagacgcccccaccagagggagaaaaactccacagcgacagtggcatctccgtggacagccagagcctgcatgaccagcagccccacacgcagacagcctcgggccaggccctcaagggtgacggaggcctctacagcagcctgcccccagccaagcgggaggaggtggagaagcttctcaacggctctgcgggggacacctggcggcacctggcgggcgagctgggctaccagcccgagcacatagactcctttacccatgaggcctgccccgttcgcgccctgcttgcaagctgggccacccaggacagcgccacactggacgccctcctggccgccctgcgccgcatccagcgagccgacctcgtggagagtctgtgcagtgagtccactgccacatccccggtgtgagcccaaccggggagcccccgccccgccccacattccgacaaccgatgctccagccaacccctgtggagcccgcacccccaccctttggggggggcccgcctggcagaactgagctcctctgggcaggacctcagagtccaggccccaaaaccacagccctgtcagtgcagcccgtgtggccccttcacttctgaccacacttcctgtccagagagagaagtgcccctgctgcctccccaaccctgcccctgccccgtcaccatctcaggccacctgcccccttctcccacactgctaggtgggccagcccctcccaccacagcaggtgtcatatatggggggccaacaccagggatggtacta

SEQ ID NO: 634 - DNA, 4465 bp, Homo sapiens
gggagctcagcggtcggcggccggcggcgggagatcgcgggcgagcggagcgcaacactcgcttggttggggagatcggcgcttggccggatgagcacaagcctgggagatggcagtgatggaaatggcctgcccaggtgcccctggctcagcagtggggcagcagaaggaactccccaaagccaaggagaagacgccgccactggggaagaaacagagctccgtctacaagcttgaggccgtggagaagagccctgtgttctgcggaaagtgggagatcctgaatgacgtgattaccaagggcacagccaaggaaggctccgaggcagggccagctgccatctctatcatcgcccaggctgagtgtgagaatagccaagagttcagccccaccttttcagaacgcattttcatcgctgggtccaaacagtacagccagtccgagagtcttgatcagatccccaacaatgtggcccatgctacagagggcaaaatggcccgtgtgtgttggaagggaaagcgtcgcagcaaagcccggaagaaacggaagaagaagagctcaaagtccctggctcatgcaggagtggccttggccaaacccctccccaggacccctgagcaggagagctgcaccatcccagtgcaggaggatgagtctccactcggcgccccatatgttagaaacaccccgcagttcaccaagcctctgaaggaaccaggccttgggcaactctgttttaagcagcttggcgagggcctacgggctctgcctcgatcagaactccacaaactgatcagccccttgcaatgtctgaaccacgtgtggaaactgcaccacccccaggacggaggccccctgcccctgcccacgcaccccttcccctatagcagactgcctcatcccttcccattccaccctctccagccctggaaacctcaccctctggagtccttcctgggcaaactggcctgtgtagacagccagaaacccttgcctgacccacacctgagcaaactggcctgtgtagacagtccaaagcccctgcctggcccacacctggagcccagctgcctgtctcgtggtgcccatgagaagttttctgtggaggaatacctagtgcatgctctgcaaggcagcgtgagctcaggccaggcccacagcctgaccagcctggccaagacctgggcagcaaggggctccagatcccgggagcccagccccaaaactgaggacaacgagggtgtcctgctcactgagaaactcaagccagtggattatgagtaccgagaagaagtccactgggccacgcaccagctccgcctgggcagaggctccttcggagaggtgcacaggatggaggacaagcagactggcttccagtgcgctgtcaaaaaggtgcggctggaagtatttcgggcagaggagctgatggcatgtgcaggattgacctcacccagaattgtccctttgtatggagctgtgagagaagggccttgggtcaacatcttcatggagctgctggaaggtggctccctgggccagctggtcaaggagcagggctgtctcccagaggaccgggccctgtactacctgggccaggccctggagggtctggaatacctccactcacgaaggattctgcatggggacgtcaaagctgacaacgtgctcctgtccagcgatgggagccacgcagccctctgtgactttggccatgctgtgtgtcttcaacctgatggcctgggaaagtccttgctcacaggggactacatccctggcacagagacccacatggctccggaggtggtgctgggcaggagctgcgacgccaaggtggatgtctggagcagctgctgtatgatgctgcacatgctcaacggctgccacccctggactcagttcttccgagggccgctctgcctcaagattgccagcgagcctccgcctgtgagggagatcccaccctcctgcgcccctctcacagcccaggccatccaagaggggctgaggaaagagcccatccaccgcgtgtctgcagcggagctgggagggaaggtgaaccgggcactacagcaagtgggaggtctgaagagcccttggaggggagaatataaagaaccaagacatccaccgccaaatcaagccaattaccaccagaccctccatgcccagccgagagagctttcgccaagggccccagggccccggccagctgaggagacaacaggcagagcccctaagctccagcctcctctcccaccagagcccccagagccaaacaagtctcctcccttgactttgagcaaggaggagtctgggatgtgggaacccttacctctgtcctccctggagccagcccctgccagaaaccccagctcaccagagcggaaagcaaccgtcccggagcaggaactgcagcagctggaaatagaattattcctcaacagcctgtcccagccattttctctggaggagcaggagcaaattctctcgtgcctcagcatcgacagcctctccctgtcggatgacagtgagaagaacccatcaaaggcctctcaaagctcgcgggacaccctgagctcaggcgtacactcctggagcagccaggccgaggctcgaagctccagctggaacatggtgctggcccgggggcggcccaccgacaccccaagctatttcaatggtgtgaaagtccaaatacagtctcttaatggtgaacacctgcacatccgggagttccaccgggtcaaagtgggagacatcgccactggcatcagcagccagatcccagctgcagccttcagcttggtcaccaaagacgggcagcctgttcgctacgacatggaggtgccagactcgggcatcgacctgcagtgcacactggcccctgatggcagcttcgcctggagctggagggtcaagcatggccagctggagaacaggccctaaccctgccctccaccgccggctccacactgccggaagcagccttcctgctcggtgcacgatgctgccctgaaacacaggctcagccgttcccagggatctgccagcccccggctcagcagtgggaccagggcctcgcagcagcaaggtgggggcaagcagaatgcctcccaggatttcacacctgagccctgccccaccctgctgagaaaacactccgccacgtgaagagacagaggaggatggcaggagttacctcgggaaacaaacaggatcttctctgccctgctccagtcgagttggcctgacccgcttggatcagtgaccatttgctggcagacaggggagagcagcttccagcctgggtcagaaggggtgggcgagcccctcggcccctcaccctccaggctgctgtgagagtgtcaagtgtgtaagggcccaaactcaggttcagtgcagaaccaggtcagcaggtatgcccgcccgtaggttaagggggccctctaaaccccttgcctggcctcacctggccagctcaccccttttgggtgtaggggaaaagaatgcctgaccctgggaaggctccctggtagaatacaccacacttttcaggttgttgcaacacaggtcctgagttgacctctggttcagccaaggaccaaagaaggtgtgtaagtgaagtggttctcagtccccagacatgtgcccctttgctgctggctaccactcttccccagagcagcaggccccgagccccttcaggcccagcactgccccagactcgctggcactcagttccctcatctgtaaaggtgaagggtgatgcaggatatgcctgacaggaacagtctgtggatggacatgatcagtgctaaggaaagcagcagagagagacgctccggcgccccagccccactatcagtgtccagcgtgctggttccccagagcacagctcagcatcacactgacactcaccctgccctgcccctggccagagggtactgccgacggcactttgcactctgatgacctcaaagcactttcatggctgccctctggcagggcagggcagggcagtgacactgtaggagcatagcaagccaggagatggggtgaagggacacagtcttgagctgtccacatgcatgtgactcctcaaacctcttccagatttctctaagaatagcacccccttccccattgccccagcttagcctcttctcccaggggagctactcaggactcacgtagcattaaatcagctgtgaatcgtcagggggtgtctgctagcctcaacctcctggggcaggggacgccgagactccgtgggagaagctcattcccacatcttgccaagacagcctttgtccagctgtccacattgagtcagactgctcccggggagagagccccggcccccagcacataaagaactgcagccttggtactgcagagtctgggttgtagagaactctttgtaagcaataaagtttggggtgatgacaaatgtttccaggc

SEQ ID NO: 635 - DNA, 1476 bp, Homo sapiens
tgttttaagcagcttggcgagggcctacgggctctgcctcgatcagaactccacaaactgatcagccccttgcaatgtctgaaccacgtgtggaaactgcaccacccccaggacggaggccccctgcccctgcccacgcaccatcccttcccattccaccctctccagccctggaaacctcaccctctggagtccttcctgggcaaactggcctgtgtagacagccagaaacccttgcctgacccacacctgagcaaactggcctgtgtagacagtccaaagcccctgcctggcccacacctggagcccagctgcctgtctcgtggtgcccatgagaagttttctgtggaggaatacctagtgcatgctctgcaaggcagcgtgagctcaggccaggcccacagcctgaccagcctggccaagacctgggcagcaaggggctccagatcccgggagcccagccccaaaactgaggacaacgagggtgtcctgctcactgagaaactcaagccagtggattatgagtaccgagaagaagtccactgggccacgcaccagctccgcctgggcagaggctccttcggagaggtgcacaggatggaggacaagcagactggcttccagtgcgctgtcaaaaaggtgcggctggaagtatttcgggcagaggagctgatggcatgtgcaggattgacctcacccagaattgtccctttgtatggagctgtgagagaagggccttgggtcaacatcttcatggagctgctggaaggtggctccctgggccagctggtcaaggagcagggctgtctcccagaggaccgggccctgtactacctgggccaggccctggagggtctggaatacctccactcacgaaggattctgcatggggacgtcaaagctgacaacgtgctcctgtccagcgatgggagccacgcagccctctgtgactttggccatgctgtgtgtcttcaacctgatggcctgggaaagtccttgctcacaggggactacatccctggcacagagacccacatggctccggaggtggtgctgggcaggagctgcgacgccaaggtggatgtctggagcagctgctgtatgatgctgcacatgctcaacggctgccacccctggactcagttcttccgagggccgctctgcctcaaggtcggtgacggcacccagcatggccaacagggggagctgcagggccctggggcccaggctgcaggctggaggggctgctctgcggtggcagatggagcaaggggaggcctggtcatccatgtgggatcctaattcaaatacttgccacccaaatctgggggtacaaggggagatccagctgcggaggctcaccaagttcatggcaggtgagaactctcttctgtccataccctgggccccatccacctgcctcctaacgggccgggcctggaggctgtgggcgtcttgctgcctggctctggcctg

SEQ ID NO: 636 - DNA, 1262 bp, Homo sapiens
cgtgtgtagttggcatctccgcgcgtccggacacccgatcccagcatccctgcctgcaggactgttcgtgttcagctcgcgtcctgcagctgtccgaggtgctccagttggaggctgaggttcccgggctctgtagctgagtgggcggcggcaccggcggagatgcctgggaagaaggcgcgcaagaacgctcaaccgagccccgcgcgggctccagcaggaccggcgggtacggcgggtacggcgagggaccaagccggatttgcgattgggatgcagctgcgtttcaccaggggcaaaaagctcctttcctcctctctttcctcctcgccacttgcccttccccggggccacgaggaacaagtgcaagtagctggaagtcgagtgtgctactcaactcaggagatttggagacaaactgaacttccggcagaaacttctgaatctgatatccaaactcttctgctcaggaacctgactgcatcaaaaacttgcatgaggggactccttcaaaagagttttctcaggaggtgcacgtttcatcaatttgaagaaagactgcattgtaattgagaggaatgtgaaggtgcattcatgggtgcccttggaaacggaagatggaatacatcaaagtgaatttctgttcaagttttcccagattatcattctttgggatgagagaacattataaaaccactttgtttattttaaagcaagaatggaagacccttgaaaataaagaagtaattattgacacatttcttttttacttagagaatcgttctagtgtttttgccgaagattaccgctggcctactgtgaagggagatgacctgtgattagactgggcggctggggagaaacagttcagtgcattgttgttgttgctgtttttggtgttttgcttttcagtgccaactcagcacattgtatatgattcggtttatacatattaccttgttataatgaaaaaactcattctgagaacactgaaatgttatactcagtgttgatttcttcggtcactacacaacgtaaaatcatttgtttcttttgactcaaattgtattgcttctgttcagatgatctttcattcaatgtgttcctgttgggcgttactagaaactatggaaaactggaaaataactttgaaaaaattggataaagtataggagggttacttggggccagtaaatcagtagactgaacattcaatataataaaagaacatggggattttgtataaccagggataataaaaa

SEQ ID NO: 637 - DNA, 1948 bp, Homo sapiens
agggaagttctcactggacaaaagcgtggtctctggcgcggggatctcagagtttcccgggcactcaccgtgtgtagttggcatctccgcgcgtccggacacccgatcccagcatccctgcctgcaggactgttcgtgttcagctcgcgtcctgcagctgtccgaggtgctccagttggaggctgaggttcccgggctctgtagctgagtgggcggcggcaccggcggagatgcctgggaagaaggcgcgcaagaacgctcaaccgagccccgcgcgggctccagcagagctggaagtcgagtgtgctactcaactcaggagatttggagacaaactgaacttccggcagaaacttctgaatctgatatccaaactcttctgctcaggaacctgactgcatcaaaaacttgcatgaggggactccttcaaaagagttttctcaggaggtgcacgtttcatcaatttgaagaaagactgcattgtaattgagaggaatgtgaaggtgcattcatgggtgcccttggaaacggaagatggaatacatcaaagtgaatttctgttcaagttttcccagattatcattctttgggatgagagaacattataaaaccactttgtttattttaaagcaagaatggaagacccttgaaaataaagaagtaattattgacacatttcttttttacttagagaatcgttctagtgtttttgccgaagattaccgctggcctactgtgaagggagatgacctgtgattagactgggcggctggggagaaacagttcagtgcattgttgttgttgctgtttttggtgttttgcttttcagtgccaactcagcacattgtatatgattcggtttatacatattaccttgttataatgaaaaaactcattctgagaacactgaaatgttatactcagtgttgatttcttcggtcactacacaacgtaaaatcatttgtttcttttgactcaaattgtattgcttctgttcagatgatctttcattcaatgtgttcctgttgggcgttactagaaactatggaaaactggaaaataactttgaaaaaattggataaagtataggagggttacttggggccagtaaatcagtagactgaacattcaatataataaaagaacatggggattttgtataaccagggataataaaaagaaaaaagaagttaatttttaattgatgtttttgaaacttagtagaacaaatattcagaagtaacttgataagatatgaatgtttctaaagaagtttctaaaggttcggaaaatgctccttgtcacattagtgtgcatcctacaaaaagtgatctcttaatgtaaattaagaatattttcataattggaatatacttttcttaaaaaaaaggaacagttagttctcatctagaatgaaagttccatatatgcattggtgaatatatatgtatacacatacttacatacttatatgggtatctgtatagataatttgtattagagtattatatagcttcttagtagggtctcaagtaagtttcattttttttatctgggctatatacagtcctcaaataaataatgtcttgattttatttcagcaggaataattttatttattttgcctatttataattaaagtatttttctttagtttgaaaatgtgtattaaagttacatttttgagttacaagagtcttataactacttgaatttttagttaaaatgtcttaatgtaggttgtagtcactttagatggaaaattacctcacatctgttttcttcagtattacttaagattgtttatttagtggtagagagttttttttttcagcctagaggcagctattttaccatctggtatttatggtctaatttgtatttaaacatatgcacacatataaaagttgatactgtggcagtaaactattaaaagttttcactgttc

SEQ ID NO: 638 - DNA, 1068 bp, Homo sapiens
cgaggatgtgcgtgggggctcggcggctgggccgcgggccgtgtgcggctctgctcctcctgggcctggggctgagcaccgtgacggggctccactgtgtcggggacacctaccccagcaacgaccggtgctgccacgagtgcaggccaggcaacgggatggtgagccgctgcagccgctcccagaacacggtgtgccgtccgtgcgggccgggcttctacaacgacgtggtcagctccaagccgtgcaagccctgcacgtggtgtaacctcagaagtgggagtgagcggaagcagctgtgcacggccacacaggacacagtctgccgctgccgggcgggcacccagcccctggacagctacaagcctggagttgactgtgccccctgccctccagggcacttctccccaggcgacaaccaggcctgcaagccctggaccaactgcaccttggctgggaagcacaccctgcagccggccagcaatagctcggacgcaatctgtgaggacagggaccccccagccacgcagccccaggagacccagggccccccggccaggcccatcactgtccagcccactgaagcctggcccagaacctcacagggaccctccacccggcccgtggaggtccccgggggccgtgcggttgccgccatcctgggcctgggcctggtgctggggctgctgggccccctggccatcctgctggccctgtacctgctccggagggaccagaggctgccccccgatgcccacaagccccctgggggaggcagtttccggacccccatccaagaggagcaggccgacgcccactccaccctggccaagatctgacctgggcccaccaaggtggacgctgggccccgccaggctggagcccggagggtctgctgggcgagcagggcaggtgcaggccgcctgccccgccacgctcctgggccaactctgcaccgttctaggtgccgatggctgcctccggctctctgcttacgtatgccatgcatacctcctgccccgcgggaccacaataaaaaccttggcagacgggagtctccgaccggca

SEQ ID NO: 639 - DNA, 393 bp, Homo sapiens
cccaggggcaccccctctccctccgggggcccagactcggcccaggccacgtggagtcggggagaccacgctggccatgtggcctggccttgctggcctgagcagaagtgggagtgagcggaagcagctgtgcacggccacacaggacacagtctgccgctgccgggcgggcacccagcccctggacagctacaagcctggagttgactgtgccccctgccctccagggcacttctccccaggcgacaaccaggcctgcaagccctggaccaactgcaccttggctgggaagcacaccctgcagccggccagcaatagctcggacgcaatctgtgaggacagggaccccccagccacgcagccccaggagacccagggccccccggccaggcc

SEQ ID NO: 640 - DNA, 3470 bp, Homo sapiens
ggccctgggacctttgcctattttctgattgataggctttgttttgtctttacctccttctttctggggaaaacttcagttttatcgcacgttccccttttccatatcttcatcttccctctacccagattgtgaagatggaaagggtccaacccctggaagagaatgtgggaaatgcagccaggccaagattcgagaggaacaagctattgctggtggcctctgtaattcagggactggggctgctcctgtgcttcacctacatctgcctgcacttctctgctcttcaggtatcacatcggtatcctcgaattcaaagtatcaaagtacaatttaccgaatataagaaggagaaaggtttcatcctcacttcccaaaaggaggatgaaatcatgaaggtgcagaacaactcagtcatcatcaactgtgatgggttttatctcatctccctgaagggctacttctcccaggaagtcaacattagccttcattaccagaaggatgaggagcccctcttccaactgaagaaggtcaggtctgtcaactccttgatggtggcctctctgacttacaaagacaaagtctacttgaatgtgaccactgacaatacctccctggatgacttccatgtgaatggcggagaactgattcttatccatcaaaatcctggtgaattctgtgtcctttgaggggctgatggcaatatctaaaaccaggcaccagcatgaacaccaagctgggggtggacagggcatggattcttcattgcaagtgaaggagcctcccagctcagccacgtgggatgtgacaagaagcagatcctggccctcccgcccccacccctcagggatatttaaaacttattttatataccagttaatcttatttatccttatattttctaaattgcctagccgtcacaccccaagattgccttgagcctactaggcacctttgtgagaaagaaaaaatagatgcctcttcttcaagatgcattgtttctattggtcaggcaattgtcataataaacttatgtcattgaaaacggtacctgactaccatttgctggaaatttgacatgtgtgtggcattatcaaaatgaagaggagcaaggagtgaaggagtggggttatgaatctgccaaaggtggtatgaaccaacccctggaagccaaagcggcctctccaaggttaaattgattgcagtttgcatattgcctaaatttaaactttctcatttggtgggggttcaaaagaagaatcagcttgtgaaaaatcaggacttgaagagagccgtctaagaaataccacgtgctttttttctttaccattttgctttcccagcctccaaacatagttaatagaaatttcccttcaaagaactgtctggggatgtgatgctttgaaaaatctaatcagtgacttaagagagattttcttgtatacagggagagtgagataacttattgtgaagggttagctttactgtacaggatagcagggaactggacatctcagggtaaaagtcagtacggattttaatagcctggggaggaaaacacattctttgccacagacaggcaaagcaacacatgctcatcctcctgcctatgctgagatacgcactcagctccatgtcttgtacacacagaaacattgctggtttcaagaaatgaggtgatcctattatcaaattcaatctgatgtcaaatagcactaagaagttattgtgccttatgaaaaataatgatctctgtctagaaataccatagaccatatatagtctcacattgataattgaaactagaagggtctataatcagcctatgccagggcttcaatggaatagtatccccttatgtttagttgaaatgtccccttaacttgatataatgtgttatgcttatggcgctgtggacaatctgatttttcatgtcaactttccagatgatttgtaacttctctgtgccaaaccttttataaacataaatttttgagatatgtattttaaaattgtagcacatgtttccctgacattttcaatagaggatacaacatcacagaatctttctggatgattctgtgttatcaaggaattgtactgtgctacaattatctctagaatctccagaaaggtggagggctgttcgcccttacactaaatggtctcagttggatttttttttcctgttttctatttcctcttaagtacaccttcaactatattcccatccctctattttaatctgttatgaaggaaggtaaataaaaatgctaaatagaagaaattgtaggtaaggtaagaggaatcaagttctgagtggctgccaaggcactcacagaatcataatcatggctaaatatttatggagggcctactgtggaccaggcactgggctaaatacttacatttacaagaatcattctgagacagatattcaatgatatctggcttcactactcagaagattgtgtgtgtgtttgtgtgtgtgtgtgtgtgtgtatttcactttttgttattgaccatgttctgcaaaattgcagttactcagtgagtgatatccgaaaaagtaaacgtttatgactataggtaatatttaagaaaatgcatggttcatttttaagtttggaatttttatctatatttctcacagatgtgcagtgcacatgcaggcctaagtatatgttgtgtgtgttgtttgtctttgatgtcatggtcccctctcttaggtgctcactcgctttgggtgcacctggcctgctcttcccatgttggcctctgcaaccacacagggatatttctgctatgcaccagcctcactccaccttccttccatcaaaaatatgtgtgtgtgtctcagtccctgtaagtcatgtccttcacagggagaattaacccttcgatatacatggcagagttttgtgggaaaagaattgaatgaaaagtcaggagatcagaattttaaatttgacttagccactaactagccatgtaaccttgggaaagtcatttcccatttctgggtcttgcttttctttctgttaaatgagaggaatgttaaatatctaacagtttagaatcttatgcttacagtgttatctgtgaatgcacatattaaatgtctatgttcttgttgctatgagtcaaggagtgtaaccttctcctttactatgttgaatgtatttttttctggacaagcttacatcttcctcagccatctttgtgagtccttcaagagcagttatcaattgttagttagatattttctatttagagaatgcttaagggattccaatcccgatccaaatcataatttgttcttaagtatactgggcaggtcccctattttaagtcataattttgtatttagtgctttcctggctctcagagagtattaatattgatattaataatatagttaatagtaatattgctatttacatggaaacaaataaaagatctcagaattc

SEQ ID NO: 641 - DNA, 3429 bp, Homo sapiens
aaaacacaggacacatggctccattcaaggctaactgattgcacaacggctctgagcaggagagagcaaaaggtgaaccacagttgtacagcttgctggtggttggggtcacattggactatcaatatccaggagatgttgagaaaaagaggggatcctttccaacaagtcatccagcaactctgggacagaaggaaagctgtgggaagaaaagcagggtgctggtttctaggacactaaacctcatggtatcacatcggtatcctcgaattcaaagtatcaaagtacaatttaccgaatataagaaggagaaaggtttcatcctcacttcccaaaaggaggatgaaatcatgaaggtgcagaacaactcagtcatcatcaactgtgatgggttttatctcatctccctgaagggctacttctcccaggaagtcaacattagccttcattaccagaaggatgaggagcccctcttccaactgaagaaggtcaggtctgtcaactccttgatggtggcctctctgacttacaaagacaaagtctacttgaatgtgaccactgacaatacctccctggatgacttccatgtgaatggcggagaactgattcttatccatcaaaatcctggtgaattctgtgtcctttgaggggctgatggcaatatctaaaaccaggcaccagcatgaacaccaagctgggggtggacagggcatggattcttcattgcaagtgaaggagcctcccagctcagccacgtgggatgtgacaagaagcagatcctggccctcccgcccccacccctcagggatatttaaaacttattttatataccagttaatcttatttatccttatattttctaaattgcctagccgtcacaccccaagattgccttgagcctactaggcacctttgtgagaaagaaaaaatagatgcctcttcttcaagatgcattgtttctattggtcaggcaattgtcataataaacttatgtcattgaaaacggtacctgactaccatttgctggaaatttgacatgtgtgtggcattatcaaaatgaagaggagcaaggagtgaaggagtggggttatgaatctgccaaaggtggtatgaaccaacccctggaagccaaagcggcctctccaaggttaaattgattgcagtttgcatattgcctaaatttaaactttctcatttggtgggggttcaaaagaagaatcagcttgtgaaaaatcaggacttgaagagagccgtctaagaaataccacgtgctttttttctttaccattttgctttcccagcctccaaacatagttaatagaaatttcccttcaaagaactgtctggggatgtgatgctttgaaaaatctaatcagtgacttaagagagattttcttgtatacagggagagtgagataacttattgtgaagggttagctttactgtacaggatagcagggaactggacatctcagggtaaaagtcagtacggattttaatagcctggggaggaaaacacattctttgccacagacaggcaaagcaacacatgctcatcctcctgcctatgctgagatacgcactcagctccatgtcttgtacacacagaaacattgctggtttcaagaaatgaggtgatcctattatcaaattcaatctgatgtcaaatagcactaagaagttattgtgccttatgaaaaataatgatctctgtctagaaataccatagaccatatatagtctcacattgataattgaaactagaagggtctataatcagcctatgccagggcttcaatggaatagtatccccttatgtttagttgaaatgtccccttaacttgatataatgtgttatgcttatggcgctgtggacaatctgatttttcatgtcaactttccagatgatttgtaacttctctgtgccaaaccttttataaacataaatttttgagatatgtattttaaaattgtagcacatgtttccctgacattttcaatagaggatacaacatcacagaatctttctggatgattctgtgttatcaaggaattgtactgtgctacaattatctctagaatctccagaaaggtggagggctgttcgcccttacactaaatggtctcagttggatttttttttcctgttttctatttcctcttaagtacaccttcaactatattcccatccctctattttaatctgttatgaaggaaggtaaataaaaatgctaaatagaagaaattgtaggtaaggtaagaggaatcaagttctgagtggctgccaaggcactcacagaatcataatcatggctaaatatttatggagggcctactgtggaccaggcactgggctaaatacttacatttacaagaatcattctgagacagatattcaatgatatctggcttcactactcagaagattgtgtgtgtgtttgtgtgtgtgtgtgtgtgtgtatttcactttttgttattgaccatgttctgcaaaattgcagttactcagtgagtgatatccgaaaaagtaaacgtttatgactataggtaatatttaagaaaatgcatggttcatttttaagtttggaatttttatctatatttctcacagatgtgcagtgcacatgcaggcctaagtatatgttgtgtgtgttgtttgtctttgatgtcatggtcccctctcttaggtgctcactcgctttgggtgcacctggcctgctcttcccatgttggcctctgcaaccacacagggatatttctgctatgcaccagcctcactccaccttccttccatcaaaaatatgtgtgtgtgtctcagtccctgtaagtcatgtccttcacagggagaattaacccttcgatatacatggcagagttttgtgggaaaagaattgaatgaaaagtcaggagatcagaattttaaatttgacttagccactaactagccatgtaaccttgggaaagtcatttcccatttctgggtcttgcttttctttctgttaaatgagaggaatgttaaatatctaacagtttagaatcttatgcttacagtgttatctgtgaatgcacatattaaatgtctatgttcttgttgctatgagtcaaggagtgtaaccttctcctttactatgttgaatgtatttttttctggacaagcttacatcttcctcagccatctttgtgagtccttcaagagcagttatcaattgttagttagatattttctatttagagaatgcttaagggattccaatcccgatccaaatcataatttgttcttaagtatactgggcaggtcccctattttaagtcataattttgtatttagtgctttcctggctctcagagagtattaatattgatattaataatatagttaatagtaatattgctatttacatggaaacaaataaaagatctcagaattca

SEQ ID NO: 642 - DNA, 1240 bp, Homo sapiens
gtacagcttgctggtggttggggtcacattggactatcaatatccaggagatgttgagaaaaagaggggatcctttccaacaagtcatccagcaactctgggacagaaggaaagctgtgggaagaaaagcagggtgctggtttctaggacactaaacctcatggtatcacatcggtatcctcgaattcaaagtatcaaagtacaatttaccgaatataagaaggagaaaggtttcatcctcacttcccaaaaggaggatgaaatcatgaaggtgcagaacaactcagtcatcatcaactgtgatgggttttatctcatctccctgaagggctacttctcccaggaagtcaacattagccttcattaccagaaggatgaggagcccctcttccaactgaagaaggtcaggtctgtcaactccttgatggtggcctctctgacttacaaagacaaagtctacttgaatgtgaccactgacaatacctccctggatgacttccatgtgaatggcggagaactgattcttatccatcaaaatcctggtgaattctgtgtcctttgaggggctgatggcaatatctaaaaccaggcaccagcatgaacaccaagctgggggtggacagggcatggattcttcattgcaagtgaaggagcctcccagctcagccacgtgggatgtgacaagaagcagatcctggccctcccgcccccacccctcagggatatttaaaacttattttatataccagttaatcttatttatccttatattttctaaattgcctagccgtcacaccccaagattgccttgagcctactaggcacctttgtgagaaagaaaaaatagatgcctcttcttcaagatgcattgtttctattggtcaggcaattgtcataataaacttatgtcattgaaaacggtacctgactaccatttgctggaaatttgacatgtgtgtggcattatcaaaatgaagaggagcaaggagtgaaggagtggggttatgaatctgccaaaggtggtatgaaccaacccctggaagccaaagcggcctctccaaggttaaattgattgcagtttgcatattgcctaaatttaaactttctcatttggtgggggttcaaaagaagaatcagcttgtgaaaaatcagtgacttaagagagattttcttgtatacagggagagtgagataacttattgtgaagggttagctttactgtacaggatagcagggaact

SEQ ID NO: 643 - DNA, 2579 bp, Homo sapiens
gttttcccctcccatgtgctcaagactggcgctaaaagttttgagcttctcaaaagtctagagccaccgtccagggagcaggtagctgctgggctccggggacactttgcgttcgggctgggagcgtgctttccacgacggtgacacgcttccctggattggcagccagactgccttccgggtcactgccatggaggagccgcagtcagatcctagcgtcgagccccctctgagtcaggaaacattttcagacctatggaaactacttcctgaaaacaacgttctgtcccccttgccgtcccaagcaatggatgatttgatgctgtccccggacgatattgaacaatggttcactgaagacccaggtccagatgaagctcccagaatgccagaggctgctccccccgtggcccctgcaccagcagctcctacaccggcggcccctgcaccagccccctcctggcccctgtcatcttctgtcccttcccagaaaacctaccagggcagctacggtttccgtctgggcttcttgcattctgggacagccaagtctgtgacttgcacgtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcagatccgtgggcgtgagcgcttcgagatgttccgagagctgaatgaggccttggaactcaaggatgcccaggctgggaaggagccaggggggagcagggctcactccagccacctgaagtccaaaaagggtcagtctacctcccgccataaaaaactcatgttcaagacagaagggcctgactcagactgacattctccacttcttgttccccactgacagcctcccacccccatctctccctcccctgccattttgggttttgggtctttgaacccttgcttgcaataggtgtgcgtcagaagcacccaggacttccatttgctttgtcccggggctccactgaacaagttggcctgcactggtgttttgttgtggggaggaggatggggagtaggacataccagcttagattttaaggtttttactgtgagggatgtttgggagatgtaagaaatgttcttgcagttaagggttagtttacaatcagccacattctaggtaggggcccacttcaccgtactaaccagggaagctgtccctcactgttgaattttctctaacttcaaggcccatatctgtgaaatgctggcatttgcacctacctcacagagtgcattgtgagggttaatgaaataatgtacatctggccttgaaaccaccttttattacatggggtctagaacttgacccccttgagggtgcttgttccctctccctgttggtcggtgggttggtagtttctacagttgggcagctggttaggtagagggagttgtcaagtctctgctggcccagccaaaccctgtctgacaacctcttggtgaaccttagtacctaaaaggaaatctcaccccatcccacaccctggaggatttcatctcttgtatatgatgatctggatccaccaagacttgttttatgctcagggtcaatttcttttttcttttttttttttttttttctttttctttgagactgggtctcgctttgttgcccaggctggagtggagtggcgtgatcttggcttactgcagcctttgcctccccggctcgagcagtcctgcctcagcctccggagtagctgggaccacaggttcatgccaccatggccagccaacttttgcatgttttgtagagatggggtctcacagtgttgcccaggctggtctcaaactcctgggctcaggcgatccacctgtctcagcctcccagagtgctgggattacaattgtgagccaccacgtccagctggaagggtcaacatcttttacattctgcaagcacatctgcattttcaccccacccttcccctccttctccctttttatatcccatttttatatcgatctcttattttacaataaaactttgctgccacctgtgtgtctgaggggtg

SEQ ID NO: 644 - DNA, 2579 bp, Homo sapiens; identical to SEQ ID NO: 643

SEQ ID NO: 645 - DNA, 1152 bp, Homo sapiens
atggaggagccgcagtcagatcctagcgtcgagccccctctgagtcaggaaacattttcagacctatggaaactacttcctgaaaacaacgttctgtcccccttgccgtcccaagcaatggatgatttgatgctgtccccggacgatattgaacaatggttcactgaagacccaggtccagatgaagctcccagaatgccagaggctgctccccccgtggcccctgcaccagcagctcctacaccggcggcccctgcaccagccccctcctggcccctgtcatcttctgtcccttcccagaaaacctaccagggcagctacggtttccgtctgggcttcttgcattctgggacagccaagtctgtgacttgcacgtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcagaaaacatttccggccaggcacggtggatcacacctgtaatcccagctactcgggaggctgaggcaggagaatcgcttgaacccaggaggcagagggttgcagtgagccgagattgcgccattgcactctagcctgggcaacagagcaagactccatctc

SEQ ID NO: 646 - DNA, 2466 bp, Homo sapiens
gagccaccgtccagggagcaggtagctgctgggctccggggacactttgcgttcgggctgggagcgtgctttccacgacggtgacacgcttccctggattggcagccagactgccttccgggtcactgccatggaggagccgcagtcagatcctagcgtcgagccccctctgagtcaggaaacattttcagacctatggaaactacttcctgaaaacaacgttctgtcccccttgccgtcccaagcaatggatgatttgatgctgtccccggacgatattgaacaatggttcactgaagacccaggtccagatgaagctcccagaatgccagaggctgctccccccgtggcccctgcaccagcagctcctacaccggcggcccctgcaccagccccctcctggcccctgtcatcttctgtcccttcccagaaaacctaccagggcagctacggtttccgtctgacttgcacgtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcagatccgtgggcgtgagcgcttcgagatgttccgagagctgaatgaggccttggaactcaaggatgcccaggctgggaaggagccaggggggagcagggctcactccagccacctgaagtccaaaaagggtcagtctacctcccgccataaaaaactcatgttcaagacagaagggcctgactcagactgacattctccacttcttgttccccactgacagcctcccacccccatctctccctcccctgccattttgggttttgggtctttgaacccttgcttgcaataggtgtgcgtcagaagcacccaggacttccatttgctttgtcccggggctccactgaacaagttggcctgcactggtgttttgttgtggggaggaggatggggagtaggacataccagcttagattttaaggtttttactgtgagggatgtttgggagatgtaagaaatgttcttgcagttaagggttagtttacaatcagccacattctaggtaggggcccacttcaccgtactaaccagggaagctgtccctcactgttgaattttctctaacttcaaggcccatatctgtgaaatgctggcatttgcacctacctcacagagtgcattgtgagggttaatgaaataatgtacatctggccttgaaaccaccttttattacatggggtctagaacttgacccccttgagggtgcttgttccctctccctgttggtcggtgggttggtagtttctacagttgggcagctggttaggtagagggagttgtcaagtctctgctggcccagccaaaccctgtctgacaacctcttggtgaaccttagtacctaaaaggaaatctcaccccatcccacaccctggaggatttcatctcttgtatatgatgatctggatccaccaagacttgttttatgctcagggtcaatttcttttttcttttttttttttttttttctttttctttgagactgggtctcgctttgttgcccaggctggagtggagtggcgtgatcttggcttactgcagcctttgcctccccggctcgagcagtcctgcctcagcctccggagtagctgggaccacaggttcatgccaccatggccagccaacttttgcatgttttgtagagatggggtctcacagtgttgcccaggctggtctcaaactcctgggctcaggcgatccacctgtctcagcctcccagagtgctgggattacaattgtgagccaccacgtccagctggaagggtcaacatcttttacattctgcaagcacatctgcattttcaccccacccttcccctccttctccctttttatatcccatttttatatcgatctcttattttacaataaaactttgctgcc

SEQ ID NO: 647 - DNA, 1018 bp, Homo sapiens
atggaggagccgcagtcagatcctagcgtcgagccccctctgagtcaggaaacattttcagacctatggaaactacttcctgaaaacaacgttctgtcccccttgccgtcccaagcaatggatgatttgatgctgtccccggacgatattgaacaatggttcactgaagacccaggtccagatgaagctcccagaatgccagaggctgctccccccgtggcccctgcaccagcagctcctacaccggcggcccctgcaccagccccctcctggcccctgtcatcttctgtcccttcccagaaaacctaccagggcagctacggtttccgtctgggcttcttgcattctgggacagccaagtctgtgacttgcacgtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccaggccaaggcaggtggatcacctgaggtcaggagttcaagacagcctggccaacatagcgaaatcccatctctactaaaaatacaaaaattagcctggcagtggtggcccacgcctgtaatcccagctactaagggggctgaggcaggaggatctcttaaccagggaggaggaggttgcagtgagcagagattgtgccactgcactccagcctgtgcaacagagtgagactctgtctc

SEQ ID NO: 648 - DNA, 808 bp, Homo sapiens
aaaagtctagagccaccgtccagggagcaggtagctgctgggctccggggacactttgcgttcgggctgggagcgtgctttccacgacggtgacacgcttccctggattggcagccagactgccttccgggtcactgccatggaggagccgcagtcagatcctagcgtcgagccccctctgagtcaggaaacattttcagacctatggaaactacttcctgaaaacaacgttctgtcccccttgccgtcccaagcaatggatgatttgatgctgtccccggacgatattgaacaatggttcactgaagacccaggtccagatgaagctcccagaatgccagaggctgctccccccgtggcccctgcaccagcagctcctacaccggcggcccctgcaccagccccctcctggcccctgtcatcttctgtcccttcccagaaaacctaccagggcagctacggtttccgtctgggcttcttgcattctgggacagccaagtctgtgacttgcacgtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtctctgggaggaggggttaa

SEQ ID NO: 649 - DNA, 1075 bp, Homo sapiens
atggaggagccgcagtcagatcctagcgtcgagccccctctgagtcaggaaacattttcagacctatggaaactacttcctgaaaacaacgttctgtcccccttgccgtcccaagcaatggatgatttgatgctgtccccggacgatattgaacaatggttcactgaagacccaggtccagatgaagctcccagaatgccagaggctgctccccccgtggcccctgcaccagcagctcctacaccggcggcccctgcaccagccccctcctggcccctgtcatcttctgtcccttcccagaaaacctaccagggcagctacggtttccgtctgggcttcttgcattctgggacagccaagtctgtgacttgcacgtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcagccacctgaagtccaaaaagggtcagtctacctcccgccataaaaaactcatgttcaagacagaagggcctgactcagactga

SEQ ID NO: 650 - DNA, 2653 bp, Homo sapiens
ctagagccaccgtccagggagcaggtagctgctgggctccggggacactttgcgttcgggctgggagcgtgctttccacgacggtgacacgcttccctggattggcagccagactgccttccgggtcactgccatggaggagccgcagtcagatcctagcgtcgagccccctctgagtcaggaaacattttcagacctatggaaactacttcctgaaaacaacgttctgtcccccttgccgtcccaagcaatggatgatttgatgctgtccccggacgatattgaacaatggttcactgaagacccaggtccagatgaagctcccagaatgccagaggctgctccccccgtggcccctgcaccagcagctcctacaccggcggcccctgcaccagccccctcctggcccctgtcatcttctgtcccttcccagaaaacctaccagggcagctacggtttccgtctgggcttcttgcattctgggacagccaagtctgtgacttgcacgtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcaggaccagaccagctttcaaaaagaaaattgttaaagagagcatgaaaatggttctatgactttgcctgatacagatgctacttgacttacgatggtgttacttcctgataaactcgtcgtaagttgaaaatattatccgtgggcgtgagcgcttcgagatgttccgagagctgaatgaggccttggaactcaaggatgcccaggctgggaaggagccaggggggagcagggctcactccagccacctgaagtccaaaaagggtcagtctacctcccgccataaaaaactcatgttcaagacagaagggcctgactcagactgacattctccacttcttgttccccactgacagcctcccacccccatctctccctcccctgccattttgggttttgggtctttgaacccttgcttgcaataggtgtgcgtcagaagcacccaggacttccatttgctttgtcccggggctccactgaacaagttggcctgcactggtgttttgttgtggggaggaggatggggagtaggacataccagcttagattttaaggtttttactgtgagggatgtttgggagatgtaagaaatgttcttgcagttaagggttagtttacaatcagccacattctaggtaggggcccacttcaccgtactaaccagggaagctgtccctcactgttgaattttctctaacttcaaggcccatatctgtgaaatgctggcatttgcacctacctcacagagtgcattgtgagggttaatgaaataatgtacatctggccttgaaaccaccttttattacatggggtctagaacttgacccccttgagggtgcttgttccctctccctgttggtcggtgggttggtagtttctacagttgggcagctggttaggtagagggagttgtcaagtctctgctggcccagccaaaccctgtctgacaacctcttggtgaaccttagtacctaaaaggaaatctcaccccatcccacaccctggaggatttcatctcttgtatatgatgatctggatccaccaagacttgttttatgctcagggtcaatttcttttttcttttttttttttttttttctttttctttgagactgggtctcgctttgttgcccaggctggagtggagtggcgtgatcttggcttactgcagcctttgcctccccggctcgagcagtcctgcctcagcctccggagtagctgggaccacaggttcatgccaccatggccagccaacttttgcatgttttgtagagatggggtctcacagtgttgcccaggctggtctcaaactcctgggctcaggcgatccacctgtctcagcctcccagagtgctgggattacaattgtgagccaccacgtccagctggaagggtcaacatcttttacattctgcaagcacatctgcattttcaccccacccttcccctccttctccctttttatatcccatttttatatcgatctcttattttacaataaaactttgctgccacctgtgtgtctgagggg

SEQ ID NO: 651 - DNA, 2506 bp, Homo sapiens
aaaagtctagagccaccgtccagggagcaggtagctgctgggctccggggacactttgcgttcgggctgggagcgtgctttccacgacggtgacacgcttccctggattggccagactgccttccgggtcactgccatggaggagccgcagtcagatcctagcgtcgagccccctctgagtcaggaaacattttcagacctatggaaactacttcctgaaaacaacgttctgtcccccttgccgtcccaagcaatggatgatttgatgctgtccccggacgatattgaacaatggttcactgaagacccaggtccagatgaagctcccagaatgccagaggctgctccccccgtggcccctgcaccagcagctcctacaccggcggcccctgcaccagccccctcctggcccctgtcatcttctgtcccttcccagaaaacctaccagggcagctacggtttccgtctgggcttcttgcattctgggacagccaagtctgtgacttgcacgtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcagatccgtgggcgtgagcgcttcgagatgttccgagagctgaatgaggccttggaactcaaggatgcccaggctgggaaggagccaggggggagcagggctcactccagccacctgaagtccaaaaagggtcagtctacctcccgccataaaaaactcatgttcaagacagaagggcctgactcagactgacattctccacttcttgttccccactgacagcctcccacccccatctctccctcccctgccattttgggttttgggtctttgaacccttgcttgcaataggtgtgcgtcagaagcacccaggacttccatttgctttgtcccggggctccactgaacaagttggcctgcactggtgttttgttgtggggaggaggatggggagtaggacataccagcttagattttaaggtttttactgtgagggatgtttgggagatgtaagaaatgttcttgcagttaagggttagtttacaatcagccacattctaggtaggggcccacttcaccgtactaaccagggaagctgtccctcactgttgaattttctctaacttcaaggcccatatctgtgaaatgctggcatttgcacctacctcacagagtgcattgtgagggttaatgaaataatgtacatctggccttgaaaccaccttttattacatggggtctagaacttgacccccttgagggtgcttgttccctctccctgttggtcggtgggttggtagtttctacagttgggcagctggttaggtagagggagttgtcaagtctctgctggcccagccaaaccctgtctgacaacctcttggtgaaccttagtacctaaaaggaaatctcaccccatcccacaccctggaggatttcatctcttgtatatgatgatctggatccaccaagacttgttttatgctcagggtcaatttcttttttcttttttttttttttttttctttttctttgagactgggtctcgctttgttgcccaggctggagtggagtggcgtgatcttggcttactgcagcctttgcctccccggctcgagcagtcctgcctcagcctccggagtagctgggaccacaggttcatgccaccatggccagccaacttttgcatgttttgtagagatggggtctcacagtgttgcccaggctggtctcaaactcctgggctcaggcgatccacctgtctcagcctcccagagtgctgggattacaattgtgagccaccacgtccagctggaagggtcaacatcttttacattctgcaagcacatctgcattttcaccccacccttcccctccttctccctttttatatcccatttttatatcgatctcttattttacaataaaactttgctgcca

SEQ ID NO: 652 - DNA, 2580 bp, Homo sapiens
ctagagccaccgtccagggagcaggtagctgctgggctccggggacactttgcgttcgggctgggagcgtgctttccacgacggtgacacgcttccctggattggcagccagactgccttccgggtcactgccatggaggagccgcagtcagatcctagcgtcgagccccctctgagtcaggaaacattttcagacctatggaaactacttcctgaaaacaacgttctgtcccccttgccgtcccaagcaatggatgatttgatgctgtccccggacgatattgaacaatggttcactgaagacccaggtccagatgaagctcccagaatgccagaggctgctccccccgtggcccctgcaccagcagctcctacaccggcggcccctgcaccagccccctcctggcccctgtcatcttctgtcccttcccagaaaacctaccagggcagctacggtttccgtctgggcttcttgcattctgggacagccaagtctgtgacttgcacgtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcagatgctacttgacttacgatggtgttacttcctgataaactcgtcgtaagttgaaaatattatccgtgggcgtgagcgcttcgagatgttccgagagctgaatgaggccttggaactcaaggatgcccaggctgggaaggagccaggggggagcagggctcactccagccacctgaagtccaaaaagggtcagtctacctcccgccataaaaaactcatgttcaagacagaagggcctgactcagactgacattctccacttcttgttccccactgacagcctcccacccccatctctccctcccctgccattttgggttttgggtctttgaacccttgcttgcaataggtgtgcgtcagaagcacccaggacttccatttgctttgtcccggggctccactgaacaagttggcctgcactggtgttttgttgtggggaggaggatggggagtaggacataccagcttagattttaaggtttttactgtgagggatgtttgggagatgtaagaaatgttcttgcagttaagggttagtttacaatcagccacattctaggtaggggcccacttcaccgtactaaccagggaagctgtccctcactgttgaattttctctaacttcaaggcccatatctgtgaaatgctggcatttgcacctacctcacagagtgcattgtgagggttaatgaaataatgtacatctggccttgaaaccaccttttattacatggggtctagaacttgacccccttgagggtgcttgttccctctccctgttggtcggtgggttggtagtttctacagttgggcagctggttaggtagagggagttgtcaagtctctgctggcccagccaaaccctgtctgacaacctcttggtgaaccttagtacctaaaaggaaatctcaccccatcccacaccctggaggatttcatctcttgtatatgatgatctggatccaccaagacttgttttatgctcagggtcaatttcttttttcttttttttttttttttttctttttctttgagactgggtctcgctttgttgcccaggctggagtggagtggcgtgatcttggcttactgcagcctttgcctccccggctcgagcagtcctgcctcagcctccggagtagctgggaccacaggttcatgccaccatggccagccaacttttgcatgttttgtagagatggggtctcacagtgttgcccaggctggtctcaaactcctgggctcaggcgatccacctgtctcagcctcccagagtgctgggattacaattgtgagccaccacgtccagctggaagggtcaacatcttttacattctgcaagcacatctgcattttcaccccacccttcccctccttctccctttttatatcccatttttatatcgatctcttattttacaataaaactttgctgccacctgtgtgtctgagggg

SEQ ID NO: 653 - DNA, 565 bp, Homo sapiens
ttcgggctgggagcgtgctttccacgacggtgacacgcttccctggattggggctgaggagtgtccgaagagaatgggcaggtgagcggtgagacagttgttcttccagaagctttgcagtgaaaggaatcaaagaaatggagccgtgtatcagcagccagactgccttccgggtcactgccatggaggagccgcagtcagatcctagcgtcgagccccctctgagtcaggaaacattttcagacctatggaaactacttcctgaaaacaacgttctgtcccccttgccgtcccaagcaatggatgatttgatgctgtccccggacgatattgaacaatggttcactgaagacccaggtccagatgaagctcccagaatgccagaggctgctccccccgtggcccctgcaccagcagctcctacaccggcggcccctgcaccagccccctcctggcccctgtcatcttctgtcccttcccagaaaacctaccagggcagctacggtttccgtctgggcttcttgcattctgggacagccaagtctgtgacttgcacgtactcccc

SEQ ID NO: 654 - DNA, 634 bp, Homo sapiens
aatgcagggctgaggagtgtccgaagagaatgggcaggtgagcggtgagacagttgttcttccagaagctttgcagtgaaaggaatcaaagaaatggagccgtgtatcagcagccagactgccttccgggtcactgccatggaggagccgcagtcagatcctagcgtcgagccccctctgagtcaggaaacattttcagacctatggaaactacttcctgaaaacaacgttctgtcccccttgccgtcccaagcaatggatgatttgatgctgtccccggacgatattgaacaatggttcactgaagacccaggtccagatgaagctcccagaatgccagaggctgctccccccgtggcccctgcaccagcagctcctacaccggcggcccctgcaccagccccctcctggcccctgtcatcttctgtcccttcccagaaaacctaccagggcagctacggtttccgtctgggcttcttgcattctgggacagccaagtctgtgacttgcacgtactcccctgccctcaacaagatgttttgccaactggccaagacctgccctgtgcagctgtgggttgattccacacccccgcccggcacccgcgtccgcgccatggccatctacaagcagt

SEQ ID NO: 655 - DNA, 729 bp, Homo sapiens
aaaagtctagagccaccgtccagggagcaggtagctgctgggctccggggacactttgcgttcgggctgggagcgtgctttccacgacggtgacacgcttccctggattggtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcag

SEQ ID NO: 656 - DNA, 546 bp, Homo sapiens
ttcgggctgggagcgtgctttccacgacggtgacacgcttccctggattggcagccagactgccttccgggtcactgccatggaggagccgcagtcagatcctagcgtcgagccccctctgagtcaggaaacattttcagacctatggaaactacttcctgaaaacaacgttctgtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggag

SEQ ID NO: 657 - DNA, 2220 bp, Homo sapiens
gagccaccgtccagggagcaggtagctgctgggctccggggacactttgcgttcgggctgggagcgtgctttccacgacggtgacacgcttccctggattggcagccagactgccttccgggtcactgccatggaggagccgcagtcagatcctagcgtcgagccccctctgagtcaggaaacattttcagacctatggaaactacttcctgaaaacaacgttctgtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcagatccgtgggcgtgagcgcttcgagatgttccgagagctgaatgaggccttggaactcaaggatgcccaggctgggaaggagccaggggggagcagggctcactccagccacctgaagtccaaaaagggtcagtctacctcccgccataaaaaactcatgttcaagacagaagggcctgactcagactgacattctccacttcttgttccccactgacagcctcccacccccatctctccctcccctgccattttgggttttgggtctttgaacccttgcttgcaataggtgtgcgtcagaagcacccaggacttccatttgctttgtcccggggctccactgaacaagttggcctgcactggtgttttgttgtggggaggaggatggggagtaggacataccagcttagattttaaggtttttactgtgagggatgtttgggagatgtaagaaatgttcttgcagttaagggttagtttacaatcagccacattctaggtaggggcccacttcaccgtactaaccagggaagctgtccctcactgttgaattttctctaacttcaaggcccatatctgtgaaatgctggcatttgcacctacctcacagagtgcattgtgagggttaatgaaataatgtacatctggccttgaaaccaccttttattacatggggtctagaacttgacccccttgagggtgcttgttccctctccctgttggtcggtgggttggtagtttctacagttgggcagctggttaggtagagggagttgtcaagtctctgctggcccagccaaaccctgtctgacaacctcttggtgaaccttagtacctaaaaggaaatctcaccccatcccacaccctggaggatttcatctcttgtatatgatgatctggatccaccaagacttgttttatgctcagggtcaatttcttttttcttttttttttttttttttctttttctttgagactgggtctcgctttgttgcccaggctggagtggagtggcgtgatcttggcttactgcagcctttgcctccccggctcgagcagtcctgcctcagcctccggagtagctgggaccacaggttcatgccaccatggccagccaacttttgcatgttttgtagagatggggtctcacagtgttgcccaggctggtctcaaactcctgggctcaggcgatccacctgtctcagcctcccagagtgctgggattacaattgtgagccaccacgtccagctggaagggtcaacatcttttacattctgcaagcacatctgcattttcaccccacccttcccctccttctccctttttatatcccatttttatatcgatctcttattttacaataaaactttgctgcc

SEQ ID NO: 658 - DNA, 5375 bp, Homo sapiens
ggctgcggcgggtccgggcccatgaggcgacgaaggaggcgggacggcttttacccagccccggacttccgagacagggaagctgaggacatggcaggagtgtttgacatagacctggaccagccagaggacgcgggctctgaggatgagctggaggaggggggtcagttaaatgaaagcatggaccatgggggagttggaccatatgaacttggcatggaacattgtgagaaatttgaaatctcagaaactagtgtgaacagagggccagaaaaaatcagaccagaatgttttgagctacttcgggtacttggtaaagggggctatggaaaggtttttcaagtacgaaaagtaacaggagcaaatactgggaaaatatttgccatgaaggtgcttaaaaaggcaatgatagtaagaaatgctaaagatacagctcatacaaaagcagaacggaatattctggaggaagtaaagcatcccttcatcgtggatttaatttatgcctttcagactggtggaaaactctacctcatccttgagtatctcagtggaggagaactatttatgcagttagaaagagagggaatatttatggaagacactgcctgcttttacttggcagaaatctccatggctttggggcatttacatcaaaaggggatcatctacagagacctgaagccggagaatatcatgcttaatcaccaaggtcatgtgaaactaacagactttggactatgcaaagaatctattcatgatggaacagtcacacacacattttgtggaacaatagaatacatggcccctgaaatcttgatgagaagtggccacaatcgtgctgtggattggtggagtttgggagcattaatgtatgacatgctgactggagcacccccattcactggggagaatagaaagaaaacaattgacaaaatcctcaaatgtaaactcaatttgcctccctacctcacacaagaagccagagatctgcttaaaaagctgctgaaaagaaatgctgcttctcgtctgggagctggtcctggggacgctggagaagttcaagctcatccattctttagacacattaactgggaagaacttctggctcgaaaggtggagcccccctttaaacctctgttgcaatctgaagaggatgtaagtcagtttgattccaagtttacacgtcagacacctgtcgacagcccagatgactcaactctcagtgaaagtgccaatcaggtctttctgggttttacatatgtggctccatctgtacttgaaagtgtgaaagaaaagttttcctttgaaccaaaaatccgatcacctcgaagatttattggcagcccacgaacacctgtcagcccagtcaaattttctcctggggatttctggggaagaggtgcttcggccagcacagcaaatcctcagacacctgtggaatacccaatggaaacaagtggcatagagcagatggatgtgacaatgagtggggaagcatcggcaccacttccaatacgacagccgaactctgggccatacaaaaaacaagcttttcccatgatctccaaacggccagagcacctgcgtatgaatctatgacagagcaatgcttttaatgaatttaaggcaaaaaaggtggagagggagatgtgtgagcatcctgcaaggtgaaacgactcaaaatgacagtttcagagagtcaatgtcattacatagaacacttcagacacaggaaaaataaacgtggattttaaaaaatcaatcaatggtgcaaaaaaaaacttaaagcaaaatagtattgctgaactcttaggcacatcaattaattgattcctcgcgacatcttctcaaccttatcaaggattttcatgttgatgactcgaaactgacagtattaagggtaggatgttgcttctgaatcactgttgagttctgattgtgttgaagaagggttatcctttcattaggcaaagtacaaaattgcctataatacttgcaactaaggacaaattagcatgcaagcttggtcaaactttttccagcaaaatggaagcaaagacaaaagaaacttaccaattgatgttttacgtgcaaacaacctgaatcttttttttatataaatatatatttttcaaatagatttttgattcagctcattatgaaaaacatcccaaactttaaaatgcgaaattattggttggtgtgaagaaagccagacaacttctgtttcttctcttggtgaaataataaaatgcaaatgaatcattgttaaccacagctgtggctcgtttgagggattggggtggacctggggtttattttcagtaacccagctgcaatacctgtctgtaatatgagaaaaaaaaaatgaatctatttaatcatttctacttgcagtactgctatgtgctaagcttaactggaagccttggaatgggcataagttgtatgtcctacatttcatcattgtcccgggcctgcattgcactggaaaaaaaaatcgccacctgttcttacaccagtatttggttcaagacaccaaatgtcttcagcccatggctgaagaacaacagaagagagtcaggataaaaaatacatactgtggtcggcaaggtgagggagatagggatatccaggggaagagggtgttgctgtggcccactctctgtctaatctctttacagcaaattggtaagattttcagttttacttctttctactgtttctgctgtctaccttccttatatttttttcctcaacagttttaaaaagaaaaaaaggtctatttttttttctcctatacttgggctacattttttgattgtaaaaatatttgatggccttttgatgaatgtcttccacagtaaagaaaacttagtggcttaatttaggaaacatgttaacaggacactatgtttttgaaattgtaacaaaatctacataaatgatttacaggttaaaagaataaaaataaaggtaactttacctttcttaaatatttcctgccttaaagagagcatttccatgactttagctggtgaaagggtttaatatctgcagagctttataaaaatatatttcagtgcatactggtataatagatgatcatgcagttgcagttgagttgtatcaccttttttgtttgtcttttataatgtcttcagtctgagtgtgcaaagtcaatttgtaatattttgcaaccctaggatttttttaaatagatgctgcttgctatgttttcaaacctttttgagccataggatccaagccataaaattctttatgcatgttgaattcagtcagaaaagagcaaggctttgctttttgaaattgcaactcaaatgagatgggatgaaatcctatgacagtaagcaaaaacagaaccatgaaaaatgattggacatacaccttttcaattgtggcaataattgaaagaatcgataaaagttcatctttggacagaaagcctttaaaaaaaaaatcactccctcttccccctcctcccttattgcagcagcctactgagaactttgactgttgctggtaaattagaagctacaataataattaagggcagaaattatacttaaaaagtgcagatccttgttctttgacaatttgtgatgtctgaaaaaacagaacccgaaaagctatggtgatatgtacaggcattatttcagactgtaaatggcttgtgatactcttgatacttgttttcaaatatgtttactaactgtagtgttgactgcctgaccaaattccagtgaaacttatacaccaaaatattcttcctaggtcctatttgctagtaacatgagcactgtgattggctggctataaccaccccagttaaaccattttcataattagtagtgccagcaatagtggcaaacactgcaacttttctgcataaaaagcattaattgcacagctaccatccacacaaatacatagtttttctgacttcacatttattaagtgaaatttatttcccatgctgtggaaagtttattgagaacttgtttcataaatggatatccctactatgactgtgaaaacatgtcaagtgtcacattagtgtcacagacagaaagcacacacctatgcaatatggcttatctatatttatttgtaaaaatccaagcatagtttaaaatatgatgtcgatattactagtcttgagtttctaagagggttctttatgttataccaggtaagtgtataaaagagattaagtgcttttttttcatcacttgattattttctttaaaatcagctattacaggatatttttttattttatacatgctgttttttaattaaaatataatcactgaagtttactaatttgattttataaggtttgtagcattacagaataactaaactgggatttataaaccagctgtgattaacaatgtaaagtattaattattgaactttgaaccagatttttaggaaaattatgttctttttccccctttatggtcttaactaatttgaatccttcaagaaggatttttccatactattttttaagatagaagataatttgtgggcaggggtggaggatgcatgtatgatactccataaattcaacattctttactataggtaatgaatgattataaacaagatgcatcttagatagtattaatatactgagccttggattatatatttaatataggacctattttgaatattcagttaatcatatggttcctagcttacaagggctagatctaagattattcccatgagaaatgttgaatttatgaagaatagattttaaggctttgaaaatggttaatttctcaaaaacatcaatgtccaaacatctaccttttttcataggagtagacactagcaagctggacaaactatcacaaaagtatttgtcacacataacctgtggtctgttgctgattaatacagtactttttcttgtgtgattcttaacattatagcacaagtattatctcagtggattatccggaataacatctgaaagatgggttcatctatgtttgtgtttgctctttaaactattgtttctcctatcccaagttcgctttgcatctatcagtaaataaaattcttcagctgccttattaggagtgctatgagggtaacacctgttctgcttttcatcttgtatttagttgactgtattatttgatttcggattgaatgaatgtaaatagaaattaaatgcaaatttgaatgaacataaatagaagtgatttatttttttattatcttaaagataggaaggaattagtatacgtatcaggtgtataaatggtttaaatttattttaacatgtcagatgtgttcaagttgtcatataaataaactatgtatgtaaggaa

SEQ ID NO: 659 - DNA, 2046 bp, Homo sapiens
agggaagctgaggacatggcaggagtgtttgacatagacctggaccagccagaggacgcgggctctgaggatgagctggaggagggggaagcgctcagctgttagaagtgacagctgaaaacttctgtcgggagtagcactgccgctgctgttacagccaccaggagttttatttcgggagcaagggggctctgctgcatcttccaatcttccaggggtcagttaaatgaaagcatggaccatgggggagttggaccatatgaacttggcatggaacattgtgagaaatttgaaatctcagaaactagtgtgaacagagggccagaaaaaatcagaccagaatgttttgagctacttcgggtacttggtaaagggggctatggaaaggtttttcaagtacgaaaagtaacaggagcaaatactgggaaaatatttgccatgaaggtgcttaaaaaggcaatgatagtaagaaatgctaaagatacagctcatacaaaagcagaacggaatattctggaggaagtaaagcatcccttcatcgtggatttaatttatgcctttcagactggtggaaaactctacctcatccttgagtatctcagtggaggagaactatttatgcagttagaaagagagggaatatttatggaagacactgcctgcttttacttggcagaaatctccatggctttggggcatttacatcaaaaggggatcatctacagagacctgaagccggagaatatcatgcttaatcaccaaggtcatgtgaaactaacagactttggactatgcaaagaatctattcatgatggaacagtcacacacacattttgtggaacaatagaatacatggcccctgaaatcttgatgagaagtggccacaatcgtgctgtggattggtggagtttgggagcattaatgtatgacatgctgactggagcacccccattcactggggagaatagaaagaaaacaattgacaaaatcctcaaatgtaaactcaatttgcctccctacctcacacaagaagccagagatctgcttaaaaagctgctgaaaagaaatgctgcttctcgtctgggagctggtcctggggacgctggagaagttcaagctcatccattctttagacacattaactgggaagaacttctggctcgaaaggtggagcccccctttaaacctctgttgcaatctgaagaggatgtaagtcagtttgattccaagtttacacgtcagacacctgtcgacagcccagatgactcaactctcagtgaaagtgccaatcaggtctttctgggttttacatatgtggctccatctgtacttgaaagtgtgaaagaaaagttttcctttgaaccaaaaatccgatcacctcgaagatttattggcagcccacgaacacctgtcagcccagtcaaattttctcctggggatttctggggaagaggtgcttcggccagcacagcaaatcctcagacacctgtggaatacccaatggaaacaagtggcatagagcagatggatgtgacaatgagtggggaagcatcggcaccacttccaatacgacagccgaactctgggccatacaaaaaacaagcttttcccatgatctccaaacggccagagcacctgcgtatgaatctatgacagagcaatgcttttaatgaatttaaggcaaaaaaggtggagagggagatgtgtgagcatcctgcaaggtgaaacgactcaaaatgacagtttcagagagtcaatgtcattacatagaacacttcagacacaggaaaaataaacgtggattttaaaaaatcaatcaatggtgcaaaaaaaaacttaaagcaaaatagtattgctgaactcttaggcacatcaattaattgattcctcgcgacatcttctcaaccttatcaaggattttcatgttgatgactcgaaactgacagtattaagggtaggatgttgcttctgaatcactgttgagttctgattgtgttgaagaagggttatcctttcattaggcaaagtacaaaattgcctataata

SEQ ID NO: 660 - DNA, 1982 bp, Homo sapiens
tggcggcagcggctgtggtggctgcggcgggtccgggcccatgaggcgacgaaggaggcgggacggcttttacccagccccggacttccgagacagggaagctgaggacatggcaggagtgtttgacatagacctggaccagccagaggacgcgggctctgaggatgagctggaggaggggggtcagttaaatgaaagcatggaccatgggggagttggaccatatgaacttggcatggaacattgtgagaaatttgaaatctcagaaactagtgtgaacagagggccagaaaaaatcagaccagaatgttttgagctacttcgggtacttggtaaagggggctatggaaaggtttttcaagtacgaaaagtaacaggagcaaatactgggaaaatatttgccatgaaggtgcttaaaaaggcaatgatagtaagaaatgctaaagatacagctcatacaaaagcagaacggaatattctggaggaagtaaagcatcccttcatcgtggatttaatttatgcctttcagactggtggaaaactctacctcatccttgagtatctcagtggaggagaactatttatgcagttagaaagagagggaatatttatggaagacactgcctgcttttacttggcagaaatctccatggctttggggcatttacatcaaaaggggatcatctacagagacctgaagccggagaatatcatgcttaatcaccaaggtcatgtgaaactaacagactttggactatgcaaagaatctattcatgatggaacagtcacacacacattttgtggaacaatagaatacatggcccctgaaatcttgatgagaagtggccacaatcgtgctgtggattggtggagtttgggagcattaatgtatgacatgctgactggagcacccccattcactggggagaatagaaagaaaacaattgacaaaatcctcaaatgtaaactcaatttgcctccctacctcacacaagaagccagagatctgcttaaaaagctgctgaaaagaaatgctgcttctcgtctgggagctggtcctggggacgctggagaagttcaagctcatccattctttagacacattaactgggaagaacttctggctcgaaaggtggagcccccctttaaacctctgttgcaatctgaagaggatgtaagtcagtttgattccaagtttacacgtcagacacctgtcgacagcccagatgactcaactctcagtgaaagtgccaatcaggtctttctgggttttacatatgtggctccatctgtacttgaaagtgtgaaagaaaagttttcctttgaaccaaaaatccgatcacctcgaagatttattggcagcccacgaacacctgtcagtactgctatgtgctaagcttaactggaagccttggaatgggcataagttgtatgtcctacatttcatcattgtcccgggcctgcattgcactggaaaaaaaaatcgccacctgttcttacaccagtatttggttcaagacaccaaatgtcttcagcccatggctgaagaacaacagaagagagtcaggataaaaaatacatactgtggtcggcaaggtgagggagatagggatatccaggggaagagggtgttgctgtggcccactctctgtctaatctctttacagcaaattggtaagattttcagttttacttctttctactgtttctgctgtctaccttccttatatttttttcctcaacagttttaaaaagaaaaaaaggtctatttttttttctcctatacttgggctacattttttgattgtaaaaatatttgatggccttttgatgaatgtcttccacagtaaagaaaacttagtggcttaatttaggaaacatgttaacaggacactatgtttttgaaattgtaacaaaatctacataaatgatttacaggttaaaagaataaaaataaaggtaactttacctttcttaaatat

SEQ ID NO: 661 - DNA, 1913 bp, Homo sapiens
ctaagcagccggtgatggcggcagcggctgtggtggctgcggcgggtccgggcccatgaggcgacgaaggaggcgggacggcttttacccagccccggacttccgagacagggaagctgaggacatggcaggagtgtttgacatagacctggaccagccagaggacgcgggctctgaggatgagctggaggaggggggtcagttaaatgaaagcatggaccatgggggagttggaccatatgaacttggcatggaacattgtgagaaatttgaaatctcagaaactagtgtgaacagagggccagaaaaaatcagaccagaatgttttgagctacttcgggtacttggtaaagggggctatggaaaggcaatgatagtaagaaatgctaaagatacagctcatacaaaagcagaacggaatattctggaggaagtaaagcatcccttcatcgtggatttaatttatgcctttcagactggtggaaaactctacctcatccttgagtatctcagtggaggagaactatttatgcagttagaaagagagggaatatttatggaagacactgcctgcttttacttggcagaaatctccatggctttggggcatttacatcaaaaggggatcatctacagagacctgaagccggagaatatcatgcttaatcaccaaggtcatgtgaaactaacagactttggactatgcaaagaatctattcatgatggaacagtcacacacacattttgtggaacaatagaatacatggcccctgaaatcttgatgagaagtggccacaatcgtgctgtggattggtggagtttgggagcattaatgtatgacatgctgactggagcacccccattcactggggagaatagaaagaaaacaattgacaaaatcctcaaatgtaaactcaatttgcctccctacctcacacaagaagccagagatctgcttaaaaagctgctgaaaagaaatgctgcttctcgtctgggagctggtcctggggacgctggagaagttcaagctcatccattctttagacacattaactgggaagaacttctggctcgaaaggtggagcccccctttaaacctctgttgcaatctgaagaggatgtaagtcagtttgattccaagtttacacgtcagacacctgtcgacagcccagatgactcaactctcagtgaaagtgccaatcaggtctttctgggttttacatatgtggctccatctgtacttgaaagtgtgaaagaaaagttttcctttgaaccaaaaatccgatcacctcgaagatttattggcagcccacgaacacctgtcagcccagtcaaattttctcctggggatttctggggaagaggtgcttcggccagcacagcaaatcctcagacacctgtggaatacccaatggaaacaagtggcatagagcagatggatgtgacaatgagtggggaagcatcggcaccacttccaatacgacagccgaactctgggccatacaaaaaacaagcttttcccatgatctccaaacggccagagcacctgcgtatgaatctatgacagagcaatgcttttaatgaatttaaggcaaaaaaggtggagagggagatgtgtgagcatcctgcaaggtgaaacgactcaaaatgacagtttcagagagtcaatgtcattacatagaacacttcagacacaggaaaaataaacgtggattttaaaaaatcaatcaatggtgcaaaaaaaaacttaaagcaaaatagtattgctgaactcttaggcacatcaattaattgattcctcgcgacatcttctcaaccttatcaaggattttcatgttgatgactcgaaactgacagtattaagggtaggatgttgcttctgaatcactgttgagttctgattgtgttgaaga

SEQ ID NO: 662 - DNA, 1726 bp, Homo sapiens
gcgcggccaggtacgggccgacgggcccgcggggccggcgccgccatggcggccgtgtttgatttggatttggagacggaggaaggcagcgagggcgagggcgagccagagctcagccccgcggacgcatgtccccttgccgagttgagggcagctggcctagagcctgtgggacactatgaagaggtggagctgactgagaccagcgtgaacgttggcccagagcgcatcgggccccactgctttgagctgctgcgtgtgctgggcaaggggggctatggcaaggtgttccaggtgcgaaaggtgcaaggcaccaacttgggcaaaatatatgccatgaaagtcctaaggaaggccaaaattgtgcgcaatgccaaggacacagcacacacacgggctgagcggaacattctagagtcagtgaagcacccctttattgtggaactggcctatgccttccagactggtggcaaactctacctcatccttgagtgcctcagtggtggcgagctcttcacgcatctggagcgagagggcatcttcctggaagatacggcctgcttctacctggctgagatcacgctggccctgggccatctccactcccagggcatcatctaccgggacctcaagcccgagaacatcatgctcagcagccagggccacatcaaactgaccgactttggactctgcaaggagtctatccatgagggcgccgtcactcacaccttctgcggcaccattgagtacatggcccctgagattctggtgcgcagtggccacaaccgggctgtggactggtggagcctgggggccctgatgtacgacatgctcactggatcgccgcccttcaccgcagagaaccggaagaaaaccatggataagatcatcaggggcaagctggcactgcccccctacctcaccccagatgcccgggaccttgtcaaaaagtttctgaaacggaatcccagccagcggattgggggtggcccaggggatgctgctgatgtgcagagacatccctttttccggcacatgaattgggacgaccttctggcctggcgtgtggacccccctttcaggccctgtctgcagtcagaggaggacgtgagccagtttgatacccgcttcacacggcagacgccggtggacagtcctgatgacacagccctcagcgagagtgccaaccaggccttcctgggcttcacatacgtggcgccgtctgtcctggacagcatcaaggagggcttctccttccagcccaagctgcgctcacccaggcgcctcaacagtagcccccgggcccccgtcagccccctcaagttctccccttttgaggggtttcggcccagccccagcctgccggagcccacggagctacctctacctccactcctgccaccgccgccgccctcgaccaccgcccctctccccatccgtcccccctcagggaccaagaagtccaagaggggccgtgggcgtccagggcgctaggaagccgggtgggggtgagggtagcccttgagccctgtccctgcggctgtgagagcagcaggaccctgggccagttccagagacctgggggtgtgtctgggggtggggtgtgagtgcgtatgaaagtgtgtgtctgctggggcagctgtgcccctgaatcatgggcacggagggccgcccgccacgccccgcgctcaactgctcccgtggaagattaaagggctgaatcatg

SEQ ID NO: 663 - DNA, 1806 bp, Homo sapiens
cggccaggtacgggccgacgggcccgcggggccggcgccgccatggcggccgtgtttgatttggatttggagacggaggaaggcagcgagggcgagggcgagccagagctcagccccgcggacgcatgtccccttgccgagttgagggcagctggcctagagcctgtgggacactatgaagaggtggagctgactgagaccagcgtgaacgttggcccagagcgcatcgggccccactgctttgagctgctgcgtgtgctgggcaaggggggctatggcaaggtgttccaggtgcgaaaggtgcaaggcaccaacttgggcaaaatatatgccatgaaagtcctaaggaaggccaaaattgtgcgcaatgccaaggacacagcacacacacgggctgagcggaacattctagagtcagtgaagcacccctttattgtggaactggcctatgccttccagactggtggcaaactctacctcatccttgagtgcctcagtgtagactgagcgtcctgagggcagtggctgggtctcttcatcctgtccccagcttcacccagcacagggccaggcaccgagtaggcgtcggtagatgtttgctgaattgaattgaatccccacggcagctctgtgaggcaggtggcgagctcttcacgcatctggagcgagagggcatcttcctggaagatacggcctgcttctacctggctgagatcacgctggccctgggccatctccactcccagggcatcatctaccgggacctcaagcccgagaacatcatgctcagcagccagggccacatcaaactgaccgactttggactctgcaaggagtctatccatgagggcgccgtcactcacaccttctgcggcaccattgagtacatggcccctgagattctggtgcgcagtggccacaaccgggctgtggactggtggagcctgggggccctgatgtacgacatgctcactggatcgccgcccttcaccgcagagaaccggaagaaaaccatggataagatcatcaggggcaagctggcactgcccccctacctcaccccagatgcccgggaccttgtcaaaaagtttctgaaacggaatcccagccagcggattgggggtggcccaggggatgctgctgatgtgcagagacatccctttttccggcacatgaattgggacgaccttctggcctggcgtgtggacccccctttcaggccctgtctgcagtcagaggaggacgtgagccagtttgatacccgcttcacacggcagacgccggtggacagtcctgatgacacagccctcagcgagagtgccaaccaggccttcctgggcttcacatacgtggcgccgtctgtcctggacagcatcaaggagggcttctccttccagcccaagctgcgctcacccaggcgcctcaacagtagcccccgggcccccgtcagccccctcaagttctccccttttgaggggtttcggcccagccccagcctgccggagcccacggagctacctctacctccactcctgccaccgccgccgccctcgaccaccgcccctctccccatccgtcccccctcagggaccaagaagtccaagaggggccgtgggcgtccagggcgctaggaagccgggtgggggtgagggtagcccttgagccctgtccctgcggctgtgagagcagcaggaccctgggccagttccagagacctgggggtgtgtctgggggtggggtgtgagtgcgtatgaaagtgtgtgtctgctggggcagctgtgcccctgaatcatgggcacggagggc

SEQ ID NO: 664 - DNA, 918 bp, Homo sapiens
agtgcgcggccaggtacgggccgacgggcccgcggggccggcgccgccatggcggccgtgtttgatttggatttggagacggaggaaggcagcgagggcgagggcgagccagagctcagccccgcggacgcatgtccccttgccgagttgagggcagctggcctagagcctgtgggacactatgaagaggtggagctgactgagaccagcgtgaacgttggcccagagcgcatcgggccccactgctttgagctgctgcgtgtgctgggcaaggggggctatggcaaggtgttccaggtgcgaaaggtgcaaggcaccaacttgggcaaaatatatgccatgaaagtcctaaggaaggccaaaattgtgcgcaatgccaaggacacagcacacacacgggctgagcggaacattctagagtcagtgaagcacccctttattgtggaactggcctatgccttccagactggtggcaaactctacctcatccttgagtgcctcagtgtagactgagcgtcctgagggcagtggctgggtctcttcatcctgtccccagcttcacccagcacagggccaggcaccgagtaggcgtcggtagatgtttgctgaattgaattgaatccccacggcagctctgtgaggcaggtggcgagctcttcacgcatctggagcgagagggcatcttcctggaagatacggcctgcttctacctggctgagatcacgctggccctgggccatctccactcccagggcatcatctaccgggacctcaagcccgagaacatcatgctcagcagccagggccacatcaaactgaccgactttggactctgcaaggagtctatccatgagggcgccgtcactcacaccttctgcggcaccattgagtacatgtaagtggcacctggctggccca

SEQ ID NO: 665 - DNA, 2369 bp, Homo sapiens
ctgtactgccaccccgctactaggaccggggcgcaaggtcctgggggtggtgctcagaggtggattcctttgcccaggcacgcccctgggaccaggcctccaaaggagaagaatggacagacctcaggggaagaagctggacttcagccgtccaaggtcttcctggtgcggaaagtcacccggcctgacagtgggcacctgtatgctatgaaggtgctgaagaaggcaacgctgaaagtacgtgaccgcgtccggaccaagatggagagagacatcctggctgatgtaaatcacccattcgtggtgaagctgcactatgccttccagaccgagggcaagctctatctcattctggacttcctgcgtggtggggacctcttcacccggctctcaaaagaggtgatgttcacggaggaggatgtgaagttttacctggctgagctggctctgggcctggatcacctgcacagcctgggtatcatttacagagacctcaagcctgagaacatccttctggatgaggagggccacatcaaactcactgactttggcctgagcaaagaggccattgaccacgagaagaaggcctattctttctgcgggacagtggagtacatggcccctgaggtcgtcaaccgccagggccactcccatagtgcggactggtggtcctatggggtgttgatgtttgagatgctgacgggctccctgcccttccaggggaaggaccggaaggagaccatgacactgattctgaaggcgaagctaggcatgccccagtttctgagcactgaagcccagagcctcttgcgggccctgttcaagcggaatcctgccaaccggctcggctccggccctgatggggcagaggaaatcaagcggcatgtcttctactccaccattgactggaataagctataccgtcgtgagatcaagccacccttcaagccagcagtggctcagcctgatgacaccttctactttgacaccgagttcacgtcccgcacacccaaggattccccaggcatcccccccagcgctggggcccatcagctgttccggggcttcagcttcgtggccaccggcctgatggaagacgacggcaagcctcgtgccccgcaggcacccctgcactcggtggtacagcaactccatgggaagaacctggtttttagtgacggctacgtggtaaaggagacaattggtgtgggctcctactctgagtgcaagcgctgtgtccacaaggccaccaacatggagtatgctgtcaaggtcattgataagagcaagcgggatccttcagaagagattgagattcttctgcggtatggccagcaccccaacatcatcactctgaaagatgtgtatgatgatggcaaacacgtgtacctggtgacagagctgatgcggggtggggagctgctggacaagatcctgcggcagaagttcttctcagagcgggaggccagctttgtcctgcacaccattggcaaaactgtggagtatctgcactcacagggggttgtgcacagggacctgaagcccagcaacatcctgtatgtggacgagtccgggaatcccgagtgcctgcgcatctgtgactttggttttgccaaacagctgcgggctgagaatgggctcctcatgacaccttgctacacagccaactttgtggcgcctgaggtgctgaagcgccagggctacgatgaaggctgcgacatctggagcctgggcattctgctgtacaccatgctggcaggatatactccatttgccaacggtcccagtgacacaccagaggaaatcctaacccggatcggcagtgggaagtttaccctcagtgggggaaattggaacacagtttcagagacagccaaggacctggtgtccaagatgctacacgtggatccccaccagcgcctcacagctaagcaggttctgcagcatccatgggtcacccagaaagacaagcttccccaaagccagctgtcccaccaggacctacagcttgtgaagggagccatggctgccacgtactccgcactcaacagctccaagcccaccccccagctgaagcccatcgagtcatccatcctggcccagcggcgagtgaggaagttgccatccaccaccctgtgaggcaccagggcattcgggccacagggcggtgctagcttgacacagtcagcatgcttcccagagggagcaggccggaaccacagggccagagggagctggaacccgaggggccggggaagctgccagcccagaacacccctaatgagggtgtgagaagtgccttctccttccccaggatggactcttctcggctcaggctctgctggtggaaagcgattcactgtataaac

SEQ ID NO: 666 - DNA, 1963 bp, Homo sapiens
atgcagaccccagcagatttccccagggttgagagagacttggttccctgtcccagaaaggatgagggcgtcctcaaggagatctccatcacgcaccacgtcaaggctggctctgagaaggctgatccatcccatttcgagctcctcaaggttctgggccagggatcctttggcaaagtcttcctggtgcggaaagtcacccggcctgacagtgggcacctgtatgctatgaaggtgctgaagaaggcaacgctgaaagtacgtgaccgcgtccggaccaagatggagagagacatcctggctgatgtaaatcacccattcgtggtgaagctgcactatgccttccagaccgagggcaagctctatctcattctggacttcctgcgtggtggggacctcttcacccggctctcaaaagaggtgatgttcacggaggaggatgtgaagttttacctggctgagctggctctgggcctggatcacctgcacagcctgggtatcatttacagagacctcaagcctgagaacatccttctggatgaggagggccacatcaaactcactgactttggcctgagcaaagaggccattgaccacgagaagaaggcctattctttctgcgggacagtggagtacatggcccctgaggtcgtcaaccgccagggccactcccatagtgcggactggtggtcctatggggtgttgatgtttgagatgctgacgggctccctgcccttccaggggaaggaccggaaggagaccatgacactgattctgaaggcgaagctaggcatgccccagtttctgagcactgaagcccagagcctcttgcgggccctgttcaagcggaatcctgccaaccggctcggctccggccctgatggggcagaggaaatcaagcggcatgtcttctactccaccattgactggaataagctataccgtcgtgagatcaagccacccttcaagccagcagtggctcagcctgatgacaccttctactttgacaccgagttcacgtcccgcacacccaaggattccccaggcatcccccccagcgctggggcccatcagctgttccggggcttcagcttcgtggccaccggcctgatggaagacgacggcaagcctcgtgccccgcaggcacccctgcactcggtggtacaggtcattgataagagcaagcgggatccttcagaagagattgagattcttctgcggtatggccagcaccccaacatcatcactctgaaagatgtgtatgatgatggcaaacacgtgtacctggtgacagagctgatgcggggtggggagctgctggacaagatcctgcggcagaagttcttctcagagcgggaggccagctttgtcctgcacaccattggcaaaactgtggagtatctgcactcacagggggttgtgcacagggacctgaagcccagcaacatcctgtatgtggacgagtccgggaatcccgagtgcctgcgcatctgtgactttggttttgccaaacagctgcgggctgagaatgggctcctcatgacaccttgctacacagccaactttgtggcgcctgaggtgctgaagcgccagggctacgatgaaggctgcgacatctggagcctgggcattctgctgtacaccatgctggcagggtgagtgcccctggcctggacccttccccactcctgcagccctagcacttgggctgagtggtgcttgtctgataggaatggctcagccagccccgccccaggatggtctggaaatagggacatgctcctgcctccaggagctctaccttgggagtaccccatctgagggggagacacagtctcccaccgcagccccagccccagtatggaggccagagtctgtacccagaccgtgcgggcttttctgcagatatactccatttgccaacggtcccagtgacacaccagaggaaatcctaacccggatc

SEQ ID NO: 667 - DNA, 3186 bp, Homo sapiens
ctagtgccgcggcggcggcggcggacggcccagccggagcgcgaggggctcgggggggcgcggcggttcgggtcgcagagccagggaccccaggacccgggaggcggcgcagccggggccgccggaggagcgcgggtgacctggcggcggcgagatgccgctcgcccagctcaaggagccctggccgctcatggagctagtgcctctggacccggagaatggacagacctcaggggaagaagctggacttcagccgtccaaggatgagggcgtcctcaaggagatctccatcacgcaccacgtcaaggctggctctgagaaggctgatccatcccatttcgagctcctcaaggttctgggccagggatcctttggcaaagtcttcctggtgcggaaagtcacccggcctgacagtgggcacctgtatgctatgaaggtgctgaagaaggcaacgctgaaagtacgtgaccgcgtccggaccaagatggagagagacatcctggctgatgtaaatcacccattcgtggtgaagctgcactatgccttccagaccgagggcaagctctatctcattctggacttcctgcgtggtggggacctcttcacccggctctcaaaagaggtgatgttcacggaggaggatgtgaagttttacctggctgagctggctctgggcctggatcacctgcacagcctgggtatcatttacagagacctcaagcctgagaacatccttctggatgaggagggccacatcaaactcactgactttggcctgagcaaagaggccattgaccacgagaagaaggcctattctttctgcgggacagtggagtacatggcccctgaggtcgtcaaccgccagggccactcccatagtgcggactggtggtcctatggggtgttgatgtttgagatgctgacgggctccctgcccttccaggggaaggaccggaaggagaccatgacactgattctgaaggcgaagctaggcatgccccagtttctgagcactgaagcccagagcctcttgcgggccctgttcaagcggaatcctgccaaccggctcggctccggccctgatggggcagaggaaatcaagcggcatgtcttctactccaccattgactggaataagctataccgtcgtgagatcaagccacccttcaagccagcagtggctcagcctgatgacaccttctactttgacaccgagttcacgtcccgcacacccaaggattccccaggcatcccccccagcgctggggcccatcagctgttccggggcttcagcttcgtggccaccggcctgatggaagacgacggcaagcctcgtgccccgcaggcacccctgcactcggtggtacagcaactccatgggaagaacctggtttttagtgacggctacgtggtaaaggagacaattggtgtgggctcctactctgagtgcaagcgctgtgtccacaaggccaccaacatggagtatgctgtcaaggtcattgataagagcaagcgggatccttcagaagagattgagattcttctgcggtatggccagcaccccaacatcatcactctgaaagatgtgtatgatgatggcaaacacgtgtacctggtgacagagctgatgcggggtggggagctgctggacaagatcctgcggcagaagttcttctcagagcgggaggccagctttgtcctgcacaccattggcaaaactgtggagtatctgcactcacagggggttgtgcacagggacctgaagcccagcaacatcctgtatgtggacgagtccgggaatcccgagtgcctgcgcatctgtgactttggttttgccaaacagctgcgggctgagaatgggctcctcatgacaccttgctacacagccaactttgtggcgcctgaggtgctgaagcgccagggctacgatgaaggctgcgacatctggagcctgggcattctgctgtacaccatgctggcaggatatactccatttgccaacggtcccagtgacacaccagaggaaatcctaacccggatcggcagtgggaagtttaccctcagtgggggaaattggaacacagtttcagagacagccaaggacctggtgtccaagatgctacacgtggatccccaccagcgcctcacagctaagcaggttctgcagcatccatgggtcacccagaaagacaagcttccccaaagccagctgtcccaccaggacctacagcttgtgaagggagccatggctgccacgtactccgcactcaacagctccaagcccaccccccagctgaagcccatcgagtcatccatcctggcccagcggcgagtgaggaagttgccatccaccaccctgtgaggcaccagggcattcgggccacagggcggtgctagcttgacacagtcagcatgcttcccagagggagcaggccggaaccacagggccagagggagctggaacccgaggggccggggaagctgccagcccagaacacccctaatgagggtgtgagaagtgccttctccttccccaggatggactcttctcggctcaggctctgctggtggaaagcgattcactgtataaacttttttttatgaaaaaaatggcatcaaccaccatggatttttacaagatccatttgcctttctgggagcagaaacagccattgcggccccaggaggggaactgagtcacgctggggctctctgagactctttagagcagctttgggatcccaccctggggacccccacgattggccacctgtagccatctgcacacacctccgagacagtccagtgtcacctctctcagagcatctggctgtttagcagaactcattctatccccaatcagctccttttccgttctgttctgctgggagttctagaaccacttcctgctacaggaggggtctcatgtcctgctggcttccagcttcaggcaccagcatccaccttggctctgccagtggatcccctgcggtcaggctgggcagccccagagagaggatgtggaaagcactttttggctgacttcatctggggttggcaacaggacagagttcacaggaggccagtgggcgggccatgagggacagggtcttttttcatttcttcctcagctggttactcagggttcatctgtccatggcctttctaataaactgttgagttgaa

SEQ ID NO: 668 - DNA, 498 bp, Homo sapiens
gctcagcctgatgacaccttctactttgacaccgagttcacgtcccgcacacccaaggattccccaggcatcccccccagcgctggggcccatcagctgttccggggcttcagcttcgtggccaccggcctgatggaagacgacggcaagcctcgtgccccgcaggcacccctgcactcggtggtacaggtcattgataagagcaagcgggatccttcagaagagattgagattcttctgcggtatggccagcaccccaacatcatcactctgaaagatgtgtatgatgatggcaaacacgtgtacctggtgacagagctgatgcggggtggggagctgctggacaagatcctgcggcagaagttcttctcagagcgggaggccagctttgtcctgcacaccattggcaaaactgtggagtatctgcactcacagggggttgtgcacagggacctgaagcccagcaacatcctgtatgtggacgagtccgggaatccc

SEQ ID NO: 669 - DNA, 3023 bp, Homo sapiens
agaagtaggaagagtaacggggccctctggtcaccggcttgagccccaccatgcagaccccagcagatttccccagggttgagagagacttggttccctgtcccagaaaggatgagggcgtcctcaaggagatctccatcacgcaccacgtcaaggctggctctgagaaggctgatccatcccatttcgagctcctcaaggttctgggccagggatcctttggcaaagtcttcctggtgcggaaagtcacccggcctgacagtgggcacctgtatgctatgaaggtgctgaagaaggcaacgctgaaagtacgtgaccgcgtccggaccaagatggagagagacatcctggctgatgtaaatcacccattcgtggtgaagctgcactatgccttccagaccgagggcaagctctatctcattctggacttcctgcgtggtggggacctcttcacccggctctcaaaagaggtgatgttcacggaggaggatgtgaagttttacctggctgagctggctctgggcctggatcacctgcacagcctgggtatcatttacagagacctcaagcctgagaacatccttctggatgaggagggccacatcaaactcactgactttggcctgagcaaagaggccattgaccacgagaagaaggcctattctttctgcgggacagtggagtacatggcccctgaggtcgtcaaccgccagggccactcccatagtgcggactggtggtcctatggggtgttgatgtttgagatgctgacgggctccctgcccttccaggggaaggaccggaaggagaccatgacactgattctgaaggcgaagctaggcatgccccagtttctgagcactgaagcccagagcctcttgcgggccctgttcaagcggaatcctgccaaccggctcggctccggccctgatggggcagaggaaatcaagcggcatgtcttctactccaccattgactggaataagctataccgtcgtgagatcaagccacccttcaagccagcagtggctcagcctgatgacaccttctactttgacaccgagttcacgtcccgcacacccaaggattccccaggcatcccccccagcgctggggcccatcagctgttccggggcttcagcttcgtggccaccggcctgatggaagacgacggcaagcctcgtgccccgcaggcacccctgcactcggtggtacagcaactccatgggaagaacctggtttttagtgacggctacgtggtaaaggagacaattggtgtgggctcctactctgagtgcaagcgctgtgtccacaaggccaccaacatggagtatgctgtcaaggtcattgataagagcaagcgggatccttcagaagagattgagattcttctgcggtatggccagcaccccaacatcatcactctgaaagatgtgtatgatgatggcaaacacgtgtacctggtgacagagctgatgcggggtggggagctgctggacaagatcctgcggcagaagttcttctcagagcgggaggccagctttgtcctgcacaccattggcaaaactgtggagtatctgcactcacagggggttgtgcacagggacctgaagcccagcaacatcctgtatgtggacgagtccgggaatcccgagtgcctgcgcatctgtgactttggttttgccaaacagctgcgggctgagaatgggctcctcatgacaccttgctacacagccaactttgtggcgcctgaggtgctgaagcgccagggctacgatgaaggctgcgacatctggagcctgggcattctgctgtacaccatgctggcaggatatactccatttgccaacggtcccagtgacacaccagaggaaatcctaacccggatcggcagtgggaagtttaccctcagtgggggaaattggaacacagtttcagagacagccaaggacctggtgtccaagatgctacacgtggatccccaccagcgcctcacagctaagcaggttctgcagcatccatgggtcacccagaaagacaagcttccccaaagccagctgtcccaccaggacctacagcttgtgaagggagccatggctgccacgtactccgcactcaacagctccaagcccaccccccagctgaagcccatcgagtcatccatcctggcccagcggcgagtgaggaagttgccatccaccaccctgtgaggcaccagggcattcgggccacagggcggtgctagcttgacacagtcagcatgcttcccagagggagcaggccggaaccacagggccagagggagctggaacccgaggggccggggaagctgccagcccagaacacccctaatgagggtgtgagaagtgccttctccttccccaggatggactcttctcggctcaggctctgctggtggaaagcgattcactgtataaacttttttttatgaaaaaaatggcatcaaccaccatggatttttacaagatccatttgcctttctgggagcagaaacagccattgcggccccaggaggggaactgagtcacgctggggctctctgagactctttagagcagctttgggatcccaccctggggacccccacgattggccacctgtagccatctgcacacacctccgagacagtccagtgtcacctctctcagagcatctggctgtttagcagaactcattctatccccaatcagctccttttccgttctgttctgctgggagttctagaaccacttcctgctacaggaggggtctcatgtcctgctggcttccagcttcaggcaccagcatccaccttggctctgccagtggatcccctgcggtcaggctgggcagccccagagagaggatgtggaaagcactttttggctgacttcatctggggttggcaacaggacagagttcacaggaggccagtgggcgggccatgagggacagggtcttttttcatttcttcctcagctggttactcagggttcatctgtccatggcctttctaataaact

SEQ ID NO: 670 - DNA, 2359 bp, Homo sapiens
ccccggactctgcctgctcctgccatggtgccgtggccctgctgggcggatggagcaggatcccaagccgccccgtctgcggctctgggccctgatcccctggcttcccaggaagcagcggcccaggatcagccagacctctctgcctgtccctggccctggctctggcccccagcgggactcggatgagggcgtcctcaaggagatctccatcacgcaccacgtcaaggctggctctgagaaggctgatccatcccatttcgagctcctcaaggttctgggccagggatcctttggcaaagtcttcctggtgcggaaagtcacccggcctgacagtgggcacctgtatgctatgaaggtgctgaagaaggcaacgctgaaagtacgtgaccgcgtccggaccaagatggagagagacatcctggctgatgtaaatcacccattcgtggtgaagctgcactatgccttccagaccgagggcaagctctatctcattctggacttcctgcgtggtggggacctcttcacccggctctcaaaagaggtgatgttcacggaggaggatgtgaagttttacctggctgagctggctctgggcctggatcacctgcacagcctgggtatcatttacagagacctcaagcctgagaacatccttctggatgaggagggccacatcaaactcactgactttggcctgagcaaagaggccattgaccacgagaagaaggcctattctttctgcgggacagtggagtacatggcccctgaggtcgtcaaccgccagggccactcccatagtgcggactggtggtcctatggggtgttgatgtttgagatgctgacgggctccctgcccttccaggggaaggaccggaaggagaccatgacactgattctgaaggcgaagctaggcatgccccagtttctgagcactgaagcccagagcctcttgcgggccctgttcaagcggaatcctgccaaccggctcggctccggccctgatggggcagaggaaatcaagcggcatgtcttctactccaccattgactggaataagctataccgtcgtgagatcaagccacccttcaagccagcagtggctcagcctgatgacaccttctactttgacaccgagttcacgtcccgcacacccaaggattccccaggcatcccccccagcgctggggcccatcagctgttccggggcttcagcttcgtggccaccggcctgatggaagacgacggcaagcctcgtgccccgcaggcacccctgcactcggtggtacagcaactccatgggaagaacctggtttttagtgacggctacgtggtaaaggagacaattggtgtgggctcctactctgagtgcaagcgctgtgtccacaaggccaccaacatggagtatgctgtcaaggtcattgataagagcaagcgggatccttcagaagagattgagattcttctgcggtatggccagcaccccaacatcatcactctgaaagatgtgtatgatgatggcaaacacgtgtacctggtgacagagctgatgcggggtggggagctgctggacaagatcctgcggcagaagttcttctcagagcgggaggccagctttgtcctgcacaccattggcaaaactgtggagtatctgcactcacagggggttgtgcacagggacctgaagcccagcaacatcctgtatgtggacgagtccgggaatcccgagtgcctgcgcatctgtgactttggttttgccaaacagctgcgggctgagaatgggctcctcatgacaccttgctacacagccaactttgtggcgcctgaggtgctgaagcgccagggctacgatgaaggctgcgacatctggagcctgggcattctgctgtacaccatgctggcaggatatactccatttgccaacggtcccagtgacacaccagaggaaatcctaacccggatcggcagtgggaagtttaccctcagtgggggaaattggaacacagtttcagagacagccaaggacctggtgtccaagatgctacacgtggatccccaccagcgcctcacagctaagcaggttctgcagcatccatgggtcacccagaaagacaagcttccccaaagccagctgtcccaccaggacctacagcttgtgaagggagccatggctgccacgtactccgcactcaacagctccaagcccaccccccagctgaagcccatcgagtcatccatcctggcccagcggcgagtgaggaagttgccatccaccaccctgtgaggcaccagggcattcgggccacagggcggtgctagcttgacacagtcagcatgcttcccagagggagcaggccgg

SEQ ID NO: 671 - DNA, 6139 bp, Homo sapiens
gtcttcctcccccagggttgtggccacgcgcagcggcggcggttgttccgcttcccctccggcccgggccgtcgccattgccgaaggctccctcccctcccctccctggcgtgcgcaggactccgccgccgctgggcctagcggtagcagcggctgctccagcgcggcgtctcttcccgccccgcttccccttccctcccctcccctccccgcaccgcgcgctagcccggggcggctccgcagcccgccgggagctctgaccgaggcgcctcgctggggcggggaccttgccttgcccggggccatttcataattctgaatcatgtctgataacggagaactggaagataagcctccagcacctcctgtgcgaatgagcagcaccatctttagcactggaggcaaagaccctttgtcagccaatcacagtttgaaacctttgccctctgttccagaagagaaaaagcccaggcataaaatcatctccatattctcaggcacagagaaaggaagtaaaaagaaagaaaaggaacggccagaaatttctcctccatctgattttgagcacaccatccatgttggctttgatgctgttactggagaattcactggcatgccagaacagtgggctcgattactacagacctccaatatcaccaaactagagcaaaagaagaatcctcaggctgtgctggatgtcctaaagttctacgactccaacacagtgaagcagaaatatctgagctttactcctcctgagaaagatggctttccttctggaacaccagcactgaatgccaagggaacagaagcacccgcagtagtgacagaggaggaggatgatgatgaagagactgctcctcccgttattgccccgcgaccggatcatacgaaatcaatttacacacggtctgtaattgaccctgttcctgcaccagttggtgattcacatgttgatggtgctgccaagtctttagacaaacagaaaaagaagactaagatgacagatgaagagattatggagaaattaagaactatcgtgagcataggtgaccctaagaaaaaatatacaagatatgaaaaaattggacaaggggcttctggtacagttttcactgctactgacgttgcactgggacaggaggttgctatcaaacaaattaatttacagaaacagccaaagaaggaactgatcattaacgagattctggtgatgaaagaattgaaaaatcccaacatcgttaactttttggacagttacctggtaggagatgaattgtttgtggtcatggaataccttgctggggggtcactcactgatgtggtaacagaaacgtgcatggatgaagcacagattgctgctgtatgcagagagtgtttacaggcattggagtttttacatgctaatcaagtgatccacagagacatcaaaagtgacaatgtacttttgggaatggaaggatctgttaagctcactgactttggtttctgtgcccagatcacccctgagcagagcaaacgcagtaccatggtcggaacgccatactggatggcaccagaggtggttacacggaaagcttatggccctaaagtcgacatatggtctctgggtatcatggctattgagatggtagaaggagagcctccatacctcaatgaaaatcccttgagggccttgtacctaatagcaactaatggaaccccagaacttcagaatccagagaaactttccccaatatttcgggatttcttaaatcgatgtttggaaatggatgtggaaaaaaggggttcagccaaagaattattacagcatcctttcctgaaactggccaaaccgttatctagcttgacaccactgatcatggcagctaaagaagcaatgaagagtaaccgttaacatcactgctgtggcctcatactcttttttccattttctacaagaagccttttagtatatgaaaattattactctttttggggtttaaagaaatggtctgcataacctgaatgaaagaagcaaatgactattctctgaagacaaccaagagaaaattgcaaaaagacaagtatgacttttatatgaaccccttctttagggtccagaaggaattgtggactgaatcactagccttaggtctttcagcaaacagcctatcagggccatttatcatgtgtgagatttgcattttactttgctgactttgttgtaatagatcccattcattgtcccctttggggtatttccaatacttgaatggcagattggagtttttcagagtatgtgtttcatctgctagtctttctctccttcatagcttttcttttcctggacttgctccttttgagttgcttttgcgtttctcatgcctaggcaagtgtaatagaaattatgtagctccttatgttggcaaaggagctctatatagtttcactttgtataaaagttaggaccagctgttgttacatgtaatattttagttcagaacttgacctgaaggaagggaagaaaagtatgtgatttttaccttttttaacaaatgtgaaaaagtcagttttagaaatttcgtggtagtaagttcggcatttgttacatgtatagagagaagactaataatctctatttataactaaatcattgagatagaaaaagattcccattgactgtagacttcttcccattttgtcttcccttctgcctgtttccccttcaggcttggctctaggaaccaaagtgatttgttgttgttccaacctgggctttgtgactttggttagtgccactaccttcttccctcctttcccccttcaatttggaaataaatttctgtatatgttgcaattttaggtttaggtttgttctttttctttttcattaatcctctctcacctcacagataccccctcccatggcaaataatataataaccagtgaattttcaggaatttaaaaattagcttttttccacttaaaggagaaaaatatttgggactagcagcagaggcagtaagagatgtgaaccttggtgagctctgatacagtgagaagagattatactcatgaaagagaatgttagtgttacagagaagcagccgatagcaaatcgactgtagagacttggcggcggtggcattgccccaggtcgtcagcagtgtggtattatctatgagaacttgagcgacagagtatttcttgatgaatttatagatcatttgagatgttgagttactttagtttagttttgttttgttttttcaaataagtagagactattgtaaaaaacgagaaaggaaaatgaaatgtgcgtgttgatagcaataatttgtttcttttaaagattctaaaaggtctgagacctgtagcattaattatttgagtgccctcccttctcccctcccctcccttttctcttctcttttttcctctcctcttcttctcctttattcattgttttgcttttggagtgggtgttgttcaagtatctgtggtttggttctggcattttgttcccaccatccccttcccccattaacttcccccctgcttgccatcctgcagtagtataaatcatgaataaaaaataattttgctgttgtagtatacattggagaaactggcaggttttatttccattattttatttccactatatctatgataagatgcaattataaggagagaagtgactgttttttattgataaggcaagattttcagaaaaatgagtaaaataattaatgaaacatatttagagcacttaatggtctctgttttcaatataattcttgatttcatttttctctggaatatattggccttctacagctattactgaattatagaaactggtttatttctggcagaaagctgcagtgccacctgagttccaaattttaccattctttgtaaacagttggatggattatgataaagaagatgctaccaatgaaatagaaaaccaacgagatgagaagactgtgatcctcatgtactcagaggcacttccctcctaagtcaaagaccatcctcactgactatgtgccaacgcctcgtttcaggcttgtgactcaacaaagggcttttccattgatagaagcagtttgggatttgtagttgcgacttcttcgatagttacctgcacgtccattgctggcaactgacttgtcattaaaacctggctctttggttaagggagctacgctgtggtttattcttaagttacgtggataaactaacctctaacagaaatatactttggttaattttgaaatgtgtcatttttaaacaatcttaaaagtaatacagaattgtgatttattaattttaaaacattcagaacttgttgaaagaaaaattatatctgaatcaagattcatgttttttatttttattttttttgatacagagtctcactctgtcactcaggctggagtgcagtgacatgatctcagctcactgcaacctccgcttcctgggttcaagcaattctcatgcctcagcctcctgagtagctgagaccacaggcacccgccaccacacccagctatttttttgtatttttagtagagacagagtctcaccacattgcccaggctggtctccaactcctgagctcaggcagtctgcccaccttggcctcccaaagtgctgcagttacaggcgtgagccactgcacctggcctcatgttttttaaataattgccttttatatttaccctttttgtcatcactttagaatgaaaattcccatttaaatctgaaagttaccttaatagtcctcttgtgttattaggacagtattattatagtacttatttattttattttagatttaaagttatcttctctttttcttttttcttctgctgcttttagggacaattaaaactgggaaactatgaaacatggaacattttatcctacctgaaagtaaacgagtaattgtgaagcataagacactgaggctaatacaactctgtcttcatgtgttgactgcctggcacatagtattcattctcttccctttaacatagaagtgtccagctgcgtacagtctagtaaccagcaactgtaaacgaacctgtgcctctaacaagcgattctaaaccacctatgagtatttcttttagggctcacttaaatacatgtttgtatatactgtattctagccagaataattttagatctgatcaggtagtagctaaaattagaaaaaaacaaaatagatgcttaaagaatttgcatccatttttgagtctaaatcttttaaaatatactgagatccacatctagtgaaatgtcagtgtcaaaatattatagattatagctaaaatccagattaatactcatttggggttttttatagtggaacttcatagtaatacaaaaagcagattgtcttcctgtctccgctgctcccacagtaggtattgaaactggtaaaatcagttttttgatagtgtgtgtatataagaaaaaatagatacacacattcttttttctcagtcaacacattgattgaacactctggcaaagatgctgtggtggatgaggttggagttcgaaagaagaagcaagcgctggcctggccttgaaagaaccgaagtctttcccattcacttctctagaaagctgccaagacagaggcagaaagaaatggatgatagttctgtcaagcacacttctgttctcttagaacttagaagtgtttctaagagaacagaagtaataagagaaacagttacgtgtggaattcaacatctttggttggaacgcattggctttttttttcttgttttgatagaaatggaattaagcaaaagtagtttttgtcttttctgttgtcttcaaattttatgccttttatttttaatttaatcccgttcaattatttaattgttatacattgacattaactgctgtattttgactttgttcaataattttgttctttcagggctagaaataaactttttaaaaaaagtgtgcatttttccctttcctaaacttttattctttcttttgatcagcgtaaaagaatattttaatgtcttttgatagcataaaagaatatttaaatgtcttaataggttttcaaagaacatttagtatttttagtgataaatgttttaaaccttttaa

SEQ ID NO: 672 - DNA, 570 bp, Homo sapiens
gtttctaggtcgtggcgtcgggcttccggagctttggcggcagctaggggaggatggcggagtcttcggataagctctatcgagtcgagtacgccaagagcgggcgcgcctcttgcaagaaatgcagcgagagcatccccaaggactcgctccggatggccatcatggtgcagtcgcccatgtttgatggaaaagtcccacactggtaccacttctcctgcttctggaaggtgggccactccatccggcaccctgacgttgaggtggatgggttctctgagcttcggtgggatgaccagcagaaagtcaagaagacagcggaagctggaggagtgacaggtgtgtacatactggggcagcatgggcattcagcccccaccctgaagctcccaggagggcctcgtctcagagagcaaagcaaacctcccccagcttgccctctcccacatgtgcagatcaagcgtatggtgcccatgttatttcagcaacacctcctggactcagcatcatctgttgcatgatatttggtattttgtttttccaggtgcttggaatgtagcctttaaagtt

SEQ ID NO: 673 - DNA, 477 bp, Homo sapiens
gaacggcggtggccggtgcggcgtgttcggtggcggctctggccgctcaggcgcctgcggctgggtgagcgcacgcgaggcggcgaggcggcagcgtgtttctaggtcgtggcgtcgggcttccggagctttggcggcagctaggggaggatggcggagtcttcggataagctctatcgagtcgagtacgccaagagcgggcgcgcctcttgcaagaaatgcagcgagagcatccccaaggactcgctccggatggccatcatggtgcagtcgcccatgtttgatggaaaagtcccacactggtaccacttctcctgcttctggaaggtgggccactccatccggcaccctgacgttgaggtggatgggttctctgagcttcggtgggatgaccagcagaaagtcaagaagacagcggaagctggaggagtgacagaacctccaataccatgtggaatagaagtgatgggaagatag

SEQ ID NO: 674 - DNA, 553 bp, Homo sapiens
ggcggtggccggtgcggcgtgttcggtggcggctctggccgctcaggcgcctgcggctgggtgagcgcacgcgaggcggcgaggcggcagcgtgtttctaggtcgtggcgtcgggcttccggagctttggcggcagctaggggaggatggcggagtcttcggataagctctatcgagtcgagtacgccaagagcgggcgcgcctcttgcaagaaatgcagcgagagcatccccaaggactcgctccggatggccatcatggtgcagtcgcccatgtttgatggaaaagtcccacactggtaccacttctcctgcttctggaaggtgggccactccatccggcaccctgacgttgaggtggatgggttctctgagcttcggtgggatgaccagcagaaagtcaagaagacagcggaagctggaggagtgacagaacctccaataccatgtggaatagaagtgatgggaagatagcttcgtcttattcctaatcttaggcaaaggccaggatggaattggtagcaaggcagagaagactctgggtgactttgcag

SEQ ID NO: 675 - DNA, 3958 bp, Homo sapiens
cggtggccggtgcggcgtgttcggtggcggctctggccgctcaggcgcctgcggctgggtgagcgcacgcgaggcggcgaggcggcagcgtgtttctaggtcgtggcgtcgggcttccggagctttggcggcagctaggggaggatggcggagtcttcggataagctctatcgagtcgagtacgccaagagcgggcgcgcctcttgcaagaaatgcagcgagagcatccccaaggactcgctccggatggccatcatggtgcagtcgcccatgtttgatggaaaagtcccacactggtaccacttctcctgcttctggaaggtgggccactccatccggcaccctgacgttgaggtggatgggttctctgagcttcggtgggatgaccagcagaaagtcaagaagacagcggaagctggaggagtgacaggcaaaggccaggatggaattggtagcaaggcagagaagactctgggtgactttgcagcagagtatgccaagtccaacagaagtacgtgcaaggggtgtatggagaagatagaaaagggccaggtgcgcctgtccaagaagatggtggacccggagaagccacagctaggcatgattgaccgctggtaccatccaggctgctttgtcaagaacagggaggagctgggtttccggcccgagtacagtgcgagtcagctcaagggcttcagcctccttgctacagaggataaagaagccctgaagaagcagctcccaggagtcaagagtgaaggaaagagaaaaggcgatgaggtggatggagtggatgaagtggcgaagaagaaatctaaaaaagaaaaagacaaggatagtaagcttgaaaaagccctaaaggctcagaacgacctgatctggaacatcaaggacgagctaaagaaagtgtgttcaactaatgacctgaaggagctactcatcttcaacaagcagcaagtgccttctggggagtcggcgatcttggaccgagtagctgatggcatggtgttcggtgccctccttccctgcgaggaatgctcgggtcagctggtcttcaagagcgatgcctattactgcactggggacgtcactgcctggaccaagtgtatggtcaagacacagacacccaaccggaaggagtgggtaaccccaaaggaattccgagaaatctcttacctcaagaaattgaaggttaaaaaacaggaccgtatattccccccagaaaccagcgcctccgtggcggccacgcctccgccctccacagcctcggctcctgctgctgtgaactcctctgcttcagcagataagccattatccaacatgaagatcctgactctcgggaagctgtcccggaacaaggatgaagtgaaggccatgattgagaaactcggggggaagttgacggggacggccaacaaggcttccctgtgcatcagcaccaaaaaggaggtggaaaagatgaataagaagatggaggaagtaaaggaagccaacatccgagttgtgtctgaggacttcctccaggacgtctccgcctccaccaagagccttcaggagttgttcttagcgcacatcttgtccccttggggggcagaggtgaaggcagagcctgttgaagttgtggccccaagagggaagtcaggggctgcgctctccaaaaaaagcaagggccaggtcaaggaggaaggtatcaacaaatctgaaaagagaatgaaattaactcttaaaggaggagcagctgtggatcctgattctggactggaacactctgcgcatgtcctggagaaaggtgggaaggtcttcagtgccacccttggcctggtggacatcgttaaaggaaccaactcctactacaagctgcagcttctggaggacgacaaggaaaacaggtattggatattcaggtcctggggccgtgtgggtacggtgatcggtagcaacaaactggaacagatgccgtccaaggaggatgccattgagcacttcatgaaattatatgaagaaaaaaccgggaacgcttggcactccaaaaatttcacgaagtatcccaaaaagttctaccccctggagattgactatggccaggatgaagaggcagtgaagaagctgacagtaaatcctggcaccaagtccaagctccccaagccagttcaggacctcatcaagatgatctttgatgtggaaagtatgaagaaagccatggtggagtatgagatcgaccttcagaagatgcccttggggaagctgagcaaaaggcagatccaggccgcatactccatcctcagtgaggtccagcaggcggtgtctcagggcagcagcgactctcagatcctggatctctcaaatcgcttttacaccctgatcccccacgactttgggatgaagaagcctccgctcctgaacaatgcagacagtgtgcaggccaaggtggaaatgcttgacaacctgctggacatcgaggtggcctacagtctgctcaggggagggtctgatgatagcagcaaggatcccatcgatgtcaactatgagaagctcaaaactgacattaaggtggttgacagagattctgaagaagccgagatcatcaggaagtatgttaagaacactcatgcaaccacacacaatgcgtatgacttggaagtcatcgatatctttaagatagagcgtgaaggcgaatgccagcgttacaagccctttaagcagcttcataaccgaagattgctgtggcacgggtccaggaccaccaactttgctgggatcctgtcccagggtcttcggatagccccgcctgaagcgcccgtgacaggctacatgtttggtaaagggatctatttcgctgacatggtctccaagagtgccaactactgccatacgtctcagggagacccaataggcttaatcctgttgggagaagttgcccttggaaacatgtatgaactgaagcacgcttcacatatcagcaagttacccaagggcaagcacagtgtcaaaggtttgggcaaaactacccctgatccttcagctaacattagtctggatggtgtagacgttcctcttgggaccgggatttcatctggtgtgaatgacacctctctactatataacgagtacattgtctatgatattgctcaggtaaatctgaagtatctgctgaaactgaaattcaattttaagacctccctgtggtaattgggagaggtagccgagtcacacccggtggctctggtatgaattcacccgaagcgcttctgcaccaactcacctggccgctaagttgctgatgggtagtacctgtactaaaccacctcagaaaggattttacagaaacgtgttaaaggttttctctaacttctcaagtcccttgttttgtgttgtgtctgtggggaggggttgttttggggttgtttttgttttttcttgccaggtagataaaactgacatagagaaaaggctggagagagattctgttgcatagactagtcctatggaaaaaaccaagcttcgttagaatgtctgccttactggtttccccagggaaggaaaaatacacttccacccttttttctaagtgttcgtctttagttttgattttggaaagatgttaagcatttatttttagttaaaaataaaaactaatttcatactatttagattttcttttttatcttgcacttattgtcccctttttagttttttttgtttgcctcttgtggtgaggggtgtgggaagaccaaaggaaggaacgctaacaatttctcatacttagaaacaaaaagagctttccttctccaggaatactgaacatgggagctcttgaaatatgtagtattaaaagttgcatttgaaattcttgactttcttatgggcacttttgtcttccaaattaaaactctaccacaaatatacttacccaagggctaatagtaatactcgattaaaaatgcagatgccttctcta

SEQ ID NO: 676 - DNA, 750 bp, Homo sapiens
atggcggagtcttcggataagctctatcgagtcgagtacgccaagagcgggcgcgcctcttgcaagaaatgcagcgagagcatccccaaggactcgctccggatggccatcatggtgcagtcgcccatgtttgatggaaaagtcccacactggtaccacttctcctgcttctggaaggtgggccactccatccggcaccctgacgttgaggtggatgggttctctgagcttcggtgggatgaccagcagaaagtcaagaagacagcggaagctggaggagtgacaggcaaaggccaggatggaattggtagcaaggcagagaagactctgggtgactttgcagcagagtatgccaagtccaacagaagtacgtgcaaggggtgtatggagaagatagaaaagggccaggtgcgcctgtccaagaagatggtggacccggagaagccacagctaggcatgattgaccgctggtaccatccaggctgctttgtcaagaacagggaggagctgggtttccggcccgagtacagtgcgagtcagctcaagggcttcagcctccttgctacagaggataaagaagccctgaagaagcagctcccaggagtcaagagtgaaggaaagagaaaaggcgatgaggtggatggagtggatgaagtggcgaagaagaaatctaaaaaagaaaaagacaagaaaaaaaaaaaaaaaaaaaaaaaggaaagaaaaaaaaagaagaaaaaaagaaaaaaaaag

SEQ ID NO: 677 - DNA, 7241 bp, Homo sapiens
gcggcgccgggggcggggggcggcgggcgacggggcgggcgcaggatgagggcggccattgctggggctccgcttcggggaggaggacgctgaggaggcgccgagccgcgcagcgctgcgggggaggcgcccgcgccgacgcggggcccatggccaggaccaccagccagctgtatgacgccgtgcccatccagtccagcgtggtgttatgttcctgcccatccccatcaatggtgaggacccagactgagtccagcacgccccctggcattcctggtggcagcaggcagggccccgccatggacggcactgcagccgagcctcggcccggcgccggctccctgcagcatgcccagcctccgccgcagcctcggaagaagcggcctgaggacttcaagtttgggaaaatccttggggaaggctctttttccacggttgtcctggctcgagaactggcaacctccagagaatatgcgattaaaattctggagaagcgacatatcataaaagagaacaaggtcccctatgtaaccagagagcgggatgtcatgtcgcgcctggatcaccccttctttgttaagctttacttcacatttcaggacgacgagaagctgtatttcggccttagttatgccaaaaatggagaactacttaaatatattcgcaaaatcggttcattcgatgagacctgtacccgattttacacggctgagattgtgtctgctttagagtacttgcacggcaagggcatcattcacagggaccttaaaccggaaaacattttgttaaatgaagatatgcacatccagatcacagattttggaacagcaaaagtcttatccccagagagcaaacaagccagggccaactcattcgtgggaacagcgcagtacgtttctccagagctgctcacggagaagtccgcctgtaagagttcagacctttgggctcttggatgcataatataccagcttgtggcaggactcccaccattccgagctggaaacgagtatcttatatttcagaagatcattaagttggaatatgactttccagaaaaattcttccctaaggcaagagacctcgtggagaaacttttggttttagatgccacaaagcggttaggctgtgaggaaatggaaggatacggacctcttaaagcacacccgttcttcgagtccgtcacgtgggagaacctgcaccagcagacgcctccgaagctcaccgcttacctgccggctatgtcggaagacgacgaggactgctatggcaattatgacaatctcctgagccagtttggctgcatgcaggtgtcttcgtcctcctcctcacactccctgtcagcctccgacacgggcctgccccagaggtcaggcagcaacatagagcagtacattcacgatctggactcgaactcctttgaactggacttacagttttccgaagatgagaagaggttgttgttggagaagcaggctggcggaaacccttggcaccagtttgtagaaaataatttaatactaaagatgggcccagtggataagcggaagggtttatttgcaagacgacgacagctgttgctcacagaaggaccacatttatattatgtggatcctgtcaacaaagttctgaaaggtgaaattccttggtcacaagaacttcgaccagaggccaagaattttaaaactttctttgtccacacgcctaacaggacgtattatctgatggaccccagcgggaacgcacacaagtggtgcaggaagatccaggaggtttggaggcagcgataccagagccacccggacgccgctgtgcagtgacgtggcctgcggccgggctgcccttcgctgccaggacacctgccccagcgcggcttggccgccatccgggacgcttccagaccacctgccagccatcacaaggggaacgcagaggcggaaaccttgcagcatttttatttaaaagaaaagaagaaaaaaaacacccaaccacacaaagaacaaaaccagtaacaaacacaaaggaattcagggtcgctttgcttgctctctgtgctccgtggaggcctccgtgtgccctcgttgccgtggggacccagctccatgcacgtcaacccagtcccgcccagactagtggacagacctggtgtcaccagtttttcctagcatcagtccgaaccatgcgcccgccctgccccaactgtgtgctggtcctgctgtggccgaggggaccgggtgtgtttggctctttatgcccctcccgctgtggtcctggaactcttcaccagggagggagccctgcgggggccgcagctttgtggagggagccgccgtgcttctgtcacctgctccctttcttgcgtctccctgtgatgggcccttaggcctggctgggcccattacatatccctgtggtggctctggtggcagctttctgtggcccctgctgtgttggcaggcaggtttgcgtggtgaggagcgggaggggttggagtggtgcgggagcaggctgccgagtggagggtgccatcgagggctccggatcccttatcctacttagcagtgttggtctctggggctggaagccgagcgcatgctgggagcggtactgtcagaagtgagcccagttagtaccccgctggctcactgcacgagagagtcctgccccgagccctaggtggggccaggaggtgccttggagaagccagccagagcagagagggctgctgacttccgtgtggagcagagaggcctgagggcctcctaaaaggtttaaatgtccacgcctctccagttgctgaagtagggtctgagagaaccctggcatcagcagacccagggtgcttctgtctcctgcagaccacgccagggagtgcagacaccaccgtcacacacgccccttttgtgttttggttcaagtttctcagagcccctcagagcttctacatctgtgcatcagaaatctcacagccttctcatgctgccggctcatctgggcccatagagtgggctttgccagttgctgttgcacaggaggcgagaacagcacacttcaaccccagcttgctggtcggctttcctctagagagagccggttttggggccatttccctttgatgctttggtggccttgccccgctctgcagcacagacaggccagatgcatttgtcctttgcctagctactccccaggtagagagtgctcctggtggcctggcaggtctgggcccttctctccctgcccaggttgtccctggagggcagccctcactccctttgggggagaggcagacattgctgcccacagacctgcctctgactcaactgtgtccaccctccctggtccctacccccaagtcacaggtgactcagcagtgaccctgtgtgccaggccagatccaaactgagagggaaggtgtcgtttttacactgctaatgacgagagtggctctttttagctaggcgagtacagacggggcctgggagggggcagagatgttccccaggccctgcctgtggttcctgcctgggccttggctgctgctgtgtgagagctgcatgtgagcctgtgaccgtgagctggggtgagctgggccgcacctaccctggggccccagggagcaggacgctccggggcccagcacgttgccctgggcctgtggccggagtcggagtcctctctcctcctcctggcttttggaaaggcttggctgtgttggggagtctctcttagccctttcaggaatttctgttcaggcttcctcctcctcatcagctattttacccatctcagaacgtcctgtgtctccatgtaggagagtggctctctcagatctctcagggcgtctggttatagggaaacaagtggagcagggacgtggctttaattggagcactcggctgggctgcttggggagactcttccgtgcgttcttcctctggatagaaccaccacctcctgggcgtcactgacaagctccatcttaacctccaaagccacagaactaggggctcagagccagagctggcagccgccagccaaaatgatgccattgcctgagctgacagccaagcccttctgtgggtcacctttctcctcacccagccccttgctcttcccttttgaaaggcccgtgtgttttctttccttaccctgtgcttgctcatgtctactccggttttctctaccacatccttagagccatcacctggcacgcaggcgccttacattctacggtagaacgtggggtactgtgtgtgcacatagacacacttacgtggaattacagttgtgggtttatccaagatgaggaagatttcacctgctgtttaatagacttggggccatgtgcctccccacacatgggcaaggacaggtggaatgtcgggaccacactgtgcggcttctcggcacaaagcggagggaggctgtggtcgctgccggcctaggtgtcccaggtgccccgcctttctctgggacacagttgggggctggcttctgagggattcctttctcccctctttgtgtggccccagccagggcggtgggcagtcctggtgtagagcacaagcctctccaccctagagaaatgcctctgtaccacggctaccatgtggaaccttaacttgcagaaggcttgttaacaattgttttgagagagatggctggtcatgccacagctgctggggactccgcctactccagccctcttgggacacactgtgggatttgtggcccttccccagaggaattgtggagactgtcccatggaacaaaccctcaggcaccagcacagggctctgggtgactcagtaaaactaacgtttgtctctgacaagatcagctgtaggctcaccggccagagaagaccactgtgagcattttgccgtatatcctgccctgccatttgttcactttttaaactaaaataggaacatccgacacacaccgtttgcatcgtcttctcccttgatattttaagcattttcccatgtcatgagtttctcagaaacatgtttttaacaattgtactatttagtcattgtccatttactataatttatctgaccatttccctactgtaaaatacttaagacggtttctgatttttccactatttaaataatgctgtgatgaatatctttaaaatcttctgatttcttacttttttcccccttagatgcctggaagtggtattttgaggtgaaagagtttgttcattttgaagatatttctgtctctctctcgacctgatgtgtagacgctcacttccagtagcagaaccaccttagttgtgtcttacagattctgaacaaatcggtttctgataagccatgtgttccaaagaatgtctgaataagaccgctctttatttaaatgctaagaggatgtcactactgcaatccatctgtggccgattttttccaagagccaatttccttgttttggttgcaagaacctggctctgcctgcatgtcagctctctgccctccctgctgccgtggctttcaagcgcttggcagaatcttgtacttcgtgtccacaatggtactgaatttgcatctgcacagtcagcagagataacaagtgttgaactgaccttgccacatgcttagtgagtgatttgtaattaagtttatagactcagaaggtatattaggacatttggaatcagtagcagagcaaagcctctttgaaaaaaaccacgtagctgattgggttttacaagagtgcatttgtctcccccttccacccgtggggccccaccttcaggtcttagtggttcacaagagcccagcagccaggctggctttttcattgtagggcgtggttgtcccagctggtgtagatttcaggccgccccccccaactccctgcccacagtgttgcagattgcctggctggcagcaagtccagaccacccaaatttggttggattcttcatttctccactgtagttggggtccattgattgtgcaggggaacgtgcaggaggtttttctaggcaccgtgttcagtgctgcttcactctaccagagattatggccaaattgcacggaatttggtttcttgccctctgaagcctgagggcccccccttgcctggctggttgacagacccggggtggtcactgctgagacttcagagatcgcagctgctgtgagaatacggtgaaggtactttgttctggaagatgttgtcatacacttttccccagttattttcaaacttgacatgagcctatgttgactcactgggtgggggtcccttcttacgcagcacacgtggcaagtgcctgaatcggggctggaggcacttcagagcctctgaggggccaccacttctggcccaaaattgcagggttgtagatgaggctgcctgtggagaactggtgtgaggaggaagctgtttccaacaaagagcactttcatctgttgagatggctgtggtgagcaactgaacgagcctacgtgtgtacctgaattttccccgtaactcatttcttccatatgaagaaacaccaaactatgtacagagaactttttacaaaaggcagaccttttttaagctgtgtaacccacatagcctaaccacctggcagaatgactacgaataggggtcattgtgctggtaaaagcctctattacgactgtaagtaagttggatgttggcaaaattaaattgttacagtatttagagctgctgtagctgttccttcacaacataaaataggataaatgactagtacgtctttcaggtgggtggcaagcagaacatgcgtaatattctctacctggtctgtagctgtaactgtgatgtacagacaaagcaaaaattaaaagaacttatgaaaacaaatgcaatgatactaggatatacacttttgtatttttattcttatataaggttatttgctggctattgttggcctctagttcagtctgtgttatttaaattctaatatatgaattatttgaattgaattcatgttcggggccacgttgttgtatgtattgatgtacagccttgaatgtgaataattattgtaaactatattttacaactttttttctggctttattatataaattttctattgggtcagtgatttaatcatataatttaatgaatctgtttatcctttttttttttccaaatacttgtgctttaggtgtagttaccagatgatgaattttcctcgtatggtcagtagtcttgtaataaaaagcatgtagagtgta

SEQ ID NO: 678 - DNA, 1819 bp, Homo sapiens
ccgcttcggggaggaggacgctgaggaggcgccgagccgcgcagcgctgcgggggaggcgcccgcgccgacgcggggcccatggccaggaccaccagccagctgtatgacgccgtgcccatccagtccagcgtggtgttatgttcctgcccatccccatcaatggtgaggacccagactgagtccagcacgccccctggcattcctggtggcagcaggcagggccccgccatggacggcactgcagccgagcctcggcccggcgccggctccctgcagcatgcccagcctccgccgcagcctcggaagaagcggcctgaggacttcaagtttgggaaaatccttggggaaggctctttttccacggttgtcctggctcgagaactggcaacctccagagaatatgcgattaaaattctggagaagcgacatatcataaaagagaacaaggtcccctatgtaaccagagagcgggatgtcatgtcgcgcctggatcaccccttctttgttaagctttacttcacatttcaggacgacgagaagctgtatttcggccttagttatgccaaaaatggagaactacttaaatatattcgcaaaatcggttcattcgatgagacctgtacccgattttacacggctgagattgtgtctgctttagagtacttgcacggcaagggcatcattcacagggaccttaaaccggaaaacattttgttaaatgaagatatgcacatccagatcacagattttggaacagcaaaagtcttatccccagagagcaaacaaggtgtttcagacctttgggctcttggatgcataatataccagcttgtggcaggactcccaccattccgagctggaaacgagtatcttatatttcagaagatcattaagttggaatatgactttccagaaaaattcttccctaaggcaagagacctcgtggagaaacttttggttttagatgccacaaagcggttaggctgtgaggaaatggaaggatacggacctcttaaagcacacccgttcttcgagtccgtcacgtgggagaacctgcaccagcagacgcctccgaagctcaccgcttacctgccggctatgtcggaagacgacgaggactgctatggcaattatgacaatctcctgagccagtttggctgcatgcaggtgtcttcgtcctcctcctcacactccctgtcagcctccgacacgggcctgccccagaggtcaggcagcaacatagagcagtacattcacgatctggactcgaactcctttgaactggacttacagttttccgaagatgagaagaggttgttgttggagaagcaggctggcggaaacccttggcaccagtttgtagaaaataatttaatactaaagatgggcccagtggataagcggaagggtttatttgcaagacgacgacagctgttgctcacagaaggaccacatttatattatgtggatcctgtcaacaaagttctgaaaggtgaaattccttggtcacaagaacttcgaccagaggccaagaattttaaaactttctttgtccacacgcctaacaggacgtattatctgatggaccccagcgggaacgcacacaagtggtgcaggaagatccaggaggtttggaggcagcgataccagagccacccggacgccgctgtgcagtgacgtggcctgcggccgggctgcccttcgctgccaggacacctgccccagcgcggcttggccgccatccgggacgcttccagaccacctgccagccatcacaaggggaacgcagaggcggaaaccttgcagcatttttattt

SEQ ID NO: 679 - DNA, 1714 bp, Homo sapiens
cgggcgcaggatgagggcggccattgctggggctccgcttcggggaggaggacgctgaggaggcgccgagccgcgcagcgctgcgggggaggcgcccgcgccgacgcggggcccatggccaggaccaccagccagctgtatgacgccgtgcccatccagtccagcgtggtgttatgttcctgcccatccccatcaatggtgaggacccagactgagtccagcacgccccctggcattcctggtggcagcaggcagggccccgccatggacggcactgcagccgagcctcggcccggcgccggctccctgcagcatgcccagcctccgccgcagcctcggaagaagcggcctgaggacttcaagtttgggaaaatccttggggaaggctctttttccacggttgtcctggctcgagaactggcaacctccagagaatatgcgattaaaattctggagaagcgacatatcataaaagagaacaaggtcccctatgtaaccagagagcgggatgtcatgtcgcgcctggatcaccccttctttgttaagctttacttcacatttcaggacgacgagaagctgtatttcggccttagttatgccaaaaatggagaactacttaaatatattcgcaaaatcggttcattcgatgagacctgtacccgattttacacggctgagattgtgtctgctttagagtacttgcacggcaagggcatcattcacagggaccttaaaccggaaaacattttgttaaatgaagatatgcacatccagatcacagattttggaacagcaaaagtcttatccccagagagcaaacaagccagggccaactcattcgtgggaacagcgcagtacgtttctccagagctgctcacggagaagtccgcctgtaagagttcagacctttgggctcttggatgcataatataccagcttgtggcaggactcccaccattccgagctggaaacgagtatcttatatttcagaagatcattaagttggaatatgactttccagaaaaattcttccctaaggcaagagacctcgtggagaaacttttggttttagatgccacaaagcggttaggctgtgaggaaatggaaggatacggacctcttaaagcacacccgttcttcgagtccgtcacgtgggagaacctgcaccagcagacgcctccgaagctcaccgcttacctgccggctatgtcggaagacgacgaggactgctatggcaattatgacaatctcctgagccagtttggctgcatgcaggtgtcttcgtcctcctcctcacactccctgtcagcctccgacacgggcctgccccagaggtcaggcagcaacatagagcagtacattcacgatctggactcgaactcctttgaactggacttacagttttccgaagatgagaagaggttgttgttggagaagcaggctggcggaaacccttgcctaacaggacgtattatctgatggaccccagcgggaacgcacacaagtggtgcaggaagatccaggaggtttggaggcagcgataccagagccacccggacgccgctgtgcagtgacgtggcctgcggccgggctgcccttcgctgccaggacacctgccccagcgcggcttggccgccatccgggacgcttccagaccacctgccagccatcacaaggggaacgcagaggcggaaaccttgcagcatttttattt

SEQ ID NO: 680 - DNA, 9093 bp, Homo sapiens
tctccctcggcgccgccgccgccgcccgcggggctgggacccgatgcggttagagccgcggagcctggaagagccccgagcgtttctgctttgggacaaccatacatctaattccttaaagtagttttatatgtaaaacttgcaaagaatcagaacaatgcctccacgaccatcatcaggtgaactgtggggcatccacttgatgcccccaagaatcctagtagaatgtttactaccaaatggaatgatagtgactttagaatgcctccgtgaggctacattaataaccataaagcatgaactatttaaagaagcaagaaaataccccctccatcaacttcttcaagatgaatcttcttacattttcgtaagtgttactcaagaagcagaaagggaagaattttttgatgaaacaagacgactttgtgaccttcggctttttcaaccctttttaaaagtaattgaaccagtaggcaaccgtgaagaaaagatcctcaatcgagaaattggttttgctatcggcatgccagtgtgtgaatttgatatggttaaagatccagaagtacaggacttccgaagaaatattctgaacgtttgtaaagaagctgtggatcttagggacctcaattcacctcatagtagagcaatgtatgtctatcctccaaatgtagaatcttcaccagaattgccaaagcacatatataataaattagataaagggcaaataatagtggtgatctgggtaatagtttctccaaataatgacaagcagaagtatactctgaaaatcaaccatgactgtgtaccagaacaagtaattgctgaagcaatcaggaaaaaaactcgaagtatgttgctatcctctgaacaactaaaactctgtgttttagaatatcagggcaagtatattttaaaagtgtgtggatgtgatgaatacttcctagaaaaatatcctctgagtcagtataagtatataagaagctgtataatgcttgggaggatgcccaatttgatgttgatggctaaagaaagcctttattctcaactgccaatggactgttttacaatgccatcttattccagacgcatttccacagctacaccatatatgaatggagaaacatctacaaaatccctttgggttataaatagtgcactcagaataaaaattctttgtgcaacctacgtgaatgtaaatattcgagacattgataagatctatgttcgaacaggtatctaccatggaggagaacccttatgtgacaatgtgaacactcaaagagtaccttgttccaatcccaggtggaatgaatggctgaattatgatatatacattcctgatcttcctcgtgctgctcgactttgcctttccatttgctctgttaaaggccgaaagggtgctaaagaggaacactgtccattggcatggggaaatataaacttgtttgattacacagacactctagtatctggaaaaatggctttgaatctttggccagtacctcatggattagaagatttgctgaaccctattggtgttactggatcaaatccaaataaagaaactccatgcttagagttggagtttgactggttcagcagtgtggtaaagttcccagatatgtcagtgattgaagagcatgccaattggtctgtatcccgagaagcaggatttagctattcccacgcaggactgagtaacagactagctagagacaatgaattaagggaaaatgacaaagaacagctcaaagcaatttctacacgagatcctctctctgaaatcactgagcaggagaaagattttctatggagtcacagacactattgtgtaactatccccgaaattctacccaaattgcttctgtctgttaaatggaattctagagatgaagtagcccagatgtattgcttggtaaaagattggcctccaatcaaacctgaacaggctatggaacttctggactgtaattacccagatcctatggttcgaggttttgctgttcggtgcttggaaaaatatttaacagatgacaaactttctcagtatttaattcagctagtacaggtcctaaaatatgaacaatatttggataacttgcttgtgagatttttactgaagaaagcattgactaatcaaaggattgggcactttttcttttggcatttaaaatctgagatgcacaataaaacagttagccagaggtttggcctgcttttggagtcctattgtcgtgcatgtgggatgtatttgaagcacctgaataggcaagtcgaggcaatggaaaagctcattaacttaactgacattctcaaacaggagaagaaggatgaaacacaaaaggtacagatgaagtttttagttgagcaaatgaggcgaccagatttcatggatgctctacagggctttctgtctcctctaaaccctgctcatcaactaggaaacctcaggcttgaagagtgtcgaattatgtcctctgcaaaaaggccactgtggttgaattgggagaacccagacatcatgtcagagttactgtttcagaacaatgagatcatctttaaaaatggggatgatttacggcaagatatgctaacacttcaaattattcgtattatggaaaatatctggcaaaatcaaggtcttgatcttcgaatgttaccttatggttgtctgtcaatcggtgactgtgtgggacttattgaggtggtgcgaaattctcacactattatgcaaattcagtgcaaaggcggcttgaaaggtgcactgcagttcaacagccacacactacatcagtggctcaaagacaagaacaaaggagaaatatatgatgcagccattgacctgtttacacgttcatgtgctggatactgtgtagctaccttcattttgggaattggagatcgtcacaatagtaacatcatggtgaaagacgatggacaactgtttcatatagattttggacactttttggatcacaagaagaaaaaatttggttataaacgagaacgtgtgccatttgttttgacacaggatttcttaatagtgattagtaaaggagcccaagaatgcacaaagacaagagaatttgagaggtttcaggagatgtgttacaaggcttatctagctattcgacagcatgccaatctcttcataaatcttttctcaatgatgcttggctctggaatgccagaactacaatcttttgatgacattgcatacattcgaaagaccctagccttagataaaactgagcaagaggctttggagtatttcatgaaacaaatgaatgatgcacatcatggtggctggacaacaaaaatggattggatcttccacacaattaaacagcatgcattgaactgaaaagataactgagaaaatgaaagctcactctggattccacactgcactgttaataactctcagcaggcaaagaccgattgcataggaattgcacaatccatgaacagcattagaatttacagcaagaacagaaataaaatactatataatttaaataatgtaaacgcaaacagggtttgatagcacttaaactagttcatttcaaaattaagctttagaataatgcgcaatttcatgttatgccttaagtccaaaaaggtaaactttgaagattgtttgtatctttttttaaaaaacaaaacaaaacaaaaatccccaaaatatatagaaatgatggagaaggaaaaagtgatggttttttttgtcttgcaaatgttctatgttttgaaatgtggacacaacaaaggctgttattgcattaggtgtaagtaaactggagtttatgttaaattacattgattggaaaagaatgaaaatttcttatttttccattgctgttcaatttatagtttgaagtgggtttttgactgcttgtttaatgaagaaaaatgcttggggtggaagggactcttgagatttcaccagagactttttctttttaataaatcaaaccttttgatgatttgaggttttatctgcagttttggaagcagtcacaaatgagacctgttataaggtggtatttttttttttcttctggacagtatttaaaggatcttattcttatttcccagggaaattctgggctcccacaaagtaaaaaaaaaaaaaaatcatagaaaaagaatgagcaggaatagttcttattccagaattgtacagtattcaccttaagttgattttttttctccttctgcaattgaactgaatacatttttcatgcatgttttccagaaaatagaagtattaatgttattaaaaagattattttttttattaaaggctatttatattatagaaactatcattaatatatattctttatttacatgatctgtcccatagtcatgcattgttttgcaccccaaattttttattgttcatagcagcatggtcagctttcttcttgatctatagatgaggctcaggcactatcccatttataccaataaccagtgtataactacttaaggaaaacataaaaacttcatcttctttccttttatttcttatgtgaatctcccgtcttccattctcttttataattgagaatgtctcaatcatatgaaattagttaccagaattaacacaatttagactatcttcctgattccttaaacccctttactgaagtatactcatgaataatactttaaaatatgggggaatagaaaccatgaactttttacctttttaaactatttatccatatctccaaagtagaacattaaaccattttaagatatgtctcattcccaagtagtcagagctcactctccaactttattaaatactatttgagcacaggacacattcttaaacattttgaaaaacattaacccaagatgtagaggctactgctagtcgtcattctagaatctgatattttactctgtatttgaaatgaatgattaatgtcctaggaaattagctttagcagatgtccaggtgccacatcaaaaaagtgcaataattattgacagttttttagattaggcatattattggaaaacaactttataaagagtgaacattgtatactctagtaaaacagcatcactttaaaaatattcatttatgaaatctgttacctatagttgaagtcttgagtagtgaacaagggactctaataccaatactcttaatatctggctattttagatcccttaaagggcataattattggaaatttaggtatttcactaaagcatgtatataatattgccaacaagaaaagtaaatttgaagattaagggaacttacttctgcaaactgtcttgcgatagttaagcagaatttaaactctgttttaagcaggaaaccagaaagattattttgcagttgtagaagatttcataacttattaaaacttattaacattttgtgttgtttagatataggcagttgatacatactaacatcccagccttttcaatatcagggttaaattataggaaaactcagtaaaatggtacaaatctgaaagtttgatggtagaaactgaagatttaacagagaactgtgttttacccgagtgccaaaaatgctgtgagcctccttgcacaaaatttataccacttttgcatttttatctatcagtccagatagttgtctcccctccttctcccaggacctctccaccattaaaatgcacaaaccacatggccgatttcaccatttacatttattttcaaaagttactacaaccaaattaattctattagaagaaatgtagacaaattctataaagactatagattgtgacctaagaaagaaatgaggcaaagaaccaaacattgaattaaatgctacatgggtgactaagatctgtttcaagtcagtgataatatagccacttctgggtacttcagtatcagagatcagttctcgtggtttagacagttcctatctatagctgactatccttgtccttgaatatggtgtaactgactattggctctacagttttattgggccacttaagaaatatttccttgaataattattttgagaaaaagtctaaaagtaataaaaataattttaaacacactgtagtaagaaatgactgttggaaaattatgctttcactttctaccatattctcagctatacaaaaccatttattttgaagatttttagactactgttaatttgaaatctgttactcttattgtggaatttgtttttttaaaaaagatgtttctaattggatttttaaaagaagaatggaatttggttgctattttacaatagaacctaagctttttgtggttcttagtgtcctatgtaaaacttagtgtcaaagtaatcaactttgagattttcccttctattctgctttatattaaaagcccattagaaaatgggaacctggtgaatatataatgaattgtaaaatattttaatgtgtaactttttcaactgtgaaactgacttgattttttgatgaaaacagctgctgataaagtattttgtgtaaagtgtagttcttattaatcaggaaaatgatgacttgattagactgtatatgccctcttggattttattttaaatggattggtgactttcacataggtaaaacacagtccatctgtattcttttttccatcaaaaatcgagtgatttggaattataaaaaaattgtgagcagcctatttgaaaggcatcatggaaatttcacagcacaataacacggatttgttttttcttaatgatgtaaatccgtttaattcatactttgatcaatagcccatgcttgccaactctgaagaaatttaatttccagcagtattttaaagctagcctgttaactttttctgaatatttaaagttcctcttttttctatgtctgcacaaactgcagacctgggctggacccacatactcaagagtccaccttaagaaattattttgatgtccaagacatcactaaaatatttaagtttaaagataatatgtggtgttaatagattgtggtgcttttactatttaaagacaactttcatacttcagatgtttttgagaagaggggaatgtgaggggagggggcagaacagggaggagttgtttgaatgaattacattctttatatccatcctgctcatttggggcatgtctttaagagaaggctgaaagttgtgagagtatattgtataccgtaagagaatcaactcttcatcatggatgggattgtgaaggctgaactataaaattcagcattgacagcatcctcaattaataattcttggtgacagaataatacagctgggctgttttttaaaatataaacaataccatttttaattattacattaaaaattgtaaatatatctatgtgccatggcctgggaagcctgctttcttttttcataaaaattatttttactgtatgaaaagatcatggggtttagctcaaaatatctgtggtcctgataaaattggattggtaactctacctcagaaggaaaatgggaaaaaaaaatagatgagtcacaattcaatacttcaagctcagaaactgtgcagatcactgaattttagatttataaagtcagagttggcatgccttgtttttaatgatatggaagaccttaagaaaaaaacttggctgaagtttaatcgttggtccagccatttgaaaaaggcaatagtttgaggaggttcccgaattcggcatttgaaattcattttgttctctcttcttcattattagtgcatttggtgtgtgtatacttgcacacaattctgtttgtgtacacactgcttgcttagccctagtcaagaggcatcttttataaaaggtgtaaagaaatatcaaggttctaaaattcggaagagtttagaatttattaggagtttcccaagttgggatgttagtctttaaataaacttcatgcacctattccacttaaggttttgcacctcctttttattagtgcagtgccatttcttctgcttgattttaggtatgttaatattccagccttgctagttagcataaagtgacaggtgtgagccatgaggaaattttctgacttaatttgtacacaactacatataagagttttagtggaggaaaaaaattagtcccttgtgcgtatacagtagttaggtaaatgatttttctaccaacagtatactccattcctcatgtaggtaagtacagaaaaggtttttaaatgtatttttttagccagttaaagtctatgaatctatctgcaaccttatttaatctgtcactataataattttgtggttatgctaagaaccatgtatacttttaggtattcttatttttgtcaatttttctaggttggcaaggaggcagaaaaccttcattgtttcatattaaaatataattagactaaacttaattctagtatgaatttccaaaatcattatctatttatttcatttttatttaattttgtttttatttcatttttaaaagtcccttgttcaatttaacttatgttcctaagagaggttggagaacttggccttcatctgatttcaaaaatgttttgagtttcaaatgaagttaatggtttcagtgtgattcagtcctcagacctaattgggttgaataaaatctaaaagaatatacccttttggagcataacattttaataccttggggaatgtggcactaccaaaagaagactactaacacgtcagatgttcacctggaagctttatcaagaaattcgaaccacccttttggccccattaattgtagcaagtttatttctctatattttgtcattcagtgaattgaagtcctgtggtatactgcattcattagaagaaaaacgtttttaatgtccttttaatgatggcccagaaagcatttgacacagcaagatgcatgtgttactatattgagaatatagaataataacagtatcactaaatttaagacctcttcccagtcttgctgttcctagcaagaagtttggcctgtgactgcacttactgtttatgctcatcagaaactgtcaatgtctgcttttctttaactctgcagtctgtaacatcacgctgtttattaaaaaaaaaaagaaaaatta

SEQ ID NO: 681 - DNA, 3213 bp, Homo sapiens
atgtgcttcagtttcataatgcctcctgctatggcagacatccttgacatctgggcggtggattcacagatagcatctgatggctccatacctgtggatttccttttgcccactgggatttatatccagttggaggtacctcgggaagctaccatttcttatattaagcagatgttatggaagcaagttcacaattacccaatgttcaacctccttatggatattgactcctatatgtttgcatgtgtgaatcagactgctgtatatgaggagcttgaagatgaaacacgaagactctgtgatgtcagaccttttcttccagttctcaaattagtgacaagaagttgtgacccaggggaaaaattagactcaaaaattggagtccttataggaaaaggtctgcatgaatttgattccttgaaggatcctgaagtaaatgaatttcgaagaaaaatgcgcaaattcagcgaggaaaaaatcctgtcacttgtgggattgtcttggatggactggctaaaacaaacatatccaccagagcatgaaccatccatccctgaaaacttagaagataaactttatgggggaaagctcatcgtagctgttcattttgaaaactgccaggacgtgtttagctttcaagtgtctcctaatatgaatcctatcaaagtaaatgaattggcaatccaaaaacgtttgactattcatgggaaggaagatgaagttagcccctatgattatgtgttgcaagtcagcgggagagtagaatatgtttttggtgatcatccactaattcagttccagtatatccggaactgtgtgatgaacagagccctgccccattttatacttgtggaatgctgcaagatcaagaaaatgtatgaacaagaaatgattgccatagaggctgccataaatcgaaattcatctaatcttcctcttccattaccaccaaagaaaacacgaattatttctcatgtttgggaaaataacaaccctttccaaattgtcttggttaagggaaataaacttaacacagaggaaactgtaaaagttcatgtcagggctggtctttttcatggtactgagctcctgtgtaaaaccatcgtaagctcagaggtatcagggaaaaatgatcatatttggaatgaaccactggaatttgatattaatatttgtgacttaccaagaatggctcgattatgttttgctgtttatgcagttttggataaagtaaaaacgaagaaatcaacgaaaactattaatccctctaaatatcagaccatcaggaaagctggaaaagtgcattatcctgtagcgtgggtaaatacgatggtttttgactttaaaggacaattgagaactggagacataatattacacagctggtcttcatttcctgatgaactcgaagaaatgttgaatccaatgggaactgttcaaacaaatccatatactgaaaatgcaacagctttgcatgttaaatttccagagaataaaaaacaaccttattattaccctcccttcgataagattattgaaaaggcagctgagattgcaagcagtgatagtgctaatgtgtcaagtcgaggtggaaaaaagtttcttcctgtattgaaagaaatcttggacagggatcccttgtctcaactgtgtgaaaatgaaatggatcttatttggactttgcgacaagactgccgagagattttcccacaatcactgccaaaattactgctgtcaatcaagtggaataaacttgaggatgttgctcagcttcaggcgctgcttcagatttggcctaaactgcccccccgggaggccctagagcttctggatttcaactatccagaccagtacgttcgagaatatgctgtaggctgcctgcgacagatgagtgatgaagaactttctcaatatcttttacaactggtgcaagtgttaaaatatgagccttttcttgattgtgccctctctagattcctattagaaagagcacttggtaatcggaggatagggcagtttctattttggcatcttaggtcagaagtgcacattcctgctgtctcagtacaatttggtgtcatccttgaagcatactgccggggaagtgtggggcacatgaaagtgctttctaagcaggttgaagcactcaataagttaaaaactttaaatagtttaatcaaactgaatgccgtgaagttaaacagagccaaagggaaggaggccatgcatacctgtttaaaacagagtgcttaccgggaagccctctctgacctgcagtcacccctgaacccatgtgttatcctctcagaactctatgttgaaaagtgcaaatacatggattccaaaatgaagcctttgtggctggtatacaataacaaggtatttggtgaggattcagttggagtgatttttaaaaatggtgatgatttacgacaggatatgttgacactccaaatgttgcgcttgatggatttactctggaaagaagctggtttggatcttcggatgttgccttatggctgtttagcaacaggagatcgctctggcctcattgaagttgtgagcacctctgaaacaattgctgacattcagctgaacagtagcaatgtggctgctgcagcagccttcaacaaagatgcccttctgaactggcttaaagaatacaactctggggatgacctggaccgagccattgaggaatttacactgtcctgtgctggctactgtgtagcttcttatgtccttgggattggtgacagacatagtgacaacatcatggtcaaaaaaactggccagctcttccacattgactttggacatattcttggaaatttcaaatctaagtttggcattaaaagggagcgagtgccttttattcttacctatgatttcatccatgtcattcaacaaggaaaaacaggaaatacagaaaagtttggccggttccgccagtgttgtgaggatgcatatctgattttacgacggcatgggaatctcttcatcactctctttgcgctgatgttgactgcagggcttcctgaactcacatcagtcaaagatatacagtatcttaaggactctcttgcattagggaagagtgaagaagaagcactcaaacagtttaagcaaaaatttgatgaggcgctcagggaaagctggactactaaagtgaactggatggcccacacagttcggaaagactacagatcttaa

SEQ ID NO: 682 - DNA, 5377 bp, Homo sapiens
gcacttccttctcggctagattatctgaaactgttgtcggttcttgagatgatactaccaccgaatgtctgtgtttcattgtctagtccaacctgtattgtggatatctacaacgttccggcaatagttttgcaggtgcatcacatttttgtttttgttttgggaggaaaagggagggcacggcagccaggcttcatattcctacaagtgcatgcttcaagattactgtacttacagtgtttccaacatcttctcataaaaggggaaagcttcatagcctcaaccatgaaggaaaccagtcgcatagggcatggagctggagaactataaacagcccgtggtgctgagagaggacaactgccgaaggcgccggaggatgaagccgcgcagtgctgcggccagcctgtcctccatggagctcatccccatcgagttcgtgctgcccaccagccagcgcaaatgcaagagccccgaaacggcgctgctgcacgtggccggccacggcaacgtggagcagatgaaggcccaggtgtggctgcgagcgctggagaccagcgtggcggcggacttctaccaccggctgggaccgcatcacttcctcctgctctatcagaagaaggggcagtggtacgagatctacgacaagtaccaggtggtgcagactctggactgcctgcgctactggaaggccacgcaccggagcccgggccagatccacctggtgcagcggcacccgccctccgaggagtcccaagccttccagcggcagctcacggcgctgattggctatgacgtcactgacgtcagcaacgtgcacgacgatgagctggagttcacgcgccgtggcttggtgaccccgcgcatggcggaggtggccagccgcgaccccaagctctacgccatgcacccgtgggtgacgtccaagcccctcccggagtacctgtggaagaagattgccaacaactgcatcttcatcgtcattcaccgcagcaccaccagccagaccattaaggtctcacccgacgacacccccggcgccatcctgcagagcttcttcaccaagatggccaagaagaaatctctgatggatattcccgaaagccaaagcgaacaggattttgtgctgcgcgtctgtggccgggatgagtacctggtgggcgaaacgcccatcaaaaacttccagtgggtgaggcactgcctcaagaacggagaagagattcacgtggtactggacacgcctccagacccggccctagacgaggtgaggaaggaagagtggccactggtggatgactgcacgggagtcaccggctaccatgagcagcttaccatccacggcaaggaccacgagagtgtgttcaccgtgtccctgtgggactgcgaccgcaagttcagggtcaagatcagaggcattgatatccccgtcctgcctcggaacaccgacctcacagtttttgtagaggcaaacatccagcatgggcaacaagtcctttgccaaaggagaaccagccccaaacccttcacagaggaggtgctgtggaatgtgtggcttgagttcagtatcaaaatcaaagacttgcccaaaggggctctactgaacctccagatctactgcggtaaagctccagcactgtccagcaaggcctctgcagagtcccccagttctgagtccaagggcaaagttcagcttctctattatgtgaacctgctgctgatagaccaccgtttcctcctgcgccgtggagaatacgtcctccacatgtggcagatatctgggaagggagaagaccaaggaagcttcaatgctgacaaactcacgtctgcaactaacccagacaaggagaactcaatgtccatctccattcttctggacaattactgccacccgatagccctgcctaagcatcagcccacccctgacccggaaggggaccgggttcgagcagaaatgcccaaccagcttcgcaagcaattggaggcgatcatagccactgatccacttaaccctctcacagcagaggacaaagaattgctctggcattttagatacgaaagccttaagcacccaaaagcatatcctaagctatttagttcagtgaaatggggacagcaagaaattgtggccaaaacataccaattgttggccagaagggaagtctgggatcaaagtgctttggatgttgggttaacaatgcagctcctggactgcaacttctcagatgaaaatgtaagagccattgcagttcagaaactggagagcttggaggacgatgatgttctgcattaccttctacaattggtccaggctgtgaaatttgaaccataccatgatagcgcccttgccagatttctgctgaagcgtggtttaagaaacaaaagaattggtcactttttgttttggttcttgagaagtgagatagcccagtccagacactatcagcagaggttcgctgtgattctggaagcctatctgaggggctgtggcacagccatgctgcacgactttacccaacaagtccaagtaatcgagatgttacaaaaagtcacccttgatattaaatcgctctctgctgaaaagtatgacgtcagttcccaagttatttcacaacttaaacaaaagcttgaaaacctgcagaattctcaactccccgaaagctttagagttccatatgatcctggactgaaagcaggagcgctggcaattgaaaaatgtaaagtaatggcctccaagaaaaaaccactatggcttgagtttaaatgtgccgatcctacagccctatcaaatgaaacaattggaattatctttaaacatggtgatgatctgcgccaagacatgcttattttacagattctacgaatcatggagtctatttgggagactgaatctttggatctatgcctcctgccatatggttgcatttcaactggtgacaaaataggaatgatcgagattgtgaaagacgccacgacaattgccaaaattcagcaaagcacagtgggcaacacgggagcatttaaagatgaagtcctgaatcactggctcaaagaaaaatcccctactgaagaaaagtttcaggcagcagtggagagatttgtttattcctgtgcaggctactgtgtggcaacctttgttcttggaataggcgacagacacaatgacaatattatgatcaccgagacaggaaacctatttcatattgacttcgggcacattcttgggaattacaaaagtttcctgggcattaataaagagagagtgccatttgtgctaacccctgacttcctctttgtgatgggaacttctggaaagaagacaagcccacacttccagaaatttcaggacatctgtgttaaggcttatctagcccttcgtcatcacacaaacctactgatcatcctgttctccatgatgctgatgacaggaatgccccagttaacaagcaaagaagacattgaatatatccgggatgccctcacagtggggaaaaatgaggaggatgctaaaaagtattttcttgatcagatcgaagtttgcagagacaaaggatggactgtgcagtttaattggtttctacatcttgttcttggcatcaaacaaggagagaaacattcagcctaatactttaggctagaatcaaaaacaagttagtgttctatggtttaaattagcatagcaatcatcgaacttggatttcaaatgcaatagacattgtgaaagctggcatttcagaagtatagctcttttcctacctgaactcttccctggagaaaagatgttggcattgctgattgtttggttaagcaatgtccagtgctaggattatttgcaggtttggttttttctcatttgtctgtggcattggagaatattctcggtttaaacagactaatgacttccttattgtccctgatattttgactatcttactattgagtgcttctggaaattctttggaataattgatgacatctattttcatctgggtttagtctcaattttggttatctttgtgttcctcaagctctttaaagaaaaagatgtaatcgttgtaacctttgtctcattccttaaatgatgcttccaaacatctccttagtgtctgcaggtgttagtggtgtgctaaaagcaaggaaagcgagttagtcttttcagtgtcttttgcaattcaattcttttgtcatgtataactgagacacacaaacacagcaggagaaatctaaaccgttgtgccttgaccttcctctgctggtcttgttccagggttatgaatatgaaaaaatagagatgagactttttgtgtcaactctgtccacaagagtgagttatctagtatgattagtatagctttctccagcatggcagcaggaagtaactacagggcctcttttatgcctgacatttcttcccttcctttttccctgcctccctttttcatcaattgcgatgctcccacaactctttacagacttgtgaaatcttcaagaacacctttactctataactcaaaaattagttgaaaaataattacttctcaaggattattagaatcttaggtacttatttgtaaagatgtttagtgacttttttttcaagtatcttattaaaggaggcattctagaaaatatgaattagtttccaaatgccttaattttaaactttggcctgaacagttttttctttttcttaatggaagaagatatttaatatcttaaaaatattccaagttaggaagaacactacttgccttatccatttcccatttaaaggacttttaaactttgacacatccttcagatttcctgaaaataattgaaatatcttactttaaaaatattttcatctctgaaatatctcgttatttattggaggtattgtttaaccttagagagaccattaaattatttataaaatattttgtaattacctgtagctaatacattacatagaaaaaaactatgttaacagtgtctctgtttaagtataatcagatataaatatatacttaattttttaattttaaaaatagatacctgtttgactttgaggtagtccagaccttttctttttttttttttttttaatgtgtgcaaaagcccaaaggttcctaagcctggctgcaaagaagaatcaacagggacactttttaaaaacactcttatcagcctgggcaacacagtgagactccatctcttaaaaaaaaaattagctgggtatagtggtatgtgcctgtagtcccaggtactcaggaggctgaggcaggaggattgcctgagcccaggaggtggaaactgcagagagtcatgatcatgtccttacactccagcctggataacagagcgagaccctgtctcaaaaaaataaaataaaaaataaaaa

SEQ ID NO: 683 - DNA, 3503 bp, Homo sapiens
cctgggagaagaggcagctgaggccgtggcccggagtagtaggagccacaagccaccctgggcaggacgaggccctgagggaggacaactgtcatctgggaagtaacaacgcaggatgccccctggggtggactgccccatggaattctggaccaaggaggagaatcagagcgttgtggttgacttcctgctgcccacaggggtctacctgaacttccctgtgtcccgcaatgccaacctcagcaccatcaagcagctgctgtggcaccgcgcccagtatgagccgctcttccacatgctcagtggccccgaggcctatgtgttcacctgcatcaaccagacagcggagcagcaagagctggaggacgagcaacggcgtctgtgtgacgtgcagcccttcctgcccgtcctgcgcctggtggcccgtgagggcgaccgcgtgaagaagctcatcaactcacagatcagcctcctcatcggcaaaggcctccacgagtttgactccttgtgcgacccagaagtgaacgactttcgcgccaagatgtgccaattctgcgaggaggcggccgcccgccggcagcagctgggctgggaggcctggctgcagtacagtttccccctgcagctggagccctcggctcaaacctgggggcctggtaccctgcggctcccgaaccgggcccttctggtcaacgttaagtttgagggcagcgaggagagcttcaccttccaggtgtccaccaaggacgtgccgctggcgctgatggcctgtgccctgcggaagaaggccacagtgttccggcagccgctggtggagcagccggaagactacacgctgcaggtgaacggcaggcatgagtacctgtatggcagctacccgctctgccagttccaggtccagaaaccgcgtgccaaaccacctcccattcctgcgaagaagccttcctctgtgtccctgtggtccctggagcagccgttccgcatcgagctcatccagggcagcaaagtgaacgccgacgagcggatgaagctggtggtgcaggccgggcttttccacggcaacgagatgctgtgcaagacggtgtccagctcggaggtgagcgtgtgctcggagcccgtgtggaagcagcggctggagttcgacatcaacatctgcgacctgccccgcatggcccgtctctgctttgcgctgtacgccgtgatcgagaaagccaagaaggctcgctccaccaagaagaagtccaagaaggcggactgccccattgcctgggccaacctcatgctgtttgactacaaggaccagcttaagaccggggaacgctgcctctacatgtggccctccgtcccagatgagaagggcgagctgctgaaccccacgggcactgtgcgcagtaaccccaacacggatagcgccgctgccctgctcatctgcctgcccgaggtggccccgcaccccgtgtactaccccgccctggagaagctgccaggagggatgctcttggcatctcgtgagtggaggccagagctgctgtggatgcgcctccatgcagaggacagcgccccctcaaggatgattggggtggcaatgcccggcctgggggtcctgcccgggctggtccaggcccctggggacgctgagtgcagccgtttgttgcagatcttggagctggggcgacacagcgagtgtgtgcatgtcaccgaggaggagcagctgcagctgcgggaaatcctggagcggcgggggtctggggagctgtatgagcacgagaaggacctggtgtggaagctgcggcatgaagtccaggagcacttcccggaggcgctagcccggctgctgctggtcaccaagtggaacaagcatgaggatgtggcccaagatgctctacctgctgtgtcctggccggagctgcccgtcctgagcgccctggagctgctagacttcagcttccccgattgccacgtaggctccttcgccatcaagtcgctgcggaaactgacggacgatgagctgttccagtacctgctgcagctggtgcaggtgctcaagtacgagtcctacctggactgcgagctgaccaaattcctgctggaccgggccctggccaaccgcaagatcggccacttccttttctggcacctccgctccgagatgcacgtgccgtcggtggccctgcgcttcggcctcatcctggaggcctactgcaggggcagcacccaccacatgaaggtgctgatgaagcagggggaagcactgagcaaactgaaggccctgaatgacttcgtcaagctgagctctcagaagacccccaagccccagaccaaggagctgatgcacttgtgcatgcggcaggaggcctacctagaggccctctcccacctgcagtccccactcgaccccagcaccctgctggctgaagtctgcgtggagcagtgcaccttcatggactccaagatgaagcccctgtggatcatgtacagcaacgaggaggcaggcagcggcggcagcgtgggcatcatctttaagaacggggatgacctccggcaggacatgctgaccctgcagatgatccagctcatggacgtcctgtggaagcaggaggggctggacctgaggatgaccccctatggctgcctccccaccggggaccgcacaggcctcattgaggtggtactccgttcagacaccatcgccaacatccaactcaacaagagcaacatggcagccacagccgccttcaacaaggatgccctgctcaactggctgaagtccaagaacccgggggaggccctggatcgagccattgaggagttcaccctctcctgtgctggctattgtgtggccacatatgtgctgggcattggcgatcggcacagcgacaacatcatgatccgagagagtgggcagctgttccacattgattttggccactttctggggaatttcaagaccaagtttggaatcaaccgcgagcgtgtcccattcatcctcacctacgactttgtccatgtgattcagcaggggaagactaataatagtgagaaatttgaacggttccggggctactgtgaaagggcctacaccatcctgcggcgccacgggcttctcttcctccacctctttgccctgatgcgggcggcaggcctgcctgagctcagctgctccaaagacatccagtatctcaaggactccctggcactggggaaaacagaggaggaggcactgaagcacttccgagtgaagtttaacgaagccctccgtgagagctggaaaaccaaagtgaactggctggcccacaacgtgtccaaagacaacaggcagtagtggctcctcccagccctgggcccaagaggaggcggctgcgggtcgtggggaccaagcacattggtcctaaaggggctgaagagcctgaactgcacctaacgggaaagaaccgacatggctgccttttgtttacactggttatttatttatgacttgaaatagtttaaggagctaaacagcc

SEQ ID NO: 684 - DNA, 3508 bp, Homo sapiens
cctgggagaagaggcagctgaggccgtggcccggagtagtaggagccacaagccaccctgggcaggacgaggccctgagggaggacaactgtcatctgggaagtaacaacgcaggatgccccctggggtggactgccccatggaattctggaccaaggaggagaatcagagcgttgtggttgacttcctgctgcccacaggggtctacctgaacttccctgtgtcccgcaatgccaacctcagcaccatcaagcagctgctgtggcaccgcgcccagtatgagccgctcttccacatgctcagtggccccgaggcctatgtgttcacctgcatcaaccagacagcggagcagcaagagctggaggacgagcaacggcgtctgtgtgacgtgcagcccttcctgcccgtcctgcgcctggtggcccgtgagggcgaccgcgtgaagaagctcatcaactcacagatcagcctcctcatcggcaaaggcctccacgagtttgactccttgtgcgacccagaagtgaacgactttcgcgccaagatgtgccaattctgcgaggaggcggccgcccgccggcagcagctgggctgggaggcctggctgcagtacagtttccccctgcagctggagccctcggctcaaacctgggggcctggtaccctgcggctcccgaaccgggcccttctggtcaacgttaagtttgagggcagcgaggagagcttcaccttccaggtgtccaccaaggacgtgccgctggcgctgatggcctgtgccctgcggaagaaggccacagtgttccggcagccgctggtggagcagccggaagactacacgctgcaggtgaacggcaggcatgagtacctgtatggcagctacccgctctgccagttccaggtccagaaaccgcgtgccaaaccacctcccattcctgcgaagaagccttcctctgtgtccctgtggtccctggagcagccgttccgcatcgagctcatccagggcagcaaagtgaacgccgacgagcggatgaagctggtggtgcaggccgggcttttccacggcaacgagatgctgtgcaagacggtgtccagctcggaggtgagcgtgtgctcggagcccgtgtggaagcagcggctggagttcgacatcaacatctgcgacctgccccgcatggcccgtctctgctttgcgctgtacgccgtgatcgagaaagccaagaaggctcgctccaccaagaagaagtccaagaaggcggactgccccattgcctgggccaacctcatgctgtttgactacaaggaccagcttaagaccggggaacgctgcctctacatgtggccctccgtcccagatgagaagggcgagctgctgaaccccacgggcactgtgcgcagtaaccccaacacggatagcgccgctgccctgctcatctgcctgcccgaggtggccccgcaccccgtgtactaccccgccctggagaagctgccaggagggatgctcttggcatctcgtgagtggaggccagagctgctgtggatgcgcctccatgcagaggacagcgccccctcaaggatgattggggtggcaatgcccggcctgggggtcctgcccgggctggtccaggcccctggggacgctgagtgcagccgtttgttgcagatcttggagctggggcgacacagcgagtgtgtgcatgtcaccgaggaggagcagctgcagctgcgggaaatcctggagcggcgggggtctggggagctgtatgagcacgagaaggacctggtgtggaagctgcggcatgaagtccaggagcacttcccggaggcgctagcccggctgctgctggtcaccaagtggaacaagcatgaggatgtggcccagatgctctacctgctgtgctcctggccggagctgcccgtcctgagcgccctggagctgctagacttcagcttccccgattgccacgtaggctccttcgccatcaagtcgctgcggaaactgacggacgatgagctgttccagtacctgctgcagctggtgcaggtgctcaagtacgagtcctacctggactgcgagctgaccaaattcctgctggaccgggccctggccaaccgcaagatcggccacttccttttctggcacctccgctccgagatgcacgtgccgtcggtggccctgcgcttcggcctcatcctggaggcctactgcaggggcagcacccaccacatgaaggtgctgatgaagcagggggaagcactgagcaaactgaaggccctgaatgacttcgtcaagctgagctctcagaagacccccaagccccagaccaaggagctgatgcacttgtgcatgcggcaggaggcctacctagaggccctctcccacctgcagtccccactcgaccccagcaccctgctggctgaagtctgcgtggagcagtgcaccttcatggactccaagatgaagcccctgtggatcatgtacagcaacgaggaggcaggcagcggcggcagcgtgggcatcatctttaagaacggggatgacctccggcaggacatgctgaccctgcagatgatccagctcatggacgtcctgtggaagcaggaggggctggacctgaggatgaccccctatggctgcctccccaccggggaccgcacaggcctcattgaggtggtactccgttcagacaccatcgccaacatccaactcaacaagagcaacatggcagccacagccgccttcaacaaggatgccctgctcaactggctgaagtccaagaacccgggggaggccctggatcgagccattgaggagttcaccctctcctgtgctggctattgtgtggccacatatgtgctgggcattggcgatcggcacagcgacaacatcatgatccgagagagtgggcagctgttccacattgattttggccactttctggggaatttcaagaccaagtttggaatcaaccgcgagcgtgtcccattcatcctcacctacgactttgtccatgtgattcagcaggggaagactaataatagtgagaaatttgaacggttccggggctactgtgaaagggcctacaccatcctgcggcgccacgggcttctcttcctccacctctttgccctgatgcgggcggcaggcctgcctgagctcagctgctccaaagacatccagtatctcaaggactccctggcactggggaaaacagaggaggaggcactgaagcacttccgagtgaagtttaacgaagccctccgtgagagctggaaaaccaaagtgaactggctggcccacaacgtgtccaaagacaacaggcagtagtggctcctcccagccctgggcccaagaggaggcggctgcgggtcgtggggaccaagcacattggtcctaaaggggctgaagagcctgaactgcacctaacgggaaagaaccgacatggctgccttttgtttacactggttatttatttatgacttgaaatagtttaaggagctaaacagccataaa

SEQ ID NO: 685 - DNA, 5203 bp, Homo sapiens
cagtcgctccgagcggccgcgagcagagccgcccagccctgccagctgcgccgggacgataaggagtcaggccagggcgggatgacactcattgattctaaagcatctttaatctgccaggcggagggggctttgctggtctttcttggactattccagagaggacaactgtcatctgggaagtaacaacgcaggatgccccctggggtggactgccccatggaattctggaccaaggaggagaatcagagcgttgtggttgacttcctgctgcccacaggggtctacctgaacttccctgtgtcccgcaatgccaacctcagcaccatcaagcagctgctgtggcaccgcgcccagtatgagccgctcttccacatgctcagtggccccgaggcctatgtgttcacctgcatcaaccagacagcggagcagcaagagctggaggacgagcaacggcgtctgtgtgacgtgcagcccttcctgcccgtcctgcgcctggtggcccgtgagggcgaccgcgtgaagaagctcatcaactcacagatcagcctcctcatcggcaaaggcctccacgagtttgactccttgtgcgacccagaagtgaacgactttcgcgccaagatgtgccaattctgcgaggaggcggccgcccgccggcagcagctgggctgggaggcctggctgcagtacagtttccccctgcagctggagccctcggctcaaacctgggggcctggtaccctgcggctcccgaaccgggcccttctggtcaacgttaagtttgagggcagcgaggagagcttcaccttccaggtgtccaccaaggacgtgccgctggcgctgatggcctgtgccctgcggaagaaggccacagtgttccggcagccgctggtggagcagccggaagactacacgctgcaggtgaacggcaggcatgagtacctgtatggcagctacccgctctgccagttccagtacatctgcagctgcctgcacagtgggttgacccctcacctgaccatggtccattcctcctccatcctcgccatgcgggatgagcagagcaaccctgccccccaggtccagaaaccgcgtgccaaaccacctcccattcctgcgaagaagccttcctctgtgtccctgtggtccctggagcagccgttccgcatcgagctcatccagggcagcaaagtgaacgccgacgagcggatgaagctggtggtgcaggccgggcttttccacggcaacgagatgctgtgcaagacggtgtccagctcggaggtgagcgtgtgctcggagcccgtgtggaagcagcggctggagttcgacatcaacatctgcgacctgccccgcatggcccgtctctgctttgcgctgtacgccgtgatcgagaaagccaagaaggctcgctccaccaagaagaagtccaagaaggcggactgccccattgcctgggccaacctcatgctgtttgactacaaggaccagcttaagaccggggaacgctgcctctacatgtggccctccgtcccagatgagaagggcgagctgctgaaccccacgggcactgtgcgcagtaaccccaacacggatagcgccgctgccctgctcatctgcctgcccgaggtggccccgcaccccgtgtactaccccgccctggagaagatcttggagctggggcgacacagcgagtgtgtgcatgtcaccgaggaggagcagctgcagctgcgggaaatcctggagcggcgggggtctggggagctgtatgagcacgagaaggacctggtgtggaagctgcggcatgaagtccaggagcacttcccggaggcgctagcccggctgctgctggtcaccaagtggaacaagcatgaggatgtggcccagatgctctacctgctgtgctcctggccggagctgcccgtcctgagcgccctggagctgctagacttcagcttccccgattgccacgtaggctccttcgccatcaagtcgctgcggaaactgacggacgatgagctgttccagtacctgctgcagctggtgcaggtgctcaagtacgagtcctacctggactgcgagctgaccaaattcctgctggaccgggccctggccaaccgcaagatcggccacttccttttctggcacctccgctccgagatgcacgtgccgtcggtggccctgcgcttcggcctcatcctggaggcctactgcaggggcagcacccaccacatgaaggtgctgatgaagcagggggaagcactgagcaaactgaaggccctgaatgacttcgtcaagctgagctctcagaagacccccaagccccagaccaaggagctgatgcacttgtgcatgcggcaggaggcctacctagaggccctctcccacctgcagtccccactcgaccccagcaccctgctggctgaagtctgcgtggagcagtgcaccttcatggactccaagatgaagcccctgtggatcatgtacagcaacgaggaggcaggcagcggcggcagcgtgggcatcatctttaagaacggggatgacctccggcaggacatgctgaccctgcagatgatccagctcatggacgtcctgtggaagcaggaggggctggacctgaggatgaccccctatggctgcctccccaccggggaccgcacaggcctcattgaggtggtactccgttcagacaccatcgccaacatccaactcaacaagagcaacatggcagccacagccgccttcaacaaggatgccctgctcaactggctgaagtccaagaacccgggggaggccctggatcgagccattgaggagttcaccctctcctgtgctggctattgtgtggccacatatgtgctgggcattggcgatcggcacagcgacaacatcatgatccgagagagtgggcagctgttccacattgattttggccactttctggggaatttcaagaccaagtttggaatcaaccgcgagcgtgtcccattcatcctcacctacgactttgtccatgtgattcagcaggggaagactaataatagtgagaaatttgaacggttccggggctactgtgaaagggcctacaccatcctgcggcgccacgggcttctcttcctccacctctttgccctgatgcgggcggcaggcctgcctgagctcagctgctccaaagacatccagtatctcaaggactccctggcactggggaaaacagaggaggaggcactgaagcacttccgagtgaagtttaacgaagccctccgtgagagctggaaaaccaaagtgaactggctggcccacaacgtgtccaaagacaacaggcagtagtggctcctcccagccctgggcccaagaggaggcggctgcgggtcgtggggaccaagcacattggtcctaaaggggctgaagagcctgaactgcacctaacgggaaagaaccgacatggctgccttttgtttacactggttatttatttatgacttgaaatagtttaaggagctaaacagccataaacggaaacgcctccttcatgcagcggcggtgctgggccccccgaggctgcacctggctctcggctgaggattgtcaccccaagtcttccagctggtggatctgggcccagcaaagactgttctcctcccgagggaaccttcttcccaggcctcccgccagactgcctgggtcctggcgcctggcggtcacctggtgcctactgtccgacaggatgccttgatcctcgtgcgacccaccctgtgtatcctccctagactgagttctggcagctccccgaggcagccggggtaccctctagattcagggatgcttgctctccacttttcaagtgggtcttgggtacgagaattccctcatctttctctactgtaaagtgattttgtttgcaggtaagaaaataatagatgactcaccacacctctacggctggggagatcaggcccagccccataaaggagaatctacgctggtcctcaggacgtgttaaagagatctgggcctcatgtagctcaccccggtcacgcatgaaggcaaaagcaggtcagaagcgaatactctgccattatctcaaaaatcttttttttttttttgagatggggtcttcctctgttgcccaggctggagtgcagtggtgcaatcttggctcactgtaacctccgcctcccaggttcaagtgattcttctgcctcagcctcctgagtagctgggattacaggtgtgcaccaccgtacccagctaatttttgtattttagtagagacgggggtttcaccatgttggctgggctggtctcgaactcctgacctcaggtgatccacccgcctgagcctcccaaagtgctgggattacaggcatgagccaccgcgcccggcccactctgccattgtctaagccacctctgaaagcaggttttaacaaaaggatgaggccagaactcttccagaaccatcacctttgggaacctgctgtgagagtgctgaggtaccagaagtgtgagaacgagggggcgtgctgggatctttctctctgactatacttagtttgaaatggtgcaggcttagtcttaagcctccaaaggcctggatttgagcagctttagaaatgcaggttctagggcttctcccagccttcagaagccaactaactctgcagatggggctaggactgtgggcttttagcagcccacaggtgatcctaacatatcaggccatggactcaggacctgcccggtgatgctgttgatttctcaaaggtcttccaaaactcaacagagccagaagtagccgcccgctcagcggctcaggtgccagctctgttctgattcaccaggggtccgtcagtagtcattgccacccgcggggcacctccctggccacacgcctgttcccagcaagtgctgaaactcactagaccgtctgcctgtttcgaaatggggaaagccgtgcgtgcgcgttatttatttaagtgcgcctgtgtgcgcgggtgtgggagcacactttgcaaagccacagcgtttctggttttgggtgtacagtcttgtgtgcctggcgagaagaatattttctatttttttaagtcatttcatgtttctgtctggggaaggcaagttagttaagtatcactgatgtgggttgagaccagcactctgtgaaaccttgaaatgagaagtaaaggcagatgaaaagaaa

SEQ ID NO: 686 - DNA, 3828 bp, Homo sapiens
aactgcaacacttcctctgcatctggatatgaagggagccccagaaaagcggaagaatttagacgcacactgggtcgcatagggcatggagctggagaactataaacagcccgtggtgctgagagaggacaactgccgaaggcgccggaggatgaagccgcgcagtgctgcggccagcctgtcctccatggagctcatccccatcgagttcgtgctgcccaccagccagcgcaaatgcaagagccccgaaacggcgctgctgcacgtggccggccacggcaacgtggagcagatgaaggcccaggtgtggctgcgagcgctggagaccagcgtggcggcggacttctaccaccggctgggaccgcatcacttcctcctgctctatcagaagaaggggcagtggtacgagatctacgacaagtaccaggtggtgcagactctggactgcctgcgctactggaaggccacgcaccggagcccgggccagatccacctggtgcagcggcacccgccctccgaggagtcccaagccttccagcggcagctcacggcgctgattggctatgacgtcactgacgtcagcaacgtgcacgacgatgagctggagttcacgcgccgtggcttggtgaccccgcgcatggcggaggtggccagccgcgaccccaagctctacgccatgcacccgtgggtgacgtccaagcccctcccggagtacctgtggaagaagattgccaacaactgcatcttcatcgtcattcaccgcagcaccaccagccagaccattaaggtctcacccgacgacacccccggcgccatcctgcagagcttcttcaccaagatggccaagaagaaatctctgatggatattcccgaaagccaaagcgaacaggattttgtgctgcgcgtctgtggccgggatgagtacctggtgggcgaaacgcccatcaaaaacttccagtgggtgaggcactgcctcaagaacggagaagagattcacgtggtactggacacgcctccagacccggccctagacgaggtgaggaaggaagagtggccactggtggatgactgcacgggagtcaccggctaccatgagcagcttaccatccacggcaaggaccacgagagtgtgttcaccgtgtccctgtgggactgcgaccgcaagttcagggtcaagatcagaggcattgatatccccgtcctgcctcggaacaccgacctcacagtttttgtagaggcaaacatccagcatgggcaacaagtcctttgccaaaggagaaccagccccaaacccttcacagaggaggtgctgtggaatgtgtggcttgagttcagtatcaaaatcaaagacttgcccaaaggggctctactgaacctccagatctactgcggtaaagctccagcactgtccagcaaggcctctgcagagtcccccagttctgagtccaagggcaaagttcagcttctctattatgtgaacctgctgctgatagaccaccgtttcctcctgcgccgtggagaatacgtcctccacatgtggcagatatctgggaagggagaagaccaaggaagcttcaatgctgacaaactcacgtctgcaactaacccagacaaggagaactcaatgtccatctccattcttctggacaattactgccacccgatagccctgcctaagcatcagcccacccctgacccggaaggggaccgggttcgagcagaaatgcccaaccagcttcgcaagcaattggaggcgatcatagccactgatccacttaaccctctcacagcagaggacaaagaattgctctggcattttagatacgaaagccttaagcacccaaaagcatatcctaagctatttagttcagtgaaatggggacagcaagaaattgtggccaaaacataccaattgttggccagaagggaagtctgggatcaaagtgctttggatgttgggttaacaatgcagctcctggactgcaacttctcagatgaaaatgtaagagccattgcagttcagaaactggagagcttggaggacgatgatgttctgcattaccttctacaattggtccaggctgtgaaatttgaaccataccatgatagcgcccttgccagatttctgctgaagcgtggtttaagaaacaaaagaattggtcactttttgttttggttcttgagaagtgagatagcccagtccagacactatcagcagaggttcgctgtgattctggaagcctatctgaggggctgtggcacagccatgctgcacgactttacccaacaagtccaagtaatcgagatgttacaaaaagtcacccttgatattaaatcgctctctgctgaaaagtatgacgtcagttcccaagttatttcacaacttaaacaaaagcttgaaaacctgcagaattctcaactccccgaaagctttagagttccatatgatcctggactgaaagcaggagcgctggcaattgaaaaatgtaaagtaatggcctccaagaaaaaaccactatggcttgagtttaaatgtgccgatcctacagccctatcaaatgaaacaattggaattatctttaaacatggtgatgatctgcgccaagacatgcttattttacagattctacgaatcatggagtctatttgggagactgaatctttggatctatgcctcctgccatatggttgcatttcaactggtgacaaaataggaatgatcgagattgtgaaagacgccacgacaattgccaaaattcagcaaagcacagtgggcaacacgggagcatttaaagatgaagtcctgaatcactggctcaaagaaaaatcccctactgaagaaaagtttcaggcagcagtggagagatttgtttattcctgtgcaggctactgtgtggcaacctttgttcttggaataggcgacagacacaatgacaatattatgatcaccgagacaggaaacctatttcatattgacttcgggcacattcttgggaattacaaaagtttcctgggcattaataaagagagagtgccatttgtgctaacccctgacttcctctttgtgatgggaacttctggaaagaagacaagcccacacttccagaaatttcaggacatctgtgttaaggcttatctagcccttcgtcatcacacaaacctactgatcatcctgttctccatgatgctgatgacaggaatgccccagttaacaagcaaagaagacattgaatatatccgggatgccctcacagtggggaaaaatgaggaggatgctaaaaagtattttcttgatcagatcgaagtttgcagagacaaaggatggactgtgcagtttaattggtttctacatcttgttcttggcatcaaacaaggagagaaacattcagcctaatactttaggctagaatcaaaaacaagttagtgttctatggtttaaattagcatagcaatcatcgaacttggatttcaaatgcaatagacattgtgaaagctggcatttcagaagtatagctcttttcctacctgaactcttccctggagaaaagatgttggcattgctgattgtttggttaagcaatgtccagtgctaggattatttgcaggtttggttttttctcatttgtctgtggcattggagaatattctcggtttaaacagactaatgacttccttattgtccctgatattttgactatcttactattgagtgcttctggaaattctttggaataattgatgacatctattttcatctgggtttagtctcaattttggttatctttgtgttcctcaagctctttaaagaaaaagatgtaatcgttgtaa

SEQ ID NO: 687 - DNA, 667 bp, Homo sapiens
tggcgcgcgcgcacacgggcgcgggttcggcggcggcgcgcgcgtgctctgtcggcctgtgcggcgctgcggcggagcgggccatggcagtggggagggggcgagtgtagtgctgcgcggggcaggcgggaggtgatcgagagaggcagggatgggggcgccggagtggagcggttgcggcggcctgggctgctgactgcgcacttggaatagtagcaggcggcggcggcggaacgccaggcagtgtatgttttaactggaaaaagtcttccatgaaaacgtcacttttaaaaaataagtaatgccatctgttttcctaaaagactgaaatgggggcgaccattcttagggccccgtggttatgaatgtgcttcagtttcataatgcctcctgctatggcagacatccttgacatctgggcggtggattcacagatagcatctgatggctccatacctgtggatttccttttgcccactgggatttatatccagttggaggtacctcgggaagctaccatttcttatattaagcagatgttatggaagcaagttcacaattacccaatgttcaacctccttatggatattgactcctatatgtttgcatgtgtgaatcagactgctgtatatgaggagcttgaagatgaaacacgaagactctgtga

SEQ ID NO: 688 - DNA, 620 bp, Homo sapiens
ggagcgcaacaagagggtctttctagaaaacagtctgcatattctttaatgaattagagttgtgatttcatcttggtgaagcttcctcattccagcactgcgcctttgtgcacatgcaggacctgggttttcggaacgatgttttgaatcatagtttgtgtggccggggagaaccccttagaatacttgggtttctgctttgggacaaccatacatctaattccttaaagtagttttatatgtaaaacttgcaaagaatcagaacaatgcctccacgaccatcatcaggtgaactgtggggcatccacttgatgcccccaagaatcctagtagaatgtttactaccaaatggaatgatagtgactttagaatgcctccgtgaggctacattaataaccataaagcatgaactatttaaagaagcaagaaaataccccctccatcaacttcttcaagatgaatcttcttacattttcgtaagtgttactcaagaagcagaaagggaagaattttttgatgaaacaagacgactttgtgaccttcggctttttcaaccctttttaaaagtaattgaaccagtaggcaaccgtgaagaaaagatcctcaatcgagaaattggt

SEQ ID NO: 689 - DNA, 4658 bp, Homo sapiens
gggctgctgactgcgcacttggaatagtagcaggcggcggcggcggaacgccaggcagggccccgtggttatgaatgtgcttcagtttcataatgcctcctgctatggcagacatccttgacatctgggcggtggattcacagatagcatctgatggctccatacctgtggatttccttttgcccactgggatttatatccagttggaggtacctcgggaagctaccatttcttatattaagcagatgttatggaagcaagttcacaattacccaatgttcaacctccttatggatattgactcctatatgtttgcatgtgtgaatcagactgctgtatatgaggagcttgaagatgaaacacgaagactctgtgatgtcagaccttttcttccagttctcaaattagtgacaagaagttgtgacccaggggaaaaattagactcaaaaattggagtccttataggaaaaggtctgcatgaatttgattccttgaaggatcctgaagtaaatgaatttcgaagaaaaatgcgcaaattcagcgaggaaaaaatcctgtcacttgtgggattgtcttggatggactggctaaaacaaacatatccaccagagcatgaaccatccatccctgaaaacttagaagataaactttatgggggaaagctcatcgtagctgttcattttgaaaactgccaggacgtgtttagctttcaagtgtctcctaatatgaatcctatcaaagtaaatgaattggcaatccaaaaacgtttgactattcatgggaaggaagatgaagttagcccctatgattatgtgttgcaagtcagcgggagagtagaatatgtttttggtgatcatccactaattcagttccagtatatccggaactgtgtgatgaacagagccctgccccattttatacttgtggaatgctgcaagatcaagaaaatgtatgaacaagaaatgattgccatagaggctgccataaatcgaaattcatctaatcttcctcttccattaccaccaaagaaaacacgaattatttctcatgtttgggaaaataacaaccctttccaaattgtcttggttaagggaaataaacttaacacagaggaaactgtaaaagttcatgtcagggctggtctttttcatggtactgagctcctgtgtaaaaccatcgtaagctcagaggtatcagggaaaaatgatcatatttggaatgaaccactggaatttgatattaatatttgtgacttaccaagaatggctcgattatgttttgctgtttatgcagttttggataaagtaaaaacgaagaaatcaacgaaaactattaatccctctaaatatcagaccatcaggaaagctggaaaagtgcattatcctgtagcgtgggtaaatacgatggtttttgactttaaaggacaattgagaactggagacataatattacacagctggtcttcatttcctgatgaactcgaagaaatgttgaatccaatgggaactgttcaaacaaatccatatactgaaaatgcaacagctttgcatgttaaatttccagagaataaaaaacaaccttattattaccctcccttcgataagattattgaaaaggcagctgagattgcaagcagtgatagtgctaatgtgtcaagtcgaggtggaaaaaagtttcttcctgtattgaaagaaatcttggacagggatcccttgtctcaactgtgtgaaaatgaaatggatcttatttggactttgcgacaagactgccgagagattttcccacaatcactgccaaaattactgctgtcaatcaagtggaataaacttgaggatgttgctcagcttcaggcgctgcttcagatttggcctaaactgcccccccgggaggccctagagcttctggatttcaactatccagaccagtacgttcgagaatatgctgtaggctgcctgcgacagatgagtgatgaagaactttctcaatatcttttacaactggtgcaagtgttaaaatatgagccttttcttgattgtgccctctctagattcctattagaaagagcacttggtaatcggaggatagggcagtttctattttggcatcttaggtcagaagtgcacattcctgctgtctcagtacaatttggtgtcatccttgaagcatactgccggggaagtgtggggcacatgaaagtgctttctaagcaggttgaagcactcaataagttaaaaactttaaatagtttaatcaaactgaatgccgtgaagttaaacagagccaaagggaaggaggccatgcatacctgtttaaaacagagtgcttaccgggaagccctctctgacctgcagtcacccctgaacccatgtgttatcctctcagaactctatgttgaaaagtgcaaatacatggattccaaaatgaagcctttgtggctggtatacaataacaaggtatttggtgaggattcagttggagtgatttttaaaaatggtgatgatttacgacaggatatgttgacactccaaatgttgcgcttgatggatttactctggaaagaagctggtttggatcttcggatgttgccttatggctgtttagcaacaggagatcgctctggcctcattgaagttgtgagcacctctgaaacaattgctgacattcagctgaacagtagcaatgtggctgctgcagcagccttcaacaaagatgcccttctgaactggcttaaagaatacaactctggggatgacctggaccgagccattgaggaatttacactgtcctgtgctggctactgtgtagcttcttatgtccttgggattggtgacagacatagtgacaacatcatggtcaaaaaaactggccagctcttccacattgactttggacatattcttggaaatttcaaatctaagtttggcattaaaagggagcgagtgccttttattcttacctatgatttcatccatgtcattcaacaaggaaaaacaggaaatacagaaaagtttggccggttccgccagtgttgtgaggatgcatatctgattttacgacggcatgggaatctcttcatcactctctttgcgctgatgttgactgcagggcttcctgaactcacatcagtcaaagatatacagtatcttaaggactctcttgcattagggaagagtgaagaagaagcactcaaacagtttaagcaaaaatttgatgaggcgctcagggaaagctggactactaaagtgaactggatggcccacacagttcggaaagactacagatcttaacgatcagccttcgctcctaatgtatttgttggtttcatttcattttcattttgcacttgcactaaattgaacatgaccctgttagagatgttataaagggaatgaaatcctggaactcagagttaaattaagaacaaggcatcccacagaacctaatctgaacaatccccgatgattccctctgctttttgaatgcttccaagacttatcatgaaaactgtcaatggataatcatttcctgctgactttgcacgccaaggaatgctactagggattgtttccgtttttgtttgttttttctaatatttggtacttcccagaatggtgtaaatacttcttttcaatgttgtgaccaagtattgtcactcagccaacaacttttccacacctgggggttggtggctgttcttactgtccaaatgaagctaaaaagaaaggcatctttcttcccttttaaaattgtgtaaactgcaaattataatataatttgaatttatgattattttccagaagaaatcttgtaaacctgtggatactcattaattcttttgttaatatttatttccatgatagcatcattccagccagacttgctgaaaatctactggtgaggcaaatataatatatataaatatgctacatatatatttataaaatttctagtgggagttctatataaatgtttctttggtattcttcagcctgtgatttaaagttttacaaaaagcagagctttttcctaagttacttttcagttaggtaactgtgtgatccagttcttccagctgcttctataatgaggcacatattaatacagtttttatatggtatctatgaaagagttcacttcatagagaataatacttgagcaaatgtatccaagaaagcaagcaaatgaaaagaaacctatttatggaataaactccagatctgaaattcagtattttagaaaaatgccagctcttcttactgtatttattaaaacttgtaataatgtgatttttttcaaggatattagttcaaattgaaatggtttcacgccacacggaaatctttaagttatttgttgaggtaccatatatttagggtgctaggggcaagtaatgttaatatgtgcaataggaactactggtttgaatgtgtaaatgggtgatctctctgagtcctggcaacatccagcaaaactactgcttattctccaaagaatattgggagctctcaatcctcggtgatatgggaaagagaactgagtatttgccctatgactgagctttctataggaattttattaaagaatgtttaattttgttgtccttcttaatgttctcagtcaaataaatgagtgagctggtttcggctgctcttggaatg

SEQ ID NO: 690 - DNA, 721 bp, Homo sapiens
tgtagtgctgcgcggggcaggcgggaggtgatcgagagaggcagggatgggggcgccggagtggagcggttgcggcggcctgggctgctgactgcgcacttggaatagtagcaggcggcggcggcggaacgccaggcagtgtatgttttaactggaaaaagtcttccatgaaaacgtcacttttaaaaaataagtaatgccatctgttttcctaaaagactgaaatgggggcgaccattcttagcctttgatctcttgctttgatgctcaaacagaagaatgatacaagactgaggatcttgccaggcaagggccccgtggttatgaatgtgcttcagtttcataatgcctcctgctatggcagacatccttgacatctgggcggtggattcacagatagcatctgatggctccatacctgtggatttccttttgcccactgggatttatatccagttggaggtacctcgggaagctaccatttcttatattaagcagatgttatggaagcaagttcacaattacccaatgttcaacctccttatggatattgactcctatatgtttgcatgtgtgaatcagactgctgtatatgaggagcttgaagatgaaacacgaagactctgtgatgtcagaccttttcttccagttctcaaattagtgacaagaagttgtgacccaggggaaaaattagactcaaaaattggagtccttataggaa

SEQ ID NO: 691 - DNA, 2347 bp, Homo sapiens
atgtcagggctggtctttttcatggtactgagctcctgtgtaaaaccatcgtaagctcagaggtatcagggaaaaatgatcatatttggaatgaaccactggaatttgatattaatatttgtgacttaccaagaatggctcgattatgttttgctgtttatgcagttttggataaagtaaaaacgaagaaatcaacgaaaactattaatccctctaaatatcagaccatcaggaaagctggaaaagtgcattatcctgtagcgtgggtaaatacgatggtttttgactttaaaggacaattgagaactggagacataatattacacagctggtcttcatttcctgatgaactcgaagaaatgttgaatccaatgggaactgttcaaacaaatccatatactgaaaatgcaacagctttgcatgttaaatttccagagaataaaaaacaaccttattattaccctcccttcgataagagtcgaggtggaaaaaagtttcttcctgtattgaaagaaatcttggacagggatcccttgtctcaactgtgtgaaaatgaaatggatcttatttggactttgcgacaagactgccgagagattttcccacaatcactgccaaaattactgctgtcaatcaagtggaataaacttgaggatgttgctcagcttcaggcgctgcttcagatttggcctaaactgcccccccgggaggccctagagcttctggatttcaactatccagaccagtacgttcgagaatatgctgtaggctgcctgcgacagatgagtgatgaagaactttctcaatatcttttacaactggtgcaagtgttaaaatatgagccttttcttgattgtgccctctctagattcctattagaaagagcacttggtaatcggaggatagggcagtttctattttggcatcttaggtcagaagtgcacattcctgctgtctcagtacaatttggtgtcatccttgaagcatactgccggggaagtgtggggcacatgaaagtgctttctaagcaggttgaagcactcaataagttaaaaactttaaatagtttaatcaaactgaatgccgtgaagttaaacagagccaaagggaaggaggccatgcatacctgtttaaaacagagtgcttaccgggaagccctctctgacctgcagtcacccctgaacccatgtgttatcctctcagaactctatgttgaaaagtgcaaatacatggattccaaaatgaagcctttgtggctggtatacaataacaaggtatttggtgaggattcagttggagtgatttttaaaaatggtgatgatttacgacaggatatgttgacactccaaatgttgcgcttgatggatttactctggaaagaagctggtttggatcttcggatgttgccttatggctgtttagcaacaggagatcgctctggcctcattgaagttgtgagcacctctgaaacaattgctgacattcagctgaacagtagcaatgtggctgctgcagcagccttcaacaaagatgcccttctgaactggcttaaagaatacaactctggggatgacctggaccgagccattgaggaatttacactgtcctgtgctggctactgtgtagcttcttatgtccttgggattggtgacagacatagtgacaacatcatggtcaaaaaaactggccagctcttccacattgactttggacatattcttggaaatttcaaatctaagtttggcattaaaagggagcgagtgccttttattcttacctatgatttcatccatgtcattcaacaaggaaaaacaggaaatacagaaaagtttggccggttccgccagtgttgtgaggatgcatatctgattttacgacggcatgggaatctcttcatcactctctttgcgctgatgttgactgcagggcttcctgaactcacatcagtcaaagatatacagtatcttaaggactctcttgcattagggaagagtgaagaagaagcactcaaacagtttaagcaaaaatttgatgaggcgctcagggaaagctggactactaaagtgaactggatggcccacacagttcggaaagactacagatcttaacgatcagccttcgctcctaatgtatttgttggtttcatttcattttcattttgcacttgcactaaattgaacatgaccctgttagagatgttataaagggaatgaaatcctggaactcagagttaaattaagaacaaggcatcccacagaacctaatctgaacaatccccgatgattccctctgctttttgaatgcttccaagacttatcatgaaaactgtcaatggataatcatttcc

SEQ ID NO: 692 - DNA, 5197 bp, Homo sapiens
gcatctggatatgaagggagccccagaaaagcggaagaatttagacgcacactgggtaggtttgaatttgttttgttttcaaaaattaaacaaatgatccttcagcatcatcgcctccgctgctttatcaggtcgcatagggcatggagctggagaactataaacagcccgtggtgctgagagaggacaactgccgaaggcgccggaggatgaagccgcgcagtgctgcggccagcctgtcctccatggagctcatccccatcgagttcgtgctgcccaccagccagcgcaaatgcaagagccccgaaacggcgctgctgcacgtggccggccacggcaacgtggagcagatgaaggcccaggtgtggctgcgagcgctggagaccagcgtggcggcggacttctaccaccggctgggaccgcatcacttcctcctgctctatcagaagaaggggcagtggtacgagatctacgacaagtaccaggtggtgcagactctggactgcctgcgctactggaaggccacgcaccggagcccgggccagatccacctggtgcagcggcacccgccctccgaggagtcccaagccttccagcggcagctcacggcgctgattggctatgacgtcactgacgtcagcaacgtgcacgacgatgagctggagttcacgcgccgtggcttggtgaccccgcgcatggcggaggtggccagccgcgaccccaagctctacgccatgcacccgtgggtgacgtccaagcccctcccggagtacctgtggaagaagattgccaacaactgcatcttcatcgtcattcaccgcagcaccaccagccagaccattaaggtctcacccgacgacacccccggcgccatcctgcagagcttcttcaccaagatggccaagaagaaatctctgatggatattcccgaaagccaaagcgaacaggattttgtgctgcgcgtctgtggccgggatgagtacctggtgggcgaaacgcccatcaaaaacttccagtgggtgaggcactgcctcaagaacggagaagagattcacgtggtactggacacgcctccagacccggccctagacgaggtgaggaaggaagagtggccactggtggatgactgcacgggagtcaccggctaccatgagcagcttaccatccacggcaaggaccacgagagtgtgttcaccgtgtccctgtgggactgcgaccgcaagttcagggtcaagatcagaggcattgatatccccgtcctgcctcggaacaccgacctcacagtttttgtagaggcaaacatccagcatgggcaacaagtcctttgccaaaggagaaccagccccaaacccttcacagaggaggtgctgtggaatgtgtggcttgagttcagtatcaaaatcaaagacttgcccaaaggggctctactgaacctccagatctactgcggtaaagctccagcactgtccagcaaggcctctgcagagtcccccagttctgagtccaagggcaaagttcagcttctctattatgtgaacctgctgctgatagaccaccgtttcctcctgcgccgtggagaatacgtcctccacatgtggcagatatctgggaagggagaagaccaaggaagcttcaatgctgacaaactcacgtctgcaactaacccagacaaggagaactcaatgtccatctccattcttctggacaattactgccacccgatagccctgcctaagcatcagcccacccctgacccggaaggggaccgggttcgagcagaaatgcccaaccagcttcgcaagcaattggaggcgatcatagccactgatccacttaaccctctcacagcagaggacaaagaattgctctggcattttagatacgaaagccttaagcacccaaaagcatatcctaagctatttagttcagtgaaatggggacagcaagaaattgtggccaaaacataccaattgttggccagaagggaagtctgggatcaaagtgctttggatgttgggttaacaatgcagctcctggactgcaacttctcagatgaaaatgtaagagccattgcagttcagaaactggagagcttggaggacgatgatgttctgcattaccttctacaattggtccaggctgtgaaatttgaaccataccatgatagcgcccttgccagatttctgctgaagcgtggtttaagaaacaaaagaattggtcactttttgttttggttcttgagaagtgagatagcccagtccagacactatcagcagaggttcgctgtgattctggaagcctatctgaggggctgtggcacagccatgctgcacgactttacccaacaagtccaagtaatcgagatgttacaaaaagtcacccttgatattaaatcgctctctgctgaaaagtatgacgtcagttcccaagttatttcacaacttaaacaaaagcttgaaaacctgcagaattctcaactccccgaaagctttagagttccatatgatcctggactgaaagcaggagcgctggcaattgaaaaatgtaaagtaatggcctccaagaaaaaaccactatggcttgagtttaaatgtgccgatcctacagccctatcaaatgaaacaattggaattatctttaaacatggtgatgatctgcgccaagacatgcttattttacagattctacgaatcatggagtctatttgggagactgaatctttggatctatgcctcctgccatatggttgcatttcaactggtgacaaaataggaatgatcgagattgtgaaagacgccacgacaattgccaaaattcagcaaagcacagtgggcaacacgggagcatttaaagatgaagtcctgaatcactggctcaaagaaaaatcccctactgaagaaaagtttcaggcagcagtggagagatttgtttattcctgtgcaggctactgtgtggcaacctttgttcttggaataggcgacagacacaatgacaatattatgatcaccgagacaggaaacctatttcatattgacttcgggcacattcttgggaattacaaaagtttcctgggcattaataaagagagagtgccatttgtgctaacccctgacttcctctttgtgatgggaacttctggaaagaagacaagcccacacttccagaaatttcaggacatctgtgttaaggcttatctagcccttcgtcatcacacaaacctactgatcatcctgttctccatgatgctgatgacaggaatgccccagttaacaagcaaagaagacattgaatatatccgggatgccctcacagtggggaaaaatgaggaggatgctaaaaagtattttcttgatcagatcgaagtttgcagagacaaaggatggactgtgcagtttaattggtttctacatcttgttcttggcatcaaacaaggagagaaacattcagcctaatactttaggctagaatcaaaaacaagttagtgttctatggtttaaattagcatagcaatcatcgaacttggatttcaaatgcaatagacattgtgaaagctggcatttcagaagtatagctcttttcctacctgaactcttccctggagaaaagatgttggcattgctgattgtttggttaagcaatgtccagtgctaggattatttgcaggtttggttttttctcatttgtctgtggcattggagaatattctcggtttaaacagactaatgacttccttattgtccctgatattttgactatcttactattgagtgcttctggaaattctttggaataattgatgacatctattttcatctgggtttagtctcaattttggttatctttgtgttcctcaagctctttaaagaaaaagatgtaatcgttgtaacctttgtctcattccttaaatgatgcttccaaacatctccttagtgtctgcaggtgttagtggtgtgctaaaagcaaggaaagcgagttagtcttttcagtgtcttttgcaattcaattcttttgtcatgtataactgagacacacaaacacagcaggagaaatctaaaccgttgtgccttgaccttcctctgctggtcttgttccagggttatgaatatgaaaaaatagagatgagactttttgtgtcaactctgtccacaagagtgagttatctagtatgattagtatagctttctccagcatggcagcaggaagtaactacagggcctcttttatgcctgacatttcttcccttcctttttccctgcctccctttttcatcaattgcgatgctcccacaactctttacagacttgtgaaatcttcaagaacacctttactctataactcaaaaattagttgaaaaataattacttctcaaggattattagaatcttaggtacttatttgtaaagatgtttagtgacttttttttcaagtatcttattaaaggaggcattctagaaaatatgaattagtttccaaatgccttaattttaaactttggcctgaacagttttttctttttcttaatggaagaagatatttaatatcttaaaaatattccaagttaggaagaacactacttgccttatccatttcccatttaaaggacttttaaactttgacacatccttcagatttcctgaaaataattgaaatatcttactttaaaaatattttcatctctgaaatatctcgttatttattggaggtattgtttaaccttagagagaccattaaattatttataaaatattttgtaattacctgtagctaatacattacatagaaaaaaactatgttaacagtgtctctgtttaagtataatcagatataaatatatacttaattttttaattttaaaaatagatacctgtttgactttgaggtagtccagaccttttctttttttttttttttttaatgtgtgcaaaagcccaaaggttcctaagcctggctgcaaagaagaatcaacagggacactttttaaaaacactcttatcagcctgggcaacacagtgagactccatctcttaaaaaaaaaattagctgggtatagtggtatgtgcctgtagtcccaggtactcaggaggctgaggcaggaggattgcctgagcccaggaggtggaaactgcagagagtcatgatcatgtccttacactccagcctggataacagagcgagaccctgtctcaaaaaaataaaa

SEQ ID NO: 693 - DNA, 5483 bp, Homo sapiens
ctcgcgcccagcgcagtcgctccgagcggccgcgagcagagccgcccagccctgccagctgcgccgggacgataaggagtcaggccagggcgggatgacactcattgattctaaagcatctttaatctgccaggcggagggggctttgctggtctttcttggactattccagagaggacaactgtcatctgggaagtaacaacgcaggatgccccctggggtggactgccccatggaattctggaccaaggaggagaatcagagcgttgtggttgacttcctgctgcccacaggggtctacctgaacttccctgtgtcccgcaatgccaacctcagcaccatcaagcagctgctgtggcaccgcgcccagtatgagccgctcttccacatgctcagtggccccgaggcctatgtgttcacctgcatcaaccagacagcggagcagcaagagctggaggacgagcaacggcgtctgtgtgacgtgcagcccttcctgcccgtcctgcgcctggtggcccgtgagggcgaccgcgtgaagaagctcatcaactcacagatcagcctcctcatcggcaaaggcctccacgagtttgactccttgtgcgacccagaagtgaacgactttcgcgccaagatgtgccaattctgcgaggaggcggccgcccgccggcagcagctgggctgggaggcctggctgcagtacagtttccccctgcagctggagccctcggctcaaacctgggggcctggtaccctgcggctcccgaaccgggcccttctggtcaacgttaagtttgagggcagcgaggagagcttcaccttccaggtgtccaccaaggacgtgccgctggcgctgatggcctgtgccctgcggaagaaggccacagtgttccggcagccgctggtggagcagccggaagactacacgctgcaggtgaacggcaggcatgagtacctgtatggcagctacccgctctgccagttccaggtccagaaaccgcgtgccaaaccacctcccattcctgcgaagaagccttcctctgtgtccctgtggtccctggagcagccgttccgcatcgagctcatccagggcagcaaagtgaacgccgacgagcggatgaagctggtggtgcaggccgggcttttccacggcaacgagatgctgtgcaagacggtgtccagctcggaggtgagcgtgtgctcggagcccgtgtggaagcagcggctggagttcgacatcaacatctgcgacctgccccgcatggcccgtctctgctttgcgctgtacgccgtgatcgagaaagccaagaaggctcgctccaccaagaagaagtccaagaaggcggactgccccattgcctgggccaacctcatgctgtttgactacaaggaccagcttaagaccggggaacgctgcctctacatgtggccctccgtcccagatgagaagggcgagctgctgaaccccacgggcactgtgcgcagtaaccccaacacggatagcgccgctgccctgctcatctgcctgcccgaggtggccccgcaccccgtgtactaccccgccctggagaagctgccaggagggatgctcttggcatctcgtgagtggaggccagagctgctgtggatgcgcctccatgcagaggacagcgccccctcaaggatgattggggtggcaatgcccggcctgggggtcctgcccgggctggtccaggcccctggggacgctgagtgcagccgtttgttgcagatcttggagctggggcgacacagcgagtgtgtgcatgtcaccgaggaggagcagctgcagctgcgggaaatcctggagcggcgggggtctggggagctgtatgagcacgagaaggacctggtgtggaagctgcggcatgaagtccaggagcacttcccggaggcgctagcccggctgctgctggtcaccaagtggaacaagcatgaggatgtggcccagatgctctacctgctgtgctcctggccggagctgcccgtcctgagcgccctggagctgctagacttcagcttccccgattgccacgtaggctccttcgccatcaagtcgctgcggaaactgacggacgatgagctgttccagtacctgctgcagctggtgcaggtgctcaagtacgagtcctacctggactgcgagctgaccaaattcctgctggaccgggccctggccaaccgcaagatcggccacttccttttctggcacctccgctccgagatgcacgtgccgtcggtggccctgcgcttcggcctcatcctggaggcctactgcaggggcagcacccaccacatgaaggtgctgatgaagcagggggaagcactgagcaaactgaaggccctgaatgacttcgtcaagctgagctctcagaagacccccaagccccagaccaaggagctgatgcacttgtgcatgcggcaggaggcctacctagaggccctctcccacctgcagtccccactcgaccccagcaccctgctggctgaagtctgcgtggagcagtgcaccttcatggactccaagatgaagcccctgtggatcatgtacagcaacgaggaggcaggcagcggcggcagcgtgggcatcatctttaagaacggggatgacctccggcaggacatgctgaccctgcagatgatccagctcatggacgtcctgtggaagcaggaggggctggacctgaggatgaccccctatggctgcctccccaccggggaccgcacaggcctcattgaggtggtactccgttcagacaccatcgccaacatccaactcaacaagagcaacatggcagccacagccgccttcaacaaggatgccctgctcaactggctgaagtccaagaacccgggggaggccctggatcgagccattgaggagttcaccctctcctgtgctggctattgtgtggccacatatgtgctgggcattggcgatcggcacagcgacaacatcatgatccgagagagtgggcagctgttccacattgattttggccactttctggggaatttcaagaccaagtttggaatcaaccgcgagcgtgtcccattcatcctcacctacgactttgtccatgtgattcagcaggggaagactaataatagtgagaaatttgaacggttccggggctactgtgaaagggcctacaccatcctgcggcgccacgggcttctcttcctccacctctttgccctgatgcgggcggcaggcctgcctgagctcagctgctccaaagacatccagtatctcaaggactccctggcactggggaaaacagaggaggaggcactgaagcacttccgagtgaagtttaacgaagccctccgtgagagctggaaaaccaaagtgaactggctggcccacaacgtgtccaaagacaacaggcagtagtggctcctcccagccctgggcccaagaggaggcggctgcgggtcgtggggaccaagcacattggtcctaaaggggctgaagagcctgaactgcacctaacgggaaagaaccgacatggctgccttttgtttacactggttatttatttatgacttgaaatagtttaaggagctaaacagccataaacggaaacgcctccttcatgcagcggcggtgctgggccccccgaggctgcacctggctctcggctgaggattgtcaccccaagtcttccagctggtggatctgggcccagcaaagactgttctcctcccgagggaaccttcttcccaggcctcccgccagactgcctgggtcctggcgcctggcggtcacctggtgcctactgtccgacaggatgccttgatcctcgtgcgacccaccctgtgtatcctccctagactgagttctggcagctccccgaggcagccggggtaccctctagattcagggatgcttgctctccacttttcaagtgggtcttgggtacgagaattccctcatctttctctactgtaaagtgattttgtttgcaggtaagaaaataatagatgactcaccacacctctacggctggggagatcaggcccagccccataaaggagaatctacgctggtcctcaggacgtgttaaagagatctgggcctcatgtagctcaccccggtcacgcatgaaggcaaaagcaggtcagaagcgaatactctgccattatctcaaaaatcttttttttttttttgagatggggtcttcctctgttgcccaggctggagtgcagtggtgcaatcttggctcactgtaacctccgcctcccaggttcaagtgattcttctgcctcagcctcctgagtagctgggattacaggtgtgcaccaccgtacccagctaatttttgtattttagtagagacgggggtttcaccatgttggctgggctggtctcgaactcctgacctcaggtgatccacccgcctgagcctcccaaagtgctgggattacaggcatgagccaccgcgcccggcccactctgccattgtctaagccacctctgaaagcaggttttaacaaaaggatgaggccagaactcttccagaaccatcacctttgggaacctgctgtgagagtgctgaggtaccagaagtgtgagaacgagggggcgtgctgggatctttctctctgactatacttagtttgaaatggtgcaggcttagtcttaagcctccaaaggcctggatttgagcagctttagaaatgcaggttctagggcttctcccagccttcagaagccaactaactctgcagatggggctaggactgtgggcttttagcagcccacaggtgatcctaacatatcaggccatggactcaggacctgcccggtgatgctgttgatttctcaaaggtcttccaaaactcaacagagccagaagtagccgcccgctcagcggctcaggtgccagctctgttctgattcaccaggggtccgtcagtagtcattgccacccgcggggcacctccctggccacacgcctgttcccagcaagtgctgaaactcactagaccgtctgcctgtttcgaaatggggaaagccgtgcgtgcgcgttatttatttaagtgcgcctgtgtgcgcgggtgtgggagcacactttgcaaagccacagcgtttctggttttgggtgtacagtcttgtgtgcctggcgagaagaatattttctatttttttaagtcatttcatgtttctgtctggggaaggcaagttagttaagtatcactgatgtgggttgagaccagcactctgtgaaaccttgaaatgagaagtaaaggcagatgaaaagaaagaaaaagcctttttatgttcttttatgttctcggctcaaaaagaaacaagggagtgtaggtttaaaaccaaaacaggagagaagacaaaccccgctccggctggagttagttagaaccagaactttattgtagcggatacactttctgacctatcatgagtatacacatctgcgaagggaaaccgcgcggcgaca

SEQ ID NO: 694 - DNA, 1458 bp, Homo sapiens
tcttaacactttcacacgctccatcgcaacagcctgcagtcatgggctttattgtcctgtttgctggacatgatacctgagtcctcagagctggtggtgcaggccgggcttttccacggcaacgagatgctgtgcaagacggtgtccagctcggaggtgagcgtgtgctcggagcccgtgtggaagcagcggctggagttcgacatcaacatctgcgacctgccccgcatggcccgtctctgctttgcgctgtacgccgtgatcgagaaagccaagaaggctcgctccaccaagaagaagtccaagaaggcggactgccccattgcctgggccaacctcatgctgtttgactacaaggaccagcttaagaccggggaacgctgcctctacatgtggccctccgtcccagatgagaagggcgagctgctgaaccccacgggcactgtgcgcagtaaccccaacacggatagcgccgctgccctgctcatctgcctgcccgaggtggccccgcaccccgtgtactaccccgccctggagaagatcttggagctggggcgacacagcgagtgtgtgcatgtcaccgaggaggagcagctgcagctgcgggaaatcctggagcggcgggggtctggggagctgtatgagcacgagaaggacctggtgtggaagctgcggcatgaagtccaggagcacttcccggaggcgctagcccggctgctgctggtcaccaagtggaacaagcatgaggatgtggcccagatgctctacctgctgtgctcctggccggagctgcccgtcctgagcgccctggagctgctagacttcagcttccccgattgccacgtaggctccttcgccatcaagtcgctgcggaaactgacggacgatgagctgttccagtacctgctgcagctggtgcaggtgctcaagtacgagtcctacctggactgcgagctgaccaaattcctgctggaccgggccctggccaaccgcaagatcggccacttccttttctggcacctccggtagcgggacttgccccagccgttctgtgggaatcccagcccctgagtctccctggaaggccactggggacgtttccagcaggcctgggtgtcctggcctcgctaggtcctgctgggcgggaggggctgcgtggtgctgcctggtgaggctcagccctcccttcaccttccagctccgagatgcacgtgccgtcggtggccctgcgcttcggcctcatcctggaggcctactgcaggggcagcacccaccacatgaaggtgctgatgaagcagggggaagcactgagcaaactgaaggccctgaatgacttcgtcaagctgagctctcagaagacccccaagccccagaccaaggagctgatgcacttgtgcatgcggcaggaggcctacctagaggccctctcccacctgcagtccccactcgaccccagca

SEQ ID NO: 695 - DNA, 3181 bp, Homo sapiens
caggaaagctggaaaagtgcattatcctgtagcgtgggtaaatacgatggtttttgactttaaaggacaattgagaactggagacataatattacacagctggtcttcatttcctgattattgaaaaggcagctgagattgcaagcagtgatagtgctaatgtgtcaagtcgaggtggaaaaaagtttcttcctgtattgaaagaaatcttggacagggatcccttgtctcaactgtgtgaaaatgaaatggatcttatttggactttgcgacaagactgccgagagattttcccacaatcactgccaaaattactgctgtcaatcaagtggaataaacttgaggatgttgctcagcttcaggcgctgcttcagatttggcctaaactgcccccccgggaggccctagagcttctggatttcaactatccagaccagtacgttcgagaatatgctgtaggctgcctgcgacagatgagtgatgaagaactttctcaatatcttttacaactggtgcaagtgttaaaatatgagccttttcttgattgtgccctctctagattcctattagaaagagcacttggtaatcggaggatagggcagtttctattttggcatcttaggtcagaagtgcacattcctgctgtctcagtacaatttggtgtcatccttgaagcatactgccggggaagtgtggggcacatgaaagtgctttctaagcaggttgaagcactcaataagttaaaaactttaaatagtttaatcaaactgaatgccgtgaagttaaacagagccaaagggaaggaggccatgcatacctgtttaaaacagagtgcttaccgggaagccctctctgacctgcagtcacccctgaacccatgtgttatcctctcagaactctatgttgaaaagtgcaaatacatggattccaaaatgaagcctttgtggctggtatacaataacaaggtatttggtgaggattcagttggagtgatttttaaaaatggtgatgtttgttttcccttagatttacgacaggatatgttgacactccaaatgttgcgcttgatggatttactctggaaagaagctggtttggatcttcggatgttgccttatggctgtttagcaacaggagatcgctctggcctcattgaagttgtgagcacctctgaaacaattgctgacattcagctgaacagtagcaatgtggctgctgcagcagccttcaacaaagatgcccttctgaactggcttaaagaatacaactctggggatgacctggaccgagccattgaggaatttacactgtcctgtgctggctactgtgtagcttcttatgtccttgggattggtgacagacatagtgacaacatcatggtcaaaaaaactggccagctcttccacattgactttggacatattcttggaaatttcaaatctaagtttggcattaaaagggagcgagtgccttttattcttacctatgatttcatccatgtcattcaacaaggaaaaacaggaaatacagaaaagtttggccggttccgccagtgttgtgaggatgcatatctgattttacgacggcatgggaatctcttcatcactctctttgcgctgatgttgactgcagggcttcctgaactcacatcagtcaaagatatacagtatcttaaggactctcttgcattagggaagagtgaagaagaagcactcaaacagtttaagcaaaaatttgatgaggcgctcagggaaagctggactactaaagtgaactggatggcccacacagttcggaaagactacagatcttaacgatcagccttcgctcctaatgtatttgttggtttcatttcattttcattttgcacttgcactaaattgaacatgaccctgttagagatgttataaagggaatgaaatcctggaactcagagttaaattaagaacaaggcatcccacagaacctaatctgaacaatccccgatgattccctctgctttttgaatgcttccaagacttatcatgaaaactgtcaatggataatcatttcctgctgactttgcacgccaaggaatgctactagggattgtttccgtttttgtttgttttttctaatatttggtacttcccagaatggtgtaaatacttcttttcaatgttgtgaccaagtattgtcactcagccaacaacttttccacacctgggggttggtggctgttcttactgtccaaatgaagctaaaaagaaaggcatctttcttcccttttaaaattgtgtaaactgcaaattataatataatttgaatttatgattattttccagaagaaatcttgtaaacctgtggatactcattaattcttttgttaatatttatttccatgatagcatcattccagccagacttgctgaaaatctactggtgaggcaaatataatatatataaatatgctacatatatatttataaaatttctagtgggagttctatataaatgtttctttggtattcttcagcctgtgatttaaagttttacaaaaagcagagctttttcctaagttacttttcagttaggtaactgtgtgatccagttcttccagctgcttctataatgaggcacatattaatacagtttttatatggtatctatgaaagagttcacttcatagagaataatacttgagcaaatgtatccaagaaagcaagcaaatgaaaagaaacctatttatggaataaactccagatctgaaattcagtattttagaaaaatgccagctcttcttactgtatttattaaaacttgtaataatgtgatttttttcaaggatattagttcaaattgaaatggtttcacgccacacggaaatctttaagttatttgttgaggtaccatatatttagggtgctaggggcaagtaatgttaatatgtgcaataggaactactggtttgaatgtgtaaatgggtgatctctctgagtcctggcaacatccagcaaaactactgcttattctccaaagaatattgggagctctcaatcctcggtgatatgggaaagagaactgagtatttgccctatgactgagctttctataggaattttattaaagaatgtttaattttgttgtccttcttaatgttctcagtcaaataaatgagtgagctggtttcggctgctcttgg

SEQ ID NO: 696 - DNA, 2671 bp, Homo sapiens
gatcttgggctgaggttcccgggcgggcgggcgcggagagacgcgggaagcaggggctgggcgggggtcgcggcgccgcagctagcgcagccagcccgagggccgccgccgccgccgcccagcgcgctccggggccgccggccgcagccagcacccgccgcgccgcagctccgggaccggccccggccgccgccgccgcgatgggcaacgccgccgccgccaagaagggcagcgagcaggagagcgtgaaagaattcttagccaaagccaaagaagattttcttaaaaaatgggaaagtcccgctcagaacacagcccacttggatcagtttgaacgaatcaagaccctcggcacgggctccttcgggcgggtgatgctggtgaaacacaaggagaccgggaaccactatgccatgaagatcctcgacaaacagaaggtggtgaaactgaaacagatcgaacacaccctgaatgaaaagcgcatcctgcaagctgtcaactttccgttcctcgtcaaactcgagttctccttcaaggacaactcaaacttatacatggtcatggagtacgtgcccggcggggagatgttctcacacctacggcggatcggaaggttcagtgagccccatgcccgtttctacgcggcccagatcgtcctgacctttgagtatctgcactcgctggatctcatctacagggacctgaagccggagaatctgctcattgaccagcagggctacattcaggtgacagacttcggtttcgccaagcgcgtgaagggccgcacttggaccttgtgcggcacccctgagtacctggcccctgagattatcctgagcaaaggctacaacaaggccgtggactggtgggccctgggggttcttatctatgaaatggccgctggctacccgcccttcttcgcagaccagcccatccagatctatgagaagatcgtctctgggaaggtgcgcttcccttcccacttcagctctgacttgaaggacctgctgcggaacctcctgcaggtagatctcaccaagcgctttgggaacctcaagaatggggtcaacgatatcaagaaccacaagtggtttgccacaactgactggattgccatctaccagaggaaggtggaagctcccttcataccaaagtttaaaggccctggggatacgagtaactttgacgactatgaggaagaagaaatccgggtctccatcaatgagaagtgtggcaaggagttttctgagttttaggggcatgcctgtgcccccatgggttttcttttttcttttttcttttttttggtcgggggggtgggagggttggattgaacagccagagggccccagagttccttgcatctaatttcacccccaccccaccctccagggttagggggagcaggaagcccagataatcagagggacagaaacaccagctgctccccctcatccccttcaccctcctgccccctctcccacttttcccttcctctttccccacagccccccagcccctcagccctcccagcccacttctgcctgttttaaacgagtttctcaactccagtcagaccaggtcttgctggtgtatccagggacagggtatggaaagaggggctcacgcttaactccagcccccacccacacccccatcccacccaaccacaggccccacttgctaagggcaaatgaacgaagcgccaaccttcctttcggagtaatcctgcctgggaaggagagatttttagtgacatgttcagtgggttgcttgctagaatttttttaaaaaaacaacaatttaaaatcttatttaagttccaccagtgcctccctccctccttcctctactcccacccctcccatgtccccccattcctcaaatccattttaaagagaagcagactgactttggaaagggaggcgctggggtttgaacctccccgctgctaatctcccctgggcccctccccggggaatcctctctgccaatcctgcgagggtctaggcccctttaggaagcctccgctctctttttccccaacagacctgtcttcacccttgggctttgaaagccagacaaagcagctgcccctctccctgccaaagaggagtcatcccccaaaaagacagagggggagccccaagcccaagtctttcctcccagcagcgtttccccccaactccttaattttattctccgctagattttaacgtccagccttccctcagctgagtggggagggcatccctgcaaaagggaacagaagaggccaagtccccccaagccacggcccggggttcaaggctagagctgctggggaggggctgcctgttttactcacccaccagcttccgcctcccccatcctgggcgcccctcctccagcttagctgtcagctgtccatcacctctcccccactttctcatttgtgcttttttctctcgtaatagaaaagtggggagccgctggggagccaccccattcatccccgtatttccccctctcataacttctccccatcccaggaggagttctcaggcctggggtggggccccgggtgggtgcgggggcgattcaacctgtgtgctgcgaaggacgagacttcctcttgaacagtgtgctgttgtaaacatatttgaaaactattaccaataaagttttgttt

SEQ ID NO: 697 - DNA, 2472 bp, Homo sapiens
ggtgccctgagaacaggactgagtgatggcttccaactccagcgatgtgaaagaattcttagccaaagccaaagaagattttcttaaaaaatgggaaagtcccgctcagaacacagcccacttggatcagtttgaacgaatcaagaccctcggcacgggctccttcgggcgggtgatgctggtgaaacacaaggagaccgggaaccactatgccatgaagatcctcgacaaacagaaggtggtgaaactgaaacagatcgaacacaccctgaatgaaaagcgcatcctgcaagctgtcaactttccgttcctcgtcaaactcgagttctccttcaaggacaactcaaacttatacatggtcatggagtacgtgcccggcggggagatgttctcacacctacggcggatcggaaggttcagtgagccccatgcccgtttctacgcggcccagatcgtcctgacctttgagtatctgcactcgctggatctcatctacagggacctgaagccggagaatctgctcattgaccagcagggctacattcaggtgacagacttcggtttcgccaagcgcgtgaagggccgcacttggaccttgtgcggcacccctgagtacctggcccctgagattatcctgagcaaaggctacaacaaggccgtggactggtgggccctgggggttcttatctatgaaatggccgctggctacccgcccttcttcgcagaccagcccatccagatctatgagaagatcgtctctgggaaggtgcgcttcccttcccacttcagctctgacttgaaggacctgctgcggaacctcctgcaggtagatctcaccaagcgctttgggaacctcaagaatggggtcaacgatatcaagaaccacaagtggtttgccacaactgactggattgccatctaccagaggaaggtggaagctcccttcataccaaagtttaaaggccctggggatacgagtaactttgacgactatgaggaagaagaaatccgggtctccatcaatgagaagtgtggcaaggagttttctgagttttaggggcatgcctgtgcccccatgggttttcttttttcttttttcttttttttggtcgggggggtgggagggttggattgaacagccagagggccccagagttccttgcatctaatttcacccccaccccaccctccagggttagggggagcaggaagcccagataatcagagggacagaaacaccagctgctccccctcatccccttcaccctcctgccccctctcccacttttcccttcctctttccccacagccccccagcccctcagccctcccagcccacttctgcctgttttaaacgagtttctcaactccagtcagaccaggtcttgctggtgtatccagggacagggtatggaaagaggggctcacgcttaactccagcccccacccacacccccatcccacccaaccacaggccccacttgctaagggcaaatgaacgaagcgccaaccttcctttcggagtaatcctgcctgggaaggagagatttttagtgacatgttcagtgggttgcttgctagaatttttttaaaaaaacaacaatttaaaatcttatttaagttccaccagtgcctccctccctccttcctctactcccacccctcccatgtccccccattcctcaaatccattttaaagagaagcagactgactttggaaagggaggcgctggggtttgaacctccccgctgctaatctcccctgggcccctccccggggaatcctctctgccaatcctgcgagggtctaggcccctttaggaagcctccgctctctttttccccaacagacctgtcttcacccttgggctttgaaagccagacaaagcagctgcccctctccctgccaaagaggagtcatcccccaaaaagacagagggggagccccaagcccaagtctttcctcccagcagcgtttccccccaactccttaattttattctccgctagattttaacgtccagccttccctcagctgagtggggagggcatccctgcaaaagggaacagaagaggccaagtccccccaagccacggcccggggttcaaggctagagctgctggggaggggctgcctgttttactcacccaccagcttccgcctcccccatcctgggcgcccctcctccagcttagctgtcagctgtccatcacctctcccccactttctcatttgtgcttttttctctcgtaatagaaaagtggggagccgctggggagccaccccattcatccccgtatttccccctctcataacttctccccatcccaggaggagttctcaggcctggggtggggccccgggtgggtgcgggggcgattcaacctgtgtgctgcgaaggacgagacttcctcttgaacagtgtgctgttgtaaacatatttgaaaactattaccaataaagttttgttt

SEQ ID NO: 698 - DNA, 1278 bp, Homo sapiens
attctgctgtttgctccttgccaggttcaacatgggattgtcacgcaaatcatcagatgcatctgcttgctcctcttcagaaatatctgattttgtgaaagagtttctagccaaagccaaagaagactttttgaaaaaatgggagaatccaactcagaataatgccggacttgaagattttgaaaggaaaaaaacccttggaacaggttcatttggaagagtcatgttggtaaaacacaaagccactgaacagtattatgccatgaagatcttagataagcagaaggttgttaaactgaagcaaatagagcatactttgaatgagaaaagaatattacaggcagtgaattttcctttccttgttcgactggagtatgcttttaaggataattctaatttatacatggttatggaatatgtccctgggggtgaaatgttttcacatctaagaagaattggaaggttcagtgagccccatgcacggttctatgcagctcagatagtgctaacattcgagtacctccattcactagacctcatctacagagatctaaaacctgaaaatctcttaattgaccatcaaggctatatccaggtcacagactttgggtttgccaaaagagttaaaggcagaacttggacattatgtggaactccagagtatttggctccagaaataattctcagcaagggctacaataaggcagtggattggtgggcattaggagtgctaatctatgaaatggcagctggctatcccccattctttgcagaccaaccaattcagatttatgaaaagattgtttctggaaaggtccgattcccatcccacttcagttcagatctcaaggaccttctacggaacctgctgcaggtggatttgaccaagagatttggaaatctaaagaatggtgtcagtgatataaaaactcacaagtggtttgccacgacagattggattgctatttaccagaggaaggttgaagctccattcataccaaagtttagaggctctggagataccagcaactttgatgactatgaagaagaagatatccgtgtctctataacagaaaaatgtgcaaaagaatttggtgaattttaaagaggaacaagatgacatctgagctcacactcagtgtttgcactctgttgagagataaggtagagctgagaccgtccttgttgaagcagttacctagttccttcattccaacgactgagtgaggtctttattgccatcatcccgtgtgcgcactctgcatccacctatgtaac

SEQ ID NO: 699 - DNA, 1914 bp, Homo sapiens
ccattttgagttgttctagtggtatatgaaggaggctgggataactagcttgaaagaaattcagtctagttatagacatctttggcattaatctgatgtttactagtgatatctcatgctaggcagttatgctttgcttctaggggcttctctttttaaaacaaaagaaagctcttttcgttttctgtgtgctgcatgctccagtgtgtgtgtttacaccatcggttcttctccctctagagattagcataactccctttgctgttggattgttattttgagcaatatgttttggaaaggttggttttcatcatgagtgcacgcaaatcatcagatgcatctgcttgctcctcttcagaaatatctgattcctttgtgaaagagtttctagccaaagccaaagaagactttttgaaaaaatgggagaatccaactcagaataatgccggacttgaagattttgaaaggaaaaaaacccttggaacaggttcatttggaagagtcatgttggtaaaacacaaagccactgaacagtattatgccatgaagatcttagataagcagaaggttgttaaactgaagcaaatagagcatactttgaatgagaaaagaatattacaggcagtgaattttcctttccttgttcgactggagtatgcttttaaggataattctaatttatacatggttatggaatatgtccctgggggtgaaatgttttcacatctaagaagaattggaaggttcagtgagccccatgcacggttctatgcagctcagatagtgctaacattcgagtacctccattcactagacctcatctacagagatctaaaacctgaaaatctcttaattgaccatcaaggctatatccaggtcacagactttgggtttgccaaaagagttaaaggcagaacttggacattatgtggaactccagagtatttggctccagaaataattctcagcaagggctacaataaggcagtggattggtgggcattaggagtgctaatctatgaaatggcagctggctatcccccattctttgcagaccaaccaattcagatttatgaaaagattgtttctggaaagcagaacttttgatatgaacaaaacaaaactttgagaaaaattaacagacaaggcagtgatttatttttgaagaatttgagaagtgtagactctcaagaggactaaaggtcatatgaagaatgatgagagaaccaaaatacattaaaatcacaaatggaagaagaatattttactaatacaaaaactaagaatgtaaatgttataataattgtttcaaatcatttaattgacagtaattataaagttcttgaatctttactatattacttttatttatattcatataagaaatccaattttctaacaaggatactgtcataactaaatttacatttattaagaaaaactgctttagttaaaattaatgtgtcttcatttttatgcattggcctcgatttgccaatcattctctattggttaaattttatattcagctgtttatgaatatatattcattttatatcaaactttaaaattttgtatctaataatcagcatatattctaaaatcataacagtctaaatcctgggcaccttagaagaatgacaccagaaaaccttattatatcacaatattctgttttccccttcatttatttagaaatatgacaggatatttggtgtacttttgttttttaactaaaagtaccagattatctctccccatgtgggatataaaattatccccatctcttactccctttactcatctaaagtagaagtcatgaaagtggaatttttgccattaaaaggctctgtattatgtgaagttagattgtattaaccatttcccaataaatcatctgtttcaaaactcaaa

SEQ ID NO: 700 - DNA, 1380 bp, Homo sapiens
atgctgctactatctagttctataagcttatataaagacagaaatgaagcaagactgatttcttcacagaataatgccggacttgaagattttgaaaggaaaaacccttggaacaggttcatttggaagagtcatgttggtaaaacacaaagccactgaacagtattatgccatgaagatcttagataagcagaaggttgttaaactgaagcaaatagagcatactttgaatgagaaaagaatattacaggcagtgaattttcctttccttgttcgactggagtatgcttttaaggataattctaatttatacatggttatggaatatgtccctgggggtgaaatgttttcacatctaagaagaattggaaggttcagtgagccccatgcacggttctatgcagctcagatagtgctaacattcgagtacctccattcactagacctcatctacagagatctaaaacctgaaaatctcttaattgaccatcaaggctatatccaggtcacagactttgggtttgccaaaagagttaaaggcagaacttggacattatgtggaactccagagtatttggctccagaaataattctcagcaagggctacaataaggcagtggattggtgggcattaggagtgctaatctatgaaatggcagctggctatcccccattctttgcagaccaaccaattcagatttatgaaaagattgtttctggaaaggtccgattcccatcccacttcagttcagatctcaaggaccttctacggaacctgctgcaggtggatttgaccaagagatttggaaatctaaagaatggtgtcagtgatataaaaactcacaagtggtttgccacgacagattggattgctatttaccagaggaaggttgaagctccattcataccaaagtttagaggctctggagataccagcaactttgatgactatgaagaagaagatatccgtgtctctataacagaaaaatgtgcaaaagaatttggtgaattttaaagaggaacaagatgacatctgagctcacactcagtgtttgcactctgttgagagataaggtagagctgagaccgtccttgttgaagcagttacctagttccttcattccaacgactgagtgaggtctttattgccatcatcccgtgtgcgcactctgcatccacctatgtaacaaggcaccgctaagcaagcattgtctgtgccataacacagtactagaccactttcttacttctctttgggttgtctttctcctctcctatatccatttcttccttttccaatttcattggttttctctaaacagtgctccattttattttgttggtgtttcagatgggcagtgttatggctacgtgatattt

SEQ ID NO: 701 - DNA, 4283 bp, Homo sapiens
attctgctgtttgctccttgccaggttcaacatgggattgtcacgcaaatcatcagatgcatctgcttgctcctcttcagaaatatctgtgaaagagtttctagccaaagccaaagaagactttttgaaaaaatgggagaatccaactcagaataatgccggacttgaagattttgaaaggaaaaaaacccttggaacaggttcatttggaagagtcatgttggtaaaacacaaagccactgaacagtattatgccatgaagatcttagataagcagaaggttgttaaactgaagcaaatagagcatactttgaatgagaaaagaatattacaggcagtgaattttcctttccttgttcgactggagtatgcttttaaggataattctaatttatacatggttatggaatatgtccctgggggtgaaatgttttcacatctaagaagaattggaaggttcagtgagccccatgcacggttctatgcagctcagatagtgctaacattcgagtacctccattcactagacctcatctacagagatctaaaacctgaaaatctcttaattgaccatcaaggctatatccaggtcacagactttgggtttgccaaaagagttaaaggcagaacttggacattatgtggaactccagagtatttggctccagaaataattctcagcaagggctacaataaggcagtggattggtgggcattaggagtgctaatctatgaaatggcagctggctatcccccattctttgcagaccaaccaattcagatttatgaaaagattgtttctggaaaggtccgattcccatcccacttcagttcagatctcaaggaccttctacggaacctgctgcaggtggatttgaccaagagatttggaaatctaaagaatggtgtcagtgatataaaaactcacaagtggtttgccacgacagattggattgctatttaccagaggaaggttgaagctccattcataccaaagtttagaggctctggagataccagcaactttgatgactatgaagaagaagatatccgtgtctctataacagaaaaatgtgcaaaagaatttggtgaattttaaagaggaacaagatgacatctgagctcacactcagtgtttgcactctgttgagagataaggtagagctgagaccgtccttgttgaagcagttacctagttccttcattccaacgactgagtgaggtctttattgccatcatcccgtgtgcgcactctgcatccacctatgtaacaaggcaccgctaagcaagcattgtctgtgccataacacagtactagaccactttcttacttctctttgggttgtctttctcctctcctatatccatttcttccttttccaatttcattggttttctctaaacagtgctccattttattttgttggtgtttcagatgggcagtgttatggctacgtgatatttgaagggaaggataagtgttgctttcagtagttattgccaatattgttgttggtcaatggcttgaagataaactttctaataattattatttctttgagtagctcagacttggttttgccaaaactcttggtaatttttgaagatagactgtcttatcaccaaggaaatttatacaaattaagactaactttcttggaattcactattctggcaataaattttggtagactaatacagtacagctagacccagaaatttggaaggctgtagatcagaggttctagttccctttccctccttttatatcctcctctccttgagtaatgaagtgaccagcctgtgtagtgtgacaaacgtgtctcattcagcaggaaaaactaatgatatggatcatcacccagattctctcacttggtaccagcatttctgtaggtattagagaagagttctaagttttctaaaccttaactgttccttaaggattttagccagtattttaatagaacatgattaatgaaagtgacaaattttaaattttctctaatagtcctcatcataaactttttaaaggaaaataagcaaactaaaaagaacattggtttagataaatacttatactttgcaaagtcaaaaatggcttgatttttggaaacaatatagaggtattcatatttaaatgagggtttacatttgttttgttttgtaaccgttaaaaagaagttgtttccagctaattattgtggtgtactatatttgtgagcctagggtaggggcactgctgcaacttctgctttcatcccatgcctcatcaatgaggaaagggaacaaagtgtataaaactgccacaattgtattttaattttgaggtatgatattttcagatatttcataatttctaacctctgttctctcagtaaacagaatgtctgatcgatcatgcagatacaatgttggtatttgagaggttagtttttttcctacacttttttttgccaactgacttaacaacattgctgtcaggtggaaatttcaagcacttttgcacatttagttcagtgtttgttgagaatccatggcttaacccacttgttttgctatttttttctttgcttttaattttccccatctgattttatctctgcgtttcagtgacctaccttaaaacaacacacgagaagagttaaactgggttcattttaatgatcaatttacctgcatataaaatttatttttaatcaagctgatcttaatgtatataatcattctatttgctttattatcggtgcaggtaggtcattaacaccacttcttttcatctgtaccacaccctggtgaaacctttgaagacataaaaaaaacctgtctgagatgttctttctaccaatctatatgtctttcggttatcaagtgtttctgcatggtaatgtcatgtaaatgctgatattgatttcactggtccatctatatttaaaacgtgcaagaaaaaaataaaatactctgctctagcaagttttgtgtaacaaaggcatatcgtcatgttaataaatttaaaacatcattcgtataaaatattttaattttcttgtatttcatttagacccaagaacatgctgaccaatgtgttctatatgtaaactacaaattctatggtagctttgttgtatattattgtaaaattattttaataagtcatggggatgacaatttgattattacaatttagttttcagtaatcaaaaagatttctatgaattctaaaaaatatttttttctatgaaattactagtgcccagctgtagaatctaccttaggtagatgatccctagacatacgttggttttgagggctattcagccattccattttactctctatttaaaggccgtgagcaagcttgtcatgagcaaatatgtcaagggagtcaatttctgaccaatcaagtacactaaattagaatatttttaaagtatgtaacattcccagtttcagccacaatttagccaagaataagataaaaacttgaataagaagtaagtagcataaatcagtatttaacctaaaattacatatttgaaacagaagatattatgttatgctcagtaaataattaagagatggcattgtgtaagaaggagccctagactgaaagtcaagacatctgaatttcaggctggaaaactatcagtatgatctcagcctcagttctcttgtctgtaaaatggaagaactggattaggcagtttgtaagattcctcctaactttcacagtcgatgacaagattgtctttttatctgatattttgaagggtatattgctttgaagtaagtctcaataaggcaatatattttagggcatctttcttcttatctctgacagtgttcttaaaattatttgaatatcataagagccttggtgtctgtcctaattcctttctcactcaccgatgctgaatacccagttgaatcaaactgtcaacctaccaaaaacgatattgtggcttatgggtattgctgtctcattcttggtatattcttgtgttaactgcccattggcctgaaaatactcattgtaagcctgaaaaaaaaaatctttcccactgttttttctgcttgttgtaagaatcaaatgaaataatgtatgtgaaagcaccttgtaaactgtaacctatcaatgtaaaatgttaaggtgtgttgttatttcattaattacttctttgtttagaatggaatttcctatgcactactgtagctaggaaatgctgaaaacaactgtgttttttaattaatcaataactgcaaaattaaagtaccttcaatgg

SEQ ID NO: 702 - DNA, 869 bp, Homo sapiens
aatatcagtgaggtccacagctagcagtaagagctggtgtaattgaaagacgtttaggtgcaatcattctgctgtttgctccttgccaggttcaacatgggattgttgaaagagtttctagccaaagccaaagaagactttttgaaaaaatgggagaatccaactcagaataatgccggacttgaagattttgaaaggaaaaaaacccttggaacaggttcatttggaagagtcatgttggtaaaacacaaagccactgaacagtattatgccatgaagatcttagataagcagaaggttgttaaactgaagcaaatagagcatactttgaatgagaaaagaatattacaggcagtgaattttcctttccttgttcgactggagtatgcttttaaggataattctaatttatacatggttatggaatatgtccctgggggtgaaatgttttcacatctaagaagaattggaaggttcagtgagccccatgcacggttctatgcagctcagatagtgctaacattcgagtacctccattcactagacctcatctacagagatctaaaacctgaaaatctcttaattgaccatcaaggctatatccaggtcacagactttgggtttgccaaaagagttaaaggcagaacttggacattatgtggaactccagagtatttggctccagaaataattctcagcaagggctacaataaggcagtggattggtgggcattaggagtgctaatctatgaaatggcagctggctatcccccattctttgcagaccaaccaattcagatttatgaaaagattgtttctggaaagaacttttgatatgaacaaaacaaaactttgagaaaaattaacag

SEQ ID NO: 703 - DNA, 4481 bp, Homo sapiens
acatgcatagctcttagcttctgtgtaagaagttgtgagctccttctggaaacatttgcagttacattaagtaaagtgtaaatgcacatgaatggcagcttatagagaaccaccttgtaaccagtatacaggtacaactacagctcttcagaaattggaaggttttgctagccggttatttcatagacactctaaaggtactgcacatgatcagaaaacagctctggaaaatgacagccttcatttctctgaacatactgccttatgggacagatcaatgaaagagtttctagccaaagccaaagaagactttttgaaaaaatgggagaatccaactcagaataatgccggacttgaagattttgaaaggaaaaaaacccttggaacaggttcatttggaagagtcatgttggtaaaacacaaagccactgaacagtattatgccatgaagatcttagataagcagaaggttgttaaactgaagcaaatagagcatactttgaatgagaaaagaatattacaggcagtgaattttcctttccttgttcgactggagtatgcttttaaggataattctaatttatacatggttatggaatatgtccctgggggtgaaatgttttcacatctaagaagaattggaaggttcagtgagccccatgcacggttctatgcagctcagatagtgctaacattcgagtacctccattcactagacctcatctacagagatctaaaacctgaaaatctcttaattgaccatcaaggctatatccaggtcacagactttgggtttgccaaaagagttaaaggcagaacttggacattatgtggaactccagagtatttggctccagaaataattctcagcaagggctacaataaggcagtggattggtgggcattaggagtgctaatctatgaaatggcagctggctatcccccattctttgcagaccaaccaattcagatttatgaaaagattgtttctggaaaggtccgattcccatcccacttcagttcagatctcaaggaccttctacggaacctgctgcaggtggatttgaccaagagatttggaaatctaaagaatggtgtcagtgatataaaaactcacaagtggtttgccacgacagattggattgctatttaccagaggaaggttgaagctccattcataccaaagtttagaggctctggagataccagcaactttgatgactatgaagaagaagatatccgtgtctctataacagaaaaatgtgcaaaagaatttggtgaattttaaagaggaacaagatgacatctgagctcacactcagtgtttgcactctgttgagagataaggtagagctgagaccgtccttgttgaagcagttacctagttccttcattccaacgactgagtgaggtctttattgccatcatcccgtgtgcgcactctgcatccacctatgtaacaaggcaccgctaagcaagcattgtctgtgccataacacagtactagaccactttcttacttctctttgggttgtctttctcctctcctatatccatttcttccttttccaatttcattggttttctctaaacagtgctccattttattttgttggtgtttcagatgggcagtgttatggctacgtgatatttgaagggaaggataagtgttgctttcagtagttattgccaatattgttgttggtcaatggcttgaagataaactttctaataattattatttctttgagtagctcagacttggttttgccaaaactcttggtaatttttgaagatagactgtcttatcaccaaggaaatttatacaaattaagactaactttcttggaattcactattctggcaataaattttggtagactaatacagtacagctagacccagaaatttggaaggctgtagatcagaggttctagttccctttccctccttttatatcctcctctccttgagtaatgaagtgaccagcctgtgtagtgtgacaaacgtgtctcattcagcaggaaaaactaatgatatggatcatcacccagattctctcacttggtaccagcatttctgtaggtattagagaagagttctaagttttctaaaccttaactgttccttaaggattttagccagtattttaatagaacatgattaatgaaagtgacaaattttaaattttctctaatagtcctcatcataaactttttaaaggaaaataagcaaactaaaaagaacattggtttagataaatacttatactttgcaaagtcaaaaatggcttgatttttggaaacaatatagaggtattcatatttaaatgagggtttacatttgttttgttttgtaaccgttaaaaagaagttgtttccagctaattattgtggtgtactatatttgtgagcctagggtaggggcactgctgcaacttctgctttcatcccatgcctcatcaatgaggaaagggaacaaagtgtataaaactgccacaattgtattttaattttgaggtatgatattttcagatatttcataatttctaacctctgttctctcagtaaacagaatgtctgatcgatcatgcagatacaatgttggtatttgagaggttagtttttttcctacacttttttttgccaactgacttaacaacattgctgtcaggtggaaatttcaagcacttttgcacatttagttcagtgtttgttgagaatccatggcttaacccacttgttttgctatttttttctttgcttttaattttccccatctgattttatctctgcgtttcagtgacctaccttaaaacaacacacgagaagagttaaactgggttcattttaatgatcaatttacctgcatataaaatttatttttaatcaagctgatcttaatgtatataatcattctatttgctttattatcggtgcaggtaggtcattaacaccacttcttttcatctgtaccacaccctggtgaaacctttgaagacataaaaaaaacctgtctgagatgttctttctaccaatctatatgtctttcggttatcaagtgtttctgcatggtaatgtcatgtaaatgctgatattgatttcactggtccatctatatttaaaacgtgcaagaaaaaaataaaatactctgctctagcaagttttgtgtaacaaaggcatatcgtcatgttaataaatttaaaacatcattcgtataaaatattttaattttcttgtatttcatttagacccaagaacatgctgaccaatgtgttctatatgtaaactacaaattctatggtagctttgttgtatattattgtaaaattattttaataagtcatggggatgacaatttgattattacaatttagttttcagtaatcaaaaagatttctatgaattctaaaaaatatttttttctatgaaattactagtgcccagctgtagaatctaccttaggtagatgatccctagacatacgttggttttgagggctattcagccattccattttactctctatttaaaggccgtgagcaagcttgtcatgagcaaatatgtcaagggagtcaatttctgaccaatcaagtacactaaattagaatatttttaaagtatgtaacattcccagtttcagccacaatttagccaagaataagataaaaacttgaataagaagtaagtagcataaatcagtatttaacctaaaattacatatttgaaacagaagatattatgttatgctcagtaaataattaagagatggcattgtgtaagaaggagccctagactgaaagtcaagacatctgaatttcaggctggaaaactatcagtatgatctcagcctcagttctcttgtctgtaaaatggaagaactggattaggcagtttgtaagattcctcctaactttcacagtcgatgacaagattgtctttttatctgatattttgaagggtatattgctttgaagtaagtctcaataaggcaatatattttagggcatctttcttcttatctctgacagtgttcttaaaattatttgaatatcataagagccttggtgtctgtcctaattcctttctcactcaccgatgctgaatacccagttgaatcaaactgtcaacctaccaaaaacgatattgtggcttatgggtattgctgtctcattcttggtatattcttgtgttaactgcccattggcctgaaaatactcattgtaagcctgaaaaaaaaaatctttcccactgttttttctgcttgttgtaagaatcaaatgaaataatgtatgtgaaagcaccttgtaaactgtaacctatcaatgtaaaatgttaaggtgtgttgttatttcattaattacttctttgtttagaatggaatttcctatgcactactgtagctaggaaatgctgaaaacaactgtgttttttaattaatcaataactgcaaaattaaagtaccttcaatggataagacaa

SEQ ID NO: 704 - DNA, 1905 bp, Homo sapiens
gttcgctggagccctttcctcagacccggcccggtcttcgcgcccggactcctggcgccagcgctaggcgcactcaccgctctgacgggtgcagacgcgggagttgtcccagactgtggagtggcgggcacggccccagccccccttcccttccctgaccccttcttgccatcgccccagacatggggaacgcggcgaccgccaagaaaggcagcgaggtggagagcgtgaaagagtttctagccaaagccaaagaagactttttgaaaaaatgggagaatccaactcagaataatgccggacttgaagattttgaaaggaaaaaaacccttggaacaggttcatttggaagagtcatgttggtaaaacacaaagccactgaacagtattatgccatgaagatcttagataagcagaaggttgttaaactgaagcaaatagagcatactttgaatgagaaaagaatattacaggcagtgaattttcctttccttgttcgactggagtatgcttttaaggataattctaatttatacatggttatggaatatgtccctgggggtgaaatgttttcacatctaagaagaattggaaggttcagtgagccccatgcacggttctatgcagctcagatagtgctaacattcgagtacctccattcactagacctcatctacagagatctaaaacctgaaaatctcttaattgaccatcaaggctatatccaggtcacagactttgggtttgccaaaagagttaaaggcagaacttggacattatgtggaactccagagtatttggctccagaaataattctcagcaagggctacaataaggcagtggattggtgggcattaggagtgctaatctatgaaatggcagctggctatcccccattctttgcagaccaaccaattcagatttatgaaaagattgtttctggaaagaacttttgatatgaacaaaacaaaactttgagaaaaattaacagacaaggcagtgatttatttttgaagaatttgagaagtgtagactctcaagaggactaaaggtcatatgaagaatgatgagagaaccaaaatacattaaaatcacaaatggaagaagaatattttactaatacaaaaactaagaatgtaaatgttataataattgtttcaaatcatttaattgacagtaattataaagttcttgaatctttactatattacttttatttatattcatataagaaatccaattttctaacaaggatactgtcataactaaatttacatttattaagaaaaactgctttagttaaaattaatgtgtcttcatttttatgcattggcctcgatttgccaatcattctctattggttaaattttatattcagctgtttatgaatatatattcattttatatcaaactttaaaattttgtatctaataatcagcatatattctaaaatcataacagtctaaatcctgggcaccttagaagaatgacaccagaaaaccttattatatcacaatattctgttttccccttcatttatttagaaatatgacaggatatttggtgtacttttgttttttaactaaaagtaccagattatctctccccatgtgggatataaaattatccccatctcttactccctttactcatctaaagtagaagtcatgaaagtggaatttttgccattaaaaggctctgtattatgtgaagttagattgtattaaccatttcccaataaatcatctgtttcaaaactcaaattcaaactagaatgtgtctctattcacattgcaaaaatattattgtctctctggttagtggctaaaagccaaattggaaactaactagttttttaaattttttaaattgtgcaaattattaaaaatccaatttggtcttata

SEQ ID NO: 705 - DNA, 4513 bp, Homo sapiens
gtctgcccgccgccgccactgctgctgccaccgccgtcgccgccgccgccgccgccgccgctgctgctgccggtgctaaggagttcgctggagccctttcctcagacccggcccggtcttcgcgcccggactcctggcgccagcgctaggcgcactcaccgctctgacgggtgcagacgcgggagttgtcccagactgtggagtggcgggcacggccccagccccccttcccttccctgaccccttcttgccatcgccccagacatggggaacgcggcgaccgccaagaaaggcagcgaggtggagagcgtgaaagagtttctagccaaagccaaagaagactttttgaaaaaatgggagaatccaactcagaataatgccggacttgaagattttgaaaggaaaaaaacccttggaacaggttcatttggaagagtcatgttggtaaaacacaaagccactgaacagtattatgccatgaagatcttagataagcagaaggttgttaaactgaagcaaatagagcatactttgaatgagaaaagaatattacaggcagtgaattttcctttccttgttcgactggagtatgcttttaaggataattctaatttatacatggttatggaatatgtccctgggggtgaaatgttttcacatctaagaagaattggaaggttcagtgagccccatgcacggttctatgcagctcagatagtgctaacattcgagtacctccattcactagacctcatctacagagatctaaaacctgaaaatctcttaattgaccatcaaggctatatccaggtcacagactttgggtttgccaaaagagttaaaggcagaacttggacattatgtggaactccagagtatttggctccagaaataattctcagcaagggctacaataaggcagtggattggtgggcattaggagtgctaatctatgaaatggcagctggctatcccccattctttgcagaccaaccaattcagatttatgaaaagattgtttctggaaaggtccgattcccatcccacttcagttcagatctcaaggaccttctacggaacctgctgcaggtggatttgaccaagagatttggaaatctaaagaatggtgtcagtgatataaaaactcacaagtggtttgccacgacagattggattgctatttaccagaggaaggttgaagctccattcataccaaagtttagaggctctggagataccagcaactttgatgactatgaagaagaagatatccgtgtctctataacagaaaaatgtgcaaaagaatttggtgaattttaaagaggaacaagatgacatctgagctcacactcagtgtttgcactctgttgagagataaggtagagctgagaccgtccttgttgaagcagttacctagttccttcattccaacgactgagtgaggtctttattgccatcatcccgtgtgcgcactctgcatccacctatgtaacaaggcaccgctaagcaagcattgtctgtgccataacacagtactagaccactttcttacttctctttgggttgtctttctcctctcctatatccatttcttccttttccaatttcattggttttctctaaacagtgctccattttattttgttggtgtttcagatgggcagtgttatggctacgtgatatttgaagggaaggataagtgttgctttcagtagttattgccaatattgttgttggtcaatggcttgaagataaactttctaataattattatttctttgagtagctcagacttggttttgccaaaactcttggtaatttttgaagatagactgtcttatcaccaaggaaatttatacaaattaagactaactttcttggaattcactattctggcaataaattttggtagactaatacagtacagctagacccagaaatttggaaggctgtagatcagaggttctagttccctttccctccttttatatcctcctctccttgagtaatgaagtgaccagcctgtgtagtgtgacaaacgtgtctcattcagcaggaaaaactaatgatatggatcatcacccagattctctcacttggtaccagcatttctgtaggtattagagaagagttctaagttttctaaaccttaactgttccttaaggattttagccagtattttaatagaacatgattaatgaaagtgacaaattttaaattttctctaatagtcctcatcataaactttttaaaggaaaataagcaaactaaaaagaacattggtttagataaatacttatactttgcaaagtcaaaaatggcttgatttttggaaacaatatagaggtattcatatttaaatgagggtttacatttgttttgttttgtaaccgttaaaaagaagttgtttccagctaattattgtggtgtactatatttgtgagcctagggtaggggcactgctgcaacttctgctttcatcccatgcctcatcaatgaggaaagggaacaaagtgtataaaactgccacaattgtattttaattttgaggtatgatattttcagatatttcataatttctaacctctgttctctcagtaaacagaatgtctgatcgatcatgcagatacaatgttggtatttgagaggttagtttttttcctacacttttttttgccaactgacttaacaacattgctgtcaggtggaaatttcaagcacttttgcacatttagttcagtgtttgttgagaatccatggcttaacccacttgttttgctatttttttctttgcttttaattttccccatctgattttatctctgcgtttcagtgacctaccttaaaacaacacacgagaagagttaaactgggttcattttaatgatcaatttacctgcatataaaatttatttttaatcaagctgatcttaatgtatataatcattctatttgctttattatcggtgcaggtaggtcattaacaccacttcttttcatctgtaccacaccctggtgaaacctttgaagacataaaaaaaacctgtctgagatgttctttctaccaatctatatgtctttcggttatcaagtgtttctgcatggtaatgtcatgtaaatgctgatattgatttcactggtccatctatatttaaaacgtgcaagaaaaaaataaaatactctgctctagcaagttttgtgtaacaaaggcatatcgtcatgttaataaatttaaaacatcattcgtataaaatattttaattttcttgtatttcatttagacccaagaacatgctgaccaatgtgttctatatgtaaactacaaattctatggtagctttgttgtatattattgtaaaattattttaataagtcatggggatgacaatttgattattacaatttagttttcagtaatcaaaaagatttctatgaattctaaaaaatatttttttctatgaaattactagtgcccagctgtagaatctaccttaggtagatgatccctagacatacgttggttttgagggctattcagccattccattttactctctatttaaaggccgtgagcaagcttgtcatgagcaaatatgtcaagggagtcaatttctgaccaatcaagtacactaaattagaatatttttaaagtatgtaacattcccagtttcagccacaatttagccaagaataagataaaaacttgaataagaagtaagtagcataaatcagtatttaacctaaaattacatatttgaaacagaagatattatgttatgctcagtaaataattaagagatggcattgtgtaagaaggagccctagactgaaagtcaagacatctgaatttcaggctggaaaactatcagtatgatctcagcctcagttctcttgtctgtaaaatggaagaactggattaggcagtttgtaagattcctcctaactttcacagtcgatgacaagattgtctttttatctgatattttgaagggtatattgctttgaagtaagtctcaataaggcaatatattttagggcatctttcttcttatctctgacagtgttcttaaaattatttgaatatcataagagccttggtgtctgtcctaattcctttctcactcaccgatgctgaatacccagttgaatcaaactgtcaacctaccaaaaacgatattgtggcttatgggtattgctgtctcattcttggtatattcttgtgttaactgcccattggcctgaaaatactcattgtaagcctgaaaaaaaaaatctttcccactgttttttctgcttgttgtaagaatcaaatgaaataatgtatgtgaaagcaccttgtaaactgtaacctatcaatgtaaaatgttaaggtgtgttgttatttcattaattacttctttgtttagaatggaatttcctatgcactactgtagctaggaaatgctgaaaacaactgtgttttttaattaatcaataactgcaaaattaaagtaccttcaatggataagacaa

SEQ ID NO: 706 - DNA, 1571 bp, Homo sapiens
cgagacccccgcccctgccgccgccaccgccatgggcaacgcccccgccaagaaggacaccgagcaggaggagagcgtgaacgagttcctagccaaagccagaggagatttcctctacagatggggaaaccccgctcaaaacaccgccagctcggatcagttcgaacggctcaggacgctgggcatgggctccttcgggcgggtgatgctggtgaggcaccaggagaccggcggccactacgccatgaagatcctcaacaagcagaaggtggtgaagatgaagcaggtcgagcacatactgaacgagaagcgcatcctgcaggcgatcgactttccgttcctcgtcaagctccagttctcctttaaggacaactcctacctgtacctggtgatggagtacgtgccgggtggggagatgttctcccgcctacagcgcgtcggaaggtttagcgagccccatgcctgtttctatgccgcccaggtcgtcctggccgtccagtacctacactcgctcgacctcatccaccgcgacctgaagcccgagaatctcctcatcgaccagcagggctacctgcaggtgacggacttcggtttcgccaagcgcgtgaagggccgcacttggaccttgtgcgggaccccagagtacctggcccccgagatcatcctgagcaaaggctacaacaaggccgtggactggtgggccctaggggtgctcatctatgagatggccgtgggcttcccacccttctacgccgaccagcccatccagatctacgagaagatcgtctctgggagggtgcggtttccctccaaactcagctctgacctcaagcatctgctgcggagcctgctgcaggtggacctcaccaagcgcttcggaaacctcaggaacggggttggcgacatcaagaaccacaagtggttcgccacaaccagctggatcgccatctatgagaagaaggtggaagctcccttcatcccgaagtacacaggccctggggatgccagtaactttgacgactacgaggaggaagagctccggatctccatcaatgagaagtgtgccaaggagttttctgagttttaggggtgtgcttgtgcccctgtgggttttctttcctttttgtttttggtggtttgggggatgggagggttggattgaacagccagagggccccagagttccttgtatctaatttcatcctcaccccaccctccagggttgggggagcaggaagcccagatatttggaggaacagaaacaccagctgctccctcacccccccccatgccttcctggtccctctgtgcttctctctttctcctcccacagggtcccccttgccccagcccccttctgcctgttttaaacgagtttctcagctctattcaggccaggtcttgctgttgtatcaagggacacggtgtggaaagaggggctcaaacttaactccagccctgaacaggcaccacttactaagagaggatgaatgaaaagcacacctaccctttggcgtaatcctgcctgggaaggagagaggtttagtgccatgttcagtgggctgtttgct

SEQ ID NO: 707 - DNA, 4292 bp, Homo sapiens
attctgctgtttgctccttgccaggttcaacatgggattgtcacgcaaatcatcagatgcatctgcttgctcctcttcagaaatatctgattcctttgtgaaagagtttctagccaaagccaaagaagactttttgaaaaaatgggagaatccaactcagaataatgccggacttgaagattttgaaaggaaaaaaacccttggaacaggttcatttggaagagtcatgttggtaaaacacaaagccactgaacagtattatgccatgaagatcttagataagcagaaggttgttaaactgaagcaaatagagcatactttgaatgagaaaagaatattacaggcagtgaattttcctttccttgttcgactggagtatgcttttaaggataattctaatttatacatggttatggaatatgtccctgggggtgaaatgttttcacatctaagaagaattggaaggttcagtgagccccatgcacggttctatgcagctcagatagtgctaacattcgagtacctccattcactagacctcatctacagagatctaaaacctgaaaatctcttaattgaccatcaaggctatatccaggtcacagactttgggtttgccaaaagagttaaaggcagaacttggacattatgtggaactccagagtatttggctccagaaataattctcagcaagggctacaataaggcagtggattggtgggcattaggagtgctaatctatgaaatggcagctggctatcccccattctttgcagaccaaccaattcagatttatgaaaagattgtttctggaaaggtccgattcccatcccacttcagttcagatctcaaggaccttctacggaacctgctgcaggtggatttgaccaagagatttggaaatctaaagaatggtgtcagtgatataaaaactcacaagtggtttgccacgacagattggattgctatttaccagaggaaggttgaagctccattcataccaaagtttagaggctctggagataccagcaactttgatgactatgaagaagaagatatccgtgtctctataacagaaaaatgtgcaaaagaatttggtgaattttaaagaggaacaagatgacatctgagctcacactcagtgtttgcactctgttgagagataaggtagagctgagaccgtccttgttgaagcagttacctagttccttcattccaacgactgagtgaggtctttattgccatcatcccgtgtgcgcactctgcatccacctatgtaacaaggcaccgctaagcaagcattgtctgtgccataacacagtactagaccactttcttacttctctttgggttgtctttctcctctcctatatccatttcttccttttccaatttcattggttttctctaaacagtgctccattttattttgttggtgtttcagatgggcagtgttatggctacgtgatatttgaagggaaggataagtgttgctttcagtagttattgccaatattgttgttggtcaatggcttgaagataaactttctaataattattatttctttgagtagctcagacttggttttgccaaaactcttggtaatttttgaagatagactgtcttatcaccaaggaaatttatacaaattaagactaactttcttggaattcactattctggcaataaattttggtagactaatacagtacagctagacccagaaatttggaaggctgtagatcagaggttctagttccctttccctccttttatatcctcctctccttgagtaatgaagtgaccagcctgtgtagtgtgacaaacgtgtctcattcagcaggaaaaactaatgatatggatcatcacccagattctctcacttggtaccagcatttctgtaggtattagagaagagttctaagttttctaaaccttaactgttccttaaggattttagccagtattttaatagaacatgattaatgaaagtgacaaattttaaattttctctaatagtcctcatcataaactttttaaaggaaaataagcaaactaaaaagaacattggtttagataaatacttatactttgcaaagtcaaaaatggcttgatttttggaaacaatatagaggtattcatatttaaatgagggtttacatttgttttgttttgtaaccgttaaaaagaagttgtttccagctaattattgtggtgtactatatttgtgagcctagggtaggggcactgctgcaacttctgctttcatcccatgcctcatcaatgaggaaagggaacaaagtgtataaaactgccacaattgtattttaattttgaggtatgatattttcagatatttcataatttctaacctctgttctctcagtaaacagaatgtctgatcgatcatgcagatacaatgttggtatttgagaggttagtttttttcctacacttttttttgccaactgacttaacaacattgctgtcaggtggaaatttcaagcacttttgcacatttagttcagtgtttgttgagaatccatggcttaacccacttgttttgctatttttttctttgcttttaattttccccatctgattttatctctgcgtttcagtgacctaccttaaaacaacacacgagaagagttaaactgggttcattttaatgatcaatttacctgcatataaaatttatttttaatcaagctgatcttaatgtatataatcattctatttgctttattatcggtgcaggtaggtcattaacaccacttcttttcatctgtaccacaccctggtgaaacctttgaagacataaaaaaaacctgtctgagatgttctttctaccaatctatatgtctttcggttatcaagtgtttctgcatggtaatgtcatgtaaatgctgatattgatttcactggtccatctatatttaaaacgtgcaagaaaaaaataaaatactctgctctagcaagttttgtgtaacaaaggcatatcgtcatgttaataaatttaaaacatcattcgtataaaatattttaattttcttgtatttcatttagacccaagaacatgctgaccaatgtgttctatatgtaaactacaaattctatggtagctttgttgtatattattgtaaaattattttaataagtcatggggatgacaatttgattattacaatttagttttcagtaatcaaaaagatttctatgaattctaaaaaatatttttttctatgaaattactagtgcccagctgtagaatctaccttaggtagatgatccctagacatacgttggttttgagggctattcagccattccattttactctctatttaaaggccgtgagcaagcttgtcatgagcaaatatgtcaagggagtcaatttctgaccaatcaagtacactaaattagaatatttttaaagtatgtaacattcccagtttcagccacaatttagccaagaataagataaaaacttgaataagaagtaagtagcataaatcagtatttaacctaaaattacatatttgaaacagaagatattatgttatgctcagtaaataattaagagatggcattgtgtaagaaggagccctagactgaaagtcaagacatctgaatttcaggctggaaaactatcagtatgatctcagcctcagttctcttgtctgtaaaatggaagaactggattaggcagtttgtaagattcctcctaactttcacagtcgatgacaagattgtctttttatctgatattttgaagggtatattgctttgaagtaagtctcaataaggcaatatattttagggcatctttcttcttatctctgacagtgttcttaaaattatttgaatatcataagagccttggtgtctgtcctaattcctttctcactcaccgatgctgaatacccagttgaatcaaactgtcaacctaccaaaaacgatattgtggcttatgggtattgctgtctcattcttggtatattcttgtgttaactgcccattggcctgaaaatactcattgtaagcctgaaaaaaaaaatctttcccactgttttttctgcttgttgtaagaatcaaatgaaataatgtatgtgaaagcaccttgtaaactgtaacctatcaatgtaaaatgttaaggtgtgttgttatttcattaattacttctttgtttagaatggaatttcctatgcactactgtagctaggaaatgctgaaaacaactgtgttttttaattaatcaataactgcaaaattaaagtaccttcaatgg

SEQ ID NO: 708 - DNA, 4200 bp, Homo sapiens
gttattttgagcaatatgttttggaaaggttggttttcatcatgagtgcacgcaaatcatcagatgcatctgcttgctcctcttcagaaatatctgtgaaagagtttctagccaaagccaaagaagactttttgaaaaaatgggagaatccaactcagaataatgccggacttgaagattttgaaaggaaaaaaacccttggaacaggttcatttggaagagtcatgttggtaaaacacaaagccactgaacagtattatgccatgaagatcttagataagcagaaggataattctaatttatacatggttatggaatatgtccctgggggtgaaatgttttcacatctaagaagaattggaaggttcagtgagccccatgcacggttctatgcagctcagatagtgctaacattcgagtacctccattcactagacctcatctacagagatctaaaacctgaaaatctcttaattgaccatcaaggctatatccaggtcacagactttgggtttgccaaaagagttaaaggcagaacttggacattatgtggaactccagagtatttggctccagaaataattctcagcaagggctacaataaggcagtggattggtgggcattaggagtgctaatctatgaaatggcagctggctatcccccattctttgcagaccaaccaattcagatttatgaaaagattgtttctggaaaggtccgattcccatcccacttcagttcagatctcaaggaccttctacggaacctgctgcaggtggatttgaccaagagatttggaaatctaaagaatggtgtcagtgatataaaaactcacaagtggtttgccacgacagattggattgctatttaccagaggaaggttgaagctccattcataccaaagtttagaggctctggagataccagcaactttgatgactatgaagaagaagatatccgtgtctctataacagaaaaatgtgcaaaagaatttggtgaattttaaagaggaacaagatgacatctgagctcacactcagtgtttgcactctgttgagagataaggtagagctgagaccgtccttgttgaagcagttacctagttccttcattccaacgactgagtgaggtctttattgccatcatcccgtgtgcgcactctgcatccacctatgtaacaaggcaccgctaagcaagcattgtctgtgccataacacagtactagaccactttcttacttctctttgggttgtctttctcctctcctatatccatttcttccttttccaatttcattggttttctctaaacagtgctccattttattttgttggtgtttcagatgggcagtgttatggctacgtgatatttgaagggaaggataagtgttgctttcagtagttattgccaatattgttgttggtcaatggcttgaagataaactttctaataattattatttctttgagtagctcagacttggttttgccaaaactcttggtaatttttgaagatagactgtcttatcaccaaggaaatttatacaaattaagactaactttcttggaattcactattctggcaataaattttggtagactaatacagtacagctagacccagaaatttggaaggctgtagatcagaggttctagttccctttccctccttttatatcctcctctccttgagtaatgaagtgaccagcctgtgtagtgtgacaaacgtgtctcattcagcaggaaaaactaatgatatggatcatcacccagattctctcacttggtaccagcatttctgtaggtattagagaagagttctaagttttctaaaccttaactgttccttaaggattttagccagtattttaatagaacatgattaatgaaagtgacaaattttaaattttctctaatagtcctcatcataaactttttaaaggaaaataagcaaactaaaaagaacattggtttagataaatacttatactttgcaaagtcaaaaatggcttgatttttggaaacaatatagaggtattcatatttaaatgagggtttacatttgttttgttttgtaaccgttaaaaagaagttgtttccagctaattattgtggtgtactatatttgtgagcctagggtaggggcactgctgcaacttctgctttcatcccatgcctcatcaatgaggaaagggaacaaagtgtataaaactgccacaattgtattttaattttgaggtatgatattttcagatatttcataatttctaacctctgttctctcagtaaacagaatgtctgatcgatcatgcagatacaatgttggtatttgagaggttagtttttttcctacacttttttttgccaactgacttaacaacattgctgtcaggtggaaatttcaagcacttttgcacatttagttcagtgtttgttgagaatccatggcttaacccacttgttttgctatttttttctttgcttttaattttccccatctgattttatctctgcgtttcagtgacctaccttaaaacaacacacgagaagagttaaactgggttcattttaatgatcaatttacctgcatataaaatttatttttaatcaagctgatcttaatgtatataatcattctatttgctttattatcggtgcaggtaggtcattaacaccacttcttttcatctgtaccacaccctggtgaaacctttgaagacataaaaaaaacctgtctgagatgttctttctaccaatctatatgtctttcggttatcaagtgtttctgcatggtaatgtcatgtaaatgctgatattgatttcactggtccatctatatttaaaacgtgcaagaaaaaaataaaatactctgctctagcaagttttgtgtaacaaaggcatatcgtcatgttaataaatttaaaacatcattcgtataaaatattttaattttcttgtatttcatttagacccaagaacatgctgaccaatgtgttctatatgtaaactacaaattctatggtagctttgttgtatattattgtaaaattattttaataagtcatggggatgacaatttgattattacaatttagttttcagtaatcaaaaagatttctatgaattctaaaaaatatttttttctatgaaattactagtgcccagctgtagaatctaccttaggtagatgatccctagacatacgttggttttgagggctattcagccattccattttactctctatttaaaggccgtgagcaagcttgtcatgagcaaatatgtcaagggagtcaatttctgaccaatcaagtacactaaattagaatatttttaaagtatgtaacattcccagtttcagccacaatttagccaagaataagataaaaacttgaataagaagtaagtagcataaatcagtatttaacctaaaattacatatttgaaacagaagatattatgttatgctcagtaaataattaagagatggcattgtgtaagaaggagccctagactgaaagtcaagacatctgaatttcaggctggaaaactatcagtatgatctcagcctcagttctcttgtctgtaaaatggaagaactggattaggcagtttgtaagattcctcctaactttcacagtcgatgacaagattgtctttttatctgatattttgaagggtatattgctttgaagtaagtctcaataaggcaatatattttagggcatctttcttcttatctctgacagtgttcttaaaattatttgaatatcataagagccttggtgtctgtcctaattcctttctcactcaccgatgctgaatacccagttgaatcaaactgtcaacctaccaaaaacgatattgtggcttatgggtattgctgtctcattcttggtatattcttgtgttaactgcccattggcctgaaaatactcattgtaagcctgaaaaaaaaaatctttcccactgttttttctgcttgttgtaagaatcaaatgaaataatgtatgtgaaagcaccttgtaaactgtaacctatcaatgtaaaatgttaaggtgtgttgttatttcattaattacttctttgtttagaatggaatttcctatgcactactgtagctaggaaatgctgaaaacaactgtgttttttaattaatcaataactgcaaaattaaagtaccttcaatggataagacaa

SEQ ID NO: 709 - DNA, 730 bp, Homo sapiens
gtgtttacaccatcggttcttctccctctagagattagcataactccctttgctgttggattgttattttgagcaatatgttttggaaaggttggttttcatcatgagtgcttgctcctcttcagaaatatctgtgaaagagtttctagccaaagccaaagaagactttttgaaaaaatgggagaatccaactcagaataatgccggacttgaagattttgaaaggaaaaaaacccttggaacaggttcatttggaagagtcatgttggtaaaacacaaagccactgaacagtattatgccatgaagatcttagataagcagaaggttgttaaactgaagcaaatagagcatactttgaatgagaaaagaatattacaggcagtgaattttcctttccttgttcgactggagtatgcttttaaggataattctaatttatacatggttatggaatatgtccctgggggtgaaatgttttcacatctaagaagaattggaaggttcagtgagccccatgcacggttctatgcagctcagatagtgctaacattcgagtacctccattcactagacctcatctacagagatctaaaacctgaaaatctcttaattgaccatcaaggctatatccaggtcacagactttgggtttgccaaaagagttaaaggcagaacttggacattatgtggaactccagagtatttggctccagaaataattctcagcaag

SEQ ID NO: 710 - DNA, 686 bp, Homo sapiens
accatcggttcttctccctctagagattagcataactccctttgctgttggattgttattttgagcaatatgttttggaaaggttggttttcatcatgagtgtgaaagagtttctagccaaagccaaagaagactttttgaaaaaatgggagaatccaactcagaataatgccggacttgaagattttgaaaggaaaaaaacccttggaacaggttcatttggaagagtcatgttggtaaaacacaaagccactgaacagtattatgccatgaagatcttagataagcagaaggttgttaaactgaagcaaatagagcatactttgaatgagaaaagaatattacaggcagtgaattttcctttccttgttcgactggagtatgcttttaaggataattctaatttatacatggttatggaatatgtccctgggggtgaaatgttttcacatctaagaagaattggaaggttcagtgagccccatgcacggttctatgcagctcagatagtgctaacattcgagtacctccattcactagacctcatctacagagatctaaaacctgaaaatctcttaattgaccatcaaggctatatccaggtcacagactttgggtttgccaaaagagttaaaggcagaacttggacattatgtggaactccagagtatttggctccagaaata

SEQ ID NO: 711 - DNA, 662 bp, Homo sapiens
gctccttgccaggttcaacatgggattgtcttgctcctcttcagaaatatctgtgaaagagtttctagccaaagccaaagaagactttttgaaaaaatgggagaatccaactcagaataatgccggacttgaagattttgaaaggaaaaaaacccttggaacaggttcatttggaagagtcatgttggtaaaacacaaagccactgaacagtattatgccatgaagatcttagataagcagaaggttgttaaactgaagcaaatagagcatactttgaatgagaaaagaatattacaggcagtgaattttcctttccttgttcgactggagtatgcttttaaggataattctaatttatacatggttatggaatatgtccctgggggtgaaatgttttcacatctaagaagaattggaaggttcagtgagccccatgcacggttctatgcagctcagatagtgctaacattcgagtacctccattcactagacctcatctacagagatctaaaacctgaaaatctcttaattgaccatcaaggctatatccaggtcacagactttgggtttgccaaaagagttaaaggcagaacttggacattatgtggaactccagagtatttggctccagaaataattctcagcaagggctacaataagg

SEQ ID NO: 712 - DNA, 648 bp, Homo sapiens
agtgaggtccacagctagcagtaagagctggtgtaattgaaagacgtttaggtgcaatcattctgctgtttgctccttgccaggttcaacatgggattgtcacgcaaatcatcagatgcatctgcttgctcctcttcagaaatatctgtgaaagagtttctagccaaagccaaagaagactttttgaaaaaatgggagaatccaactcagaataatgccggacttgaagattttgaaaggaaaaaaacccttggaacaggttcatttggaagagtcatgttggtaaaacacaaagccactgaacagtattatgccatgaagatcttagataagcagaaggttgttaaactgaagcaaatagagcatactttgaatgagaaaagaatattacaggcagtgaattttcctttccttgttcgactggagtatgcttttaaggataattctaatttatacatggttatggaatatgtccctgggggtgaaatgttttcacatctaagaagaattggaaggttcagtgagccccatgcacggttctatgcagctcagatagtgctaacattcgagtacctccattcactagacctcatctacagagatctaaaacctgaaaatctcttaattgaccatcaaggctatatccag

SEQ ID NO: 713 - DNA, 638 bp, Homo sapiens
agcacacagcattttaatatcagtgaggtccacagctagcagtaagagctggtgtaattgaaagacgtttaggtgcaatcattctgctgtttgctccttgccaggttcaacatgggattgtcacgcaaatcatcagatgcatctgcttgctcctcttcagaaatatctgattcctttgtgaaagagtttctagccaaagccaaagaagactttttgaaaaaatgggagaatccaactcagaataatgccggacttgaagattttgaaaggaaaaaaacccttggaacaggttcatttggaagagtcatgttggtaaaacacaaagccactgaacagtattatgccatgaagatcttagataagcagaaggttgttaaactgaagcaaatagagcatactttgaatgagaaaagaatattacaggcagtgaattttcctttccttgttcgactggagtatgcttttaaggataattctaatttatacatggttatggaatatgtccctgggggtgaaatgttttcacatctaagaagaattggaaggttcagtgagccccatgcacggttctatgcagctcagatagtgctaacattcgagtacctccattcactagacctcatctacagagatctaaa

SEQ ID NO: 714 - DNA, 944 bp, Homo sapiens
acattttctccctgccattttgagttgttctagtggtatatgaaggaggctgggataactagcttgaaagaaattcagtctagttatagacatctttggcattaatctgatgtttactagtgatatctcatgctaggcagttatgctttgcttctaggggcttctctttttaaaacaaaagaaagctcttttcgttttctgtgtgctgcatgctccagtgtgtgtgtttacaccatcggttcttctccctctagagattagcataactccctttgctgttggattgttattttgagcaatatgttttggaaaggttggttttcatcatgagtgcacgcaaatcatcagatgcatctgcttgctcctcttcagaaatatctgtgaaagagtttctagccaaagccaaagaagactttttgaaaaaatgggagaatccaactcagaataatgccggacttgaagattttgaaaggaaaaaaacccttggaacaggttcatttggaagagtcatgttggtaaaacacaaagccactgaacagtattatgccatgaagatcttagataagcagaaggttgttaaactgaagcaaatagagcatactttgaatgagaaaagaatattacaggcagtgaattttcctttccttgttcgactggagtatgcttttaaggataattctaatttatacatggttatggaatatgtccctgggggtgaaatgttttcacatctaagaagaattggaaggttcagtgagccccatgcacggttctatgcagctcagatagtgctaacattcgagtacctccattcactagacctcatctacagagatctaaaacctgaaaatctcttaattgaccatcaaggctatatccaggtcacagactttgggtttgccaaaagagttaaaggcagaacttggacattatgtggaactcca

SEQ ID NO: 715 - DNA, 1457 bp, Homo sapiens
acagacagcggcagagatcttgggctgaggttcccgggcgggcgggcgcggagagacgcgggaagcagccgccgccgccgcgatgggcaacgccgccgccgccaagaagggcagcgagcaggagagcgtgaaagaattcttagccaaagccaaagaagattttcttaaaaaatgggaaagtcccgctcagaacacagcccacttggatcagtttgaacgaatcaagaccctcggcacgggctccttcgggcgggtgatgctggtgaaacacaaggagaccgggaaccactatgccatgaagatcctcgacaaacagaaggtggtgaaactgaaacagatcgaacacaccctgaatgaaaagcgcatcctgcaagctgtcaactttccgttcctcgtcaaactcgagttctccttcaaggacaactcaaacttatacatggtcatggagtacgtgcccggcggggagatgttctcacacctacggcggatcggaaggttcagtgagccccatgcccgtttctacgcggcccagatcgtcctgacctttgagtatctgcactcgctggatctcatctacagggacctgaagccggagaatctgctcattgaccagcagggctacattcaggtgacagacttcggtttcgccaagcgcgtgaagggccgcacttggaccttgtgcggcacccctgagtacctggcccctgagattatcctgagcaaaggctacaacaaggccgtggactggtgggccctgggggttcttatctatgaaatggccgctggctacccgcccttcttcgcagaccagcccatccagatctatgagaagatcgtctctgggaaggtgcgcttcccttcccacttcagctctgacttgaaggacctgctgcggaacctcctgcaggtagatctcaccaagcgctttgggaacctcaagaatggggtcaacgatatcaagaaccacaagtggtttgccacaactgactggattgccatctaccagaggaaggtggaagctcccttcataccaaagtttaaaggccctggggatacgagtaactttgacgactatgaggaagaagaaatccgggtctccatcaatgagaagtgtggcaaggagttttctgagttttaggggcatgcctgtgcccccatgggttttcttttttcttttttcttttttttggtcgggggggtgggagggttggattgaacagccagagggccccagagttccttgcatctaatttcacccccaccccaccctccagggttagggggagcaggaagcccagataatcagagggacagaaacaccagctgctccccctcatccccttcaccctcctgccccctctcccacttttcccttcctctttccccacagccccccagcccctcagccctcccagcccacttctgcctgttttaaacgagtttctcaactccagtca

SEQ ID NO: 716 - DNA, 1524 bp, Homo sapiens
ctctgcaaaccttggctagcttggagcaggtacctttaaaagcttctgtggcaaccagctcctcctccctggtcccctgaggccatcccaaggaagctgacttagaggctctgcgttttcctggtttctcagcaaaaggaagattccagggagagcccaagggggctggggatggatctgggatcaggcagcagccagggtggggacttggagaccaccttccagctgtggctgcagctgctcctctgggcccacctggctgtacgtttcctgggctacctgcaccgcaccttccgggggcctaagccacagccagcaccctgagcctccctggccagggggcagaaggccgccagatcaccccatcccacccaccctttattctaccctttcctggaagagacaggaagcagagtgaaagaattcttagccaaagccaaagaagattttcttaaaaaatgggaaagtcccgctcagaacacagcccacttggatcagtttgaacgaatcaagaccctcggcacgggctccttcgggcgggtgatgctggtgaaacacaaggagaccgggaaccactatgccatgaagatcctcgacaaacagaaggtggtgaaactgaaacagatcgaacacaccctgaatgaaaagcgcatcctgcaagctgtcaactttccgttcctcgtcaaactcgagttctccttcaaggacaactcaaacttatacatggtcatggagtacgtgcccggcggggagatgttctcacacctacggcggatcggaaggttcagtgagccccatgcccgtttctacgcggcccagatcgtcctgacctttgagtatctgcactcgctggatctcatctacagggacctgaagccggagaatctgctcattgaccagcagggctacattcaggtgacagacttcggtttcgccaagcgcgtgaagggccgcacttggaccttgtgcggcacccctgagtacctggcccctgagattatcctgagcaaaggctacaacaaggccgtggactggtgggccctgggggttcttatctatgaaatggccgctggctacccgcccttcttcgcagaccagcccatccagatctatgagaagatcgtctctgggaaggtgaggtccggatgtggggacacagccctggaagaaacagaccgttccctgctcacccatcctattccctggggagccctgcttgttgtcagaataatctagaagttccttaagtcaggccaggtggtgaagctggacgcgccggccacactgaggccaacacctcaagcccccttgctgtccagccccaaccccgcggttccagaatcccatgggcttccaaaatcccgagcctcacgggaacatcttggccacagaacacaaaccgccctgccagacgaccctccttttcgctcctcatcccagttagtgtgagttttcgcaaattccaaggcagaaaaacgaatgtatttggttcctgttcccaggtgctgtccatagcctcaccca

SEQ ID NO: 717 - DNA, 2680 bp, Homo sapiens
ccgccccctcgcacttccgtgtgccgcggcgccggagcccgaggcggctgtagcccacatctcccgagcgacccccggcgcccgcccgccgcgcggaggcccgggccacacctcactggccgcttggcccatcccagtcagcgccgcgccgaaccccgtccgcgcgcgccggggagcggcgcccccgccgctgccgccgcgacccttggcgcctgcccctgcaacgggaggtctgcagggaactggccaggcaagggggcaggcccgtttctcctggtggttggtgcgttgtagcagcagcgggagccaggactaaggacaagcaggagctgggagccccagccccactgcaggccccaccatggcgccgttcctgcgcatcgccttcaactcctatgagctgggctccctgcaggccgaggacgaggcgaaccagcccttctgtgccgtgaagatgaaggaggcgctcagcacagagcgtgggaaaacactggtgcagaagaagccgaccatgtatcctgagtggaagtcgacgttcgatgcccacatctatgaggggcgcgtcatccagattgtgctaatgcgggcagcagaggagccagtgtctgaggtgaccgtgggtgtgtcggtgctggccgagcgctgcaagaagaacaatggcaaggctgagttctggctggacctgcagcctcaggccaaggtgttgatgtctgttcagtatttcctggaggacgtggattgcaaacagtctatgcgcagtgaggacgaggccaagttcccaacgatgaaccgccgcggagccatcaaacaggccaaaatccactacatcaagaaccatgagtttatcgccaccttctttgggcaacccaccttctgttctgtgtgcaaagactttgtctggggcctcaacaagcaaggctacaaatgcaggcaatgtaacgctgccatccacaagaaatgcatcgacaagatcatcggcagatgcactggcaccgcggccaacagccgggacactatattccagaaagaacgcttcaacatcgacatgccgcaccgcttcaaggttcacaactacatgagccccaccttctgtgaccactgcggcagcctgctctggggactggtgaagcagggattaaagtgtgaagactgcggcatgaatgtgcaccataaatgccgggagaaggtggccaacctctgcggcatcaaccagaagcttttggctgaggccttgaaccaagtcacccagagagcctcccggagatcagactcagcctcctcagagcctgttgggatatatcagggtttcgagaagaagaccggagttgctggggaggacatgcaagacaacagtgggacctacggcaagatctgggagggcagcagcaagtgcaacatcaacaacttcatcttccacaaggtcctgggcaaaggcagcttcgggaaggtgctgcttggagagctgaagggcagaggagagtactttgccatcaaggccctcaagaaggatgtggtcctgatcgacgacgacgtggagtgcaccatggttgagaagcgggtgctgacacttgccgcagagaatccctttctcacccacctcatctgcaccttccagaccaaggaccacctgttctttgtgatggagttcctcaacgggggggacctgatgtaccacatccaggacaaaggccgctttgaactctaccgtgccacgttttatgccgctgagataatgtgtggactgcagtttctacacagcaagggcatcatttacagggacctcaaactggacaatgtgctgctggaccgggatggccacatcaagattgccgactttgggatgtgcaaagagaacatattcggggagagccgggccagcaccttctgcggcacccctgactatatcgcccctgagatcctacagggcctgaagtacacattctctgtggactggtggtctttcggggtccttctgtacgagatgctcattggccagtcccccttccatggtgatgatgaggatgaactcttcgagtccatccgtgtggacacgccacattatccccgctggatcaccaaggagtccaaggacatcctggagaagctctttgaaagggaaccaaccaagaggctgggagtgaccggaaacatcaaaatccaccccttcttcaagaccataaactggactctgctggaaaagcggaggttggagccacctttcaggcccaaagtgaagtcacccagagactacagtaactttgaccaggagttcctgaacgagaaggcgcgcctctcctacagcgacaagaacctcatcgactccatggaccagtctgcattcgctggcttctcctttgtgaaccccaaattcgagcacctcctggaagattgaggttcctggacagatcaggctagccctgccctccacccacacctgcccgctccccacgataagcaccagtgggactgtggtgacttctgctgctggccccgcccctgcccccagagcgtccttggctgccgtctggccgggctctcatggtacttcctctgtgaactgtgtgtgaatctgcttttcctctgccttcggagggaaattgtaaatcctgtgtttcattacttgaatgtagttatctattgaaaatatatattatatacatagacatatatatatatataa

SEQ ID NO: 718 - DNA, 2810 bp, Homo sapiens
ggcctggcagggcgaggcctggcgggggcggggcctggcgggggcggggccggcggcacctgggtgaggtcgctcggccccgccccctcgcacttccgtgtgccgcggcgccggagcccgaggcggctgtagcccacatctcccgagcgacccccggcgcccgcccgccgcgcggaggcccgggccacacctcactggccgcttggcccatcccagtcagcgccgcgccgaaccccgtccgcgcgcgccggggagcggcgcccccgccgctgccgccgcgacccttggcgcctgcccctgcaacgggagccccactgcaggccccaccatggcgccgttcctgcgcatcgccttcaactcctatgagctgggctccctgcaggccgaggacgaggcgaaccagcccttctgtgccgtgaagatgaaggaggcgctcagcacagagcgtgggaaaacactggtgcagaagaagccgaccatgtatcctgagtggaagtcgacgttcgatgcccacatctatgaggggcgcgtcatccagattgtgctaatgcgggcagcagaggagccagtgtctgaggtgaccgtgggtgtgtcggtgctggccgagcgctgcaagaagaacaatggcaaggctgagttctggctggacctgcagcctcaggccaaggtgttgatgtctgttcagtatttcctggaggacgtggattgcaaacagtctatgcgcagtgaggacgaggccaagttcccaacgatgaaccgccgcggagccatcaaacaggccaaaatccactacatcaagaaccatgagtttatcgccaccttctttgggcaacccaccttctgttctgtgtgcaaagactttgtctggggcctcaacaagcaaggctacaaatgcaggcaatgtaacgctgccatccacaagaaatgcatcgacaagatcatcggcagatgcactggcaccgcggccaacagccgggacactatattccagaaagaacgcttcaacatcgacatgccgcaccgcttcaaggttcacaactacatgagccccaccttctgtgaccactgcggcagcctgctctggggactggtgaagcagggattaaagtgtgaagactgcggcatgaatgtgcaccataaatgccgggagaaggtggccaacctctgcggcatcaaccagaagcttttggctgaggccttgaaccaagtcacccagagagcctcccggagatcagactcagcctcctcagagcctgttgggatatatcagggtttcgagaagaagaccggagttgctggggaggacatgcaagacaacagtgggacctacggcaagatctgggagggcagcagcaagtgcaacatcaacaacttcatcttccacaaggtcctgggcaaaggcagcttcgggaaggtgctgcttggagagctgaagggcagaggagagtactttgccatcaaggccctcaagaaggatgtggtcctgatcgacgacgacgtggagtgcaccatggttgagaagcgggtgctgacacttgccgcagagaatccctttctcacccacctcatctgcaccttccagaccaaggaccacctgttctttgtgatggagttcctcaacgggggggacctgatgtaccacatccaggacaaaggccgctttgaactctaccgtgccacgttttatgccgctgagataatgtgtggactgcagtttctacacagcaagggcatcatttacagggacctcaaactggacaatgtgctgctggaccgggatggccacatcaagattgccgactttgggatgtgcaaagagaacatattcggggagagccgggccagcaccttctgcggcacccctgactatatcgcccctgagatcctacagggcctgaagtacacattctctgtggactggtggtctttcggggtccttctgtacgagatgctcattggccagtcccccttccatggtgatgatgaggatgaactcttcgagtccatccgtgtggacacgccacattatccccgctggatcaccaaggagtccaaggacatcctggagaagctctttgaaagggaaccaaccaagaggctgggagtgaccggaaacatcaaaatccaccccttcttcaagaccataaactggactctgctggaaaagcggaggttggagccacctttcaggcccaaagtgaagtcacccagagactacagtaactttgaccaggagttcctgaacgagaaggcgcgcctctcctacagcgacaagaacctcatcgactccatggaccagtctgcattcgctggcttctcctttgtgaaccccaaattcgagcacctcctggaagattgaggttcctggacagatcaggctagccctgccctccacccacacctgcccgctccccacgataagcaccagtgggactgtggtgacttctgctgctggccccgcccctgcccccagagcgtccttggctgccgtctggccgggctctcatggtacttcctctgtgaactgtgtgtgaatctgcttttcctctgccttcggagggaaattgtaaatcctgtgtttcattacttgaatgtagttatctattgaaaatatatattatatacatagacatatatatatatataataggctgtatatattgctcagtagagaaaaaccatgggggactggtgatatgttgatctttttcaaaaaaatatatatatgacaaaaaaaaaaaaaaaggagcacaagctgtttgaaccaccaggtttatttgtgtgtctaaataaacaccaaatagtaccaa

SEQ ID NO: 719 - DNA, 589 bp, Homo sapiens
aaggattagggagtcctgagccccaggctgctctgctcagtcttggaaggcctcacgcaacccccttcacaaagcctgcccgattgtgtcctcaagggacaatttatagcatgcaatgacagtgcggagggcaggtctgtctggggagatgaaacgacctgtgcgattacaggagattcctactttcctcgcccccagtcctcaaggtcttctcagaggttcccactaggaggccggctgcagtgccctggacgaccctcacacccaggacctcagttgctccatccaaggaatgggcgagctcaggtcttcctgactttcctggagaacaaagaggccccactgcaggccccaccatggcgccgttcctgcgcatcgccttcaactcctatgagctgggctccctgcaggccgaggacgaggcgaaccagcccttctgtgccgtgaagatgaaggaggcgctcagcacagagcgtgggaaaacactggtgcagaagaagccgaccatgtatcctgagtggaagtcgacgttcgatgcccacatctatgaggggcgcgtcatccagattgtgctaatgcgggcagcaga

SEQ ID NO: 720 - DNA, 562 bp, Homo sapiens
aaactgagaaactgagccgcggtcagcgaaagtcccgccgcgccgagacctgccggtctgcagggaactggccaggcaagggggcaggcccgtttctcctggtggttggtgcgttgtagcagcagcgggagccaggactaaggacaagcaggagctgggagccccagccccactgcaggccccaccatggcgccgttcctgcgcatcgccttcaactcctatgagctgggctccctgcaggccgaggacgaggcgaaccagcccttctgtgccgtgaagatgaaggaggcgctcagcacagagcgtgggaaaacactggtgcagaagaagccgaccatgtatcctgagtggaagtcgacgttcgatgcccacatctatgaggggcgcgtcatccagattgtgctaatgcgggcagcagaggagccagtgtctgaggtgaccgtgggtgtgtcggtgctggccgagcgctgcaagaagaacaatggcaaggctgagttctggctggacctgcagcctcaggccaaggtgttgatgtctgttcagtatttcctggaggacgtgg

SEQ ID NO: 721 - DNA, 2326 bp, Homo sapiens
gccccgcgcgccgccggagttccgcggagttgaccgggtcggcgccgtcggtcctgagcgctgccttccgcgttccgccgcggccccacctggagcccccgccccgcgccatggccggagctcccggggcgcagcgctgacggcggcggggggagcgcgccatgcccagcaggaccggccccaagatggaagggagcggcggccgcgtccgcctcaaggcgcattacgggggggacatcttcatcaccagcgtggacgccgccacgaccttcgaggagctctgtgaggaagtgagagacatgtgtcgtctgcaccagcagcacccgctcaccctcaagtgggtggacagcgaaggtgacccttgcacggtgtcctcccagatggagctggaagaggctttccgcctggcccgtcagtgcagggatgaaggcctcatcattcatgttttcccgagcacccctgagcagcctggcctgccatgtccgggagaagacaaatctatctaccgccggggagccagaagatggaggaagctgtaccgtgccaacggccacctcttccaagccaagcgctttaacaggagagcgtactgcggtcagtgcagcgagaggatatggggcctcgcgaggcaaggctacaggtgcatcaactgcaaactgctggtccataagcgctgccacggcctcgtcccgctgacctgcaggaagcatatggattctgtcatgccttcccaagagcctccagtagacgacaagaacgaggacgccgaccttccttccgaggagacagatggaattgcttacatttcctcatcccggaagcatgacagcattaaagacgactcggaggaccttaagccagttatcgatgggatggatggaatcaaaatctctcaggggcttgggctgcaggactttgacctaatcagagtcatcgggcgcgggagctacgccaaggttctcctggtgcggttgaagaagaatgaccaaatttacgccatgaaagtggtgaagaaagagctggtgcatgatgacgaggatattgactgggtacagacagagaagcacgtgtttgagcaggcatccagcaaccccttcctggtcggattacactcctgcttccagacgacaagtcggttgttcctggtcattgagtacgtcaacggcggggacctgatgttccacatgcagaggcagaggaagctccctgaggagcacgccaggttctacgcggccgagatctgcatcgccctcaacttcctgcacgagagggggatcatctacagggacctgaagctggacaacgtcctcctggatgcggacgggcacatcaagctcacagactacggcatgtgcaaggaaggcctgggccctggtgacacaacgagcactttctgcggaaccccgaattacatcgcccccgaaatcctgcggggagaggagtacgggttcagcgtggactggtgggcgctgggagtcctcatgtttgagatgatggccgggcgctccccgttcgacatcatcaccgacaacccggacatgaacacagaggactaccttttccaagtgatcctggagaagcccatccggatcccccggttcctgtccgtcaaagcctcccatgttttaaaaggatttttaaataaggaccccaaagagaggctcggctgccggccacagactggattttctgacatcaagtcccacgcgttcttccgcagcatagactgggacttgctggagaagaagcaggcgctccctccattccagccacagatcacagacgactacggtctggacaactttgacacacagttcaccagcgagcccgtgcagctgaccccagacgatgaggatgccataaagaggatcgaccagtcagagttcgaaggctttgagtatatcaacccattattgctgtccaccgaggagtcggtgtgaggccgcgtgcgtctctgtcgtggacacgcgtgattgaccctttaactgtatccttaaccaccgcatatgcatgccaggctgggcacggctccgagggcggccagggacagacgcttgcgccgagaccgcagagggaagcgtcagcgggcgctgctgggagcagaacagtccctcacacctgggcccgggcaggccagcttcgtgctggaggaacttgctgctgtgcctgcgtcgcggcggatccgcggggaccctgccgagggggctgtcatgcggtttccaaggtgcacattttccacggaaacagaactcgatgcactgacctgctccgccaggaaagtgagcgtgtagcgtcctgaggaataaaatgttccgatgatgtggaa

SEQ ID NO: 722 - DNA, 2009 bp, Homo sapiens
agaacatcgctcggtgccagacaggcaggacgcagcgggctggcctgcggggctcactgctgccccccggggccgagcacgaaagggagagttggagggcgcttcctcgccgggtgttgcggtgtgagcggggactggtgagtgtgtgctgtcttcagagagagaagagcagttttcaggaatctatctaccgccggggagccagaagatggaggaagctgtaccgtgccaacggccacctcttccaagccaagcgctttaacaggagagcgtactgcggtcagtgcagcgagaggatatggggcctcgcgaggcaaggctacaggtgcatcaactgcaaactgctggtccataagcgctgccacggcctcgtcccgctgacctgcaggaagcatatggattctgtcatgccttcccaagagcctccagtagacgacaagaacgaggacgccgaccttccttccgaggagacagatggaattgcttacatttcctcatcccggaagcatgacagcattaaagacgactcggaggaccttaagccagttatcgatgggatggatggaatcaaaatctctcaggggcttgggctgcaggactttgacctaatcagagtcatcgggcgcgggagctacgccaaggttctcctggtgcggttgaagaagaatgaccaaatttacgccatgaaagtggtgaagaaagagctggtgcatgatgacgaggatattgactgggtacagacagagaagcacgtgtttgagcaggcatccagcaaccccttcctggtcggattacactcctgcttccagacgacaagtcggttgttcctggtcattgagtacgtcaacggcggggacctgatgttccacatgcagaggcagaggaagctccctgaggagcacgccaggttctacgcggccgagatctgcatcgccctcaacttcctgcacgagagggggatcatctacagggacctgaagctggacaacgtcctcctggatgcggacgggcacatcaagctcacagactacggcatgtgcaaggaaggcctgggccctggtgacacaacgagcactttctgcggaaccccgaattacatcgcccccgaaatcctgcggggagaggagtacgggttcagcgtggactggtgggcgctgggagtcctcatgtttgagatgatggccgggcgctccccgttcgacatcatcaccgacaacccggacatgaacacagaggactaccttttccaagtgatcctggagaagcccatccggatcccccggttcctgtccgtcaaagcctcccatgttttaaaaggatttttaaataaggaccccaaagagaggctcggctgccggccacagactggattttctgacatcaagtcccacgcgttcttccgcagcatagactgggacttgctggagaagaagcaggcgctccctccattccagccacagatcacagacgactacggtctggacaactttgacacacagttcaccagcgagcccgtgcagctgaccccagacgatgaggatgccataaagaggatcgaccagtcagagttcgaaggctttgagtatatcaacccattattgctgtccaccgaggagtcggtgtgaggccgcgtgcgtctctgtcgtggacacgcgtgattgaccctttaactgtatccttaaccaccgcatatgcatgccaggctgggcacggctccgagggcggccagggacagacgcttgcgccgagaccgcagagggaagcgtcagcgggcgctgctgggagcagaacagtccctcacacctgggcccgggcaggccagcttcgtgctggaggaacttgctgctgtgcctgcgtcgcggcggatccgcggggaccctgccgagggggctgtcatgcggtttccaaggtgcacattttccacggaaacagaactcgatgcactgacctgctccgccaggaaagtgagcgtgtagcgtcctgaggaataaaatgttccgatgatgtgg

SEQ ID NO: 723 - DNA, 2294 bp, Homo sapiens
ctggcaggccaacctgcaggaccccgggcttagctgggttctgttctgatgtcgcattttcaaggtccgctgagtccgagccctgcctgggtctggctgctgcccgcccgctctctggactgtgctgatgcagagatgcttgttttcctgtgacgtcagcgtcagctcctgcacatccatgccgtgttttagtttgtgcctcagctgctggctacagcttcccgggggagccgggtaccacccgggcctggagacatgaggaggcagggatgtgaggggcgggggacaggacagccggccttccgttaaatatctgctcctcgcgctcgagcctccctgcctattgtcggggccggaggcgagccgacgcagcatcagctcgtcaacgggaaggaagatgcctccctgcacgcccgccgcgcacagagcataaagaatctgcgctgaggaggcaggagaagaaagccgaatctatctaccgccggggagccagaagatggaggaagctgtaccgtgccaacggccacctcttccaagccaagcgctttaacaggagagcgtactgcggtcagtgcagcgagaggatatggggcctcgcgaggcaaggctacaggtgcatcaactgcaaactgctggtccataagcgctgccacggcctcgtcccgctgacctgcaggaagcatatggattctgtcatgccttcccaagagcctccagtagacgacaagaacgaggacgccgaccttccttccgaggagacagatggaattgcttacatttcctcatcccggaagcatgacagcattaaagacgactcggaggaccttaagccagttatcgatgggatggatggaatcaaaatctctcaggggcttgggctgcaggactttgacctaatcagagtcatcgggcgcgggagctacgccaaggttctcctggtgcggttgaagaagaatgaccaaatttacgccatgaaagtggtgaagaaagagctggtgcatgatgacgaggatattgactgggtacagacagagaagcacgtgtttgagcaggcatccagcaaccccttcctggtcggattacactcctgcttccagacgacaagtcggttgttcctggtcattgagtacgtcaacggcggggacctgatgttccacatgcagaggcagaggaagctccctgaggagcacgccaggttctacgcggccgagatctgcatcgccctcaacttcctgcacgagagggggatcatctacagggacctgaagctggacaacgtcctcctggatgcggacgggcacatcaagctcacagactacggcatgtgcaaggaaggcctgggccctggtgacacaacgagcactttctgcggaaccccgaattacatcgcccccgaaatcctgcggggagaggagtacgggttcagcgtggactggtgggcgctgggagtcctcatgtttgagatgatggccgggcgctccccgttcgacatcatcaccgacaacccggacatgaacacagaggactaccttttccaagtgatcctggagaagcccatccggatcccccggttcctgtccgtcaaagcctcccatgttttaaaaggatttttaaataaggaccccaaagagaggctcggctgccggccacagactggattttctgacatcaagtcccacgcgttcttccgcagcatagactgggacttgctggagaagaagcaggcgctccctccattccagccacagatcacagacgactacggtctggacaactttgacacacagttcaccagcgagcccgtgcagctgaccccagacgatgaggatgccataaagaggatcgaccagtcagagttcgaaggctttgagtatatcaacccattattgctgtccaccgaggagtcggtgtgaggccgcgtgcgtctctgtcgtggacacgcgtgattgaccctttaactgtatccttaaccaccgcatatgcatgccaggctgggcacggctccgagggcggccagggacagacgcttgcgccgagaccgcagagggaagcgtcagcgggcgctgctgggagcagaacagtccctcacacctgggcccgggcaggccagcttcgtgctggaggaacttgctgctgtgcctgcgtcgcggcggatccgcggggaccctgccgagggggctgtcatgcggtttccaaggtgcacattttccacggaaacagaactcgatgcactgacctgctccgccaggaaagtgagcgtgtagcgtcctgaggaataaaatgttccgatgatg

SEQ ID NO: 724 - DNA, 1916 bp, Homo sapiens
gtgctgcaggccctgtgcgtgcggaggacggtgcccgagtcagcattttgggtctgagtcccggcgttgccgctgcctgtgcgctgcacagatgctccgggcagcaacacggctggtgccacggcccggggaaggcgtgcggctgcagcagctcccagcaatgtcaggggaaacgcagtgagaggctgttgttttgcgggtgacagatttttagaaaaataaggctgtggagggaccttctgagcgaggcaggggctgctggagggacatgctcaccccgaggacggatgaatctatctaccgccggggagccagaagatggaggaagctgtaccgtgccaacggccacctcttccaagccaagcgctttaacaggagagcgtactgcggtcagtgcagcgagaggatatggggcctcgcgaggcaaggctacaggtgcatcaactgcaaactgctggtccataagcgctgccacggcctcgtcccgctgacctgcaggaagcatatggattctgtcatgccttcccaagagcctccagtagacgacaagaacgaggacgccgaccttccttccgaggagacagatggaattgcttacatttcctcatcccggaagcatgacagcattaaagacgactcggaggaccttaagccagttatcgatgggatggatggaatcaaaatctctcaggggcttgggctgcaggactttgacctaatcagagtcatcgggcgcgggagctacgccaaggttctcctggtgcggttgaagaagaatgaccaaatttacgccatgaaagtggtgaagaaagagctggtgcatgatgacgaggatattgactgggtacagacagagaagcacgtgtttgagcaggcatccagcaaccccttcctggtcggattacactcctgcttccagacgacaagtcggttgttcctggtcattgagtacgtcaacggcggggacctgatgttccacatgcagaggcagaggaagctccctgaggagcacgccaggttctacgcggccgagatctgcatcgccctcaacttcctgcacgagagggggatcatctacagggacctgaagctggacaacgtcctcctggatgcggacgggcacatcaagctcacagactacggcatgtgcaaggaaggcctgggccctggtgacacaacgagcactttctgcggaaccccgaattacatcgcccccgaaatcctgcggggagaggagtacgggttcagcgtggactggtgggcgctgggagtcctcatgtttgagatgatggccgggcgctccccgttcgacatcatcaccgacaacccggacatgaacacagaggactaccttttccaagtgatcctggagaagcccatccggatcccccggttcctgtccgtcaaagcctcccatgttttaaaaggatttttaaataaggaccccaaagagaggctcggctgccggccacagactggattttctgacatcaagtcccacgcgttcttccgcagcatagactgggacttgctggagaagaagcaggcgctccctccattccagccacagatcacagacgactacggtctggacaactttgacacacagttcaccagcgagcccgtgcagctgaccccagacgatgaggatgccataaagaggatcgaccagtcagagttcgaaggctttgagtatatcaacccattattgctgtccaccgaggagtcggtgtgaggccgcgtgcgtctctgtcgtggacacgcgtgattgaccctttaactgtatccttaaccaccgcatatgcatgccaggctgggcacggctccgagggcggccagggacagacgcttgcgccgagaccgcagagggaagcgtcagcgggcgctgctgggagcagaacagtccctcacacctg

SEQ ID NO: 725 - DNA, 567 bp, Homo sapiens
gaattcccgatgcacctccttccagcacatggactgtcagagccctgcgttgtcgccagcacagcagatctgaaaggcactaggctgtggcctcgcgacggctgagaatctatctaccgccggggagccagaagatggaggaagctgtaccgtgccaacggccacctcttccaagccaagcgctttaacaggagagcgtactgcggtcagtgcagcgagaggatatggggcctcgcgaggcaaggctacaggtgcatcaactgcaaactgctggtccataagcgctgccacggcctcgtcccgctgacctgcaggaagcatatggattctgtcatgccttcccaagagcctccagtagacgacaagaacgaggacgccgaccttccttccgaggagacagatggaattgcttacatttcctcatcccggaagcatgacagcattaaagacgactcggaggaccttaagccagttatcgatgggatggatggaatcaaaatctctcaggggcttgggctgcaggactttgacctaatcagagtcatcgggcgcgggagctacgccaag

SEQ ID NO: 726 - DNA, 788 bp, Homo sapiens
ttttttttaaaaaaaaaaacaacaaaaaaccaaaacaacaaccagcctccccagtcaggcttgtggggagccgtgggcctggggagactgggctgctgaaggtggggactgggctgctgggggaggcggctttccctctcggggggtgctggctgctggggaggctggcagcgcgcccctcccccaggtgcgaagggacctcagcagacgcagggctgctccgcacagccagcttgggccgcaggggtccttgagtgatgaagattctgtgttgatgggaatctatctaccgccggggagccagaagatggaggaagctgtaccgtgccaacggccacctcttccaagccaagcgctttaacaggagagcgtactgcggtcagtgcagcgagaggatatggggcctcgcgaggcaaggctacaggtgcatcaactgcaaactgctggtccataagcgctgccacggcctcgtcccgctgacctgcaggaagcatatggattctgtcatgccttcccaagagcctccagtagacgacaagaacgaggacgccgaccttccttccgaggagacagatggaattgcttacatttcctcatcccggaagcatgacagcattaaagacgactcggaggaccttaagccagttatcgatgggatggatggaatcaaaatctctcaggggcttgggctgcaggactttgacctaatcagagtcatcgggcgcgggagctacgccaaggttctcctggtgcggttgaagaagaatgaccaaatttacgccatgaaa

SEQ ID NO: 727 - DNA, 706 bp, Homo sapiens
ggcggggctgctgccggcctggactcaggaccctcaccctccagcccgcaccctcgactccccaccagccagaccctctgtcctggtgtggacagcacccacatcctggctccacccttgtttcttgccctttgacctacagcctcaggacgtgcaggagggagaatctatctaccgccggggagccagaagatggaggaagctgtaccgtgccaacggccacctcttccaagccaagcgctttaacaggagagcgtactgcggtcagtgcagcgagaggatatggggcctcgcgaggcaaggctacaggtgcatcaactgcaaactgctggtccataagcgctgccacggcctcgtcccgctgacctgcaggaagcatatggattctgtcatgccttcccaagagcctccagtagacgacaagaacgaggacgccgaccttccttccgaggagacagatggaattgcttacatttcctcatcccggaagcatgacagcattaaagacgactcggaggaccttaagccagttatcgatgggatggatggaatcaaaatctctcaggggcttgggctgcaggactttgacctaatcagagtcatcgggcgcgggagctacgccaaggttctcctggtgcggttgaagaagaatgaccaaatttacgccatgaaagtggtgaagaaagagctggtgcatgatgacgag

SEQ ID NO: 728 - DNA, 614 bp, Homo sapiens
agaacatcgctcggtgccagacaggcaggacgcagcgggctggcctgcggggctcactgctgccccccggggccgagcacgaaagggagagttggagggcgcttcctcgccgggtgttgcggtgtgagcggggactggtgagtgtgtgctgtcttcagagagagaagagcagttttcaggaatctatctaccgccggggagccagaagatggaggaagctgtaccgtgccaacggccacctcttccaagccaagcgctttaacaggagagcgtactgcggtcagtgcagcgagaggatatggggcctcgcgaggcaaggctacaggtgcatcaactgcaaactgctggtccataagcgctgccacggcctcgtcccgctgacctgcaggaagcatatggattctgtcatgccttcccaagagcctccagtagacgacaagaacgaggacgccgaccttccttccgaggagacagatggaattgcttacatttcctcatcccggaagcatgacagcattaaagacgactcggaggaccttaagccagttatcgatgggatggatggaatcaaaatctctcaggggcttgggctgcaggactttgacctaatcaga

SEQ ID NO: 729 - DNA, 563 bp, Homo sapiens
tttcgtgtgagcccacgctggccatgcacagctggcacgatcccttgcggtgtgaatacactgctggggtgggagcgccgtggccagggtcaggattcgagcggttactggcttttggtctgatggccctcggtggaatctatctaccgccggggagccagaagatggaggaagctgtaccgtgccaacggccacctcttccaagccaagcgctttaacaggagagcgtactgcggtcagtgcagcgagaggatatggggcctcgcgaggcaaggctacaggtgcatcaactgcaaactgctggtccataagcgctgccacggcctcgtcccgctgacctgcaggaagcatatggattctgtcatgccttcccaagagcctccagtagacgacaagaacgaggacgccgaccttccttccgaggagacagatggaattgcttacatttcctcatcccggaagcatgacagcattaaagacgactcggaggaccttaagccagttatcgatgggatggatggaatcaaaatctctcaggggcttgggctgcaggactttgacct

SEQ ID NO: 730 - DNA, 1389 bp, Homo sapiens
gcggcgccgccatgtccgacagcgagaagctcaacctggactcgatcatcgggcgcctgctggaagggtccagggtcctgacaccccattgcgccccagtgcagggctcgcggcctggcaagaatgtacagctgacagagaacgagatccgcggtctgtgcctgaaatcccgggagatttttctgagccagcccattcttctggagctggaggcacccctcaagatctgcggtgacatacacggccagtactacgaccttctgcgactatttgagtatggcggtttccctcccgagagcaactacctctttctgggggactatgtggacaggggcaagcagtccttggagaccatctgcctgctgctggcctataagatcaagtaccccgagaacttcttcctgctccgtgggaaccacgagtgtgccagcatcaaccgcatctatggtttctacgatgagtgcaagagacgctacaacatcaaactgtggaaaaccttcactgactgcttcaactgcctgcccatcgcggccatagtggacgaaaagatcttctgctgccacggaggcctgtccccggacctgcagtctatggagcagattcggcggatcatgcggcccacagatgtgcctgaccagggcctgctgtgtgacctgctgtggtctgaccctgacaaggacgtgcagggctggggcgagaacgaccgtggcgtctcttttacctttggagccgaggtggtggccaagttcctccacaagcacgacttggacctcatctgccgagcacaccaggtggtagaagacggctacgagttctttgccaagcggcagctggtgacacttttctcagctcccaactactgtggcgagtttgacaatgctggcgccatgatgagtgtggacgagaccctcatgtgctctttccagatcctcaagcccgccgacaagaacaaggggaagtacgggcagttcagtggcctgaaccctggaggccgacccatcaccccaccccgcaattccgccaaagccaagaaatagcccccgcacaccaccctgtgccccagatgatggattgattgtacagaaatcatgctgccatgctgggggggggtcaccccgacccctcaggcccacctgtcacggggaacatggagccttggtgtatttttcttttctttttttaatgaatcaatagcagcgtccagtcccccagggctgcttcctgcctgcacctgcggtgactgtgagcaggatcctggggccgaggctgcagctcagggcaacggcaggccaggtcgtgggtctccagccgtgcttggcctcagggctggcagccggatcctggggcaacccatctggtctcttgaataaaggtcaaagctggattctc

SEQ ID NO: 731 - DNA, 1476 bp, Homo sapiens
gcggggcgggcccgggaggcctggaggcggggccgcgggccgggggcggactggggcgggcggaaggagagccaggccggaaggaggctgccggagggcgggaggcaggagcgggccaggagctgctgggctggagcggcggcgccgccatgtccgacagcgagaagctcaacctggactcgatcatcgggcgcctgctggaagtgcagggctcgcggcctggcaagaatgtacagctgacagagaacgagatccgcggtctgtgcctgaaatcccgggagatttttctgagccagcccattcttctggagctggaggcacccctcaagatctgcggtgacatacacggccagtactacgaccttctgcgactatttgagtatggcggtttccctcccgagagcaactacctctttctgggggactatgtggacaggggcaagcagtccttggagaccatctgcctgctgctggcctataagatcaagtaccccgagaacttcttcctgctccgtgggaaccacgagtgtgccagcatcaaccgcatctatggtttctacgatgagtgcaagagacgctacaacatcaaactgtggaaaaccttcactgactgcttcaactgcctgcccatcgcggccatagtggacgaaaagatcttctgctgccacggaggcctgtccccggacctgcagtctatggagcagattcggcggatcatgcggcccacagatgtgcctgaccagggcctgctgtgtgacctgctgtggtctgaccctgacaaggacgtgcagggctggggcgagaacgaccgtggcgtctcttttacctttggagccgaggtggtggccaagttcctccacaagcacgacttggacctcatctgccgagcacaccaggtggtagaagacggctacgagttctttgccaagcggcagctggtgacacttttctcagctcccaactactgtggcgagtttgacaatgctggcgccatgatgagtgtggacgagaccctcatgtgctctttccagatcctcaagcccgccgacaagaacaaggggaagtacgggcagttcagtggcctgaaccctggaggccgacccatcaccccaccccgcaattccgccaaagccaagaaatagcccccgcacaccaccctgtgccccagatgatggattgattgtacagaaatcatgctgccatgctgggggggggtcaccccgacccctcaggcccacctgtcacggggaacatggagccttggtgtatttttcttttctttttttaatgaatcaatagcagcgtccagtcccccagggctgcttcctgcctgcacctgcggtgactgtgagcaggatcctggggccgaggctgcagctcagggcaacggcaggccaggtcgtgggtctccagccgtgcttggcctcagggctggcagccggatcctggggcaacccatctggtctcttgaataaa

SEQ ID NO: 732 - DNA, 1685 bp, Homo sapiens
cttcttgctgacgccgccagcgccgaccaccagcagctgttttccctccatgaggcagcgcgccgaccgccgaagcatggtctccaccagcggcgccgccaccgcctcgtcggccgccggccccagccgcggcgcggcccacagcccctccagcgcgccgcacgcctccagacacaggccgccgttcagctccagggccactgggcttctccagcagcgccagcactgtgtccaccactgcacccagctctgcccgcgggtgcagacgccatgcctgccgcccccgccagcgccagccactgagcttcacagctacctgcagcaaggaggggaaaggggcctcctggacaccaccccaggtactgcagggtggggcacttccgccacaggagccgtgcagggctcgcggcctggcaagaatgtacagctgacagagaacgagatccgcggtctgtgcctgaaatcccgggagatttttctgagccagcccattcttctggagctggaggcacccctcaagatctgcggtgacatacacggccagtactacgaccttctgcgactatttgagtatggcggtttccctcccgagagcaactacctctttctgggggactatgtggacaggggcaagcagtccttggagaccatctgcctgctgctggcctataagatcaagtaccccgagaacttcttcctgctccgtgggaaccacgagtgtgccagcatcaaccgcatctatggtttctacgatgagtgcaagagacgctacaacatcaaactgtggaaaaccttcactgactgcttcaactgcctgcccatcgcggccatagtggacgaaaagatcttctgctgccacggaggcctgtccccggacctgcagtctatggagcagattcggcggatcatgcggcccacagatgtgcctgaccagggcctgctgtgtgacctgctgtggtctgaccctgacaaggacgtgcagggctggggcgagaacgaccgtggcgtctcttttacctttggagccgaggtggtggccaagttcctccacaagcacgacttggacctcatctgccgagcacaccaggtggtagaagacggctacgagttctttgccaagcggcagctggtgacacttttctcagctcccaactactgtggcgagtttgacaatgctggcgccatgatgagtgtggacgagaccctcatgtgctctttccagatcctcaagcccgccgacaagaacaaggggaagtacgggcagttcagtggcctgaaccctggaggccgacccatcaccccaccccgcaattccgccaaagccaagaaatagcccccgcacaccaccctgtgccccagatgatggattgattgtacagaaatcatgctgccatgctgggggggggtcaccccgacccctcaggcccacctgtcacggggaacatggagccttggtgtatttttcttttctttttttaatgaatcaatagcagcgtccagtcccccagggctgcttcctgcctgcacctgcggtgactgtgagcaggatcctggggccgaggctgcagctcagggcaacggcaggccaggtcgtgggtctccagccgtgcttggcctcagggctggcagccggatcctggggcaacccatctggtctcttgaataaaggtcaaagctggattctc

SEQ ID NO: 733 - DNA, 4649 bp, Homo sapiens
cttttcccctccgctccccgccgcctcctgacgccgggcgtgacgtcaccacgcccggcggccgccattacagagagccgagctctggagcctcagcgagcggaggaggaggcgcagcggccgacggccgagtactgcggtgagagccagcgggccagcgccagcctcaacagccgccagaagtacacgaggaaccggcggcggcgtgtgcgtgtaggcccgtgtgcgggcggcggcgcgggagcagcgcggagcggcagccggctggggcgggtggcatcatggacgagaaggtgttcaccaaggagctggaccagtggatcgagcagctgaacgagtgcaagcagctgtccgagtcccaggtcaagagcctctgcgagaaggctaaagaaatcctgacaaaagaatccaacgtgcaagaggttcgatgtccagttactgtctgtggagatgtgcatgggcaatttcatgatctcatggaactgtttagaattggtggcaaatcaccagatacaaattacttgtttatgggagattatgttgacagaggatattattcagttgaaacagttacactgcttgtagctcttaaggttcgttaccgtgaacgcatcaccattcttcgagggaatcatgagagcagacagatcacacaagtttatggtttctatgatgaatgtttaagaaaatatggaaatgcaaatgtttggaaatattttacagatctttttgactatcttcctctcactgccttggtggatgggcagatcttctgtctacatggtggtctctcgccatctatagatacactggatcatatcagagcacttgatcgcctacaagaagttccccatgagggtccaatgtgtgacttgctgtggtcagatccagatgaccgtggtggttggggtatatctcctcgaggagctggttacacctttgggcaagatatttctgagacatttaatcatgccaatggcctcacgttggtgtctagagctcaccagctagtgatggagggatataactggtgccatgaccggaatgtagtaacgattttcagtgctccaaactattgttatcgttgtggtaaccaagctgcaatcatggaacttgacgatactctaaaatactctttcttgcagtttgacccagcacctcgtagaggcgagccacatgttactcgtcgtaccccagactacttcctgtaatgaaattttaaacttgtacagtattgccatgaaccatatatcgacctaatggaaatgggaagagcaacagtaactccaaagtgtcagaaaatagttaacattcaaaaaacttgttttcacatggaccaaaagatgtgccatataaaaatacaaagcctcttgtcatcaacagccgtgaccactttagaatgaaccagttcattgcatgctgaagcgacattgttggtcaagaaaccagtttctggcatagcgctatttgtagttacttttgctttctctgagagactgcagataataagatgtaaacattaacacctcgtgaatacaatttaacttccatttagctatagctttactcagcatgactgtagataaggatagcagcaaacaatcattggagcttaatgaacatttttaaaaataattaccaaggcctcccttctacttgtgagttttgaaattgttctttttattttcagggataccgtttaatttaattatatgatttgtctgcactcagtttattccctactcaaatctcagccccatgttgttctttgttattgtcagaacctggtgagttgttttgaacagaactgttttttccccttcctgtaagacgatgtgactgcacaagagcactgcagtgtttttcataataaacttgtgaactaagaactgagaaggtcaaattttaattgtatcaatgggcaagactggtgctgtttattaaaaaagttaaatcaattgagtaaattttagaatttgtagacttgtaggtaaaataaaaatcaagggcactacataacctctctggtaactccttgacattcttcagattaacttcaggatttatttgtatttcacatattacaatttgtcacattgttggtgtgcactttgtgggttcttcctgcatattaacttgtttgtaagaaaggaaatctgtgctgcttcagtaagacttaattgtaaaaccatataacttgagatttaagtctttgggttttgttttaataaaacagcatgttttcaggtagagcttaaactaaatgatgtgtttacttagtgcagtttctggttatgaatattatattgctatgtgtatattatatggactctttaaaatgattgacagattggcaaattcttaaatctttgtacattgttgagtcatatgttcttagagttaaatttgtctcagataagaaagtgttaaagcattagcctgtgtcaagttctttgagtgatactagtgaaaccaaatagaaaactattgttggatcatgatttagtcttatgtacattcacccgaagacaaaaatggtacttaaagtggcagtgttcaacatttaatgagtttttccccttttatccttcgaataggattagatgtttaaaaaaaagttcttctgtgggaactaatatttgatattttaacctaccagagtaaacaggaacacttaatcatacttgtgagtgtagtaaataaaagttttcttgctttgtgctgtgttgaatctggaaccaacagggaagttatagcatatcccctttctaaaatgcttgaggaacacatacataccgaatgtcttttctgatctaattgatagtatttttagtggcttgtggagttaattttccaaagcaaaaggccattagggtttctacatttcatttcatttcattcttttctttcacaagaaatacattctctgtgtgtctttttgttgctctgtcactctatgccctttctctccgactgaacaaatagcttatccatgtgcagtggttttaatacccaaacaatctagacaccaagcagctattttttccggtcctgtgatatcagaattgaccaaggaatacgtatattgtaattgacacgtggtggtatcttccaggtacaaattctctaaattttgtggttagcagaatgggacttgtgataagaatagcttggttttagcataactagggtttaaaataattgtttaattatagagactgaccgggctttggccatctaaactggaaagtgttagtaccctaccttcttttgaaaatggctatggtaaggaaaatgtgttagtaaattatgtattttcttgaaaaatacataattatggttggatgggaatcactaagttgggtgttaactgatgtctcaattagtaacattaggattttcattaataaacctaaaaagctttccctaagaacaggcctggcacagtggctcatgcctgtaatcccagcactttgggagaccagggtgggtggatcccttgaggtcaggagttgaagagcagcctggccaacatggcaaaaccccatctctacaaaaaatatgaaaatcagccgggcttggtggcataccatagtcccagctacttgggaggctgaggtgagaggatcgcctgagcccaggagatggaggttgcagtgggctgagattgtgccactgtactccagtctgggtgacagagccagaccctgtctcaaaaataaagaggattctgagtttgtatagtgagggcttgcagaaattttgaaacttattttgtaagtttacaatgaatttgtacatgatgtgctcatgtcttgggttgagtatcctagacatgattttttcatttgctgcatattaaacatttgttggttgtagtcggtatttcttaaatagaagtttgtcaatattagattagtttcaagaaggacttagctcaggaaaaggatagttatttctgtggttctcagctttgatgcctacagagattctgatttaaattgctggaggagggcccaggcatacattttttaagtttcccaagtgattctaatttacatctagggttaaaaacagccaggcgcggtggctcatgcctgtaatcccagcacttggggaggccggggtgggtggatcacctgatgtcaggagatcgagaccagcctggccagcgtggtgaaaccccatctctattaaaaatacaaaactgaccggtgtggtggcaggagcctgtaatcccagctacttgggaggctgaggcaggagaatcacttgaactcaggaggaggaggttacagtgagcccagatcgtgccattgcactccagcctgggcaaaaagagcaaaactccatctcaaaaaacaaaaacacctcactgctgtttcctaagtacatacttaagaaaattgggatacatggtggtggttcatggatgttgataaggaattaaaatgtaccgtgcgactctctgtttcagtggtgacttttacctgtttagtataaatattcctttgcttccaaccataaatgtgttcttagaaatgggcctatagtttagtaacctatagtttggtaataggcttgtttgttttcagatggattttggttctgtgagctaaagctattttgcattaaagccttcgtcctca

SEQ ID NO: 734 - DNA, 5748 bp, Homo sapiens
gctgcagctgcagccgcctgggcgctcctggagcgcgcggtgactcccccggtcggcccgctccatgcagctccgttgcggaagtgtagcggggggaggcggcggccaccgcggcactaagcacgagaggccggggctcggccccctgcagcactaggctctgggagccgcgcgcggcgcgtcccagtggcccgactcgccgtgcgcccggcgcccaccgcagcctgcatgccccgcgctgcgccttgcccggcccccgccgcctcctgctcgcaccgctgcagccgggcgccggagtaatatgctcactcgagtgaaatctgccgtggccaatttcatgggcggcatcatggctggcagctcaggctccgagcacggcggcggcagctgcggaggctcggacctgcccctgcgtttcccctacgggcggccagagttcctggggctgtctcaggacgaggtggagtgcagcgccgaccacatcgcccgccccatcctcatcctcaaggagactcggcggctgccctgggccactggctacgcagaggttatcaatgccgggaagagcacacacaatgaagaccaagccagctgtgaggtgctcactgtgaagaagaaggcaggggccgtgacctcaaccccaaacaggaactcatccaagagacggtcctcccttcccaatggggaagggctgcagctgaaggagaactcggaatccgagggtgtttcctgccactattggtcgctgtttgacgggcacgcggggtccggggccgcggtggtggcgtcacgcctgctgcagcaccacatcacggagcagctgcaggacatcgtggacatcctgaagaactccgccgtcctgccccctacctgcctgggggaggagcctgagaacacgcccgccaacagccggactctgacccgggcagcctccctgcgcggaggggtgggggccccgggctcccccagcacgccccccacacgcttctttaccgagaagaagattccccatgagtgcctggtcatcggagcgcttgaaagtgcattcaaggaaatggacctacagatagaacgagagaggagttcatataatatatctggtggctgcacggccctcattgtgatttgccttttggggaagctgtatgttgcaaatgctggggatagcagggccataatcatcagaaatggagaaattatccccatgtcttcagaatttacccccgagacggagcgccagcgacttcagtacctggcattcatgcagcctcacttgctgggaaatgagttcacacatttggagtttccaaggagagtacagagaaaggagcttggaaagaagatgctctacagggactttaatatgacaggctgggcatacaaaaccattgaggatgaggacttgaagttcccccttatatatggagaaggcaagaaggcccgggtaatggcaactattggagtgaccaggggacttggggaccatgacctgaaggtgcatgactccaacatctacattaaaccattcctgtcttcagctccagaggtaagaatctacgatctttcaaaatatgatcatggatcagatgatgtgctgatcttggccactgatggactctgggacgttttatcaaatgaagaagtagcagaagcaatcactcagtttcttcctaactgtgatccagatgatcctcacaggtacacactggcagctcaggacctggtgatgcgtgcccggggtgtgctgaaggacagaggatggcggatatctaatgaccgactgggctcaggagacgacatttctgtatatgtcattcctttaatacatggaaacaagctgtcatgaaaatggcccaggggattgggaggacagaggggaagaaagctgggatgcctcttggcaggacggaactgggaagtgccccagctgagttccaagtgatgcagtctcttcccagcccaagcggggagttcatggccaaaagactatgcttcaagatgaccctttggtttccatttcttctttagtaacaggtcaactcaacaagagcaaaacacaaaggctgctaccaagtgttgttgtatttcagttcctttcataggcctccgaggtggccattgactatttggggtatatatgtcatatttattttatctagagtagctggggcagccattttcaggtgtaaatggcagaggactcttcagcctgtcaagctgccagcttatctacgggttaaaaagtgctgcattggaaagtagggggtcatgcctcaaaatgtaagtaagtgcccaccttctaggaagcctgaggtttatttcagggattgccgtctgccccccgccccccttctctttttttcttctctgtttctattcttttatggcagtggtggagtgaggcagggatttttttttttttttttcgtgtttttgacattccttgaatctgttttttattccccttccacagaacaggcctgggactttccaacaccctgctaaggaagttctgtgtccaagtcccacccaggctgggttgtccccacctcctccagcccacacagcccaggcagcatccgggccagtgccctgcatgacagagggtctttgttgtgtaatgtttgttcccaagttgcattttctaaccgaatcagtgtgttttcatgaaactgagtgtttctgtggaccagtagttcctctgttgtcttcagtggtcttcctgtgtggctcaagggttctctgtgagagtctggattttcatttctggaatggctggccccatcccacttttctgtatcatggggacacatataaagcagtgtttaatagagcagtttaagaagttgcttgcatctgttggttcaccatggctcatctggggaccattttggattcatgtttcatggcttgtgactgtccccaagcccactccaaacaaagtgtaaggatcagagttctgtcaaggagcagcagttctgctctccccatcatctttgtgcaaggcccctcggggggcactttaataaaagaatttgaaatgggttgactggccattctcatgctgtgctccctgtctcttctcttctctaaagaatcatgtcccagctcctcaaggtccctctatggttccacatctgagtgttcgccacaagagcagcagcagcaggcacagtgcatgccatatctacctgctgcttctctgctgggaggaatggccaagtagattataaaactcacttctgtctcttaggcagacttgtacggccacaaaattacctagtcttcttcctgctgagctactgaggtattgccaccattttgacaactttgagtaattaaaacactcttctgacccaaaaaggaaaaaaggtcactgacgtgacccccccagcatgctagagagctaattccagttctcatatttgtttgaatttcttcccagaggagaggataggaacctctcctccagggcagtaaatcacctgcatttctggagttgtcggtattgtattcgaaaaggcctggagcccctcctgctcaggaaagaactcattccagggtgtggagacagtgccgtctggcaggtgaaatactgtgggaattcacgccaccaggtgtttgtgcaagtgttggcctgggaagaatgggacttcggccttgtcaggagttgtcttcatctgcagcacgtttcttcctcctgcagtagatcttagctaccccagatatctctatggagagaagtttgtggaaaatgctttgcttcgtggcagagtctgatgctgtaggaaaaccttcgggcatgtgacagcagtgtggtccactccctgttctgccctggcactcagagtcatgtgtaagtaggaaacctgagcaagtcttccgtggaggaccctgagctgccgtctttgggatccttcctgtgtccccaccgtctttcatttatttgctttcctgggcctctatctgggccctaccttgagcttctccagttttattcaagccaccagagtaagaatttgggtgtagatgtcacaactaccttctactcaattcaccaattcatttactgctatggcacgtctcaggaataactctagaaacctctaaatcgaaatattataaaatcttgagcacttagtcctgctggttttagttagaaaggcatccaggaattgttttcctacgcccccttgagtggaaagatcttagttagaagataaagtcaagtttgtgttcaggggatgggaggaagactataaataagatgaagaaatcaaaagtaggaaacatgatgtaaacgaagcatggcagatctgtccagcactgatattgctctataaattgagcttactcagttttggccttatttttttacccaggccccatgtcacccagtcctaaaacagtaaccgtgtctacataacgggttggcccctggtgcatccctggaaaagtcaaaggacgcacacttcgaaattctgcagaacgtatttatacatggttcagaaatcttgcgtatctgacttatagccaaatctgcttgctcgaatagcctcagaggaagtcttgtttaataaaaaccttttgatttcctagtcaagtctttatggttgtctcgaggggtgtgtggctactttaatgaaaggctttcctgctctaaatctctttgctgggctgggcctcttcagactatctggtgaaactcctttccttagaacaaactcagtccgtccatgctctgtggcattttgctagatgataaccaaagccttattcctgtagccagtgtcagcagtcagagaggtggagggtgtgttctgctgtggttatgcatacctatctgctgttcttgaggtgtaaaaggaaaggtgaaaatcgggccaggccaagtactcagctgtcttaataggatgaagccttaagcagtggaaatttcagttattttccacagtattccattttggaggatttggggtgtttactttttaaattcttgaacaacttaacctccatgaggctttgtgaagtcagctgtgaccaccctcctcttactgtgttctcagtattcattcacttccagggaagaatgacagccacagggagatggtggtgggcaagaatgagagtcccaggatccagatttagcctcagatcttccccattcaggaagggttttccatttaacaagagcactagtatgaaaacattagggacaaatctcccatgtctttgaaattcggattctcctcttgagatccccttcctcacctgccaatcaactttataaggccacaagtggtcactggttttccttccacaggtttgaggttctcagctttccttaagcgacccagcagctccgctgttttcagagtgaatatgttaagctttgatgagattctattttcagtaagttagtgcttctgggacacttggagaaagctgtgagagtcattgtctacgcaaagaacaacgaagctgatcctaaaagtgatccaatctaagaaaatggtaaaacgagctctggccacagcacagaattttatgtgaggaactcagatttttgaagacttaacaattgcagagaaaggttgcagcctgcacaccatagcccacctctctgagcagactttggttttgtgtggtgacgtggcacatgtttgtacactgggatttttcaaaggacgctacgcgagcagactgacttgcctcttctgtgagcactgtggcttttgtcagatggag

SEQ ID NO: 735 - DNA, 5143 bp, Homo sapiens
ggacacggagccgcgaggagacagctgaggcccgcggagaccagggggtgaagcctggagaccctcttgccctggcctagctgcaggcccccgggatgctttgggcatgtcctctggagccccacagaagagcagcccaatggccagtggagctgaggagaccccaggcttcctggacacgctcctgcaagacttcccagccctgctgaacccagaggaccctctgccatggaaggccccagggacggtgctcagccaggaggaggtggagggcgagctggctgagctggccatgggctttctgggcagcaggaaggccccgccaccacttgctgctgctctggcccacgaagcagtttcacagctgctacagacagacctttccgaattcaggaagttgcccagggaggaagaagaagaggaggaggacgatgacgaggaggaaaaggcccctgtgaccttgctggatgcccaaagcctggcacagagtttctttaaccgcctttgggaagtcgccggccagtggcagaagcaggtgccattggctgcccgggcctcacagcggcagtggctggtctccatccacgccatccggaacactcgccgcaagatggaggaccggcacgtgtccctcccttccttcaaccagctcttcggcttgtctgaccctgtgaaccgcgcctactttgctgtgtttgatggtcacggaggcgtggatgctgcgaggtacgccgctgtccacgtgcacaccaacgctgcccgccagccagagctgcccacagaccctgagggagccctcagagaagccttccggcgcaccgaccagatgtttctcaggaaagccaagcgagagcggctgcagagcggcaccacaggtgtgtgtgcgctcattgcaggagcgaccctgcacgtcgcctggctcggggattcccaggtcattttggtacagcagggacaggtggtgaagctgatggagccacacagaccagaacggcaggatgagaaggcgcgcattgaagcattgggtggctttgtgtctcacatggactgctggagagtcaacgggaccctggccgtctccagagccatcggggatgtcttccagaagccctacgtgtctggggaggccgatgcagcttcccgggcgctgacgggctccgaggactacctgctgcttgcctgtgatggcttctttgacgtcgtaccccaccaggaagttgttggcctggtccagagccacctgaccaggcagcagggcagcgggctccgtgtcgccgaggagctggtggctgcggcccgggagcggggctcccacgacaacatcacggtcatggtggtcttcctcagggacccccaagagctgctggagggcgggaaccagggagaaggggacccccaggcagaagggaggaggcaggacttgccctccagccttccagaacctgagacccaggctccaccaagaagctaggtggtttccaggcccctgccctccccttcctcccatccttgtccttctctccctcagaagcctcaggacccaacaggtggcaggcagtggacagggtgcccgccccacagtgctttccccagcaccccagagccagtcgggacaccccccgcagcccgtcctggtggctgtggaactgcactgggtggcgggcagatggtggaaggcagcttaggagacctcaccaaagagaagatggaccggctcttgctcccagctcctattaggcccggggtgggaccagaggtcataggtgcccaacggcagccaaaccaaagacactggtgtgcatggggcagcatggttgtgcacgtgggaccctggggcggacccaggagccaaactcttgaagcaccccctgggtcaggcccagcagcggagtggccagccccagtttcccattgctcctctctgcggccagggccaggtgggttcatatttacagatatgcccagccagtcctggtcggccacaccagtgtcccaaagaggagagcgcagcagagccaggggtctgttctgtagcagccacccccctgcccccactccagggcagccatgatgtgcttgggcccaccagggccttccgggctgctctcttccctgagcccggaaccggcgacgcacatgtgtcttttgttggtgtgtttgtttttttccagggaggtctaattccgaagcagtattccaggttttctctttgttttatcagtgccaagatgacctgttgtgtcatataatttaagcagagcttagcatttattttattctttagaaaacttaagtatttacttttttaaagctatttttcaaggaacctttttttgcagtattattgaatttattttctaaatcaggattgaaacaggaacttttccaggtggtgttaataagccattcaagtgccttacacagctttgaagaaactaggactgcagtgggctcggataggcccattgaggtttttagaaaagcaggatttgttttgttagggaggcatgattttggtgagatctttctggaagagttttccgcctctttgtgatgctgaacacccccaaggttctcccctccccccgctgcccaggtgactggcaggagctgcgactgccacgtagtggtgcctgggcccgacagcggggctctgggcatcccgggtgaccttggcccatctgcctgcattcccacccccttgggcctggctggatcccaggcagagggaccttgctgctgtgtgattggaacattcccaaatatcttgtgaatttgtaatcaaattggtctcattgggaaagactcttaattaagaggctcaggcaagcacagaggcagcccgtgggtctctgtctcagtctggaggcagcagggatgctgctgggagtccatggcacaggccacagcccctcaccttgccgcggtggctggcagcacgcctgccttgctctgccccatgccctgaacaggcatgagagctccacgtcccctagtgcaccctgagagggggctcacaagtgaccgatcctgggtgcctcagggagctcactgagggcgtgcaaagttgaaagtggcaaggctgggggagggtgtcgggtagagggaagagggcagggggctaggggaggactcagaggccatctgcagggccaagccacaggaagggctgagctggaggtgggcagggctgctccaggcaggtcagagcagtgcagggggaggagaggagaaagggaggaagctgggctgtgtggtccccatgaaggcattcagagtccacctgcagacagcgagagccccaggaaggtttgcacagctgtgccccaagcaccttggcctcctctcagctcgccgaggaggcacgctagagccgccttcccggtgggagccctctgtcccacagggagcggggagccagctttgctggggccctacctgcatgcccagccttacccctcattctcacagcacagatgaggttgagaccatgcagtcaatgcattgcttaaggtctcttatttacaaaaaaaaaccttaaacatagtcgctgtcattcagacattcagagaatggttggccacaaacaatgaccaagtattgcttggcttaacttgaaggcctgctgtctccttctgggggtcagggacgcagctccaccctcaccactagcccaccctgcccgtgggcataaccttgacgaagagagagaatgattggcatctgcttttctcttttctttgctaataattctgttcctggctgccgagagtgaagtttcaccatgtggaggtttggctcctatcacctggtggtctgattcataccctagcctgaggctccactggaagatctcgcagcctcagtgtatgggaaaccctttccccaggcttgtcccagcactgccgctccccacccctgagccaggaccccagaggatggccatgccccgtgcctggcagaggtctggtgccagcactgggagctgctccgcccttgccttggggccgagggagccctcgtccacccctgcacagcagctgggcacagaggagcgctcttccatcttgaccaggactgcaccaagaagcaccaggtgtcttcagcctccaacctccggggcgaccttctcttccagccacagtcccatgagggcccctagccagggacactggtctgtaaattgtaatcctttctccagcccagctctccacttgttccttgtgtgagctgagcaggcagtgcacctctgagtgtcccttttgtaaggcccaggggttgcactgagtctgcagaggccgcgacctcctagaacgctgtgggtgcaggtgagccggcgtgtcctggggagatgctgccagcacacaggggccctcctgctgccagcaggttggggtggttaagtcttattagtgtctattcttaaaattaagtgggctggagaagaatggagctccacatgccagcaccgtatatggaatacaaaagctggggaagcagggcctgccttacaggtgtggctgactctgagcccaggcctgcaggggtggagggcagtccctcagaatcccagaggcagtcccagcctcagaacccaggataggaaatgggtgtgtttagtggggaaagggacggggtgcagacggcagggccagtatggggccccctccctctcctctcctctcctatggtgagcccagcgtgggcaccgggccgtctcagccgtgttcccagggctgggaggacagctctggcccttcttaggcctagcctcgtcccaagctaaatgtaagccagttgggctgtgttaaaggaagcagtgtttttggttcgattctgcctctgtagctcaaggggggcagcccccagagtcctgtgcattctgccaaggctccatagctttgccaaatgcacggagctctgccattccggtgcagtgcaggccttgcgaagggtttatctgcgttcgtctcggtgggcttctcctgcatgggagttgtgttcctgtgcaagggggagctttgctccaggacaggatgactgtcttccctattcttagggacaagtcccaagatgccagaaaggcagtctcccaaggacccaccatgcagaagtgtcaataaaccacaagttctgaactctg

SEQ ID NO: 736 - DNA, 2606 bp, Homo sapiens
aaaaggagccgagcggcttctgctcaatggcggaaaagccgccggtgctctgacggcctcgttcccctagcagttgcgggggagtttcctgccggcgcggctggagtctctgattctcagggttcggtggttggaagatgctccagagagacgaggctgcggcggaggaggtggcggcggccgaatcggcaacggcgctagggtggagagaaggcggcatcggcggcggcggcggcgtgaggggccgggcggtgtaaacagccccggaggcggcggtcgagaccccgagggggaagcggcggctgagtcagggtcgcgcctccgttggaaacttgggctgagtaccgcggcgggcgcgagcgaggcgccctagacatcttctccctcccttgcctcagatttattgctaaacatgggtgcatttttggataaacccaaaactgaaaaacataatgctcatggtgctgggaatggtttacgttatggcctgagcagcatgcaaggatggagagtggaaatggaagatgcacacacagctgttgtaggtattcctcacggcttggaagactggtcattttttgcagtttatgatggtcatgctggatcccgagtggcaaattactgctcaacacatttattagaacacatcactactaacgaagactttagggcagctggaaaatcaggatctgctcttgagctttcagtggaaaatgttaagaatggtatcagaactggatttttgaaaattgatgaatacatgcgtaacttttcagacctcagaaacgggatggacaggagtggttcaactgcagtgggagttatgatttcacctaagcatatctactttatcaactgtggtgattcacgtgctgttctgtataggaatggacaagtctgcttttctacccaggatcacaaaccttgcaatccaagggaaaaggagcgaatccaaaatgcaggaggcagcgtgatgatacaacgtgttaatggttcattagcagtatctcgtgctctgggggactatgattacaagtgtgttgatggcaagggcccaacagaacaacttgtttctccagagcctgaggtttatgaaattttaagagcagaagaggatgaatttatcatcttggcttgtgatgggatctgggatgttatgagtaatgaggagctctgtgaatatgttaaatctaggcttgaggtatctgatgacctggaaaatgtgtgcaattgggtagtggacacttgtttacacaagggaagtcgagataacatgagtattgtactagtttgcttttcaaatgctcccaaggtctcagatgaagcggtgaaaaaagattcagagttggataagcacttggaatcacgggttgaagagattatggagaagtctggcgaggaaggaatgcctgatcttgcccatgtcatgcgcatcttgtctgcagaaaatatcccaaatttgcctcctgggggaggtcttgctggcaagcgtaatgttattgaagctgtttatagtagactgaatccacatagagaaagtgatggggcctccgatgaagcagaggaaagtggatcacagggaaaattggtggaagctctcaggcaaatgagaattaatcataggggaaactaccgacaacttctggaggagatgctgactagttacaggctagctaaagtagagggagaagaaagccctgctgaaccagctgccacagctacttcttcgaacagtgatgctggaaacccagtgacaatgcaggaaagccatactgaatcagaaagtggtcttgctgaattagacagctctaatgaagatgcagggacaaagatgagtggtgaaaaaatatgactttcctttttggtaatatttttgtgatctttgatggtttttaacctaggaagtgtaatgtatgcatttatataactgttttgttatttgaatcttggaaaactagttttattatattcagatagccttgttttttaaaaaggcctttgcatacacctttatgagatagtgtaaaattgactatttatagtactatggatttaatgaaattatatgtcatttcacattgtatgccagaaattaggctaccaattatgaattaaagtcagtagttaaattaatactagatagaattagaaattttgattagagagattatgctatattatggaaaaacttgttaatgtagaattatactgcttcatattattttacctattagtacactcatagttagctttgtaataaatttatgttttctttaataattttagttcttcaaagaatggctgatgctggcctgtaatttttctttcaaggatgataatttgtgtgttgtttgatttgtttatattttacatctctgtagttttatttttagaagttgtgagatattggatgtgtggctatttttcctttctctgtattctttatgaaacataacttttgaaaaacctatgtattattcatacagctttggtttgtatattctgtatagcctaactacacacatcaaaatgtatgtcaaccaagtgtttagaatgaaattataagtgtttaagtccaaataaagcatgtgatgtggaataatcta

SEQ ID NO: 737 - DNA, 1941 bp, Homo sapiens
gtcaaatagcagccgcggggaggctcgttcccatcggcatctgtgactggctgcgatcgagggcccgggcggccggccagccgtctcgccgagtgcggactggccggatctgctgtcagtcagcgggaacagacttctccctctccatctggtcaactgcgggagaaaaattttcgagaatttccagcaggcaaggcagtggccgctttgactgcttgcttcggagatccgagacgacggagaaggcactcttatttaccgaccaagaaagctcctcccccgtcctccgttagctaattaaaacatttttcagggacgtagccatccagagacattccattattgttccattgacctttccctcatcactgagtcctttggagctgagttatgtcaacagctgccttaattactttggtcagaagtggtgggaaccaggtgagaaggagagtgctgctaagctcccgcctgctgcaggacgacaggcgggtgacacccacgtgccacagctccacttcagagcctaggtgttctcggtttgacccagatggtagtgggagtccagctacctgggacaattttgggatctgggataaccgcattgatgagccaattctgctgccacccagcattaagtatggcaagccaattcccaaaatcagcttggaaaatgtggggtgcgcctcacagattggcaaacggaaagagaatgaagatcggtttgacttcgctcagctgacagatgaggtcctgtactttgcagtgtatgatggacacggtggacctgcagcagctgatttctgtcatacccacatggagaaatgtattatggatttgcttcctaaggagaagaacttggaaactctgttgaccttggcttttctagaaatagataaagccttttcgagtcatgcccgcctgtctgctgatgcaactcttctgacctctgggactactgcaacagtagccctattgcgagatggtattgaactggttgtagccagtgttggggacagccgggctattttgtgtagaaaaggaaaacccatgaagctgaccattgaccatactccagaaagaaaagatgaaaaagaaaggatcaagaaatgtggtggttttgtagcttggaatagtttggggcagcctcacgtaaatggcaggcttgcaatgacaagaagtattggagatttggaccttaagaccagtggtgtcatagcagaacctgaaactaagaggattaagttacatcatgctgatgacagcttcctggtcctcaccacagatggaattaacttcatggtgaatagtcaagagatttgtgactttgtcaatcagtgccatgatcccaacgaagcagcccatgcggtgactgaacaggcaatacagtacggtactgaggataacagtactgcagtagtagtgccttttggtgcctggggaaaatataagaactctgaaatcaacttctcattcagcagaagctttgcctccagtggacgatgggcctgattaccagctgggacttagagtttctgtgcaacagtttttcactgagcatgtcaagaaactgataagatcaaaaaggtctcctaactcactagatcagcgcacaagtcagtgtaaaccacttagatagtagttttttcataaatgctcatcatatttatgttccgctgtacatgttcagtataaatatatgtgtagtgaagctactgtgagtctttaaatggaaagagcaaatgagaagtggtttggatacacttgatgagagatgagagtgtcacattaataatttttaagactcttaggcagctatgggtttcttttgatcatttttgttctttattcatttgaacacgtttttgaagttcttcaaaactagtcagtttgaattttgacagctattcaatatgtgatctccaagtttaaaaaaattttttt

SEQ ID NO: 738 - DNA, 2429 bp, Homo sapiens
cttgccctcacctccgaatcctgacaacttcccggtcatcccgacccagcgttttccttgggattccgacctccccctcagagaagacaggaggtcgggaaggacctgcagcccaggggcttccaagatgaggcccagagactcggattatcaatgcagagaaatctgaattcaatgaggatcaagccgcctgtgggaagctgtgcatccggagatgtgagtttggggctgaagaagagtggctgaccctgtgcccagaggagttcctgacaggccattactgggcactgttcgatgggcacggcggtcctgcagcagccatcttggctgccaacaccctgcactcctgcttgcgccggcagctggaggccgtggtggaaggcttggtggccactcagccccccatgcacctcaatggccgctgcatctgccccagtgaccctcagtttgtggaggaaaagggcatcagggcagaagacttggtgatcggggcattggagagtgcctttcaggaatgtgatgaggtgatcgggcgggagctggaggcctcaggccagatgggcggctgcacagccctggtggctgtgtccctgcagggaaagctgtacatggccaatgctggggatagcagggccatcttggtgcggagagatgagatacggccactgagcttcgagttcaccccagagactgagcggcagcggatccagcagctggcctttgtctatcctgagcttctggctggtgagttcacccgactggagttccctcggcggctgaagggggatgacttgggacagaaggttttgttcagggatcaccacatgagtggctggagctacaaacgtgtggagaaatcggatctcaagtacccactgatccatggacagggtaggcaggctcggttactaggaacactggctgtctcccggggcctgggagaccatcagctcagagtcctggacacaaacatccagctcaagcccttcttgctctctgtgccacaggtgactgtgctggatgtggaccagctggagctacaggaggatgatgtggttgtcatggcaactgatggactctgggatgtactgtccaacgagcaggtggcatggctggtgcggagcttcctccctgggaaccaagaggacccacacaggtactgtagctgctggggacctgcctgggcctgggttggtgccagcagcaagcccaagtagttatggctgagaagacagagcactgacaatgagctggcagctggccaggatcagggctgtctcaagcttcttggaggaggcagggagaccgtgggttccgaaaatccctggatttagactctcatggtccagcccgtggccctcccagacttgctgcttgcttggtccacagtcggactgcattgcttgggtccccatgtccagccttgtgcagtgagttctcctaaggtctggccttgcccctttgctctgcccctgaagtctatctgcaggatggtcttcacaggttctcaaagctggcccagatgctgatacacagcacacagggaaaggaagacagtctcacagaggaagggcaggtgtcctacgatgacgtctctgtgttcgtgattcccttgcacagtcagggccaagagagcagtgaccactgaggattcagacactgtatcccagaactgctctagtgcccgggtgtggtctgggcatccctccagtgtgaccaagagcaaatcctgcctgccctatccctagccaccgcccagtgctctcactatccacctcaacacacatccatctcaagaggaacatttataccaggcagtcagagctggaagtgtatggagagcccagcccaccaggtcctgccttttgcggtgataaccttctctggcagagtgactttacaacttaactaggaaacccatgtgaggctcctcagacaggatcttgaacagcccaaagtatcattctcagataggggcacccaagctaagggtattagccaaagatgccaggatgggtagctagcccatgtttagatccaggtctccaattcatggttatcagggcatgtgttcaacaacccccaaagtccacgcaggtggcttgtagaaacctttgggcagcctcatgtctgctaaaacagccatcttcaagacagcccctgaaaagagaccagttcaggtcctgccctgctgttctttgctggagatgaggaacaggtgctggggctaaagtttggggtagagcacaagggacaagaggaactcttggagttggctgggtgagagggctctccatttgctacctgtagtagcctgcctcttaactggttgcttctccctagttccagccctgccctggtctgatgccccaacactgcccttgctttgttttccctgtcacctccctattattaaatgttttctacag

SEQ ID NO: 739 - DNA, 3163 bp, Homo sapiens
agtgcgcaggcgcaactgcctggctctgctcgctccggcgctccggcccagctctcgcggacaagtccagacatcgcgcgcccccccttctccgggtccgccccctcccccttctcggcgtcgtcgaagataaacaatagttggccggcgagcgcctagtgtgtctcccgccgccggattcggcgggctgcgtgggaccggcgggatcccggccagccggccatggcggggctgtactcgctgggagtgagcgtcttctccgaccagggcgggaggaagtacatggaggacgttactcaaatcgttgtggagcccgaaccgacggctgaagaaaagccctcgccgcggcggtcgctgtctcagccgttgcctccgcggccgtcgccggccgcccttcccggcggcgaagtctcggggaaaggcccagcggtggcagcccgagaggctcgcgaccctctcccggacgccggggcctcgccggcacctagccgctgctgccgccgccgttcctccgtggcctttttcgccgtgtgcgacgggcacggcgggcgggaggcggcacagtttgcccgggagcacttgtggggtttcatcaagaagcagaagggtttcacctcgtccgagccggctaaggtttgcgctgccatccgcaaaggctttctcgcttgtcaccttgccatgtggaagaaactggcggaatggccaaagactatgacgggtcttcctagcacatcagggacaactgccagtgtggtcatcattcggggcatgaagatgtatgtagctcacgtaggtgactcaggggtggttcttggaattcaggatgacccgaaggatgactttgtcagagctgtggaggtgacacaggaccataagccagaacttcccaaggaaagagaacgaatcgaaggacttggtgggagtgtaatgaacaagtctggggtgaatcgtgtagtttggaaacgacctcgactcactcacaatggacctgttagaaggagcacagttattgaccagattccttttctggcagtagcaagagcacttggtgatttgtggagctatgatttcttcagtggtgaatttgtggtgtcacctgaaccagacacaagtgtccacactcttgaccctcagaagcacaagtatattatattggggagtgatggactttggaatatgattccaccacaagatgccatctcaatgtgccaggaccaagaggagaaaaaatacctgatgggtgagcatggacaatcttgtgccaaaatgcttgtgaatcgagcattgggccgctggaggcagcgtatgctccgagcagataacactagtgccatagtaatctgcatctctccagaagtggacaatcagggaaactttaccaatgaagatgagttatacctgaacctgactgacagcccttcctataatagtcaagaaacctgtgtgatgactccttccccatgttctacaccaccagtcaagtcactggaggaggatccatggccaagggtgaattctaaggaccatatacctgccctggttcgtagcaatgccttctcagagaattttttagaggtttcagctgagatagctcgagagaatgtccaaggtgtagtcataccctcaaaagatccagaaccacttgaagaaaattgcgctaaagccctgactttaaggatacatgattctttgaataatagccttccaattggccttgtgcctactaattcaacaaacactgtcatggaccaaaaaaatttgaagatgtcaactcctggccaaatgaaagcccaagaaattgaaagaacccctccaacaaactttaaaaggacattagaagagtccaattctggccccctgatgaagaagcatagacgaaatggcttaagtcgaagtagtggtgctcagcctgcaagtctccccacaacctcacagcgaaagaactctgttaaactcaccatgcgacgcagacttaggggccagaagaaaattggaaatcctttacttcatcaacacaggaaaactgtttgtgtttgctgaaatgcatctgggaaatgaggtttttccaaacttaggatataagagggctttttaaatttggtgccgatgttgaactttttttaaggggagaaaattaaaagaaatatacagtttgactttttggaattcagcagttttatcctggccttgtacttgcttgtattgtaaatgtggattttgtagatgttagggtataagttgctgtaaaatttgtgtaaatttgtatccacacaaattcagtctctgaatacacagtattcagagtctctgatacacagtaattgtgacaatagggctaaatgtttaaagaaatcaaaagaatctattagattttagaaaaacatttaaactttttaaaatacttattaaaaaatttgtataagccacttgtcttgaaaactgtgcaactttttaaagtaaattattaagcagactggaaaagtgatgtattttcatagtgacctgtgtttcacttaatgtttcttagagccaagtgtcttttaaacattattttttatttctgatttcataattcagaactaaatttttcatagaagtgttgagccatgctacagttagtcttgtcccaattaaaatactatgcagtatctcttacatcagtagcatttttctaaaaccttagtcatcagatatgcttactaaatcttcagcatagaaggaagtgtgtttgcctaaaacaatctaaaacaattcccttctttttcatcccagaccaatggcattattaggtcttaaagtagttactcccttctcgtgtttgcttaaaatatgtgaagttttccttgctatttcaataacagatggtgctgctaattcccaacatttcttaaattattttatatcatacagttttcattgattatatgggtatatattcatctaataaatcagtgaactgttcctcatgttgctgaatttgtagttgttggtttattttaatggtatgtacaagttgagtatcccttatccaaaatgcttgggaccagaagtgtttcagattttttaaaattttggaatatttgctttatactgagcttttgagtgttcccaatctgaaattcaaaatgctctaatgagcatttcctttgagcatcatgcctgc

SEQ ID NO: 740 - DNA, 6535 bp, Homo sapiens
tgctgatcgctcgtgccggtgcggccgttaaccgcccttgccggagccctaggctcaaaagcagccccttacccttcctgggcttcccccaacccctttcccggtctgccctggggcatgagcagcgatggccggctgcatccctgaggagaaaacttaccggcgcttcctggagctattcctgggcgagtttcgcggaccgtgcggcggcggcgagccggagccggaacccgaacccgaacccgaacccgaacccgagtccgagcccgagcccgaacctgaactggtagaagctgaggcggccgaggcttcggtagaggaacccggggaggaggcggccacggtagccgcgacggaggagggggaccaggagcaagacccggagcccgaggaggaggcggcggttgagggtgaggaggaggaggagggcgcggcgacggcggcggcagccccggggcactcggccgtgccgccgccgccgccccagctgccgcctttgcccccgctcccgcgaccgctgtcagagcgcatcacccgcgaggaggtggagggcgaaagcctggacctgtgcctgcagcagctctacaaatataattgcccttcctttttggctgctgctttagccagagccacatcagatgaagtccttcagagtgatctttctgcacattatatcccaaaggaaacggatggcacagaagggactgtggagattgagacagtgaaattggcccgttctgtcttcagcaaactacacgagatttgctgcagctgggtgaaagacttccccctccgcaggagaccccagctttattatgagacatcaatccatgccatcaaaaacatgcgcaggaaaatggaggacaaacatgtctgcattcctgactttaatatgctcttcaacctagaggaccaggaagaacaagcttactttgcagtgtttgatggccatgggggagtagatgctgctatttatgcctccattcacctccacgttaacttagtccgccaggagatgttcccccatgatcctgctgaggccctgtgcagggccttccgggtcactgatgagcggtttgtgcagaaagcagccagggagagcttaagatgtgggaccacaggagtggtgactttcatcagaggcaacatgctacatgtggcctgggtgggtgattcccaggttatgcttgtgagaaagggccaagctgttgaactaatgaagccacacaaaccagacagagaggatgaaaagcagagaattgaggcccttggaggttgcgtagtctggtttggtgcctggagggtgaatggaagtctgtcggtttccagagctattggagatgctgaacataagccatatatctgtggggatgcagattctgcctccactgttctggatgggaccgaagactacctcattctggcctgtgatggcttctatgacaccgtgaaccctgatgaggcagtgaaagttgtgtccgaccacctgaaagagaataatggagacagcagcatggttgcccacaaattagtggcatcagctcgtgatgctgggtcaagtgataacatcacggttattgtggtattcctgagggacatgaacaaagctgtaaatgttagtgaggaatcagattggacagagaactcttttcaaggagggcaagaagatggtggggatgataaggagaatcatggagagtgcaaacgcccttggcctcagcaccagtgctcagcaccagccgacctaggctatgatgggcgtgtggattcattcactgatagaactagcctgagcccagggtcccaaatcaacgtgctggaagacccaggctacctagatctcacacaaatagaagcaagcaaacctcacagtgcccagtttttgctaccagttgagatgtttggtcctggtgcaccaaagaaagcaaatcttattaatgagttaatgatggagaaaaaatcagttcagtcatcattgcctgaatggagtggtgctggagagtttcccactgctttcaatttgggttcaacaggggagcagatatacagaatgcagagcttgtctcctgtctgttcagggttggaaaatgaacagttcaaatccccgggaaacagagtttctagattgtctcatttacgccaccactactcaaagaagtggcacagattcaggtttaatccaaagttttattcatttctctctgctcaagagccttcccacaaaataggcactagcctgtcctcacttactggaagtgggaagagaaataggataagaagttctctgccatggaggcaaaatagttggaaagggtacagtgaaaacatgaggaagctcagaaagactcatgatattccatgcccagatcttccttggagctataaaatagaataatttttctttcaagtaggttagctagctctcccccaataaaaataccactatcagagtagaaacaaggtagacatttctaaaacatatgtgcttcattatgaatccatggatggctcaattcttaaatgtaaatagatctctaggaaactcaaagtacagtgttttcaatctaaaaagaagtattggcagtttcacttgcaaaattacacagctggtccctgtgatgtgtctcgacaccaatacacaacccccttcccaccatccttcatgtcactagatacacaacccccttcccaccatcccttcagtcactagtggaagctttcaagttagttatttcagtcaggatatacagtgttgaaatctcaatgcagttgaaatctggtctgatgtgcctaatttatctgtggaaaatttaatgctgaattacatttggttgggaaatgtccctcaaaatcctgggcactatgaaggaaccccctgccccctcacctttttgggtaggtaaaagactaaaagccatatggattttaactgataacaatgaaagtggtaaatcagtgtaaaagtgtcatattctcagacttgtgaggcggtttatagtcagaaagatttacggatttttttcctgtaacataaaagattgtgaactttttttaattaaaaaatatttcctagggctgtagttatttgggagtttcataacctgttatggtgcttttggtggaaatttttattatttagcattttaggagaccgctgtcaactggttttaatctatgatgctaatgtgttttccactgtaccctcatctcaggaataaaactgctttaacggagatgatgtcaggtacaaatacactatagagtcaaaataccatttacaaagaaaatcaaaagcatttctatattttgtctttttttagttcagacagcaaaggcatgtactactataaaatacaaagtgattttagagaatgaaaaatgctacttttatcttctctaaaattatttcccccaaggtagtgaagtaattggaatgaaggaggctgaaagtattgtctaaagtgagcccagaggccactgagaatgcagattactgacagccaggtctgtttagttgtaattggaagacacatgagtgtcctgcttacatgtagcttcagactgcagagacaggacgtgtgcttttcatttcaatatttagttatatttgatattttgaaactgtctgctttttgctatttctgcagtttcaagttagttagaagcatgttgtcaactaaagacaacaaactatcagattcattcattcagtgaagcagcctctgattctctaagagtcacgaatgtcttagtgttaccctcccctagtcaacagcagaccagcctggccaatgcctatgggtggcccctctggagtgctcactaacaagggtgagtgctctcgctaagaagtgtcccccgcctaatcatgtgtttataggatagtacacgttccccaggcccataacagaggactaaaatctctgaattttaaagacacagatgactggcatattttggataccagtatagctatatcaaatagacaaaaacagcttcactttagcaatgatcagattgttaatctacagattttattttttaaaatttggatgtaagtagagactttcagtatttgttttctcttgattttgaagtcatttcttcttctcacgtctgtgacaaatggttgaaaaggagtcaacatggccccaactatagtgccggaaccttttcatcattctgaggctttgccccacacatggtcctcactcatatctgtcaccttctgaagcctagatcttgttaacccatcaggtgcagtgtcagtttcaaatcaaattatctaagaaaacaagaaaacaaaggcagcagactattggtacacattatagtccaaagtgcttagcgaagtaaaaaaaaaagctttttaaaatttctattgttgtctattggtaatgtttttgatcagaataaagagggtaaagggaaaaagttactacacatgctaggctttctcagtggggaaaaaaatggctggatagaactgggacaaacacagacccatctttaggggtctggattttgtaggtccgactacacagcagtgttaactcatttctcatgccattagctctctacaaaataaagcaaagtagttctagtgtggtcgttataaaccaatattgtgaaaaatagcaactattcatttgttcacaacatgcgtatttatagagtagttaggtaccatttgtaaggtaaatcctttaaaattctataatacatactaaaatagtggttattggtctgatatatgctgctcttggttctataaactagataaaagcagtgctttgtgaaatgcagtgttctctcttaacgccactggtgataggaagtagttcccttcagttcaaatcctgtgcccttatttgctgcttgctgacgtaagcaataagtaaccctctaactaatggtatctacatatttctgtaacttgtatttaatgatggtgtacctggtgattgtaaaaatattagacagatataaaagtatctatataatatctataaactgttaatgctgaggtatagtctgtgaattatgtgttttgtatttttattcattgtgtaatttagtggtggtgaaagttctacactcaatccttaaagagtggcagtatccctttttcaatttaacatggtctgcatcaatctgtttgcctgctaaacaagttagaataggaaatagtaaaataaatccaaacaagagtgtaatattggttagggaaacaaacttcaggtcaccaactgaagtcattacaaactccttgtacattcactgtgagtttcaaagggagtcagtccctaatttacaggtttcctttgttcactttctagatgtgtacttttgagggacatgaggttaggcaacattacagcaacacacactggggctattaatcccatttaggtctgtactaaagaggatgggtagaaacacatatgtatataccttttctttacctagaagtgccatccattgtccttgaattattatgattaaagttactgttgcatttaggaggctccttgaaagtaacaccttttccaaggacaatggcaacaatgtcaatgtcaacactgagtctaattttgaccacatttatagtggtatagtgtcaatactgcattttcatgacaaccacactccactgttgaaacactgtgccagtgagaagtgcaacatccagtgggcagatgaaaatgatgcatggccaagttcagtgtttacagataaaactgctgtggttcaagtgcttccttccccatcaaatccttgataaggctttgtgggaaaatgatctaaattattgttttaatttttaaacctaatttattcactcagtgaacattcttacctaagcaaggctataaaagggaatactacagttttgtccacactttaatttgagaccatttttctttgaatcgtaagttagcaaaagaaatttttttcacctttgaaaatcacgtgatgttaaaggacaaatgcccactcttctattctgatctgcaaatagcttaaatgtctcttgcaaaacaaagtaagataccaccagtattacaacacaatgattttccagacaaatggtatggtgttgaaaaataactgttacttcttaaagcagcattttatcttctattttgaagactatttattgtaataattagaaaacatgaaatagggaactccagactgacacagcagttgtttttgaaaaggaaataaactttgatgaattagataatccagatacatcattgtaaactcttactctaggtgctctttggtgagagacaggctttgttctcttgttcataacatttctctgcaaagaattctctatggagtgaagcgaatgaagtgaataatttcttaccaaataaatttatcaatttacaaatctgctctacatctcacttttgagttcagttgtagtcatgagtgatccttcatattttattaaaagtgttcattcaggtaaggtgtatgttgaaattttgccaattatcttaataaaacctggcaattt

SEQ ID NO: 741 - DNA, 1863 bp, Homo sapiens
gggccggttcctggggtggcccagagcaagggcaagtttcgcccgggacccgcccagctggccgggagccagtagcagggaagggccggctggcgcgagcaccgcccacgcggagccatgggggcggggcctgggcgggggcggggccgcggccgagggcggggcagggaggcagcatgctaaaccgggtgcgctcggccgtggcgcacctggtgagctccgggggcgctccgcctccgcgccccaaatccccggacctgcccaacgccgcctcggcgccgcccgccgccgctccagaagcgcccaggagccctcccgcgaaggctgggagcgggagcgcgacgcccgcgaaggctgttgaggctcgagcgagcttctccagaccgacctttctgcagctgagccccggggggctgcgacgcgccgatgaccacgcgggccgggctgtgcaaagccccccggacacgggccgccgcctgccctggagcacaggctacgccgaggtcatcaatgctggcaagagtcggcacaatgaggaccaggcttgctgtgaagtggtgtatgtggaaggtcggaggagtgttacaggagtacctagggagcctagccgaggccagggactctgcttctactactggggcctatttgatgggcatgcagggggcggagctgctgaaatggcctcacggctcctgcatcgccatatccgagagcagctaaaggacctggtagagatacttcaggacccttcgccaccacccctctgcctcccaaccactccggggaccccagattcctccgatccctctcacttgcttggccctcagtcctgctggtcttcacagaaggaagtgagccacgagagcctggtagtgggggccgttgagaatgccttccagctcatggatgagcagatggcccgggagcggcgtggccaccaagtggaggggggctgctgtgcactggttgtgatctacctgctaggcaaggtgtacgtggccaatgcaggcgatagcagggccatcattgtccggaatggtgaaatcattccaatgtcccgggagtttaccccggagactgagcgccagcgtcttcagctgcttggcttcctgaaaccagagctgctaggcagtgaattcacccaccttgagttcccccgcagagttctgcccaaggagctggggcagaggatgttgtaccgggaccagaacatgaccggctgggcctacaaaaagatcgagctggaggatctcaggtttcctctggtctgtggggagggcaaaaaggctcgggtgatggccaccattggggtgacccgaggcttgggagaccacagccttaaggtctgcagttccaccctgcccatcaagccctttctctcctgcttccctgaggtacgagtgtatgacctgacacaatatgagcactgcccagatgatgtgctagtcctgggaacagatggcctgtgggatgtcactactgactgtgaggtagctgccactgtggacagggtgctgtcggcctatgagcctaatgaccacagcaggtatacagctctggcccaagctctggtcctgggggcccggggtaccccccgagaccgtggctggcgtctccccaacaacaagctgggttccggggatgacatctctgtcttcgtcatccccctgggagggccaggcagttactcctgaggggctgaacaccatccctcccactagcctctccatacttactcctctcacagcccaaattctgaagttgtctccctgacccttctttagtggcaacttaactgaagaagggatgtccgctatatccaaaattacagctattggcaaataaacgagatggataaaggtg

SEQ ID NO: 742 - DNA, 1092 bp, Homo sapiens
gtcaaatagcagccgcggggaggctcgttcccatcggcatctgtgactggctgcgatcgagggcccgggcggccggccagccgtctcgccgagtgcggactggccggatctgctgtcagtcagcgggaacagacttctccctctccatctggtcaactgcgggagaaaaattttcgagaatttccagcaggcaaggcagtggccgctttgactgcttgcttcggagatccgagacgacggagaaggcactcttatttaccgaccaagaaagctcctcccccgtcctccgttagctaattaaaacatttttcagggacgtagccatccagagacattccattattgttccattgacctttccctcatcactgagtcctttggagctgagttatgtcaacagctgccttaattactttggtcagaagtggtgggaaccaggtgagaaggagagtgctgctaagctcccgcctgctgcaggacgacaggcgggtgacacccacgtgccacagctccacttcagagcctaggtgttctcggtttgacccagatggtagtgggagtccagctacctgggacaattttgggatctgggataaccgcattgatgagccaattctgctgccacccagcattaagtatggcaagccaattcccaaaatcagcttggaaaatgtggggtgcgcctcacagattggcaaacggaaagagaatgaagatcggtttgacttcgctcagctgacagatgaggtcctgtactttgcagtgtatgatggacacggtggacctgcagcagctgatttctgtcatacccacatggagaaatgtattatggatttgcttcctaaggagaagaacttggaaactctgttgaccttggcttttctagaaatagataaagccttttcgagtcatgcccgcctgtctgctgatgagaactgtgcctggtcagcagctctagacctggagcccgtggacactatatgcggggcttcagtggaaagagagatctgcttaattttgtcccaggtgaaggagtccagcggttcctatcctggactacgggaaggttcccacatctctttgtcccattag

SEQ ID NO: 743 - DNA, 2041 bp, Homo sapiens
cccgacccagcgttttccttgggattccgacctccccctcagagaagacaggaggtcgggaaggacctgcagcccaggggcttccaagatgaggcccagagactcggattatcaatgcagagaaatctgaattcaatgaggatcaagccgcctgtgggaagctgtgcatccggagatgtgagtttggggctgaagaagagtggctgaccctgtgcccagaggagttcctgacaggccattactgggcactgttcgatgggcacggcggtcctgcagcagccatcttggctgccaacaccctgcactcctgcttgcgccggcagctggaggccgtggtggaaggcttggtggccactcagccccccatgcacctcaatggccgctgcatctgccccagtgaccctcagtttgtggaggaaaagggcatcagggcagaagacttggtgatcggggcattggagagtgcctttcaggaatgtgatgaggtgatcgggcgggagctggaggcctcaggccagatgggcggctgcacagccctggtggctgtgtccctgcagggaaagctgtacatggccaatgctggggatagcagggccatcttggtgcggagagatgagatacggccactgagcttcgagttcaccccagagactgagcggcagcggatccagcagctggcctttgtctatcctgagcttctggctggtgagttcacccgactggagttccctcggcggctgaagggggatgacttgggacagaaggttttgttcagggatcaccacatgagtggctggagctacaaacgtgtggagaaatcggatctcaagtacccactgatccatggacagggtaggcaggctcggttactaggaacactggctgtctcccggggcctgggagaccatcagctcagagtcctggacacaaacatccagctcaagcccttcttgctctctgtgccacaggtgactgtgctggatgtggaccagctggagctacaggaggatgatgtggttgtcatggcaactgatggactctgggatgtactgtccaacgagcaggtggcatggctggtgcggagcttcctccctgggaaccaagaggacccacacaggttctcaaagctggcccagatgctgatacacagcacacagggaaaggaagacagtctcacagaggaagggcaggtgtcctacgatgacgtctctgtgttcgtgattcccttgcacagtcagggccaagagagcagtgaccactgaggattcagacactgtatcccagaactgctctagtgcccgggtgtggtctgggcatccctccagtgtgaccaagagcaaatcctgcctgccctatccctagccaccgcccagtgctctcactatccacctcaacacacatccatctcaagaggaacatttataccaggcagtcagagctggaagtgtatggagagcccagcccaccaggtcctgccttttgcggtgataaccttctctggcagagtgactttacaacttaactaggaaacccatgtgaggctcctcagacaggatcttgaacagcccaaagtatcattctcagataggggcacccaagctaagggtattagccaaagatgccaggatgggtagctagcccatgtttagatccaggtctccaattcatggttatcagggcatgtgttcaacaacccccaaagtccacgcaggtggcttgtagaaacctttgggcagcctcatgtctgctaaaacagccatcttcaagacagcccctgaaaagagaccagttcaggtcctgccctgctgttctttgctggagatgaggaacaggtgctggggctaaagtttggggtagagcacaagggacaagaggaactcttggagttggctgggtgagagggctctccatttgctacctgtagtagcctgcctcttaactggttgcttctccctagttccagccctgccctggtctgatgccccaacactgcccttgctttgttttccctgtcacctccctattattaaatgttttctac

SEQ ID NO: 744 - DNA, 1919 bp, Homo sapiens
gttgacagcgccgcgccgcgcccagcggccgcacgggggtgccgaggcgtctgggggcctgcgcttcggggcgagcgcagcgcaaggctggcgcgcgcgcatggaggatgctcactgcacttggctttcgttacctggtctgcccccgggctgggccttgtttgccgtcctcgacggccacggtggggctcgagctgcccgcttcggtgcacgccatttgccaggccatgtgctccaggagctgggcccggagcctagcgagcccgagggcgtgcgcgaggcgctgcgccgagccttcttgagcgccgacgagcgcctgcgctccctctggccccgcgtggaaacgggcggctgcacggccgtggtgttgctggtctccccgcggtttctgtacctggcgcactgcggtgactcccgcgcggtgctgagccgcgctggcgccgtggccttcagcacagaggaccaccggccccttcgaccccgggaacgcgagcgcatccacgccgctggcggcaccatccgccgccgccgcgtcgagggctctctggccgtgtcgcgagcgttgggcgactttacctacaaggaggctccggggaggccccccgagctacagctcgtttctgcggagccagaggtggccgcactggcacgccaggctgaggacgagttcatgctcctggcctctgatggcgtctgggacactgtgtctggtgctgccctggcgggactggtggcttcacgcctccgcttgggcctggccccagagcttctctgcgcgcagctgttggacacgtgtctgtgcaaggtcctgggggcgtggcgtggtacctttggggcttggtgcagcagagggagagagcctcggggttttggggaggagggctttgatagagaggcaagagtaaagctagcaaaggaggggataggactcaagcgaagggcgtggcctgaagtgggcagggccaaaatacaggggcggagcctgagggatgctttgaggcacgggagagttagtggaagggacttaagagaaagggcgtggtcttttggaaaggggcgattctgggtcgtaggagccgggccggaagtattgattagtgctggaaggtggaagagcaggtaaacatcagagcgggcggagctttagggaaaaggcattgttctctcaattgggagcgcctaggaccgggtttggtcccagtaagagaggattggcaggtgggtgggacgcgaaagaaatgggcataagtagaatgaagtgggggacttgaacctggggattgttgggaagctctgccttggactctcccccaccgggctcctttttctccaccggcttcagggcagcctggacaacatgacctgcatcctggtctgcttccctggggcccctaggccttctgaggaggcgatcaggagggagctagcactggacgcagccctgggctgcagaatcgctgaactgtgtgcctctgctcagaagccccccagcctgaacacagttttcaggactctggcctcagaggacatcccagatttacctcctgggggagggctggactgcaaggccactgtcattgctgaagtttattctcagatctgccaggtctcagaagagtgcggagagaaggggcaggatggggctgggaagtccaaccccacgcatttgggctcagccttggacatggaggcctgacagctgttgtcctttggggatcctttgcttctctggggcctcaacagaactaaagaagaaaaccgaccctttccccaactacatgtaccagcggaaggaaggaaggccaatgtaggaacccaaaatgcttatttcttcttctcttacttccctctcacagaaaagtcttacgaatggggaaattccaccaacatccagaccaaaaagaaaaaagcccaaatcg

SEQ ID NO: 745 - DNA, 1713 bp, Homo sapiens
aatgtattatgatgtaggggagggaggaaggagggccagggtagggggcacaccctctccctgaatgaaattcatttaggggcactgtctgctcgcatgttctgttctgggagaaaatgggtagcagaagctacaatttgtactaagctaatgaaaagagagaaaagaagaatggggaagagaagggcaaagaaggcaaaaagagaagagaagaaaaagggaggagagagaaggagaaatgagaaaagaggaaaccaaatgaagaggatgtgtgagagaaaaaaatatgaaacagacctagaggatcaagacataatgggagcatttttagacaagccaaagatggaaaagcataatgcccaggggcagggtaatgggttgcgatatgggctaagcagcatgcaaggctggcgtgttgaaatggaggatgcacatacggctgtgatcggtttgccaagtggacttgaatcgtggtcattctttgctgtgtatgatgggcatgctggttctcaggttgccaaatactgctgtgagcatttgttagatcacatcaccaataaccaggattttaaagggtctgcaggagcaccttctgtggaaaatgtaaagaatggaatcagaacaggttttctggagattgatgaacacatgagagttatgtcagagaagaaacatggtgcagatagaagtgggtcaacagctgtaggtgtcttaatttctccccaacatacttatttcattaactgtggagactcaagaggtttactttgtaggaacaggaaagttcatttcttcacacaagatcacaaaccaagtaatccgctggagaaagaacgaattcagaatgcaggtggctctgtaatgattcagcgtgtgaatggctctctggctgtatcgagggcccttggggattttgattacaaatgtgtccatggaaaaggtcctactgagcagcttgtctcaccagagcctgaagtccatgatattgaaagatctgaagaagatgatcagttcattatccttgcatgtgatggtatctgggatgttatgggaaatgaagagctctgtgattttgtaagatccagacttgaagtcactgatgaccttgagaaagtttgcaatgaagtagtcgacacctgtttgtataagggaagtcgagacaacatgagtgtgattttgatctgttttccaaatgcacccaaagtatcgccagaagcagtgaagaaggaggcagagttggacaagtacctggaatgcagagtagaagaaatcataaagaagcagggggaaggcgtccccgacttagtccatgtgatgcgcacattagcgagtgagaacatccccagcctcccaccagggggtgaattggcaagcaagaggaatgttattgaagccgtttacaatagactgaatccttacaaaaatgacgacactgactctacatcaacagatgatatgtggtaaaactgctcatctagccatggagtttaccttcacctccaaaggagagtacagctcaactttgttgaaacttttaacatccatcctcaactttaaggaaggggatatgacatgggtgagaatgattacatcagagaacttcagcagtacaacagctagcccagaactgatttttttttttttttttgtaaatttgagacttatgtaagcgtgatttcaaaccataattcgtgttgtaaatcagactccagc

SEQ ID NO: 746 - DNA, 4125 bp, Homo sapiens
ctctgcctccctctccaacgcccggatgatctgagccgcgagggcgccgacagccgggggcccggacgcagcccggctcctcccctcctccgccccttccccagcctgacctggcccgccgctgcagcggtgacccctcccccggctgccgccgtcgccgccgcggtgaccccctccccggctgccgccgccgccgcctcggccgaccagggacctgcccgcctgcggctgctccggattttaaataaacttggagccttttcttgaaagacagctggctgtggagagccttctaccaactgcagttttagatacgttttgaaaatttcatcacctgagacctagaggatcaagacataatgggagcatttttagacaagccaaagatggaaaagcataatgcccaggggcagggtaatgggttgcgatatgggctaagcagcatgcaaggctggcgtgttgaaatggaggatgcacatacggctgtgatcggtttgccaagtggacttgaatcgtggtcattctttgctgtgtatgatgggcatgctggttctcaggttgccaaatactgctgtgagcatttgttagatcacatcaccaataaccaggattttaaagggtctgcaggagcaccttctgtggaaaatgtaaagaatggaatcagaacaggttttctggagattgatgaacacatgagagttatgtcagagaagaaacatggtgcagatagaagtgggtcaacagctgtaggtgtcttaatttctccccaacatacttatttcattaactgtggagactcaagaggtttactttgtaggaacaggaaagttcatttcttcacacaagatcacaaaccaagtaatccgctggagaaagaacgaattcagaatgcaggtggctctgtaatgattcagcgtgtgaatggctctctggctgtatcgagggcccttggggattttgattacaaatgtgtccatggaaaaggtcctactgagcagcttgtctcaccagagcctgaagtccatgatattgaaagatctgaagaagatgatcagttcattatccttgcatgtgatggtatctgggatgttatgggaaatgaagagctctgtgattttgtaagatccagacttgaagtcactgatgaccttgagaaagtttgcaatgaagtagtcgacacctgtttgtataagggaagtcgagacaacatgagtgtgattttgatctgttttccaaatgcacccaaagtatcgccagaagcagtgaagaaggaggcagagttggacaagtacctggaatgcagagtagaaggtggatcatttaacaaaaaataagtagctttattaaagaaaaatcttcaacacaatcaaactttaacattttagcttttagatttttatgtgtctttgacagctagtgtctagtgtatgaaagtggaaaaggacatttctgtagtagctgttaagatgtatgcagttgtcctatcacagttatattagaaataacaactagtgtggaaagtaacccacattctgttcaggatacttttgttttaaaaggctaaaatgtttgtgtgctttaaaattcttaatgaattcactggcatgagtaattttatgccgggaaaatctgatttgtggtctatttaattacaaagagattgtgatggtgataatttgaataccatctttctatgaaaagctgtgtatattaattttaatctctagggccttttttcaataacttgaaaatcacagcctcatcattagcaactttatatacacagctttaaaaaatttgctttaaactgtttcagagcttcttccctaagccataaactgtctcacctaaacaagatagacctcaataaaagacataatatttctccacctggcagaaaagtaactgccaagtaagattaagaaataagttgagcatttctggagtatatttctcataattctgcagagacttccagtttattgcatatatgcagtaaagtgtatatattatgcagtttctctaagtggaaaaacttgacatgactttaatagtgttaaaacatgaaaatgctggtgagctgaggtagaaaaaaaacaagaaaaaaattttaaaaatagcgttaaaatgcattttaggctcctaatgtcgttaatttgcacgttaaagacctctaatcgcatgcaagcattgacctaccacacctacatcccactgtgcctgcattattgaaattactactcactttaattttttttcccctttttactgtttgataccaatcataatcagtctgatactagaatcatgattggttttgttctttagtactgtctagagctactattttgtttttattgctgtccgccacttgatagtcatacatctagtatgtgtttgtactatttagtattgcattcattggacgtactattcaacgaatttgtctccttactgttaccaagggtcttggaatttttatattttaaattaatcattcaatataagttatttataggtatagtacaattttaaaatatttagaatgctacaatcattggttcaaactattgattcatgggaaaatttaaattcataagaataatatgtatagggataagttgatatttaatgtattggcactttaacttgggcagacatgttttcttattggtttaaagaagtaataagtattttaatatttttactatgaaatgggatccaattttagaaatgaattgctacttttctctttagtgtgtacactttaagttttagatggaattatgaaatattcactttacgttattttgttacaataataagttttatatttcttattatcaagcaagagttgccacctggacagagtttacattgatactcaatatttttgatatgttaaagtgttattatacttgtaccattcaattggagattgtcataaattaaatatggtattttttactcagatttgatgagactgcaactagagaataaatattacattaaaattgctgctattttaaaacatagaatgtaactgtttgtattgtaaaagttgtgtgtcctcagtgaaaaatactgccttcagcttccaaagcaggcacctgaatgcctttttcttttctctctctcttctttctttaaatacatgccttcactagattgctgtgacctactaaacctcattttatttgcttggaacatttttggcttctctgtccacaccatagaaaaggacaaaggccttccagctctccttttctcttatttgttcccttctaaatacttgactctctgggggtgtgaaaagattcagctcataatttatactactattaattttgtggtccttctaagccaatttaaaattatacttttgtgtatatattttcaaaatctttgctactgactaccttagctttaaagttgctaatttggagatgactgatagaatccctgaaacttggtggaggggagtggaaaggagcagaatgtgtttgtgtatatgtatgtgaaacatggatcttctatatataaatattctttagaaaaagcgttcagtctttttacaattctaagtaaaacgtataggtcaacagaaattaaaggaatatttcttaaaattcatttatttttcttttttgaaagcagacagaagcaaggctagtatagtatgaatggtcaggtagtttaaatgcgttgtcccacgtggaacaggagatattaactgtttttaaagctttacattatttttttacaagaatttgttttcctgtaattttcttcacagttaaaatatcctaatttatattttaacaaaagagatgtaagatacatcaaatatagatgattcaaggtaatgttttttagacctgaaactattgattcaatttatcatcagtgtttatttctattgtatctagttatctatccaaataattgtattggcttagcggagactgtatgttaagtgtattagttttagattgtgaaattgtgcagtttaggtaaacatcaaatccctttatttttgtacagcagatttccagcattagaaccatgtagaacaaatatactagatgttaaagattacacaataaaggaacttggcaaaccaaa

SEQ ID NO: 747 - DNA, 2311 bp, Homo sapiens
ggcgagttgctaaggaaatgactgcccgcagcgcctggccccgccgcgcaggccgggcggggtctggagcggcgccgtttccgcttccgctccctcacagctcccgtcccgttaccgcctcctggccggcctcgcgcctttcaccggcaccttgcgtcggtcgcgccgcggggcctgctcctgccgcgcgcacccccggggcttcggctccggcacgggtcgcgcccagctttcctgcacctgaggccgccggccagccgccgccatgggtgcctacctctcccagcccaacacggtgaagtgctccggggacggggtcggcgccccgcgcctgccgctgccctacggcttctccgccatgcaaggctggcgcgtctccatggaggatgctcacaactgtattcctgagctggacagtgagacagccatgttttctgtctacgatggacatggaggggaggaagttgccttgtactgtgccaaatatcttcctgatatcatcaaagatcagaaggcctacaaggaaggcaagctacagaaggctttagaagatgccttcttggctattgacgccaaattgaccactgaagaagtcattaaagagctggcacagattgcagggcgacccactgaggatgaagatgaaaaagaaaaagtagctgatgaagatgatgtggacaatgaggaggctgcactgctgcatgaagaggctaccatgactattgaagagctgctgacacgctacgggcagaactgtcacaagggccctccccacagcaaatctggaggtgggacaggcgaggaaccagggtcccagggcctcaatggggaggcaggacctgaggactcaactagggaaactccttcacaagaaaatggccccacagccaaggcctacacaggcttttcctccaactcggaacgtgggactgaggcaggccaagttggtgagcctggcattcccactggtgaggctgggccttcctgctcttcagcctctgacaagctgcctcgagttgctaagtccaagttctttgaggacagtgaggatgagtcagatgaggcggaggaagaagaggaagacagtgaggaatgcagcgaggaagaggatggctacagcagtgaggaggcagagaatgaggaagatgaggatgacaccgaggaggctgaagaggacgatgaagaagaagaagaagagatgatggtgccagggatggaaggcaaagaggagcctggctctgacagtggtacaacagcggtggtggccctgatacgagggaagcagttgattgtagccaacgcaggagactctcgctgtgtggtatctgaggctggcaaagctttagacatgtcctatgatcacaaaccagaggatgaagtagaactagcacgcatcaagaatgctggtggcaaggtcaccatggatgggcgagtcaacgggggcctcaacctctccagagccattggggaccacttctataagagaaacaagaacctgccacctgaggaacagatgatttcagcccttcctgacatcaaggtgctgactctcactgacgaccatgaattcatggtcattgcctgtgatggcatctggaatgtgatgagcagccaggaagttgtagatttcattcaatcaaagatcagccagcgtgatgaaaatggggagcttcggttattgtcatccattgtggaagagctgctggatcagtgcctggcaccagacacttctggggatggtacagggtgtgacaacatgacctgcatcatcatttgcttcaagccccgaaacacagcagagctccagccagagagtggcaagcgaaaactagaggaggtgctctctactgagggggctgaagaaaatggcaacagcgacaagaagaagaaggccaagcgagactagcagtcatccagacccctgcccacctagactgttttctgagccctccggacctgagactgagttttgtctttttcctttagccttagcagtgggtatgaggtgtgcagggggagctgggtggcttcactccgcccattccaaagagggctctccctccacactgcagccgggagcctctgctgtccttcccagccgcctctgctcctcgggctcatcaccggttctgtgcctgtgctctgttgtgttggagggaaggactggcggttctggtttttactctgtgaactttatttaaggacattcttttttattggcggctccatggccctcggccgcttgcacccgctctctgttgtacactttcaatcaacactttttcagactaaaggccaaaacctaatcgta

SEQ ID NO: 748 - DNA, 1713 bp, Homo sapiens
aaaagccgccggtgctctgacggcctcgttcccctagcagttgcgggggagtttcctgccggcgcggctggagtctctgattctcagggttcggtggttggaagatgctccagagagacgaggctgcggcggaggaggtggcggcggccgaatcggcaacggcgctagggtggagagaaggcggcatcggcggcggcggcggcgtgaggggccgggcggtgtaaacagccccggaggcggcggtcgagaccccgagggggaagcggcggctgagtcagggtcgcgcctccgttggaaacttgggctgagtaccgcggcgggcgcgagcgaggcgccctagacatcttctccctcccttgcctcagggaagtcgagataacatgagtattgtactagtttgcttttcaaatgctcccaaggtctcagatgaagcggtgaaaaaagattcagagttggataagcacttggaatcacgggttgaagagattatggagaagtctggcgaggaaggaatgcctgatcttgcccatgtcatgcgcatcttgtctgcagaaaatatcccaaatttgcctcctgggggaggtcttgctggcaagcgtaatgttattgaagctgtttatagtagactgaatccacatagagaaagtgatggggcctccgatgaagcagaggaaagtggatcacagggaaaattggtggaagctctcaggcaaatgagaattaatcataggggaaactaccgacaacttctggaggagatgctgactagttacaggctagctaaagtagagggagaagaaagccctgctgaaccagctgccacagctacttcttcgaacagtgatgctggaaacccagtgacaatgcaggaaagccatactgaatcagaaagtggtcttgctgaattagacagctctaatgaagatgcagggacaaagatgagtggtgaaaaaatatgactttcctttttggtaatatttttgtgatctttgatggtttttaacctaggaagtgtaatgtatgcatttatataactgttttgttatttgaatcttggaaaactagttttattatattcagatagccttgttttttaaaaaggcctttgcatacacctttatgagatagtgtaaaattgactatttatagtactatggatttaatgaaattatatgtcatttcacattgtatgccagaaattaggctaccaattatgaattaaagtcagtagttaaattaatactagatagaattagaaattttgattagagagattatgctatattatggaaaaacttgttaatgtagaattatactgcttcatattattttacctattagtacactcatagttagctttgtaataaatttatgttttctttaataattttagttcttcaaagaatggctgatgctggcctgtaatttttctttcaaggatgataatttgtgtgttgtttgatttgtttatattttacatctctgtagttttatttttagaagttgtgagatattggatgtgtggctatttttcctttctctgtattctttatgaaacataacttttgaaaaacctatgtattattcatacagctttggtttgtatattctgtatagcctaactacacacatcaaaatgtatgtcaaccaagtgtttagaatgaaattataagtgtttaagtccaaataaagcatgtgatgtggaataatcta

SEQ ID NO: 749 - DNA, 2146 bp, Homo sapiens
gtcccgttaccgcctcctgctcctgccgcgcgcacccccggggcttcggctccggcacgggtcgcgcccagctttcctgcacctgaggccgccggccagccgccgccatgggtgcctacctctcccagcccaacacggtgaagtgctccggggacggggtcggcgccccgcgcctgccgctgccctacggcttctccgccatgcaaggctggcgcgtctccatggaggatgctcacaactgtattcctgagctggacagtgagacagccatgttttctgtctacgatggacatggaggggaggaagttgccttgtactgtgccaaatatcttcctgatatcatcaaagatcagaaggcctacaaggaaggcaagctacagaaggctttagaagatgccttcttggctattgacgccaaattgaccactgaagaagtcattaaagagctggcacagattgcagggcgacccactgaggatgaagatgaaaaagaaaaagtagctgatgaagatgatgtggacaatgaggaggctgcactgctgcatgaagaggctaccatgactattgaagagctgctgacacgctacgggcagaactgtcacaagggccctccccacagcaaatctggaggtgggacaggcgaggaaccagggtcccagggcctcaatggggaggcaggacctgaggactcaactagggaaactccttcacaagaaaatggccccacagccaaggcctacacaggcttttcctccaactcggaacgtgggactgaggcaggccaagttggtgagcctggcattcccactggtgaggctgggccttcctgctcttcagcctctgacaagctgcctcgagttgctaagtccaagttctttgaggacagtgaggatgagtcagatgaggcggaggaagaagaggaagacagtgaggaatgcagcgaggaagaggatggctacagcagtgaggaggcagagaatgaggaagatgaggatgacaccgaggaggctgaagaggacgatgaagaagaagaagaagagatgatggtgccagggatggaaggcaaagaggagcctggctctgacagtggtacaacagcggtggtggccctgatacgagggaagcagttgattgtagccaacgcaggagactctcgctgtgtggtatctgaggctggcaaagctttagacatgtcctatgatcacaaaccagaggatgaagtagaactagcacgcatcaagaatgctggtggcaaggtcaccatggatgggcgagtcaacgggggcctcaacctctccagagccattggggaccacttctataagagaaacaagaacctgccacctgaggaacagatgatttcagcccttcctgacatcaaggtgctgactctcactgacgaccatgaattcatggtcattgcctgtgatggcatctggaatgtgatgagcagccaggaagttgtagatttcattcaatcaaagatcagccagcgtgatgaaaatggggagcttcggttattgtcatccattgtggaagagctgctggatcagtgcctggcaccagacacttctggggatggtacagggtgtgacaacatgacctgcatcatcatttgcttcaagccccgaaacacagcagagctccagccagagagtggcaagcgaaaactagaggaggtgctctctactgagggggctgaagaaaatggcaacagcgacaagaagaagaaggccaagcgagactagcagtcatccagacccctgcccacctagactgttttctgagccctccggacctgagactgagttttgtctttttcctttagccttagcagtgggtatgaggtgtgcagggggagctgggtggcttcactccgcccattccaaagagggctctccctccacactgcagccgggagcctctgctgtccttcccagccgcctctgctcctcgggctcatcaccggttctgtgcctgtgctctgttgtgttggagggaaggactggcggttctggtttttactctgtgaactttatttaaggacattcttttttattggcggctccatggccctcggccgcttgcacccgctctctgttgtacactttcaatcaacactttttcagactaaaggccaaaacct

SEQ ID NO: 750 - DNA, 1060 bp, Homo sapiens
atggcctcacggctcctgcatcgccatatccgagagcagctaaaggacctgaaggaagtgagccacgagagcctggtagtgggggccgttgagaatgccttccagctcatggatgagcagatggcccgggagcggcgtggccaccaagtggaggggggctgctgtgcactggttgtgatctacctgctaggcaaggtgtacgtggccaatgcaggcgatagcagggccatcattgtccggaatggtgaaatcattccaatgtcccgggagtttaccccggagactgagcgccagcgtcttcagctgcttggcttcctgaaaccagagctgctaggcagtgaattcacccaccttgagttcccccgcagagttctgcccaaggagctggggcagaggatgttgtaccgggaccagaacatgaccggctgggcctacaaaaagatcgagctggaggatctcaggtttcctctggtctgtggggagggcaaaaaggctcgggtgatggccaccattggggtgacccgaggcttgggagaccacagccttaaggtctgcagttccaccctgcccatcaagccctttctctcctgcttccctgaggtacgagtgtatgacctgacacaatatgagcactgcccagatgatgtgctagtcctgggaacagatggcctgtgggatgtcactactgactgtgaggtagctgccactgtggacagggtgctgtcggcctatgagcctaatgaccacagcaggtatacagctctggcccaagctctggtcctgggggcccggggtaccccccgagaccgtggctggcgtctccccaacaacaagctgggttccggggatgacatctctgtcttcgtcatccccctgggagggccaggcagttactcctgaggggctgaacaccatccctcccactagcctctccatacttactcctctcacagcccaaattctgaagttgtctccctgacccttctttagtggcaacttaactgaagaagggatgtccgctatatccaaaattacagctattggcaaataaacgagatgg

SEQ ID NO: 751 - DNA, 3877 bp, Homo sapiens
aaaaggagccgagcggcttctgctcaatggcggaaaagccgccggtgctctgacggcctcgttcccctagcagttgcgggggagtttcctgccggcgcggctggagtctctgattctcagggttcggtggttggaagatgctccagagagacgaggctgcggcggaggaggtggcggcggccgaatcggcaacggcgctagggtggagagaaggcggcatcggcggcggcggcggcgtgaggggccgggcggtgtaaacagccccggaggcggcggtcgagaccccgagggggaagcggcggctgagtcagggtcgcgcctccgttggaaacttgggctgagtaccgcggcgggcgcgagcgaggcgccctagacatcttctccctcccttgcctcagatttattgctaaacatgggtgcatttttggataaacccaaaactgaaaaacataatgctcatggtgctgggaatggtttacgttatggcctgagcagcatgcaaggatggagagtggaaatggaagatgcacacacagctgttgtaggtattcctcacggcttggaagactggtcattttttgcagtttatgatggtcatgctggatcccgagtggcaaattactgctcaacacatttattagaacacatcactactaacgaagactttagggcagctggaaaatcaggatctgctcttgagctttcagtggaaaatgttaagaatggtatcagaactggatttttgaaaattgatgaatacatgcgtaacttttcagacctcagaaacgggatggacaggagtggttcaactgcagtgggagttatgatttcacctaagcatatctactttatcaactgtggtgattcacgtgctgttctgtataggaatggacaagtctgcttttctacccaggatcacaaaccttgcaatccaagggaaaaggagcgaatccaaaatgcaggaggcagcgtgatgatacaacgtgttaatggttcattagcagtatctcgtgctctgggggactatgattacaagtgtgttgatggcaagggcccaacagaacaacttgtttctccagagcctgaggtttatgaaattttaagagcagaagaggatgaatttatcatcttggcttgtgatgggatctgggatgttatgagtaatgaggagctctgtgaatatgttaaatctaggcttgaggtatctgatgacctggaaaatgtgtgcaattgggtagtggacacttgtttacacaagggaagtcgagataacatgagtattgtactagtttgcttttcaaatgctcccaaggtctcagatgaagcggtgaaaaaagattcagagttggataagcacttggaatcacgggttgaagagattatggagaagtctggcgaggaaggaatgcctgatcttgcccatgtcatgcgcatcttgtctgcagaaaatatcccaaatttgcctcctgggggaggtcttgctggcaagcgtaatgttattgaagctgtttatagtagactgaatccacatagagaaagtgatgggggtgctggagatctagaagacccatggtagccttaaaaaccttctaaaatgcttttgattctgaaaattgggggaaaaaacttttaatcacaattttcttcaatacaaggggaaaatattcttgcggattcccaacgttttgtgatatgagcagaaaatcattagcatttcccatcatttgttcatatttgtgttttctgacagttgccacttgtagcattgcctgtactacagtattttttgccaacctcaggcatactcgttacatctgtattgaactttcggccctagaaaccagtggagttatttcaccacaaatcaacaatgtgcctgaggtgcatgggaaatatagttagctatactctgaaaatacattatgttttttttctttaaacaaaacacacaacatgtaagcatgtaagagtaaagaattgtatgatatgttccttttttcagttcaccaagttggaagccttttgcagctctgtggcttggaatttcatttgagcaatttctataggatatgtatttattattgattgttatttaatttttttccaattttacctgtattaccaaactgggttctccaataatgtccaaattgtaatgttgccttgcttcaagataaagtgtatttgggaataatattataaacccttacaaattttatgcatgtatctactgcatccttcaactctcactagaaaatcttttgaaaccaaatggattaatttatggctatttataatttgctttgacatctcactgttggaaattttttaaagatgagatttgcctttataatgtaaattgtgatttttgttttacatgtgggtttctatagttttaattttttcagcttttaagatacgagttttgtgtaatttggtatttttaatcatttatgttattttaaaagctcagaatatcacattgaaattactataaatacatttaaaattatctattttagatctaaggaaatactacagagatattttcatgggttcagtaacttttcattttataacattgggcacggtacagagtgattgtcacataaggtacttgaagatttattagtttaattctatttttacagtaaccttgaattcttctgagttttgcatgtattaaattcaattaatgctgaacatgaagagtaaagtatttatctgaaagaagtttctgggttaggagaagtaatgaatgtatccatttgtacatggtttacatgttgtggatgctttgtaaacattttcctgtatgtttaaattgtgtttcagcaggatgtaattgcccttgtgtgtagttaaaatgagtcatcatctggtcctttgtgaaatggaattcatggtattttctgtaacgttttcctgaagctgtttctggagagccacacatttaaatacagacagctttcctgatcatttgatttattgtgcacctgatttttggtctaaaaggaattattgccacaatatattttatttattctttagattttagccttgtaagttaaagtgctttacatgatgatgtgaaaagctgtttgtccctttactgggtttggggggttgttaaaagatagggaatgaagaatgcaaaatggtttatcgttcaaactgtccactctgatccaaccctgtactgatagtacttcccagtatgatattgtgatgtttcatacaatgcagtgaacataaccaacttgttacctaaataaagaattgataaaaacagtgtgacatattactatttggtatgattcagtttttaatgttattttaaacttcttatatggttggcatatttctgaaaatttaattccaaagaggaattaaccaaactgtacaggacaatattaaccccttctgtactctagaaatatttatactccttttaaaaaaacctgcctttggccgggtgcattggctcacacctgtaatcccagcactttgggaggccaaggcgggtggatcacgaggtcaagagatcgtgaccatcctggccaacacggtgaaaccctgcctctactaaaaatacaaagattagctgggcatggtggtgcttgcctgtaatcccagctgcttgggaggctgaggcagaagaattgcttgaacccaggaggcggaggttgcagtgagctaagatcgcgccactgcactccagcctggcgacagagcgagactccgtctcaaaaaaaaaaaaaaagaaaaaaaaaaacttttccggcagggggcagggtgggggttactggtgcttgaaacagaaataatgtatgagttagtaaaagaaaaacccatattcagtgttgactcatctgaa

SEQ ID NO: 752 - DNA, 2996 bp, Homo sapiens
cgcgcccccccttctccgggtccgccccctcccccttctcggcgtcgtcgaagataaacaatagttggccggcgagcgcctagtgtgtctcccgccgccggattcggcgggctgcgtgggaccggcgggatcccggccagccggccatggcggggctgtactcgctgggagtgagcgtcttctccgaccagggcgggaggaagtacatggaggacgttactcaaatcgttgtggagcccgaaccgacggctgaagaaaagccctcgccgcggcggtcgctgtctcagccgttgcctccgcggccgtcgccggccgcccttcccggcggcgaagtctcggggaaaggcccagcggtggcagcccgagaggctcgcgaccctctcccggacgccggggcctcgccggcacctagccgctgctgccgccgccgttcctccgtggcctttttcgccgtgtgcgacgggcacggcgggcgggaggcggcacagtttgcccgggagcacttgtggggtttcatcaagaagcagaagggtttcacctcgtccgagccggctaaggtttgcgctgccatccgcaaaggctttctcgcttgtcaccttgccatgtggaagaaactggcggaatggccaaagactatgacgggtcttcctagcacatcagggacaactgccagtgtggtcatcattcggggcatgaagatgtatgtagctcacgtaggtgactcaggggtggttcttggaattcaggatgacccgaaggatgactttgtcagagctgtggaggtgacacaggaccataagccagaacttcccaaggaaagagaacgaatcgaaggacttggtgggagtgtaatgaacaagtctggggtgaatcgtgtagtttggaaacgacctcgactcactcacaatggacctgttagaaggagcacagttattgaccagattccttttctggcagtagcaagagcacttggtgatttgtggagctatgatttcttcagtggtgaatttgtggtgtcacctgaaccagacacaagtgtccacactcttgaccctcagaagcacaagtatattatattggggagtgatggactttggaatatgattccaccacaagatgccatctcaatgtgccaggaccaagaggagaaaaaatacctgatgggtgagcatggacaatcttgtgccaaaatgcttgtgaatcgagcattgggccgctggaggcagcgtatgctccgagcagataacactagtgccatagtaatctgcatctctccagaagtggacaatcagggaaactttaccaatgaagatgagttatacctgaacctgactgacagcccttcctataatagtcaagaaacctgtgtgatgactccttccccatgttctacaccaccagtcaaggattttggatttgaactcgattcaagaaagtgatgtaacttattatcagagagccatctttacatcaatactaatctgaatgccagccatgtgtacagcactaataaaaagtcactggaggaggatccatggccaagggtgaattctaaggaccatatacctgccctggttcgtagcaatgccttctcagagaattttttagaggtttcagctgagatagctcgagagaatgtccaaggtgtagtcataccctcaaaagatccagaaccacttgaagaaaattgcgctaaagccctgactttaaggatacatgattctttgaataatagccttccaattggccttgtgcctactaattcaacaaacactgtcatggaccaaaaaaatttgaagatgtcaactcctggccaaatgaaagcccaagaaattgaaagaacccctccaacaaactttaaaaggacattagaagagtccaattctggccccctgatgaagaagcatagacgaaatggcttaagtcgaagtagtggtgctcagcctgcaagtctccccacaacctcacagcgaaagaactctgttaaactcaccatgcgacgcagacttaggggccagaagaaaattggaaatcctttacttcatcaacacaggaaaactgtttgtgtttgctgaaatgcatctgggaaatgaggtttttccaaacttaggatataagagggctttttaaatttggtgccgatgttgaactttttttaaggggagaaaattaaaagaaatatacagtttgactttttggaattcagcagttttatcctggccttgtacttgcttgtattgtaaatgtggattttgtagatgttagggtataagttgctgtaaaatttgtgtaaatttgtatccacacaaattcagtctctgaatacacagtattcagagtctctgatacacagtaattgtgacaatagggctaaatgtttaaagaaatcaaaagaatctattagattttagaaaaacatttaaactttttaaaatacttattaaaaaatttgtataagccacttgtcttgaaaactgtgcaactttttaaagtaaattattaagcagactggaaaagtgatgtattttcatagtgacctgtgtttcacttaatgtttcttagagccaagtgtcttttaaacattattttttatttctgatttcataattcagaactaaatttttcatagaagtgttgagccatgctacagttagtcttgtcccaattaaaatactatgcagtatctcttacatcagtagcatttttctaaaaccttagtcatcagatatgcttactaaatcttcagcatagaaggaagtgtgtttgcctaaaacaatctaaaacaattcccttctttttcatcccagaccaatggcattattaggtcttaaagtagttactcccttctcgtgtttgcttaaaatatgtgaagttttccttgctatttcaataacagatggtgctgctaattcccaacatttcttaaattattttatatcatacagttttcattgattatatgggtatatattcatctaataaatcagtgaactgtt

SEQ ID NO: 753 - DNA, 8184 bp, Homo sapiens
cgggagctagagagcagtggtctcggcgctcgtccggcccgcagcttcgggtcctcaggcggctgttgctccggaacgggtggttggggaggggggggtggggggactctagacagctgaggcgcgaaagcgatgagtcctcggctcttcctcctccttctccgggacccgctctctgcctccctctccaacgcccggatgatctgagccgcgagggcgccgacagccgggggcccggacgcagcccggctcctcccctcctccgccccttccccagcctgacctggcccgccgctgcagcggtgacccctcccccggctgccgccgtcgccgccgcggtgaccccctccccggctgccgccgccgccgcctcggccgaccagggacctgcccgcctgcggctgctccggacctagaggatcaagacataatgggagcatttttagacaagccaaagatggaaaagcataatgcccaggggcagggtaatgggttgcgatatgggctaagcagcatgcaaggctggcgtgttgaaatggaggatgcacatacggctgtgatcggtttgccaagtggacttgaatcgtggtcattctttgctgtgtatgatgggcatgctggttctcaggttgccaaatactgctgtgagcatttgttagatcacatcaccaataaccaggattttaaagggtctgcaggagcaccttctgtggaaaatgtaaagaatggaatcagaacaggttttctggagattgatgaacacatgagagttatgtcagagaagaaacatggtgcagatagaagtgggtcaacagctgtaggtgtcttaatttctccccaacatacttatttcattaactgtggagactcaagaggtttactttgtaggaacaggaaagttcatttcttcacacaagatcacaaaccaagtaatccgctggagaaagaacgaattcagaatgcaggtggctctgtaatgattcagcgtgtgaatggctctctggctgtatcgagggcccttggggattttgattacaaatgtgtccatggaaaaggtcctactgagcagcttgtctcaccagagcctgaagtccatgatattgaaagatctgaagaagatgatcagttcattatccttgcatgtgatggtatctgggatgttatgggaaatgaagagctctgtgattttgtaagatccagacttgaagtcactgatgaccttgagaaagtttgcaatgaagtagtcgacacctgtttgtataagggaagtcgagacaacatgagtgtgattttgatctgttttccaaatgcacccaaagtatcgccagaagcagtgaagaaggaggcagagttggacaagtacctggaatgcagagtagaagaaatcataaagaagcagggggaaggcgtccccgacttagtccatgtgatgcgcacattagcgagtgagaacatccccagcctcccaccagggggtgaattggcaagcaagaggaatgttattgaagccgtttacaatagactgaatccttacaaaaatgacgacactgactctacatcaacagatgatatgtggtaaaactgctcatctagccatggagtttaccttcacctccaaaggagagtacagctcaactttgttgaaacttttaacatccatcctcaactttaaggaaggggatatgacatgggtgagaatgattacatcagagaacttcagcagtacaacagctagcccagaactgatttttttttttttttttgtaaatttgagacttatgtaagcgtgatttcaaaccataattcgtgttgtaaatcagactccagcaatttttgttgtatgattttgtttttttgtaaagtgtaattgtccttgtacaaaatgctcatatttaattatgaactgctttaaatcactatcaaagttacaagaaatgtttggcttattgtgtgatgcaacagatatatagccctttcaagtcatgttgtgtttggacttggggttggaacagggagagcagcagccatgtcagctacacgctcaaatgtgcagatgattatggaaaataacctcaaaatcttacaaagctgaacatccaaggagttattgaaaactatcttaaatgttcttggtaggggagttggcattgttgataaagccagtcccttcatttaactgtctttcaggatgttccttcgttgtttccatgagtattgcaggtaataatacagtgtattcataagaatctcaatcttggggctaaatgccttgtttctttgcacctcttttcaagtccttacatttaattactaattgataagcagcagcttcctacatatagtaggaaactgccacatttttgctatcatgattggctgggcctgctgctgttcctagtaagatattctgaattccattttatcaataaagcttgatttaacaaacaagaaacttaatcatgtatgtgtaattcctcttttaccctggccttttaaaacactgtgccgttgtaatgagacgtttctcatagggaaagatgttagtctcttttaattggacaacactgtcactcaaggcatagatgaaactttccttccattagaaagactaaaagatttaattcttggttgtaccttaatctattttttaaataggtttctttcaggctgcttatttttcattaagatgtgtatcagcttggatttgcctactgtttaattaaaatatttattgtcaaagtttgacaatctaacactctatggtaggggtgtgtgtgtgtgtgtttgtgagtgtgtgtttgcctgtgatttttaattggcccatgtctttagaatccaagtggttaagatgtatttgtgatttgaaatatagcatgttgataatatttagctgttggcctttacaaataactttcaaagcttaaggaattgtagatataaaaataacctaatttaatttaggcttaaattcctctgattaagcatgtgaaagtaagttttaaaatctgtcgcattgaaaagattactgttccgtgcccttctgtatttttgtctctttaggttgaatattgtatttatcaccatgtaatcattcagtaggcagattcccactagaaaactgttgaaatgtaagactaaaatacaacattgaatacaaaatcaaaattttgtgtataaaaaccagtatagtccattttgttatatttgttttttccctaacttggaaatatacatatttgtatatatagccttaaaattaatgtaaagttaggggagtagtggggaaagtaatgtgaaatgtctcagatttaagtagttaaataccagcaaaatcttttcattatccctcttattttgtgaggtgattaaatgtaacttaattgtatttaatttatatcttattccagcatgaatgaggaaaaactgaagtactatttatatttagaaattcatatcagttgaaattacagaaccaattccatacttacaataaatacttaatgtctaaatctgtggtagagtgcgaagtatgataatgttctaagttatggctttgcaagcatctaaatgtgcatttaatgaataccagtgcttctagtatagactaattaccagacatactggtactgaaagctaaatccctattataacaaaccagttccttaatattttaagtagactgacaactttagttccagaaattgcaaaactttgaactggactgtgtaatcttttgagatgcaaaacttaagtcacaagtagagtatgtgatggaaagctgtatttcaaaccataacagcatatttagagccttttttttttgagtctttaaacaagagaaaattaaaatattcctgtcaaaattattagtattgaaattaggcttggacacgagagagaaccgtatttgagtgatgtgagaagactaaatcttttccacatgagtcagcactgccatactaataatttttttactataaaaatacaggaaggaagtatacattataacagcagactgtgtgtgttcctgattcctggaggtaatagtggggggaaaccaaccatactttttaaaggcacttttgcacctctattgtgcacttcattcttgtaccacttaaattcttcacccccatcccctttttttgtgctaattagcatctcagggcaatgcctcaaaaatgtttgatgtgttctgttctttggagggaaaaagttcttatgtgatgataatatagtactcaaaatatacttttatcatttaaatgtcttatttgctgctatgaataggaaataacattttgtatagcaggctctgttttaccctaacattaaaaaatttcactgatctttctttcattaacagggtagaatctcctaatttccactttcttgggaatatacttttatagacaatagaagcagttctcaatattagcatatactttaaaaaatcaaagtgataacttaattcagctttggaagtatctcaaacatatttttactttatagtgcattaacttgcttctagagtacttaatgcaactgctctagccacttaattttttatactaatctcaacattaagaaatttggattaagtaataaattagttatgtaattcaagtaatctgaattacagcagtacttttagtgatcattcataggactatatattaacccagctaataactcagtttttttacaaaatgtttcgagtattattggtaaaacactgttctaggctaagcacattgggactgtaaagaaatgagtagatccttggcttcaagtttacatctggacaatttataatctagtgtatgttagtattataactggatcactcatcaaaaaatatatatatatatctattgcccacctgctatctaccaggtacttagctgatcaaggcaggcccctgccctaaagaccttgtttatacttcctttactcacctgaaaactgttctccagtttattttcttctctctaaagttaaagagtaattcagaagaaaattttgcttagcataagaataaaattggactgaagaggcttaagcccattcagtatccttgattgcatttatccaacggcctttattcttcctgctgacagcagtaactcagaggaataggtagtagatttctgaaaattatccagccatggaaatgtaggtggggtttgagtttaaggcatttaaaaatgtaaatatctctagctaaatttatcttaagtagaactctgtgtttttgtaacacactgccagtgttaatatcaaattttagccaaattattactatgtgttttaatattttaaaataatttcactgcccatctttactggacaaactcatttggagttcaacttgtgatttctgaaagaactgatgaaattgggtactgctttttttctccatttttcgttttgttttaattttgaatttcatggtatatacttttagttcaaactcagctgtttgtacagtattgtattaggatttggtattagaaaagatgtgtaaatatcttagtatataattgtttctcatttgaggtttttcttctaagggaccttaaagagttttatatacttttgctcacagaaactgctggtgagattaccattttttgagtatctagtcttctagtttttcttttaggcattaggaagccttctttagagttcaaaattttagaagcctaatttgctcttacttccttcaattatgtgccatgtgttttggtttgtatatgttttaaattgtatatttccttggaatatgcttgaaatatttaagaatacattttcaaaatgtataatactgtattgttttgttgatcagaataataagtctcagttaaatgtttgttattactgatagtcaaaatgctcaatagaaatgatgagaggcattggttccaattcattgtcaaatgaacgttttctaattttgttcacagattctttccctttcgattgttctgtatgttaagatagtggcttctgctctcactgttttcctatttatattactagcaggtaggagtgctaattagaaaaacttagatggtattgaaattacagttgacaacttatatttttatgagatggagaaaaaagattaagttgatataacaacaaagtggactttttttcttccttatcctgcacgaaatattgcccttgtttcctctactttcctcttggtgttttctctttttttcaaacagaaacaggccaattccattttcttgagcaagaaagcttagtgtgttacttcatcaaggccagctaatactgtgttaaaccgggctgaaaatgagaaaacttgggagatggaggaatggggaaatggcagtgggataggtagggaaggattactcttaattgttttaaaagccataggaaagtcttccttgtacgtggctgtaaatttataagaactattgtgtcacataaaccaacaagaatgaacctttgctgcttcagataatttgatttttccagcaaggaaattaataagttactgattcttcagcatagaaacaactgagaagaattaatgcaatgtttcttcactagaaaacccaacccttcatttcttttcattgctccaaaacccagttttcaactaatggttttctcattaaactaaatgtttagaaaagttgtttagagtttttctttttcttttacatagtcctcctgatccagtataagactatttagtaacgtgcatttgtatggtactatctaaagtaagttagattgatgtaagagatcgggtagctgcggaacaaaattagttatatcctaattaggtacagtgaatgacacaaaatcattttagcaatgcttcttaaccttttggggtcacaggcgttttgagactgatgaatcctagggacttatttacccaggaaaatgcgtatataacatacatatctccctaaagtttacaatattgtagtggttcatgggccccctggttaagagcccattctaaagtacaatagggcatcatcccttttcctgcaaagcccaaaagtatatttctagggcatgaaaataacttgagtctattttaaggaattgtttcactctagaggtagataggggacctggctagaatctgacattaaaatatactttttaaaaaatattatatttggggtggggaaagtgattaaaaggtgaaaaaaaaacatagtattcagaagttttggaggttaatgtctttctctaagatttgccactttagaaattcaacagaaaagaggtaaaacagaaatggaatgtatctggaacatttttggcctccatagtgcagatatactatattaacaagtaatacatttatttacctgtcagatctccaggttttaagattttgagctttctagtattaggattcattaaatgttcaattcatttcatattctaaggaattaggttatttacttactaattcaggatgttaaaataacatccaagtcggacaaccaccaccaatgcacacagttaatgagatttctaaaatataataagtacaatgtaacaaacgtatagaattttgcatttgttgccaaaattagatgtttaatgacagcttatttaattcccatttgtgggacttctggaacatagaaaccattatcttacctggttatcccttgactaaatagcatatctgcaggaaaatatcttgtttgtagtgatatgccccaatagtgattgatttcactcttgaaatgagttatatcacttaatttgtataaatgttatgagtggagagacatgtacatgttaaaagcatgttgcattatatattcattttttaaactctataaatgttaagaataatataattgcagaaatatttttcttaaatacaatgtgtaacaaaattctccgtagcaactcacccactttgcagtttatgtgatccacacttttaaagaaattccataaatgtatattttgtattatgtattatttcctggtccaaagaaaatatgtgaattcagttctaactttaagaatgtactgtttgttttcaagttcattgaaaaattgcattcagcctgcgaatggttgcagattgtatgttagatgaaaagtagaaataatttctagtttggaaaactggtgccactaaataaacaggcaattacataa

SEQ ID NO: 754 - DNA, 1442 bp, Homo sapiens
tttagcctcttccctgcagtggacaatgaggaggctgcactgctgcatgaagaggctaccatgactattgaagagctgctgacacgctacgggcagaactgtcacaagggccctccccacagcaaatctggagcctctgacaagctgcctcgagttgctaagtccaagttctttgaggacagtgaggatgagtcagatgaggcggaggaagaagaggaagacagtgaggaatgcagcgaggaagaggatggctacagcagtgaggaggcagagaatgaggaagatgaggatgacaccgaggaggctgaagaggacgatgaagaagaagaagaagagatgatggtgccagggatggaaggcaaagaggagcctggctctgacagtggtacaacagcggtggtggccctgatacgagggaagcagttgattgtagccaacgcaggagactctcgctgtgtggtatctgaggctggcaaagctttagacatgtcctatgatcacaaaccagaggatgaagtagaactagcacgcatcaagaatgctggtggcaaggtcaccatggatgggcgagtcaacgggggcctcaacctctccagagccattggggaccacttctataagagaaacaagaacctgccacctgaggaacagatgatttcagcccttcctgacatcaaggtgctgactctcactgacgaccatgaattcatggtcattgcctgtgatggcatctggaatgtgatgagcagccaggaagttgtagatttcattcaatcaaagatcagccagcgtgatgaaaatggggagcttcggttattgtcatccattgtggaagagctgctggatcagtgcctggcaccagacacttctggggatggtacagggtgtgacaacatgacctgcatcatcatttgcttcaagccccgaaacacagcagagctccagccagagagtggcaagcgaaaactagaggaggtgctctctactgagggggctgaagaaaatggcaacagcgacaagaagaagaaggccaagcgagactagcagtcatccagacccctgcccacctagactgttttctgagccctccggacctgagactgagttttgtctttttcctttagccttagcagtgggtatgaggtgtgcagggggagctgggtggcttcactccgcccattccaaagagggctctccctccacactgcagccgggagcctctgctgtccttcccagccgcctctgctcctcgggctcatcaccggttctgtgcctgtgctctgttgtgttggagggaaggactggcggttctggtttttactctgtgaactttatttaaggacattcttttttattggcggctccatggccctcggccgcttgcacccgctctctgttgtacactttcaatcaacactttttcagactaaaggccaaaacct

SEQ ID NO: 755 - DNA, 1712 bp, Homo sapiens
atggcggtcctggcccgccagctgcagcgtctcctctggaccgcttgcaagaaaaaggagagggagaaggaggggagggaggaagaggaggaggaggaggcggggcgcagggcccccgaagggcctcggtctctgttgacagcgccgcgccgcgcccagcggccgcacgggggtgccgaggcgtctgggggcctgcgcttcggggcgagcgcagcgcaaggctggcgcgcgcgcatggaggatgctcactgcacttggctttcgttacctggtctgcccccgggctgggccttgtttgccgtcctcgacggccacggtggggctcgagctgcccgcttcggtgcacgccatttgccaggccatgtgctccaggagctgggcccggagcctagcgagcccgagggcgtgcgcgaggcgctgcgccgagccttcttgagcgccgacgagcgcctgcgctccctctggccccgcgtggaaacgggcggctgcacggccgtggtgttgctggtctccccgcggtttctgtacctggcgcactgcggtgactcccgcgcggtgctgagccgcgctggcgccgtggccttcagcacagaggaccaccggccccttcgaccccgggaacgcgagcgcatccacgccgctggcggcaccatccgccgccgccgcgtcgagggctctctggccgtgtcgcgagcgttgggcgactttacctacaaggaggctccggggaggccccccgagctacagctcgtttctgcggagccagaggtggccgcactggcacgccaggctgaggacgagttcatgctcctggcctctgatggcgtctgggacactgtgtctggtgctgccctggcgggactggtggcttcacgcctccgcttgggcctggccccagagcttctctgcgcgcagctgttggacacgtgtctgtgcaagggcagcctggacaacatgacctgcatcctggtctgcttccctggggcccctaggccttctgaggaggcgatcaggagggagctagcactggacgcagccctgggctgcagaatcgctgaactgtgtgcctctgctcagaagccccccagcctgaacacagttttcaggactctggcctcagaggacatcccagatttacctcctgggggagggctggactgcaaggccactgtcattgctgaagtttattctcagatctgccaggtctcagaagagtgcggagagaaggggcaggatggggctgggaagtccaaccccacgcatttgggctcagccttggacatggaggcctgacagctgttgtcctttggggatcctttgcttctctggggcctcaacagaactaaagaagaaaaccgaccctttccccaactacatgtaccagcggaaggaaggaaggccaatgtaggaacccaaaatgcttatttcttcttctcttacttccctctcacagaaaagtcttacgaatggggaaattccaccaacatccagaccaaaaagaaaaaagcccaaatcgaaaaaaaaaaaaaaaaaaaaaaaaaacaaaaaaacccaaccaaatgtttttgaaatattcagagccgaacagattctgagagataacccagtccaataacctctttccttcttattactcatctgtttttgaggggaagtagagttttgattattaaactttatttacataagtgattccaaatacattttcttgt

SEQ ID NO: 756 - DNA, 1778 bp, Homo sapiens
ggagccgcgaggagacagctgaggcccgcggagaccagggggtgaagcctggagaccctcttgccctggcctagctgcaggcccccgggatgctttgggcatgtcctctggagccccacagaagagcagcccaatggccagtggagctgaggagaccccaggcttcctggacacgctcctgcaagacttcccagccctgctgaacccagaggaccctctgccatggaaggccccagggacggtgctcagccaggaggaggtggagggcgagctggctgagctggccatgggctttctgggcagcaggaaggccccgccaccacttgctgctgctctggcccacgaagcagtttcacagctgctacagacagacctttccgaattcaggaagttgcccagggaggaagaagaagaggaggaggacgatgacgaggaggaaaaggcccctgtgaccttgctggatgcccaaagcctggcacagagtttctttaaccgcctttgggaagtcgccggccagtggcagaagcaggtgccattggctgcccgggcctcacagcggcagtggctggtctccatccacgccatccggaacactcgccgcaagatggaggaccggcacgtgtccctcccttccttcaaccagctcttcggcttgtctgaccctgtgaaccgcgcctactttgctgtgtttgatggtcacggaggcgtggatgctgcgaggtacgccgctgtccacgtgcacaccaacgctgcccgccagccagagctgcccacagaccctgagggagccctcagagaagccttccggcgcaccgaccagatgtttctcaggaaagccaagcgagagcggctgcagagcggcaccacaggtgtgtgtgcgctcattgcaggagcgaccctgcacgtcgcctggctcggggattcccaggtcattttggtacagcagggacaggtggtgaagctgatggagccacacagaccagaacggcaggatgagaaggcgcgcattgaagcattgggtggctttgtgtctcacatggactgctggagagtcaacgggaccctggccgtctccagagccatcggtgagagccaaagaggccgacccaagtgggagaaggtctctcggaagcccaggcctcgagtgtggcccgcggctcaccaggggttcagggaggcagtgtgatgggccgagggggatttgtcatgcactggggtgataccctcgtagtgtgaagggaacagggcagattcagagactgcagcaccagtgtctgagtgtaagttacactgtatgttattatctcacctaaaacagctcctacaaatctcatagaaacctgtggctcaccaccctatgggctggaagtagagcttccaatattccggaaatgaggtttatcctcctcccgcgttcatgctgacaatccttttttctcttttgggaaaaaagtgggttcgctgggcgcggtggctcacgcctgtaatcccagcactttgggaggccgaggtgggtggatcacctgaggtcgggagttcgagaccagcctgatgaaaccccatgtctactaaaaaaaaaatacaaaaaattagccaggcatggtagtgagcccctgtaattccagctattcagaaggctgaggcaggagaatcacttgaacccagaaggcggaggttgcagtgagctgagatcgcgccactccactccagcctggataacgaggaaaactctgtctcaaaaaataataataaaaataaataaaaattttaaaaagtaa

SEQ ID NO: 757 - DNA, 5245 bp, Homo sapiens
tccctgttgttctaaattcggcattactagtgcatgcgtgcatccggggaaaaggaacaaggtgggagaagagagagaaagcgaatacccgaggccgccagcatcagtgggtgcccgcgctctcctcctcgctctcgtcctctgccctccgccctggctccctgcccgcattccctgggagcgcagccttgccttagcctgggagacagctgtccacagtgacaggcggccattgttctcggccgagccagcaggcttccggccggtggcagctgctgctcctccgctctgcggccccaccaagggggcgccgccaccgcccaggccctccccgcctgatgggtctctgtccgtccacgcgggagacagcgccacctgccggtgagaaggagcgttgctgcgccggcaccagcccagtcctacgctcggggctcctgcaggcctgggaaggagggagggcgcagctagaaggaagtctcgcctgcccttgcttccccgtctgtcagagtgcctcgcatgcaggcctgcctagcggccttgatcatgctctccctgtcacggaagtagaatgtagtcaagtttttggactccaagccattcttacaaaattgcgtcagagtggggattgtattataagaattgccactgaagagcagcgagtggctgaaacctctgtgtggctgccagtcagcccctccccggtgactggatcagcgaagaatccagaagcgaggttgcggggctgcagcccttggcatggggagtccgtgggctgggcagcactgcctcagccgctggcctttcctgagcagagtctaggctaagcggctgttggaaatagcagtagcacccggggcgagaccgtgagccacagcggcggccggagtctcccccagcccgagctcaggcctgtgctggatgcccaaagcctggcacagagtttctttaaccgcctttgggaagtcgccggccagtggcagaagcaggtgccattggctgcccgggcctcacagcggcagtggctggtctccatccacgccatccggaacactcgccgcaagatggaggaccggcacgtgtccctcccttccttcaaccagctcttcggcttgtctgaccctgtgaaccgcgcctactttgctgtgtttgatggtcacggaggcgtggatgctgcgaggtacgccgctgtccacgtgcacaccaacgctgcccgccagccagagctgcccacagaccctgagggagccctcagagaagccttccggcgcaccgaccagatgtttctcaggaaagccaagcgagagcggctgcagagcggcaccacaggtgtgtgtgcgctcattgcaggagcgaccctgcacgtcgcctggctcggggattcccaggtcattttggtacagcagggacaggtggtgaagctgatggagccacacagaccagaacggcaggatgagaaggcgcgcattgaagcattgggtggctttgtgtctcacatggactgctggagagtcaacgggaccctggccgtctccagagccatcggggatgtcttccagaagccctacgtgtctggggaggccgatgcagcttcccgggcgctgacgggctccgaggactacctgctgcttgcctgtgatggcttctttgacgtcgtaccccaccaggaagttgttggcctggtccagagccacctgaccaggcagcagggcagcgggctccgtgtcgccgaggagctggtggctgcggcccgggagcggggctcccacgacaacatcacggtcatggtggtcttcctcagggacccccaagagctgctggagggcgggaaccagggagaaggggacccccaggcagaagggaggaggcaggacttgccctccagccttccagaacctgagacccaggctccaccaagaagctaggtggtttccaggcccctgccctccccttcctcccatccttgtccttctctccctcagaagcctcaggacccaacaggtggcaggcagtggacagggtgcccgccccacagtgctttccccagcaccccagagccagtcgggacaccccccgcagcccgtcctggtggctgtggaactgcactgggtggcgggcagatggtggaaggcagcttaggagacctcaccaaagagaagatggaccggctcttgctcccagctcctattaggcccggggtgggaccagaggtcataggtgcccaacggcagccaaaccggcgacgcacatgtgtcttttgttggtgtgtttgtttttttccagggaggtctaattccgaagcagtattccaggttttctctttgttttatcagtgccaagatgacctgttgtgtcatataatttaagcagagcttagcatttattttattctttagaaaacttaagtatttacttttttaaagctatttttcaaggaacctttttttgcagtattattgaatttattttctaaatcaggattgaaacaggaacttttccaggtggtgttaataagccattcaagtgccttacacagctttgaagaaactaggactgcagtgggctcggataggcccattgaggtttttagaaaagcaggatttgttttgttagggaggcatgattttggtgagatctttctggaagagttttccgcctctttgtgatgctgaacacccccaaggttctcccctccccccgctgcccaggtgactggcaggagctgcgactgccacgtagtggtgcctgggcccgacagcggggctctgggcatcccgggtgaccttggcccatctgcctgcattcccacccccttgggcctggctggatcccaggcagagggaccttgctgctgtgtgattggaacattcccaaatatcttgtgaatttgtaatcaaattggtctcattgggaaagactcttaattaagaggctcaggcaagcacagaggcagcccgtgggtctctgtctcagtctggaggcagcagggatgctgctgggagtccatggcacaggccacagcccctcaccttgccgcggtggctggcagcacgcctgccttgctctgccccatgccctgaacaggcatgagagctccacgtcccctagtgcaccctgagagggggctcacaagtgaccgatcctgggtgcctcagggagctcactgagggcgtgcaaagttgaaagtggcaaggctgggggagggtgtcgggtagagggaagagggcagggggctaggggaggactcagaggccatctgcagggccaagccacaggaagggctgagctggaggtgggcagggctgctccaggcaggtcagagcagtgcagggggaggagaggagaaagggaggaagctgggctgtgtggtccccatgaaggcattcagagtccacctgcagacagcgagagccccaggaaggtttgcacagctgtgccccaagcaccttggcctcctctcagctcgccgaggaggcacgctagagccgccttcccggtgggagccctctgtcccacagggagcggggagccagctttgctggggccctacctgcatgcccagccttacccctcattctcacagcacagatgaggttgagaccatgcagtcaatgcattgcttaaggtctcttatttacaaaaaaaaaccttaaacatagtcgctgtcattcagacattcagagaatggttggccacaaacaatgaccaagtattgcttggcttaacttgaaggcctgctgtctccttctgggggtcagggacgcagctccaccctcaccactagcccaccctgcccgtgggcataaccttgacgaagagagagaatgattggcatctgcttttctcttttctttgctaataattctgttcctggctgccgagagtgaagtttcaccatgtggaggtttggctcctatcacctggtggtctgattcataccctagcctgaggctccactggaagatctcgcagcctcagtgtatgggaaaccctttccccaggcttgtcccagcactgccgctccccacccctgagccaggaccccagaggatggccatgccccgtgcctggcagaggtctggtgccagcactgggagctgctccgcccttgccttggggccgagggagccctcgtccacccctgcacagcagctgggcacagaggagcgctcttccatcttgaccaggactgcaccaagaagcaccaggtgtcttcagcctccaacctccggggcgaccttctcttccagccacagtcccatgagggcccctagccagggacactggtctgtaaattgtaatcctttctccagcccagctctccacttgttccttgtgtgagctgagcaggcagtgcacctctgagtgtcccttttgtaaggcccaggggttgcactgagtctgcagaggccgcgacctcctagaacgctgtgggtgcaggtgagccggcgtgtcctggggagatgctgccagcacacaggggccctcctgctgccagcaggttggggtggttaagtcttattagtgtctattcttaaaattaagtgggctggagaagaatggagctccacatgccagcaccgtatatggaatacaaaagctggggaagcagggcctgccttacaggtgtggctgactctgagcccaggcctgcaggggtggagggcagtccctcagaatcccagaggcagtcccagcctcagaacccaggataggaaatgggtgtgtttagtggggaaagggacggggtgcagacggcagggccagtatggggccccctccctctcctctcctctcctatggtgagcccagcgtgggcaccgggccgtctcagccgtgttcccagggctgggaggacagctctggcccttcttaggcctagcctcgtcccaagctaaatgtaagccagttgggctgtgttaaaggaagcagtgtttttggttcgattctgcctctgtagctcaaggggggcagcccccagagtcctgtgcattctgccaaggctccatagctttgccaaatgcacggagctctgccattccggtgcagtgcaggccttgcgaagggtttatctgcgttcgtctcggtgggcttctcctgcatgggagttgtgttcctgtgcaagggggagctttgctccaggacaggatgactgtcttccctattcttagggacaagtcccaagatgccagaaaggcagtctcccaaggacccaccatgcagaagtgtcaataaaccacaagttctg

SEQ ID NO: 758 - DNA, 5587 bp, Homo sapiens
tccctgttgttctaaattcggcattactagtgcatgcgtgcatccggggaaaaggaacaaggtgggagaagagagagaaagcgaatacccgaggccgccagcatcagtgggtgcccgcgctctcctcctcgctctcgtcctctgccctccgccctggctccctgcccgcattccctgggagcgcagccttgccttagcctgggagacagctgtccacagtgacaggcggccattgttctcggccgagccagcaggcttccggccggtggcagctgctgctcctccgctctgcggccccaccaagggggcgccgccaccgcccaggccctccccgcctgatgggtctctgtccgtccacgcgggagacagcgccacctgccggtgagaaggagcgttgctgcgccggcaccagcccagtcctacgctcggggctcctgcaggcctgggaaggagggagggcgcagctagaaggaagtctcgcctgcccttgcttccccgtctgtcagagtgcctcgcatgcaggcctgcctagcggccttgatcatgctctccctgtcacggaagtagaatgtagtcaagtttttggactccaagccattcttacaaaattgcgtcagagtggggattgtattataagaattgccactgaagagcagcgagtggctgaaacctctgtgtggctgccagtcagcccctccccggtgactggatcagcgaagaatccagaagcgaggttgcggggctgcagcccttggcatggggagtccgtgggctgggcagcactgcctcagccgctggcctttcctgagcagagtctaggctaagcggctgttggaaatagcagtagcacccggggcgagaccgtgagccacagcggcggccggagtctcccccagcccgagctcaggcctgtgctggatgcccaaagcctggcacagagtttctttaaccgcctttgggaagtcgccggccagtggcagaagcaggtgccattggctgcccgggcctcacagcggcagtggctggtctccatccacgccatccggaacactcgccgcaagatggaggaccggcacgtgtccctcccttccttcaaccagctcttcggcttgtctgaccctgtgaaccgcgcctactttgctgtgtttgatggtcacggaggcgtggatgctgcgaggtacgccgctgtccacgtgcacaccaacgctgcccgccagccagagctgcccacagaccctgagggagccctcagagaagccttccggcgcaccgaccagatgtttctcaggaaagccaagcgagagcggctgcagagcggcaccacaggtgtgtgtgcgctcattgcaggagcgaccctgcacgtcgcctggctcggggattcccaggtcattttggtacagcagggacaggtggtgaagctgatggagccacacagaccagaacggcaggatgagaaggcgcgcattgaagcattgggtggctttgtgtctcacatggactgctggagagtcaacgggaccctggccgtctccagagccatcggggatgtcttccagaagccctacgtgtctggggaggccgatgcagcttcccgggcgctgacgggctccgaggactacctgctgcttgcctgtgatggcttctttgacgtcgtaccccaccaggaagttgttggcctggtccagagccacctgaccaggcagcagggcagcgggctccgtgtcgccgaggagctggtggctgcggcccgggagcggggctcccacgacaacatcacggtcatggtggtcttcctcagggacccccaagagctgctggagggcgggaaccagggagaaggggacccccaggcagaagggaggaggcaggacttgccctccagccttccagaacctgagacccaggctccaccaagaagctaggtggtttccaggcccctgccctccccttcctcccatccttgtccttctctccctcagaagcctcaggacccaacaggtggcaggcagtggacagggtgcccgccccacagtgctttccccagcaccccagagccagtcgggacaccccccgcagcccgtcctggtggctgtggaactgcactgggtggcgggcagatggtggaaggcagcttaggagacctcaccaaagagaagatggaccggctcttgctcccagctcctattaggcccggggtgggaccagaggtcataggtgcccaacggcagccaaaccaaagacactggtgtgcatggggcagcatggttgtgcacgtgggaccctggggcggacccaggagccaaactcttgaagcaccccctgggtcaggcccagcagcggagtggccagccccagtttcccattgctcctctctgcggccagggccaggtgggttcatatttacagatatgcccagccagtcctggtcggccacaccagtgtcccaaagaggagagcgcagcagagccaggggtctgttctgtagcagccacccccctgcccccactccagggcagccatgatgtgcttgggcccaccagggccttccgggctgctctcttccctgagcccggaaccggcgacgcacatgtgtcttttgttggtgtgtttgtttttttccagggaggtctaattccgaagcagtattccaggttttctctttgttttatcagtgccaagatgacctgttgtgtcatataatttaagcagagcttagcatttattttattctttagaaaacttaagtatttacttttttaaagctatttttcaaggaacctttttttgcagtattattgaatttattttctaaatcaggattgaaacaggaacttttccaggtggtgttaataagccattcaagtgccttacacagctttgaagaaactaggactgcagtgggctcggataggcccattgaggtttttagaaaagcaggatttgttttgttagggaggcatgattttggtgagatctttctggaagagttttccgcctctttgtgatgctgaacacccccaaggttctcccctccccccgctgcccaggtgactggcaggagctgcgactgccacgtagtggtgcctgggcccgacagcggggctctgggcatcccgggtgaccttggcccatctgcctgcattcccacccccttgggcctggctggatcccaggcagagggaccttgctgctgtgtgattggaacattcccaaatatcttgtgaatttgtaatcaaattggtctcattgggaaagactcttaattaagaggctcaggcaagcacagaggcagcccgtgggtctctgtctcagtctggaggcagcagggatgctgctgggagtccatggcacaggccacagcccctcaccttgccgcggtggctggcagcacgcctgccttgctctgccccatgccctgaacaggcatgagagctccacgtcccctagtgcaccctgagagggggctcacaagtgaccgatcctgggtgcctcagggagctcactgagggcgtgcaaagttgaaagtggcaaggctgggggagggtgtcgggtagagggaagagggcagggggctaggggaggactcagaggccatctgcagggccaagccacaggaagggctgagctggaggtgggcagggctgctccaggcaggtcagagcagtgcagggggaggagaggagaaagggaggaagctgggctgtgtggtccccatgaaggcattcagagtccacctgcagacagcgagagccccaggaaggtttgcacagctgtgccccaagcaccttggcctcctctcagctcgccgaggaggcacgctagagccgccttcccggtgggagccctctgtcccacagggagcggggagccagctttgctggggccctacctgcatgcccagccttacccctcattctcacagcacagatgaggttgagaccatgcagtcaatgcattgcttaaggtctcttatttacaaaaaaaaaccttaaacatagtcgctgtcattcagacattcagagaatggttggccacaaacaatgaccaagtattgcttggcttaacttgaaggcctgctgtctccttctgggggtcagggacgcagctccaccctcaccactagcccaccctgcccgtgggcataaccttgacgaagagagagaatgattggcatctgcttttctcttttctttgctaataattctgttcctggctgccgagagtgaagtttcaccatgtggaggtttggctcctatcacctggtggtctgattcataccctagcctgaggctccactggaagatctcgcagcctcagtgtatgggaaaccctttccccaggcttgtcccagcactgccgctccccacccctgagccaggaccccagaggatggccatgccccgtgcctggcagaggtctggtgccagcactgggagctgctccgcccttgccttggggccgagggagccctcgtccacccctgcacagcagctgggcacagaggagcgctcttccatcttgaccaggactgcaccaagaagcaccaggtgtcttcagcctccaacctccggggcgaccttctcttccagccacagtcccatgagggcccctagccagggacactggtctgtaaattgtaatcctttctccagcccagctctccacttgttccttgtgtgagctgagcaggcagtgcacctctgagtgtcccttttgtaaggcccaggggttgcactgagtctgcagaggccgcgacctcctagaacgctgtgggtgcaggtgagccggcgtgtcctggggagatgctgccagcacacaggggccctcctgctgccagcaggttggggtggttaagtcttattagtgtctattcttaaaattaagtgggctggagaagaatggagctccacatgccagcaccgtatatggaatacaaaagctggggaagcagggcctgccttacaggtgtggctgactctgagcccaggcctgcaggggtggagggcagtccctcagaatcccagaggcagtcccagcctcagaacccaggataggaaatgggtgtgtttagtggggaaagggacggggtgcagacggcagggccagtatggggccccctccctctcctctcctctcctatggtgagcccagcgtgggcaccgggccgtctcagccgtgttcccagggctgggaggacagctctggcccttcttaggcctagcctcgtcccaagctaaatgtaagccagttgggctgtgttaaaggaagcagtgtttttggttcgattctgcctctgtagctcaaggggggcagcccccagagtcctgtgcattctgccaaggctccatagctttgccaaatgcacggagctctgccattccggtgcagtgcaggccttgcgaagggtttatctgcgttcgtctcggtgggcttctcctgcatgggagttgtgttcctgtgcaagggggagctttgctccaggacaggatgactgtcttccctattcttagggacaagtcccaagatgccagaaaggcagtctcccaaggacccaccatgcagaagtgtcaataaaccacaagttctg

SEQ ID NO: 759 - DNA, 3025 bp, Homo sapiens
aaaaggagccgagcggcttctgctcaatggcggaaaagccgccggtgctctgacggcctcgttcccctagcagttgcgggggagtttcctgccggcgcggctggagtctctgattctcagggttcggtggttggaagatgctccagagagacgaggctgcggcggaggaggtggcggcggccgaatcggcaacggcgctagggtggagagaaggcggcatcggcggcggcggcggcgtgaggggccgggcggtgtaaacagccccggaggcggcggtcgagaccccgagggggaagcggcggctgagtcagggtcgcgcctccgttggaaacttgggctgagtaccgcggcgggcgcgagcgaggcgccctagacatcttctccctcccttgcctcagatttattgctaaacatgggtgcatttttggataaacccaaaactgaaaaacataatgctcatggtgctgggaatggtttacgttatggcctgagcagcatgcaaggatggagagtggaaatggaagatgcacacacagctgttgtaggtattcctcacggcttggaagactggtcattttttgcagtttatgatggtcatgctggatcccgagtggcaaattactgctcaacacatttattagaacacatcactactaacgaagactttagggcagctggaaaatcaggatctgctcttgagctttcagtggaaaatgttaagaatggtatcagaactggatttttgaaaattgatgaatacatgcgtaacttttcagacctcagaaacgggatggacaggagtggttcaactgcagtgggagttatgatttcacctaagcatatctactttatcaactgtggtgattcacgtgctgttctgtataggaatggacaagtctgcttttctacccaggatcacaaaccttgcaatccaagggaaaaggagcgaatccaaaatgcaggaggcagcgtgatgatacaacgtgttaatggttcattagcagtatctcgtgctctgggggactatgattacaagtgtgttgatggcaagggcccaacagaacaacttgtttctccagagcctgaggtttatgaaattttaagagcagaagaggatgaatttatcatcttggcttgtgatgggatctgggatgttatgagtaatgaggagctctgtgaatatgttaaatctaggcttgaggtatctgatgacctggaaaatgtgtgcaattgggtagtggacacttgtttacacaagggaagtcgagataacatgagtattgtactagtttgcttttcaaatgctcccaaggtctcagatgaagcggtgaaaaaagattcagagttggataagcacttggaatcacgggttgaagagattatggagaagtctggcgaggaaggaatgcctgatcttgcccatgtcatgcgcatcttgtctgcagaaaatatcccaaatttgcctcctgggggaggtcttgctggcaagcgtaatgttattgaagctgtttatagtagactgaatccacatagagaaagtgatgggcagaaatgatgaagaaactgttctgatggcctgcttttctgtccttttcctactgctttaaacattgattttcttttgtactaaatcatatagccaaatattgtttaagtaagtcagttttaggaaatgcttgtgttgctgttgaattataaaagctgagtaaatttcagattaaactttaaatgactgtgaaataagacataaactagttaatggtaatttgcttaaaatgacttgagattattattggaagtttttattaattgatacaggtaagaattgatatttaataaaatgttctcatgcttagactatattacttttcggtagagaaattagtattttgctgtaatgtgttatgaaatacatgtgatatcctagtttgtctactgacactggggtcttgaatcttaaaaaaaggcctccgatgaagcagaggaaagtggatcacagggaaaattggtggaagctctcaggcaaatgagaattaatcataggggaaactaccgacaacttctggaggagatgctgactagttacaggctagctaaagtagagggagaagaaagccctgctgaaccagctgccacagctacttcttcgaacagtgatgctggaaacccagtgacaatgcaggaaagccatactgaatcagaaagtggtcttgctgaattagacagctctaatgaagatgcagggacaaagatgagtggtgaaaaaatatgactttcctttttggtaatatttttgtgatctttgatggtttttaacctaggaagtgtaatgtatgcatttatataactgttttgttatttgaatcttggaaaactagttttattatattcagatagccttgttttttaaaaaggcctttgcatacacctttatgagatagtgtaaaattgactatttatagtactatggatttaatgaaattatatgtcatttcacattgtatgccagaaattaggctaccaattatgaattaaagtcagtagttaaattaatactagatagaattagaaattttgattagagagattatgctatattatggaaaaacttgttaatgtagaattatactgcttcatattattttacctattagtacactcatagttagctttgtaataaatttatgttttctttaataattttagttcttcaaagaatggctgatgctggcctgtaatttttctttcaaggatgataatttgtgtgttgtttgatttgtttatattttacatctctgtagttttatttttagaagttgtgagatattggatgtgtggctatttttcctttctctgtattctttatgaaacataacttttgaaaaacctatgtattattcatacagctttggtttgtatattctgtatagcctaactacacacatcaaaatgtatgtcaaccaagtgtttagaatgaaattataagtgtttaagtccaaataaagcatgtgatgtggaataatct

SEQ ID NO: 760 - DNA, 1790 bp, Homo sapiens
cccgacccagcgttttccttgggattccgacctccccctcagagaagacaggaggtcgggaaggacctgcagcccaggggcttccaagatgaggcccagagactcggattatcaatgcagagaaatctgaattcaatgaggatcaagccgcctgtgggaagctgtgcatccggagatgtgagtttggggctgaagaagagtggctgaccctgtgcccagaggaggatgaggtgatcgggcgggagctggaggcctcaggccagatgggcggctgcacagccctggtggctgtgtccctgcagggaaagctgtacatggccaatgctggggatagcagggccatcttggtgcggagagatgagatacggccactgagcttcgagttcaccccagagactgagcggcagcggatccagcagctggcctttgtctatcctgagcttctggctggtgagttcacccgactggagttccctcggcggctgaagggggatgacttgggacagaaggttttgttcagggatcaccacatgagtggctggagctacaaacgtgtggagaaatcggatctcaagtacccactgatccatggacagggtaggcaggctcggttactaggaacactggctgtctcccggggcctgggagaccatcagctcagagtcctggacacaaacatccagctcaagcccttcttgctctctgtgccacaggtgactgtgctggatgtggaccagctggagctacaggaggatgatgtggttgtcatggcaactgatggactctgggatgtactgtccaacgagcaggtggcatggctggtgcggagcttcctccctgggaaccaagaggacccacacaggttctcaaagctggcccagatgctgatacacagcacacagggaaaggaagacagtctcacagaggaagggcaggtgtcctacgatgacgtctctgtgttcgtgattcccttgcacagtcagggccaagagagcagtgaccactgaggattcagacactgtatcccagaactgctctagtgcccgggtgtggtctgggcatccctccagtgtgaccaagagcaaatcctgcctgccctatccctagccaccgcccagtgctctcactatccacctcaacacacatccatctcaagaggaacatttataccaggcagtcagagctggaagtgtatggagagcccagcccaccaggtcctgccttttgcggtgataaccttctctggcagagtgactttacaacttaactaggaaacccatgtgaggctcctcagacaggatcttgaacagcccaaagtatcattctcagataggggcacccaagctaagggtattagccaaagatgccaggatgggtagctagcccatgtttagatccaggtctccaattcatggttatcagggcatgtgttcaacaacccccaaagtccacgcaggtggcttgtagaaacctttgggcagcctcatgtctgctaaaacagccatcttcaagacagcccctgaaaagagaccagttcaggtcctgccctgctgttctttgctggagatgaggaacaggtgctggggctaaagtttggggtagagcacaagggacaagaggaactcttggagttggctgggtgagagggctctccatttgctacctgtagtagcctgcctcttaactggttgcttctccctagttccagccctgccctggtctgatgccccaacactgcccttgctttgttttccctgtcacctccctattattaaatgttttctacagaa

SEQ ID NO: 761 - DNA, 1497 bp, Homo sapiens
gcggggagggggttgcaaaaggagccgagcggcttctgctcaatggcggaaaagccgccggtgctctgacggcctcgttcccctagcagttgcgggggagtttcctgccggcgcggctggagtctctgattctcagggttcggtggttggaagatgctccagagagacgaggctgcggcggaggaggtggcggcggccgaatcggcaacggcgctagggtggagagaaggcggcatcggcggcggcggcggcgtgaggggccgggcggtgtaaacagccccggaggcggcggtcgagaccccgagggggaagcggcggctgagtcagggtcgcgcctccgttggaaacttgggctgagtaccgcggcgggcgcgagcgaggcgccctagacatcttctccctcccttgcctcagatttattgctaaacatgggtgcatttttggataaacccaaaactgaaaaacataatgctcatggtgctgggaatggtttacgttatggcctgagcagcatgcaaggatggagagtggaaatggaagatgcacacacagctgttgtaggtattcctcacggcttggaagactggtcattttttgcagtttatgatggtcatgctggatcccgagtggcaaattactgctcaacacatttattagaacacatcactactaacgaagactttagggcagctggaaaatcaggatctgctcttgagctttcagtggaaaatgttaagaatggtatcagaactggatttttgaaaattgatgaatacatgcgtaacttttcagacctcagaaacgggatggacaggagtggttcaactgcagtgggagttatgatttcacctaagcatatctactttatcaactgtggtgattcacgtgctgttctgtataggaatggacaagtctgcttttctacccaggatcacaaaccttgcaatccaagggaaaaggagcgaatccaaaatgcaggaggcagcgtgatgatacaacgtgttaatggttcattagcagtatctcgtgctctgggggactatgattacaagtgtgttgatggcaagggcccaacagaacaacttgtttctccagagcctgaggtttatgaaattttaagagcagaagaggatgaatttatcatcttggcttgtgatgggatctgggatgttatgagtaatgaggagctctgtgaatatgttaaatctaggcttgaggtatctgatgacctggaaaatgtgtgcaattgggtagtggacacttgtttacacaagggaagtcgagataacatgagtattgtactagtttgcttttcaaatgctcccaaggtctcagatgaagcggtgaaaaaagattcagagttggataagcacttggaatcacgggttgaaggtaagacaaatgctttttaaaaatatagacaggccaggcacggtagctcatgcctgtaatcctagcacttttgtcgcctgggcgacacaccaaggctctgtctca

SEQ ID NO: 762 - DNA, 2084 bp, Homo sapiens
ggctgaagcaaaacaaccgcctctcccctgcccacttcttgtcctcgtctgagtcgtcccttcccgtctccacgccgaagagaggcgtttagatcctccaatgagggcctaggaggactttcttagccaatcagtagccaagcccctgcaattccgggtgggaccaggcgtccacacctatagctggactgctcgttggtcccttatggcgcttcttttacgcgaggcttagaggtcaaatacaagggggcacggtcctcacagaacggaaaggatccgtacagactctccgggtttgaccgttttctaggacgaaccaatcgctttccagatacttccccgccttttgcgcgttcatttgaaaaaagccggtgtgacggacttggaaattggctcagtgactgacccgcaagaaagccagtgactgggggttcggatcacgagttggaccaataagaaaagacaatcgctggggccggggctttgctaggaggagcgcaggtgggcgttatttgattgacggagggctctacttatggctggtagcgggggctggtccctgacgttcgggaggtaggacctagcggaggcggggccgaataaagtaaatgttgcgggggagtttcctgccggcgcggctggagtctctgattctcagggttcggtggttggaagatgctccagagagacgaggctgcggcggaggaggtggcggcggccgaatcggcaacggcgctagggtggagagaaggcggcatcggcggcggcggcggcgtgaggggccgggcggtgtaaacagccccggaggcggcggtcgagaccccgagggggaagcggcggctgagtcagggtcgcgcctccgttggaaacttgggctgagtaccgcggcgggcgcgagcgaggcgccctagacatcttctccctcccttgcctcagatttattgctaaacatgggtgcatttttggataaacccaaaactgaaaaacataatgctcatggtgctgggaatggtttacgttatggcctgagcagcatgcaaggatggagagtggaaatggaagatgcacacacagctgttgtaggtattcctcacggcttggaagactggtcattttttgcagtttatgatggtcatgctggatcccgagtggcaaattactgctcaacacatttattagaacacatcactactaacgaagactttagggcagctggaaaatcaggatctgctcttgagctttcagtggaaaatgttaagaatggtatcagaactggatttttgaaaattgatgaatacatgcgtaacttttcagacctcagaaacgggatggacaggagtggttcaactgcagtgggagttatgatttcacctaagcatatctactttatcaactgtggtgattcacgtgctgttctgtataggaatggacaagtctgcttttctacccaggatcacaaaccttgcaatccaagggaaaaggagcgaatccaaaatgcaggaggcagcgtgatgatacaacgtgttaatggttcattagcagtatctcgtgctctgggggactatgattacaagtgtgttgatggcaagggcccaacagaacaacttgtttctccagagcctgaggtttatgaaattttaagagcagaagaggatgaatttatcatcttggcttgtgatgggatctgggatgttatgagtaatgaggagctctgtgaatatgttaaatctaggcttgaggtatctgatgacctggaaaatgtgtgcaattgggtagtggacacttgtttacacaagggaagtcgagataacatgagtattgtactagtttgcttttcaaatgctcccaaggtctcagatgaagcggtgaaaaaagattcagagttggataagcacttggaatcacgggttgaagagattatggagaagtctggcgaggaaggaatgcctgatcttgcccatgtcatgcgcatcttgtctgcagaaaatatcccaaatttgcctcctgggggaggtcttgctggcaagcgtaatgttattgaagctgtttatagtagactgaatccacatagagaaagtgatggg

SEQ ID NO: 763 - DNA, 5961 bp, Homo sapiens
ttgagacaatgttataattataattgcccttcctttttggctgctgctttagccagagccacatcagatgaagtccttcagagtgatctttctgcacattatatcccaaaggaaacggatggcacagaagggactgtggagattgagacagtgaaattggcccgttctgtcttcagcaaactacacgagatttgctgcagctgggtgaaagacttccccctccgcaggagaccccagctttattatgagacatcaatccatgccatcaaaaacatgcgcaagctattctataaacatataagcaaaaaaaaaaaaaaaagaaagaaaagagattgggaccaggaagaacaagcttactttgcagtgtttgatggccatgggggagtagatgctgctatttatgcctccattcacctccacgttaacttagtccgccaggagatgttcccccatgatcctgctgaggccctgtgcagggccttccgggtcactgatgagcggtttgtgcagaaagcagccagggagagcttaagatgtgggaccacaggagtggtgactttcatcagaggcaacatgctacatgtggcctgggtgggtgattcccaggttatgcttgtgagaaagggccaagctgttgaactaatgaagccacacaaaccagacagagaggatgaaaagcagagaattgaggcccttggaggttgcgtagtctggtttggtgcctggagggtgaatggaagtctgtcggtttccagagctattggagatgctgaacataagccatatatctgtggggatgcagattctgcctccactgttctggatgggaccgaagactacctcattctggcctgtgatggcttctatgacaccgtgaaccctgatgaggcagtgaaagttgtgtccgaccacctgaaagagaataatggagacagcagcatggttgcccacaaattagtggcatcagctcgtgatgctgggtcaagtgataacatcacggttattgtggtattcctgagggacatgaacaaagctgtaaatgttagtgaggaatcagattggacagagaactcttttcaaggagggcaagaagatggtggggatgataaggagaatcatggagagtgcaaacgcccttggcctcagcaccagtgctcagcaccagccgacctaggctatgatgggcgtgtggattcattcactgatagaactagcctgagcccagggtcccaaatcaacgtgctggaagacccaggctacctagatctcacacaaatagaagcaagcaaacctcacagtgcccagtttttgctaccagttgagatgtttggtcctggtgcaccaaagaaagcaaatcttattaatgagttaatgatggagaaaaaatcagttcagtcatcattgcctgaatggagtggtgctggagagtttcccactgctttcaatttgggttcaacaggggagcagatatacagaatgcagagcttgtctcctgtctgttcagggttggaaaatgaacagttcaaatccccgggaaacagagtttctagattgtctcatttacgccaccactactcaaagaagtggcacagattcaggtttaatccaaagttttattcatttctctctgctcaagagccttcccacaaaataggcactagcctgtcctcacttactggaagtgggaagagaaataggataagaagttctctgccatggaggcaaaatagttggaaagggtacagtgaaaacatgaggaagctcagaaagactcatgatattccatgcccagatcttccttggagctataaaatagaataatttttctttcaagtaggttagctagctctcccccaataaaaataccactatcagagtagaaacaaggtagacatttctaaaacatatgtgcttcattatgaatccatggatggctcaattcttaaatgtaaatagatctctaggaaactcaaagtacagtgttttcaatctaaaaagaagtattggcagtttcacttgcaaaattacacagctggtccctgtgatgtgtctcgacaccaatacacaacccccttcccaccatccttcatgtcactagatacacaacccccttcccaccatcccttcagtcactagtggaagctttcaagttagttatttcagtcaggatatacagtgttgaaatctcaatgcagttgaaatctggtctgatgtgcctaatttatctgtggaaaatttaatgctgaattacatttggttgggaaatgtccctcaaaatcctgggcactatgaaggaaccccctgccccctcacctttttgggtaggtaaaagactaaaagccatatggattttaactgataacaatgaaagtggtaaatcagtgtaaaagtgtcatattctcagacttgtgaggcggtttatagtcagaaagatttacggatttttttcctgtaacataaaagattgtgaactttttttaattaaaaaatatttcctagggctgtagttatttgggagtttcataacctgttatggtgcttttggtggaaatttttattatttagcattttaggagaccgctgtcaactggttttaatctatgatgctaatgtgttttccactgtaccctcatctcaggaataaaactgctttaacggagatgatgtcaggtacaaatacactatagagtcaaaataccatttacaaagaaaatcaaaagcatttctatattttgtctttttttagttcagacagcaaaggcatgtactactataaaatacaaagtgattttagagaatgaaaaatgctacttttatcttctctaaaattatttcccccaaggtagtgaagtaattggaatgaaggaggctgaaagtattgtctaaagtgagcccagaggccactgagaatgcagattactgacagccaggtctgtttagttgtaattggaagacacatgagtgtcctgcttacatgtagcttcagactgcagagacaggacgtgtgcttttcatttcaatatttagttatatttgatattttgaaactgtctgctttttgctatttctgcagtttcaagttagttagaagcatgttgtcaactaaagacaacaaactatcagattcattcattcagtgaagcagcctctgattctctaagagtcacgaatgtcttagtgttaccctcccctagtcaacagcagaccagcctggccaatgcctatgggtggcccctctggagtgctcactaacaagggtgagtgctctcgctaagaagtgtcccccgcctaatcatgtgtttataggatagtacacgttccccaggcccataacagaggactaaaatctctgaattttaaagacacagatgactggcatattttggataccagtatagctatatcaaatagacaaaaacagcttcactttagcaatgatcagattgttaatctacagattttattttttaaaatttggatgtaagtagagactttcagtatttgttttctcttgattttgaagtcatttcttcttctcacgtctgtgacaaatggttgaaaaggagtcaacatggccccaactatagtgccggaaccttttcatcattctgaggctttgccccacacatggtcctcactcatatctgtcaccttctgaagcctagatcttgttaacccatcaggtgcagtgtcagtttcaaatcaaattatctaagaaaacaagaaaacaaaggcagcagactattggtacacattatagtccaaagtgcttagcgaagtaaaaaaaaaagctttttaaaatttctattgttgtctattggtaatgtttttgatcagaataaagagggtaaagggaaaaagttactacacatgctaggctttctcagtggggaaaaaaatggctggatagaactgggacaaacacagacccatctttaggggtctggattttgtaggtccgactacacagcagtgttaactcatttctcatgccattagctctctacaaaataaagcaaagtagttctagtgtggtcgttataaaccaatattgtgaaaaatagcaactattcatttgttcacaacatgcgtatttatagagtagttaggtaccatttgtaaggtaaatcctttaaaattctataatacatactaaaatagtggttattggtctgatatatgctgctcttggttctataaactagataaaagcagtgctttgtgaaatgcagtgttctctcttaacgccactggtgataggaagtagttcccttcagttcaaatcctgtgcccttatttgctgcttgctgacgtaagcaataagtaaccctctaactaatggtatctacatatttctgtaacttgtatttaatgatggtgtacctggtgattgtaaaaatattagacagatataaaagtatctatataatatctataaactgttaatgctgaggtatagtctgtgaattatgtgttttgtatttttattcattgtgtaatttagtggtggtgaaagttctacactcaatccttaaagagtggcagtatccctttttcaatttaacatggtctgcatcaatctgtttgcctgctaaacaagttagaataggaaatagtaaaataaatccaaacaagagtgtaatattggttagggaaacaaacttcaggtcaccaactgaagtcattacaaactccttgtacattcactgtgagtttcaaagggagtcagtccctaatttacaggtttcctttgttcactttctagatgtgtacttttgagggacatgaggttaggcaacattacagcaacacacactggggctattaatcccatttaggtctgtactaaagaggatgggtagaaacacatatgtatataccttttctttacctagaagtgccatccattgtccttgaattattatgattaaagttactgttgcatttaggaggctccttgaaagtaacaccttttccaaggacaatggcaacaatgtcaatgtcaacactgagtctaattttgaccacatttatagtggtatagtgtcaatactgcattttcatgacaaccacactccactgttgaaacactgtgccagtgagaagtgcaacatccagtgggcagatgaaaatgatgcatggccaagttcagtgtttacagataaaactgctgtggttcaagtgcttccttccccatcaaatccttgataaggctttgtgggaaaatgatctaaattattgttttaatttttaaacctaatttattcactcagtgaacattcttacctaagcaaggctataaaagggaatactacagttttgtccacactttaatttgagaccatttttctttgaatcgtaagttagcaaaagaaatttttttcacctttgaaaatcacgtgatgttaaaggacaaatgcccactcttctattctgatctgcaaatagcttaaatgtctcttgcaaaacaaagtaagataccaccagtattacaacacaatgattttccagacaaatggtatggtgttgaaaaataactgttacttcttaaagcagcattttatcttctattttgaagactatttattgtaataattagaaaacatgaaatagggaactccagactgacacagcagttgtttttgaaaaggaaataaactttgatgaattagataatccagatacatcattgtaaactcttactctaggtgctctttggtgagagacaggctttgttctcttgttcataacatttctctgcaaagaattctctatggagtgaagcgaatgaagtgaataatttcttaccaaataaatttatcaatttacaaatctgctctacatctcacttttgagttcagttgtagtcatgagtgatccttcatattttattaaaagtgttcattcaggtaaggtgtatgttgaaattttgccaattatcttaataaaacctggcaattt

SEQ ID NO: 764 - DNA, 1380 bp, Homo sapiens
atgtccgccggctggttccggcgccgcttcctgcctggggagccgctccccgcgccgcggccgcctgggccgcatgccagccccgtgccctaccgacggccccgcttccttcgcggctccagctccagccccggggcggccgacgcctcgcgccgcccagactcccggcccgtgcgcagccccgcacgaggacgcacgctaccctggaatgcaggctacgccgagattatcaatgcagagaaatctgaattcaatgaggatcaagccgcctgtgggaagctgtgcatccggagatgtgagtttggggctgaagaagagtggctgaccctgtgcccagaggagttcctgacaggccattactgggcactgttcgatgggcacggcggtcctgcagcagccatcttggctgccaacaccctgcactcctgcttgcgccggcagctggaggccgtggtggaaggcttggtggccactcagccccccatgcacctcaatggccgctgcatctgccccagtgaccctcagtttgtggaggaaaagggcatcagggcagaagacttggtgatcggggcattggagagtgcctttcaggaatgtgatgaggtgatcgggcgggagctggaggcctcaggccagatgggcggctgcacagccctggtggctgtgtccctgcagggaaagctgtacatggccaatgctggggatagcagggccatcttggtgcggagagatgagatacggccactgagcttcgagttcaccccagagactgagcggcagcggatccagcagctggcctttgtctatcctgagcttctggctggtgagttcacccgactggagttccctcggcggctgaagggggatgacttgggacagaaggttttgttcagggatcaccacatgagtggctggagctacaaacgtgtggagaaatcggatctcaagtacccactgatccatggacagggtaggcaggctcggttactaggaacactggctgtctcccggggcctgggagaccatcagctcagagtcctggacacaaacatccagctcaagcccttcttgctctctgtgccacaggtgactgtgctggatgtggaccagctggagctacaggaggatgatgtggttgtcatggcaactgatggactctgggatgtactgtccaacgagcaggtggcatggctggtgcggagcttcctccctgggaaccaagaggacccacacaggttctcaaagctggcccagatgctgatacacagcacacagggaaaggaagacagtctcacagaggaagggcaggtgtcctacgatgacgtctctgtgttcgtgattcccttgcacagtcagggccaagagagcagtgaccactga

SEQ ID NO: 765 - DNA, 1589 bp, Homo sapiens
ccgggaggtgcctgggagaggcaggcagagcccagccggccgcctgcggctcagtaccgaccgtgccgcgtcgccgggctctgcgtacccctgtctctgcccaggctcccgcaaaacttttattctctggggcccccggggtgtgtgaaggaattggaaccttccgccatctccgcgctccccttcggcggcgaccgaggggacctgcgtccctcgtccgccgggctctggagccctgcgcctcacctgctgatcgctctccggagtctcgagggggcacccccggagggaccgcgcgggcgccggcgcccctgaactctcccgctcaccgcggcagacccgcccagcgcaactttaacttgattcttcttgcccaaccggggcaccagcggctgctgctgcggcggctgctgctaccgccgccgccgcggtctcacaaaggggctcagggaagggaggcggcgcgggcggcagggacgggcctccgggccgccgaggcggggagacaaaagggaagctgcctctgctcgcgctgcctgctcggagccgcttgctcggctgcctctggctgggctccgcgatcctctcccccaccctcgggcactgctccgcctccctcccggcgggctgtccccgcagtgctcccggacccggcgagccttcggggcgcgcgtcgctggtggtggttgaggctctagcgataataaatgatagaggatacaatgactttgctgtctctgctgggtcgcatcatgcgctacttcttgctgagacccgagacgcttttcctgctgtgcatcagcttggctctatggagttacttcttccacaccgacgaggtgaagaccatcgtgaagtccagccgggacgccgtgaagatggtgaagggcaaggtagccgagatcatgcagaacgatcgactcggggggcttgatgtgctcgaggccgagttttccaagacctgggagttcaagaaccacaacgtggcggtgtactccatccagggccggagagaccacatggaggaccgcttcgaagttctcacggatctggccaacaagacgcacccgtccatcttcgggatcttcgacgggcacgggggagagactgcagctgaatatgtaaaatctcgactcccagaggcccttaaacagcatcttcaggactacgagaaagacaaagaaaatagtgtattatcttaccagaccatccttgaacagcagattttgtcaattgaccgagaaatgctagaaaaattgactgtatcctatgatgaagcagttactttttgaatgactgcttggagactgcaagtaacaccttagcttcaaaatatctagttcatattaattctaaactaatttcgattttaaacaaagactttgctttaatataccactattccctccccattctctgtgctgttgtcaaccaaattatatgcttatacattataatgtcatcaataatttcataattatttctttatgcatttattttttaaattagaagaaaaaagttaacaaataagatcaaattagaacaaaatataattctttttaaattaaaatcctgcttctgtaaaaaaa

SEQ ID NO: 766 - DNA, 10934 bp, Homo sapiens
ctccgcctccctcccggcgggctgtccccgcagtgctcccggacccggcgagccttcggggcgcgcgtcgctggtggtggttgaggctctagcgataataaatgatagaggatacaatgactttgctgtctctgctgggtcgcatcatgcgctacttcttgctgagacccgagacgcttttcctgctgtgcatcagcttggctctatggagttacttcttccacaccgacgaggtgaagaccatcgtgaagtccagccgggacgccgtgaagatggtgaagggcaaggtagccgagatcatgcagaacgatcgactcggggggcttgatgtgctcgaggccgagttttccaagacctgggagttcaagaaccacaacgtggcggtgtactccatccagggccggagagaccacatggaggaccgcttcgaagttctcacggatctggccaacaagacgcacccgtccatcttcgggatcttcgacgggcacgggggagagactgcagctgaatatgtaaaatctcgactcccagaggcccttaaacagcatcttcaggactacgagaaagacaaagaaaatagtgtattatcttaccagaccatccttgaacagcagattttgtcaattgaccgagaaatgctagaaaaattgactgtatcctatgatgaagcaggcacaacgtgtttgattgctctgctatcagataaagacctcactgtggccaacgtgggtgactcgcgcggggtcctgtgtgacaaagatgggaacgctattcctttgtctcatgatcacaagccttaccagttgaaggaaagaaagaggataaagagagcaggtggtttcatcagtttcaatggctcctggagggtccagggaatcctggccatgtctcggtccctgggggattatccgctgaaaaatctcaacgtggtcatcccagacccagacatcctgacctttgacctggacaagcttcagcctgagttcatgatcttggcatcagatggtctctgggatgctttcagcaatgaagaagcagttcgattcatcaaggagcgcttggatgaacctcactttggggccaagagcatagttttacagtcattttacagaggctgccctgacaatataacagtcatggtggtgaagttcagaaatagcagcaaaacagaagagcagtgaacccttcaggggtctcagctgccttagactaaaggactttcaacacactggtctcttttaatttagtgaaaagtgtgggagttgtaattaggatcatccaccccagacatggaatcccccctccctggtggtcttaggtctataatcagtgacgaacagagggtgcccttggccaatgtagttaagaaactggaaaatggtttcttcatgttttcccaactctttcatccagtgtccaaaatatataagtaaatagctgtagagtcacatatatgaagtgaatagcatatgtgtcatttagtctccctgaagattcttttcaagatcctgttcagggtcctccaggcatcagctgttgtgtcctctctttgtaacagtggacaggacagaccacccagtgctgcaggagacaggccactgcgtcacctgtgagtggtcaggggctgatgtggcaacaccctctgccaagagacagagctgtcctgagaatgctttgtccttctgagcccatgttttctgctcagtagcagcttggaagcagatttggaatggtttactattttggctgctcttggggactgcgagaagcagagagaatgagagaccagtggcaactgcctgcacagcagagataaccctcttcccttgcttcctttaatagttaaatagactttgtataccacctgaccagcctttgtgcatttatcctaatcatgcatgaccgttaaccttttgcttagtccttaccatatgtaataggcagctgttaaattcaccaacagataccctgatttttcatcttacgtgaccaagaaaccacgttaggggaaatgaaaaaagcaagccacaataccatgattccttccattttcaacagtagatgaaggaaatgatactgaatgagtcacagtgttccctggcaagtaagctgtttgcattgagaaaggagtgagctggtgaggttaccaccctgaattgagctccagctgccagtttttgtgtttttccttgcccctttccaagtggttttcaagtgtcaggcagtgttctgagaagcagcagcctataactgtatgtgtgttccttgaagccaggtgcagagttcccagctactgcagcttgggatttggtgggaaactactgggataagcttctccttgacaatggaaaggcagcagtcttcaacatttggttgcaaatctccatccacatcagggagctttccccaggcaaatacaaaccgccccgtggcctgcaggcctgcaggggaggcagcaaagggacctggcagttgcaacacagtaagtcaggaattcaagcgtgaacccatattgataagtgggccagaattatttaggggcctggcttgctgctctccatttcctgtatcgctaatttatcatttttccaaccttggtattttatattatttagagaaaatgctgggtcactctctttgcctaaggtgactcaaacagccaaacgaaacttccgttgcctcccagccctctgtatccacctggttttgttctttccctgtgagcatttgtggttatagcttcccatatgccacattcaccggccacctcctcgccgtggaaccctgccctctcccctcctgctgctgtagagttttcccaaagcagtgtccaggagagaatttgagagagtgaagaaattgccttgtagatgtggagggctgcaatctgtcttgatttctccaagcacttaactttctttgactgcactgagaattgctaatgatttcccatgagatttgcttacttttgtatactgtattttccagcattacagaaccttggttattgttttttagccatagaatcttctagtaaaaaatatctgccaccattttagatttaagcatttgcctatggggagacactgaatatgtggatgtgtgtattaatatttggggtggggacagggaagggaatgtggaaaacaaatgctggctgtgagcagtgctgagatggccaggccaggcggctgagtttgcttggaaattcaggacattctgactcctaagagttgcccccacccaccatcaaactgaaatcagcaccaatggtgtcagcactttacagcccatagccaactttctttatttttaacgtagcacaaaaatgtataatagcaaggaaaagacatttttaaattccggttatttttattgtctaaaatgaaagcaacagtgttttgataaagatgaaaaagaaaagctactaaattagtaaatcagtggttacgtgccctgcagaatttcttaacagatggtgctgagtgcacgagttacataactttctctctaattgaggttcacaaggcgtcttctaaattttgctttgtacaattaattcatttctgatgttaaccaaatagagtgtatatatcctactcccattactgcctctttcccccctactatggcttgtagattttcaaaagatagaagttctaggcaaaactgtagcagtttcattaatagttgttaggatagttatatctaaaatcagagtattttgttcccttccttctggagctctctctccctagcccttttccagctgttggggatgtgcagacatcactcctgggggtgccctatggtacactggctgctccccagggacctgggaatgctgaatctagccattagggaaattgatttgagatgtttgcatgtgaagcttccctaagcagcactgccaaagctttggaattgtcacccaaggcttcctagactccctagctagctcgagttcgaattgccaatagtccccatggtgccaaattttgggatggttttacagtcttttagaaatgaagacaggaatggccatgtgcttctgagaccccagcacgatgccaggcccaggtctccattaatgcagtgctctgctgctgctccactggcaatttgtactcttaacataggttgggggagggacagctagggaaattttttttaattaattgtatctaaaattctttcatcataggaataaacaacacatatagaaagctccaaagctgttcccaagacctgtattatttattttatatgaccaacttgccccaaggcaattaactctgaattgctgttctaatgtgacatatctgtgtacatatgtacatagtactggtaaccagtggctgcattttattccttgctgtggactgaggtattggcttcttgaatcttgtatatgtcataagaatattatacagagagtgttatagtgaaggatgtaagctggataatttaaaacagaccttatttcatacaagtgtaattattacatcattttgggtaaatggcaaacaggattgcatgagagtgatggcatcatcatttcaattgaatctgaagtgattctaggaaattgattccactgttggattctaggaaattgagtccactgttttcctttgcgtttaatttcctttgtgtttaatttgaccacagaaacttttttgagtagcacctagtaacattgcaaggaacttgtgtatcaaggtgtatcttgattatcctgattttttttgttctctaagttgttgccagatctctcttgcaactgtgtcaatgaaaggtctgtgtttagaaaaggcagcatatcattgtatatttgaaactataggaatatatactttgtataaaacttttccaatgatttcagaaattcttttttcctccttttgacccacaactagactgttcataccctaatagttccccaaaattgccttagcatgtcacaccagcatttgtcatccagctctggagaaatgacatgactgttagatactatgcctgtttaattgcctctggattaagtcattgatagctagacttttgagctagttagctgtagaaataatagaatccagtgtttcccaaagtgtgttccaaagaacacaagttccaaagatgctcttctaaatataggattctaggatgaaataagtttggaaaacacataccatcttagaaagttagtgaacatgagcacatcaaaggctctaatttaaatgtcctgtgaggagagaaaaacacaacaaatatctactgtcagttagcccagtgttttccagattaatttgaccacagaaacttttttgagtggcacctagtaacactgcaaggaacttgtgttctaaagaacaccctttgggaaattctggtatattgaaatattgctgtgttttcattcacgatgactcttagtagcagtacaatttgcaacttagaagcatgagcctttcatatatgaagctgacttgttaataaaagcagtgttaagaagtagtatgacttaatatgaccaacagcagcctcatattgatagcagaacaatcctacttaaagctctaaacatcatccccccctttttttttttaacggaatctcgctctgtcacccaggctggaatgccgtggcgcaatgtcaggtcactgcaagctccgcctcccaggttcacaccattctcctgcctcagcctcctgagcagctgggactacaggcggcctccaccacacctggctaattttttgtatttttagtagagacggggtttcaccatgttagccaggatggtcttgatatcctgaccttgtaatccaccagccttggcctcccaaagtgctgggattacaggtgtgagccactgcacccggccatccctttcttttatatgaataatgagcaagagccctgccatagctaaatatgtctcaaattcattccaagatctttccattgcttttttgcagttacctttgctttttgggttgaatcaaaatgaatatttttatatttcattactatatgatatttaaaaatatacagaaaatcacagaaaaggaaaaacagaaatttgattttaattcacttttgaaattttaacgatttttaaaactaatgatctgttatataataactgaaatgtaaactattaacagttatttactttctttcctttattgtcctctctggattcagtgaaataatttgaaatcaattagagctcataccttctaaaactcctgtcccatatcatcccacctttcatgttttatgtacatagttaagtttggcatgttatctcttgcctaaaatgtgaggccttcctgtagttccacagtagttactcttggctgcagaaataggtttgggaagctatgagagattaccccaaagtcatggatgaaacaaatctagtcgaaaacatggtacagagtgaattaaggcaaaagtcattaacttaaaattacatccaatatttaggaatagctcatcctctgcacattatccaaaatattttaaaaaactaaaagtaagatctcttaggctaggtggcggattgcaaagggcagggggcagttgataccatgaagcttccaatagatgcatttctaaacattttttctaatatgtaaatttgctgatccttagtaatgttaatgctttgtctatttgttatttttaccactgttgaacagcaaactgttgaggctagggttgattattgataatttttatgtgtttagtaataaccacagcatcatacgtacaactgctttaataaatccaagttaaggactttgaggagagcatgtagcaagtattcattttaacaaatcatcacagacagtttccctgttcaaagctccaccaaaaagcaagcatgcagcaaaggcatagactgtatttagagatgtggtttcatttattcttgaagtcctataaccttgcattatttaaacacaaaatcccacctaacatttgccaaatccaagttaatctcaaaaacctccgaggacattgagcacaagcagattactgtaagggcactggtggcagattgtggtggagagagggctgagtgacccagagcaaagcctgcccgggttactcgctgccacttcaggagagggattgtatcagctctcattaccttttgtcatgaggcagttcataaattaaatatgatatcatgcattatctcaaaatatttctatattaattagataattcacgatgtaaaacgtgttcatgcagaagcaaaggcggatgtaatagtcaagtatcagggaaaaacccctttaggatacccagacattaaaaatgtaaaaagtagcttataagaaatgtggattatcagatttttactatatataggttgtgtttaatagtaatttctgacacctgcacatagatgaagaaaaggcagttgttaccacttttcaccattcaaaaaatgggcttgtctcttagagtattggttaatgctttgcttatttgttaatgaagacagcattttaattttaaagcttccttttgtaggactgatggcacgggcagaatcacatttaagaaaaatggtttggaacactttttaataaaaaattgtaaaatcagtttccagtgtggtcaaaattagaatgtaaaggaaagcatttttaagaaaatacagaagcccaaatcaagggagagtaatataaaaggaaatattttaaattaagaaaaggaggtgttatagtttattacatcatgaattatgctttctgtacttacgctcttagtgaaggagataacattgaagtgagaaaatgaacattctcagttatttgcgaagttagtaaaattgcagtccctattccatttttttctgatgaaaatggatacatgagatctcatttattgctctcctcaacacctttactgtcccagattccattcacgttccaaatcgtggacagtaaaactgaagtcagataaacacagtcacaggtacaactgggagcgagttttaacatagtggtaattttgcaaatgccaacatgaatactagtgagtactcaatttacgacagacaatttcacaaaaaccaaccacagagtgatttgatattcttgcttcttagagagttttctaatccatataatgcaatgggtcaggttgctcatatgattaaaaaaattaatcctgtagaaatgatgtattagacatctctaacccaagaaaaagatgtcttttgtataacttttaaattcccatttgtctatcttaggacaaatgatgacttcttcgtgtagtaatgaaaacgtctaaatcctgctctgtggagaaaagctagaaccatgggacattaagcaagaatactcctctgatttaggctcccagactacaactaacagtctttatgtatttatcatcttggttattgttttatctcaagcatatacagtgtgcagaaagtagaataatgaataaaatatgaccatggagaaaacccataacttttgcttctattatagaaagcagtgtttgttctttttaatttattacatgttcacattgaaacattaacatctacaatattgtctttcagtttactcttcaattactaaagcaaatgattttgatttatagcacttacacaactgcagttcaggtcacagaattgaaatctatttgataatgtctcagcattctcatgggcagccaggaaaaaaaaaaagagagagaaagacaaatagaaattttagtgggttcagataaatgattattctgacaaacctggaaaatagtaattaaacagttcattccaaaagaccccaatgtaaactctgctcacatacataatttgtataaggaaaatgtatgagtttttttcttaaaaataaatagaagcatcattgcatttataacagattgatcaatcttatgaacagattacattgggaaagtcactattattgctgtgtgtttgtatattttattctttccttttttgtgtgagcatctactatgtgccaggcagtgactgtgtctgagtgaatgtatccatggtgagcactcaggcgccatcactgccttcttggggcttacaccctattggggtgtcagagatattataacactcaatattgacccaatgggatgaaaattgttatcttcatgatttcttccaatgggcttagatttgttgggacagggcagaattagaataattatttctcacatataagagtaagtgatatgagattgggaatttcttgccaacactcaagcaaactgcagaagataattactccattttactagctcacctagtttctgaaggatggggtggggagtgagacatggagcctctggggacaaggataggggggtgggactgtcccagtggagggtgccactggaagcctccacccaagtgggccagcagctgtgcaagggtgcagcagtaggctggtgaaagccaggttgtccagatctttctaggggaagagaaggattatagaaaaggagaaaagggaggagcaagaacatctctccatggcctatttttatttttgttcccaagagactagtgtaataaccttatgcccccaaagacagcccagaactgagtatcttcagtgttcctgagtgtaaatcagtgaatctgttatatagaaagttaacatttcaggagcacaattatttcctgatttcaaatatgaacagaagactaaatgtcatttttttaaatcataaatttggtatccatagttactttacacattccagagtctaagcatggaatttaagttttgtattttgaacaaaaatagcaacatctgttttctgtatggcaaagaaaaactaaatcccagacttttatttttaaccacagaaaccatcacttctttctaaattatttgcttgcctgctcatttcccctaaacatctctgtttatgccaatggctttttaaatccaaataatactagttattgccaaattgcattagaatcctattgaattagaataattcatatacttcatatactaggcagtaaatggttagagacggtaaagatctgattgtgatcaaaagtagggtttttgttttgtttttaatcatgagcacatataaaaggaaattcaaatgaaaccaagccaatttctgatttagtaagattaaaaccatagatggagctcagttattaaggatggaaaggaggaaagcacagagtgaggagagaaaaaggggaaggaaaaaaagtagtgtttttttggggaacagtataatgtctcagaagttcttctctcttatcctgctgatgttgagacagtggctttgtataagcttttatttatacctatttcaacatcatgaaaatttttccatcagcattttcttgcaactttaaaaatcacaagggattatttgtttataaagagatacaggatctataatttattggcaatactttattttaggaatcttcaaattgtacttaataaataaatcacaggtcaaaatgactgtaaaatcaatcaggctttctcgtaagttatttcctgaaaaccatccatgataaatacaacaaggcttggcgaaacctcattactcttggaagtcttcagaggttattatacctactgatctgtatttgtctctaagagacatttgaaacacagttacaatgtcaatttggtgtaacattacctgtagtagagctcagagtatatggcagtgcacggtcactcaagatgcatggcgtgtcatttgggtcgctttgatgggtgctcgggtagaattagccttgtagagactaatgtgttcatgctatctctgatcctgtggtgttgtataaaaatgaacagctaaaaatttacccatgacaagattaaagcaaaaataaacacaaagttgttagactttaaacatga

SEQ ID NO: 767 - DNA, 1091 bp, Homo sapiens
gagaatttccagcaggcaaggcagtggccgctttgactgcttgcttcggagatccgagacgacggagaaggcactcttatttaccgaccaagaaagctcctcccccgtcctccgttagctaattaaaacatttttcagggacgtagccatccagagacattccattattgttccattgacctttccctcatcactgagtcctttggagctgagttatgtcaacagctgccttaattactttggtcagaagtggtgggaaccaggtgagaaggagagtgctgctaagctcccgcctgctgcaggacgacaggcgggtgacacccacgtgccacagctccacttcagagcctaggtgttctcggtttgacccagatggtagtgggagtccagctacctgggacaattttgggatctgggataaccgcattgatgagccaattctgctgccacccagcattaagtatggcaagccaattcccaaaatcagcttggaaaatgtggggtgcgcctcacagattggcaaacggaaagagaatgaagatcggtttgacttcgctcagctgacagatgaggtcctgtactttgcagtgtatgatggacacggtggacctgcagcagctgatttctgtcatacccacatggagaaatgtattatggatttgcttcctaaggagaagaacttggaaactctgttgaccttggcttttctagaaatagataaagccttttcgagtcatgcccgcctgtctgctgatgagaactgtgcctggtcagcagctctagacctggagcccgtggacactatatgcggggcttcagtggaaagagagatctgcttaattttgtcccaggtgaaggagtccagcggttcctatcctggactacgggaaggttcccacatctctttgtcccattagttgagatgacttgcagtagaaattgtccacaactcttctgacctctgggactactgcaacagtagccctattgcgagatggtattgaactggttgtagccagtgttggggacagccgggctattttgtgtagaaaaggaaaacccatgaagctgaccattgaccatactccaga

SEQ ID NO: 768 - DNA, 854 bp, Homo sapiens
ccttctaccaactgcagttttagatacgttttgaaaatttcatcacctgagggataagagttggtgtccttgttcttttttctttcctgggaattgttctagtactgagatttcctctttggcttgaagtttctggtcttcactctagcactaattgaaaaaaaaaaaatttgttttccgagaactgttactttcctccatattttcaaatttattaacagagaattgtacagagtgatttattttacaacaataaaattctatttgtgagacctagaggatcaagacataatgggagcatttttagacaagccaaagatggaaaagcataatgcccaggggcagggtaatgggttgcgatatgggctaagcagcatgcaaggctggcgtgttgaaatggaggatgcacatacggctgtgatcggtttgccaagtggacttgaatcgtggtcattctttgctgtgtatgatgggcatgctggttctcaggttgccaaatactgctgtgagcatttgttagatcacatcaccaataaccaggattttaaagggtctgcaggagcaccttctgtggaaaatgtaaagaatggaatcagaacaggttttctggagattgatgaacacatgagagttatgtcagagaagaaacatggtgcagatagaagtgggtcaacagctgtaggtgtcttaatttctccccaacatacttatttcattaactgtggagactcaagaggtttactttgtaggaacaggaaagttcatttcttcacacaagatcacaaaccaagtaatccgctggagaaagaacgaattcagaatgcaggtggctctgtaatgattcagcgtgtgaa

SEQ ID NO: 769 - DNA, 564 bp, Homo sapiens
cgcctgcggctgctccggtactttgttttgaaaagttcagatcaactgataatactagtgctgtgatgagactcagcttgtactcaagaacagatttatgactagcttatagttggctgcttcaccaggactctacaaattgctcagaacccaaggagacctagaggatcaagacataatgggagcatttttagacaagccaaagatggaaaagcataatgcccaggggcagggtaatgggttgcgatatgggctaagcagcatgcaaggctggcgtgttgaaatggaggatgcacatacggctgtgatcggtttgccaagtggacttgaatcgtggtcattctttgctgtgtatgatgggcatgctggttctcaggttgccaaatactgctgtgagcatttgttagatcacatcaccaataaccaggattttaaagggtctgcaggagcaccttctgtggaaaatgtaaagaatggaatcagaacaggttttctggagattgatgaacacatgagagttatgtcagagaagaaacatggtgcagatagaagtgggtcaacagc

SEQ ID NO: 770 - DNA, 1546 bp, Homo sapiens
attatgatgtaggggagggaggaaggagggccagggtagggggcacaccctctccctgaatgaaattcatttaggggcactgtctgctcgcatgttctgttctgggagaaaatgggtagcagaagctacaatttgtactaagctaatgaaaagagagaaaagaagaatggggaagagaagggcaaagaaggcaaaaagagaagagaagaaaaagggaggagagagaaggagaaatgagaaaagaggaaaccaaatgaagaggatgtgtgagagaaaaaaatatgaaacagtactttgttttgaaaagttcagatcaactgataatactagtgctgtgatgagactcagcttgtactcaagaacagatttatgactagacctagaggatcaagacataatgggagcatttttagacaagccaaagatggaaaagcataatgcccaggggcagggtaatgggttgcgatatgggctaagcagcatgcaaggctggcgtgttgaaatggaggatgcacatacggctgtgatcggtttgccaagtggacttgaatcgtggtcattctttgctgtgtatgatgggcatgctggttctcaggttgccaaatactgctgtgagcatttgttagatcacatcaccaataaccaggattttaaagggtctgcaggagcaccttctgtggaaaatgtaaagaatggaatcagaacaggttttctggagattgatgaacacatgagagttatgtcagagaagaaacatggtgcagatagaagtgggtcaacagctgtaggtgtcttaatttctccccaacatacttatttcattaactgtggagactcaagaggtttactttgtaggaacaggaaagttcatttcttcacacaagatcacaaaccaagtaatccgctggagaaagaacgaattcagaatgcaggtggctctgtaatgattcagcgtgtgaatggctctctggctgtatcgagggcccttggggattttgattacaaatgtgtccatggaaaaggtcctactgagcagcttgtctcaccagagcctgaagtccatgatattgaaagatctgaagaagatgatcagttcattatccttgcatgtgatggtatctgggatgttatgggaaatgaagagctctgtgattttgtaagatccagacttgaagtcactgatgaccttgagaaagtttgcaatgaagtagtcgacacctgtttgtataagggaagtcgagacaacatgagtgtgattttgatctgttttccaaatgcacccaaagtatcgccagaagcagtgaagaaggaggcagagttggacaagtacctggaatgcagagtagaagaaatcataaagaagcagggggaaggcgtccccgacttagtccatgtgatgcgcacattagcgagtgagaacatccccagcctcccaccagggggtgaattggcaagcaagaggaatgttattgaagccgtttacaatagactgaatccttacaaaaatgacgacactgactctacatcaacagatgatatgtggtaa

SEQ ID NO: 771 - DNA, 569 bp, Homo sapiens
ttatttgccaagagtttcagagctattaacagaagcctaatacatgttcttggactttgcagaaataatttgttgatccatgcggtttcattgctactgcggaaaacctagaggatcaagacataatgggagcatttttagacaagccaaagatggaaaagcataatgcccaggggcagggtaatgggttgcgatatgggctaagcagcatgcaaggctggcgtgttgaaatggaggatgcacatacggctgtgatcggtttgccaagtggacttgaatcgtggtcattctttgctgtgtatgatgggcatgctggttctcaggttgccaaatactgctgtgagcatttgttagatcacatcaccaataaccaggattttaaagggtctgcaggagcaccttctgtggaaaatgtaaagaatggaatcagaacaggttttctggagattgatgaacacatgagagttatgtcagagaagaaacatggtgcagatagaagtgggtcaacagctgtaggtgtcttaatttctccccaacatacttatttcattaactgtggagactcaaga

SEQ ID NO: 772 - DNA, 1634 bp, Homo sapiens
attactagtgcatgcgtgcatccggggaaaaggaacaaggtgggagaagagagagaaagcgaatacccgaggccgccagcatcagtgggtgcccgcgctctcctcctcgctctcgtcctctgccctccgccctggctccctgcccgcattccctgggagcgcagccttgccttagcctgggagacagctgtccacagtgacaggcggccattgttctcggccgagccagcaggcttccggccggtggcagctgctgctcctccgctctgcggccccaccaagggggcgccgccaccgcccaggccctccccgcctgatgggtctctgtccgtccacgcgggagacagcgccacctgccgtgctggatgcccaaagcctggcacagagtttctttaaccgcctttgggaagtcgccggccagtggcagaagcaggtgccattggctgcccgggcctcacagcggcagtggctggtctccatccacgccatccggaacactcgccgcaagatggaggaccggcacgtgtccctcccttccttcaaccagctcttcggcttgtctgaccctgtgaaccgcgcctactttgctgtgtttgatggtcacggaggcgtggatgctgcgaggtacgccgctgtccacgtgcacaccaacgctgcccgccagccagagctgcccacagaccctgagggagccctcagagaagccttccggcgcaccgaccagatgtttctcaggaaagccaagcgagagcggctgcagagcggcaccacaggtgtgtgtgcgctcattgcaggagcgaccctgcacgtcgcctggctcggggattcccaggtcattttggtacagcagggacaggtggtgaagctgatggagccacacagaccagaacggcaggatgagaaggcgcgcattgaagcattgggtggctttgtgtctcacatggactgctggagagtcaacgggaccctggccgtctccagagccatcggggatgtcttccagaagccctacgtgtctggggaggccgatgcagcttcccgggcgctgacgggctccgaggactacctgctgcttgcctgtgatggcttctttgacgtcgtaccccaccaggaagttgttggcctggtccagagccacctgaccaggcagcagggcagcgggctccgtgtcgccgaggagctggtggctgcggcccgggagcggggctcccacgacaacatcacggtcatggtggtcttcctcagggacccccaagagctgctggagggcgggaaccagggagaaggggacccccaggcagaagggaggaggcaggacttgccctccagccttccagaacctgagacccaggctccaccaagaagctaggtggtttccaggcccctgccctccccttcctcccatccttgtccttctctccctcagaagcctcaggacccaacaggtggcaggcagtggacagggtgcccgccccacagtgctttccccagcaccccagagccagtcgggacaccccccgcagcccgtcctggtggctgtggaactgcactgggtggcgggcagatggtggaaggcagcttaggagacctcaccaaagagaagatggaccggctcttgctcccagctcctatta

SEQ ID NO: 773 - DNA, 1988 bp, Homo sapiens
atgggtgcctacctctcccagcccaacacggtgaagtgctccggggacggggtcggcgtctccatggaggatgctcacaactgtattcctgagctggacagtgagacagccatgttttctgtctacgatggacatggaggggaggaagttgccttgtactgtgccaaatatcttcctgatatcatcaaagatcagaaggcctacaaggaaggcaagctacagaaggctttagaagatgccttcttggctattgacgccaaattgaccactgaagaagtcattaaagagctggcacagattgcagggcgacccactgaggatgaagatgaaaaagaaaaagtagctgatgaagatgatgtggacaatgaggaggctgcactgctgcatgaagaggctaccatgactattgaagagctgctgacacgctacgggcagaactgtcacaagggccctccccacagcaaatctggaggtgggacaggcgaggaaccagggtcccagggcctcaatggggaggcaggacctgaggactcaactagggaaactccttcacaagaaaatggccccacagccaaggcctacacaggcttttcctccaactcggaacgtgggactgaggcaggccaagttggtgagcctggcattcccactggtgaggctgggccttcctgctcttcagcctctgacaagctgcctcgagttgctaagtccaagttctttgaggacagtgaggatgagtcagatgaggcggaggaagaagaggaagacagtgaggaatgcagcgaggaagaggatggctacagcagtgaggaggcagagaatgaggaagatgaggatgacaccgaggaggctgaagaggacgatgaagaagaagaagaagagatgatggtgccagggatggaaggcaaagaggagcctggctctgacagtggtacaacagcggtggtggccctgatacgagggaagcagttgattgtagccaacgcaggagactctcgctgtgtggtatctgaggctggcaaagctttagacatgtcctatgatcacaaaccagaggatgaagtagaactagcacgcatcaagaatgctggtggcaaggtcaccatggatgggcgagtcaacgggggcctcaacctctccagagccattggggaccacttctataagagaaacaagaacctgccacctgaggaacagatgatttcagcccttcctgacatcaaggtgctgactctcactgacgaccatgaattcatggtcattgcctgtgatggcatctggaatgtgatgagcagccaggaagttgtagatttcattcaatcaaagatcagccagcgtgatgaaaatggggagcttcggttattgtcatccattgtggaagagctgctggatcagtgcctggcaccagacacttctggggatggtacagggtgtgacaacatgacctgcatcatcatttgcttcaagccccgaaacacagcagagctccagccagagagtggcaagcgaaaactagaggaggtgctctctactgagggggctgaagaaaatggcaacagcgacaagaagaagaaggccaagcgagactagcagtcatccagacccctgcccacctagactgttttctgagccctccggacctgagactgagttttgtctttttcctttagccttagcagtgggtatgaggtgtgcagggggagctgggtggcttcactccgcccattccaaagagggctctccctccacactgcagccgggagcctctgctgtccttcccagccgcctctgctcctcgggctcatcaccggttctgtgcctgtgctctgttgtgttggagggaaggactggcggttctggtttttactctgtgaactttatttaaggacattcttttttattggcggctccatggccctcggccgcttgcacccgctctctgttgtacactttcaatcaacactttttcagactaaaggccaaaacct

SEQ ID NO: 774 - DNA, 1751 bp, Homo sapiens
gtgcgcaggcgcaactgcctggctctgctcgctccggcgctccggcccagctctcgcggacaagtccagacatcgcgcgcccccccttctccgggtccgccccctcccccttctcggcgtcgtcgaagataaacaatagttggccggcgagcgcctagtgtgtctcccgccgccggattcggcgggctgcgtgggaccggcgggatcccggccagccggccatggcggggctgtactcgctgggagtgagcgtcttctccgaccagggcgggaggcggcacagtttgcccgggagcacttgtggggtttcatcaagaagcagaagggtttcacctcgtccgagccggctaaggtttgcgctgccatccgcaaaggctttctcgcttgtcaccttgccatgtggaagaaactggcggaatggccaaagactatgacgggtcttcctagcacatcagggacaactgccagtgtggtcatcattcggggcatgaagatgtatgtagctcacgtaggtgactcaggggtggttcttggaattcaggatgacccgaaggatgactttgtcagagctgtggaggtgacacaggaccataagccagaacttcccaaggaaagagaacgaatcgaaggacttggtgggagtgtaatgaacaagtctggggtgaatcgtgtagtttggaaacgacctcgactcactcacaatggacctgttagaaggagcacagttattgaccagattccttttctggcagtagcaagagcacttggtgatttgtggagctatgatttcttcagtggtgaatttgtggtgtcacctgaaccagacacaagtgtccacactcttgaccctcagaagcacaagtatattatattggggagtgatggactttggaatatgattccaccacaagatgccatctcaatgtgccaggaccaagaggagaaaaaatacctgatgggtgagcatggacaatcttgtgccaaaatgcttgtgaatcgagcattgggccgctggaggcagcgtatgctccgagcagataacactagtgccatagtaatctgcatctctccagaagtggacaatcagggaaactttaccaatgaagatgagttatacctgaacctgactgacagcccttcctataatagtcaagaaacctgtgtgatgactccttccccatgttctacaccaccagtcaaggattttggatttgaactcgattcaagaaagtgatgtaacttattatcagagagccatctttacatcaatactaatctgaatgccagccatgtgtacagcactaataaaaagtcactggaggaggatccatggccaagggtgaattctaaggaccatatacctgccctggttcgtagcaatgccttctcagagaattttttagaggtttcagctgagatagctcgagagaatgtccaaggtgtagtcataccctcaaaagatccagaaccacttgaagaaaattgcgctaaagccctgactttaaggatacatgattctttgaataatagccttccaattggccttgtgcctactaattcaacaaacactgtcatggaccaaaaaaatttgaagatgtcaactcctggccaaatgaaagcccaagaaattgaaagaacccctccaacaaactttaaaaggacattagaagagtccaattctggccccctgatgaagaagcatagacgaaatggcttaagtcgaagtagtggtgctcagcctgcaagtctcc

SEQ ID NO: 775 - DNA, 1347 bp, Homo sapiens
gaggcgattgcgattgggtgagacccagtaaggatggaaagtgtagaggagacaggaatccacggctttggaaaaaggaaggacaaaactcaccaaaccagagcagggcaggaagtaacaatgagaaactgaaaaagaaacggaatggaaagctatgagacaggatgaaatttggcatggggtctgcccaggcatgtccatgccaggtgcccagggctgcttccacgacgtgggtcccctgccagatttgtgagacaagaggagcagcagcggcaccgcccctcaccctggagggtcctgtacaatctcatcatgggactcctgcccttacccaggggccacagagcccccgagatggagcccaattaggtgcctgcacccgcccggtggacgtcagggactcggggggcaggcccctcccacctcctgacaccctggccagcgcgggggactttctctgcaccatgtagcatactggactcccagccctgcctgtcccgggggcgggccggggcagccactccagccccagcccagcctggggtgcactgacggagatgcggactcctgggtccctggccaagaagccaggagagggacggctgatggactcagcatcggaaggtggcggtgaccgagggggtggggactgagccgcccgcctctgccgcccaccaccatctcaggaaaggctgttgtgctggtgcccgttccagctgcaggggtgacactgggaggggggggctctcctctcggtgctccttcactctgggcctggcctcaggcccctggtgcttccccccctcctcctgggagggggcccgtgaagagcaaatgagccaaacgtgaccactagcctcctggagccagagagtggggctcgtttgccggttgctccagcccggcgcccagccatcttccctgagccagccggcgggtggtgggcatgcctgcctcaccttcatcagggggtggccaggaggggcccagactgtgaatcctgtgctctgcccgtgaccgccccccgccccatcaatcccattgcataggtttagagagagcacgtgtgaccactggcattcatttggggggtgggagattttggctgaagccgccccagccttagtccccagggccaagcgctggggggaagacggggagtcagggagggggggaaatctcggaagagggaggagtctgggagtggggagggatggcccagcctgtaagatactgtatatgcgctgctgtagataccggaatgaattttctgtacatgtttggttaattttttttgtacatgatttttgtatgtttccttttcaataaaatcagattggaacagtg

SEQ ID NO: 776 - DNA, 1538 bp, Homo sapiens
gaggcgattgcgattgggtgagacccagtaaggatggaaagtgtagaggagacaggaatccacggctttggaaaaaggaaggacaaaactcaccaaaccagagcagggcaggaagtaacaatgagaaactgaaaaagaaacggaatggaaagctatgagacaggatgaaatttggcatggggtctgcccaggcatgtccatgccaggtgcccagggctgcttccacgacgtgggtcccctgccagatttgtggtcctcagccctcgctctcgctggcggagcagcacctggagtcgcccgtgcccagcgccccgggggctctggcgggcggtcccacccaggcggccccgggagtccgcggggaggaggaacagtgggcccgggagatcggggcccagctgcggcggatggcggacgacctcaacgcacagtacgagcggcggagacaagaggagcagcagcggcaccgcccctcaccctggagggtcctgtacaatctcatcatgggactcctgcccttacccaggggccacagagcccccgagatggagcccaattaggtgcctgcacccgcccggtggacgtcagggactcggggggcaggcccctcccacctcctgacaccctggccagcgcgggggactttctctgcaccatgtagcatactggactcccagccctgcctgtcccgggggcgggccggggcagccactccagccccagcccagcctggggtgcactgacggagatgcggactcctgggtccctggccaagaagccaggagagggacggctgatggactcagcatcggaaggtggcggtgaccgagggggtggggactgagccgcccgcctctgccgcccaccaccatctcaggaaaggctgttgtgctggtgcccgttccagctgcaggggtgacactgggaggggggggctctcctctcggtgctccttcactctgggcctggcctcaggcccctggtgcttccccccctcctcctgggagggggcccgtgaagagcaaatgagccaaacgtgaccactagcctcctggagccagagagtggggctcgtttgccggttgctccagcccggcgcccagccatcttccctgagccagccggcgggtggtgggcatgcctgcctcaccttcatcagggggtggccaggaggggcccagactgtgaatcctgtgctctgcccgtgaccgccccccgccccatcaatcccattgcataggtttagagagagcacgtgtgaccactggcattcatttggggggtgggagattttggctgaagccgccccagccttagtccccagggccaagcgctggggggaagacggggagtcagggagggggggaaatctcggaagagggaggagtctgggagtggggagggatggcccagcctgtaagatactgtatatgcgctgctgtagataccggaatgaattttctgtacatgtttggttaattttttttgtacatgatttttgtatgtttccttttcaataaaatcagattggaacagtg

SEQ ID NO: 777 - DNA, 1843 bp, Homo sapiens
gcggcgcgagccacatgcgagcgggcgcctggcggcggcggcggcggcaccagcgatcccagcagcggccacgacgcggacgcgcctgcggcccggggagcagcagcagccacagccacagcagccgccactgcagttagagcggcagcagcagcgacagccacagcagcagccgccgcggagagcggcgctcggcgggcgcgccctcctgaaggaagccgcccgccccccaccgccgccccctccggcgtgttcatgcccccggggccccagggagcgccatggcccgcgcacgccaggagggcagctccccggagcccgtagagggcctggcccgcgacggcccgcgccccttcccgctcggccgcctggtgccctcggcagtgtcctgcggcctctgcgagcccggcctggctgccgcccccgccgcccccaccctgctgcccgctgcctacctctgcgcccccaccgccccacccgccgtcaccgccgccctggggggttcccgctggcctgggggtccccgcagccggccccgaggcccgcgcccggacggtcctcagccctcgctctcgctggcggagcagcacctggagtcgcccgtgcccagcgccccgggggctctggcgggcggtcccacccaggcggccccgggagtccgcggggaggaggaacagtgggcccgggagatcggggcccagctgcggcggatggcggacgacctcaacgcacagtacgagcggcggagacaagaggagcagcagcggcaccgcccctcaccctggagggtcctgtacaatctcatcatgggactcctgcccttacccaggggccacagagcccccgagatggagcccaattaggtgcctgcacccgcccggtggacgtcagggactcggggggcaggcccctcccacctcctgacaccctggccagcgcgggggactttctctgcaccatgtagcatactggactcccagccctgcctgtcccgggggcgggccggggcagccactccagccccagcccagcctggggtgcactgacggagatgcggactcctgggtccctggccaagaagccaggagagggacggctgatggactcagcatcggaaggtggcggtgaccgagggggtggggactgagccgcccgcctctgccgcccaccaccatctcaggaaaggctgttgtgctggtgcccgttccagctgcaggggtgacactgggaggggggggctctcctctcggtgctccttcactctgggcctggcctcaggcccctggtgcttccccccctcctcctgggagggggcccgtgaagagcaaatgagccaaacgtgaccactagcctcctggagccagagagtggggctcgtttgccggttgctccagcccggcgcccagccatcttccctgagccagccggcgggtggtgggcatgcctgcctcaccttcatcagggggtggccaggaggggcccagactgtgaatcctgtgctctgcccgtgaccgccccccgccccatcaatcccattgcataggtttagagagagcacgtgtgaccactggcattcatttggggggtgggagattttggctgaagccgccccagccttagtccccagggccaagcgctggggggaagacggggagtcagggagggggggaaatctcggaagagggaggagtctgggagtggggagggatggcccagcctgtaagatactgtatatgcgctgctgtagataccggaatgaattttctgtacatgtttggttaattttttttgtacatgatttttgtatgtttccttttcaataaaatcagattggaacagtgga

SEQ ID NO: 778 - DNA, 1827 bp, Homo sapiens
gaggcgattgcgattgggtgagacccagtaaggatggaaagtgtagaggagacaggaatccacggctttggaaaaaggaaggacaaaactcaccaaaccagagcagggcaggaagtaacaatgagaaactgaaaaagaaacggaatggaaagctatgagacaggatgaaatttggcatggggtctgcccaggcatgtccatgccaggtgcccagggctgcttccacgacgtgggtcccctgccagatttgtggccccagggagcgccatggcccgcgcacgccaggagggcagctccccggagcccgtagagggcctggcccgcgacggcccgcgccccttcccgctcggccgcctggtgccctcggcagtgtcctgcggcctctgcgagcccggcctggctgccgcccccgccgcccccaccctgctgcccgctgcctacctctgcgcccccaccgccccacccgccgtcaccgccgccctggggggttcccgctggcctgggggtccccgcagccggccccgaggcccgcgcccggacggtcctcagccctcgctctcgctggcggagcagcacctggagtcgcccgtgcccagcgccccgggggctctggcgggcggtcccacccaggcggccccgggagtccgcggggaggaggaacagtgggcccgggagatcggggcccagctgcggcggatggcggacgacctcaacgcacagtacgagcggcggagacaagaggagcagcagcggcaccgcccctcaccctggagggtcctgtacaatctcatcatgggactcctgcccttacccaggggccacagagcccccgagatggagcccaattaggtgcctgcacccgcccggtggacgtcagggactcggggggcaggcccctcccacctcctgacaccctggccagcgcgggggactttctctgcaccatgtagcatactggactcccagccctgcctgtcccgggggcgggccggggcagccactccagccccagcccagcctggggtgcactgacggagatgcggactcctgggtccctggccaagaagccaggagagggacggctgatggactcagcatcggaaggtggcggtgaccgagggggtggggactgagccgcccgcctctgccgcccaccaccatctcaggaaaggctgttgtgctggtgcccgttccagctgcaggggtgacactgggaggggggggctctcctctcggtgctccttcactctgggcctggcctcaggcccctggtgcttccccccctcctcctgggagggggcccgtgaagagcaaatgagccaaacgtgaccactagcctcctggagccagagagtggggctcgtttgccggttgctccagcccggcgcccagccatcttccctgagccagccggcgggtggtgggcatgcctgcctcaccttcatcagggggtggccaggaggggcccagactgtgaatcctgtgctctgcccgtgaccgccccccgccccatcaatcccattgcataggtttagagagagcacgtgtgaccactggcattcatttggggggtgggagattttggctgaagccgccccagccttagtccccagggccaagcgctggggggaagacggggagtcagggagggggggaaatctcggaagagggaggagtctgggagtggggagggatggcccagcctgtaagatactgtatatgcgctgctgtagataccggaatgaattttctgtacatgtttggttaattttttttgtacatgatttttgtatgtttccttttcaataaaatcagattggaacagtg

SEQ ID NO: 779 - DNA, 1169 bp, Homo sapiens
gccattaacaaagatggtgcttatggggcaggttccctaacagtcaggattccggttgcagtttttctcccccgccccaaagatacgtggttgcagacggagaaatggaggccagagacaaacaagtactccgctcacttcgcctggagctgggtgcagaggtattggtggagggactggttcttcagtacctctaccaggaaggaatcttgacggaaaaccatattcaagaaatcaatgctcaaaccacaggcctccggaaaacaatgctcctgctggatatcctaccttccaggggccctaaagcatttgatacattcctagattccctacaggagtttccctgggtcagggagaagctgaagaaggcaagggaagaggccatgaccgacctgcctgcaggtgacagattgactgggatcccctcgcacatcctcaacagctccccatcagaccggcagattaaccagctggcccagaggctgggccctgagtgggagcccatggtgctgtctctgggactgtcccagacggatatctaccgctgtaaggccaaccacccccacaacgtgcagtcgcaggtggtggaggccttcatccgttggcggcagcgcttcgggaagcaggccaccttccagagcctgcacaacgggctgcgggctgtggaggtggacccctcgctgctcctgcacatgttggagtgatggtgcctccagcaaccgctggggagtgtgtccctgagtcatgtgggctgaatcctgactttcactcagagcaggtggttttttgtgtaggtttgttttttatttttgatgatcttcagatggaaggagaaaacagggtttccactagacattacttgaaaggccagattactcagcagatctcccatgttggctcaacaattctttgtttttaattgcttgaagattgcattgttgtaattgttcagtttttaaatgtgtaatggcattttaatagactagtaaatcacagtggttcaaaatatatatccatatatatatatatccatatatatatctcatgtcatcacattacaggcaggtgtctcatatgtaaaacatttacctgaatgttgtctgaggactgaactgtggactttactattcataatgataaaataataaaatgcgaattactatatataa

SEQ ID NO: 780 - DNA, 366 bp, Homo sapiens
atggaggccagagacaaacaagtactccgctcacttcgcctggagctgggtgcagaggtattggtggagggactggttcttcagtacctctaccaggaaggaatcttgacggaaaaccatattcaagaaatcaatgctcaaaccacaggcctccggaaaacaatgctcctgctggatatcctaccttccaggggccctaaagcatttgatacattcctagattccctacaggagtttccctgggtcagggagaagctgaagaaggcaagggaagaggccatgaccgacctgcctgcagagatgaggaaactgaggccaaaggattctgttacttgcctggcttcacagctcacctggagattctga

SEQ ID NO: 781 - DNA, 1403 bp, Homo sapiens
aagggtttcagcggccgaagcagagcctttttaaatagttcccaatgggcgctcacggccaaacgtgaacacctcccctcctcacctgtcacctcctgaactttacagggttgcgagggggagtgtgggatcgggtgtcgcctagccgtggtcgtactgcccgggtgtgtctgaagccccatctgtcatccctgcctgccttcccggtcacttaaccttcactgccttacacacaaccaagccacagcacactggtgcaggggtggtggaactgcaccttcaaatcgtgcctggctactgaccagtgctgggggagaaatggaggccagagacaaacaagtactccgctcacttcgcctggagctgggtgcagaggtattggtggagggactggttcttcagtacctctaccaggaaggaatcttgacggaaaaccatattcaagaaatcaatgctcaaaccacaggcctccggaaaacaatgctcctgctggatatcctaccttccaggggccctaaagcatttgatacattcctagattccctacaggagtttccctgggtcagggagaagctgaagaaggcaagggaagaggccatgaccgacctgcctgcaggtgacagattgactgggatcccctcgcacatcctcaacagctccccatcagaccggcagattaaccagctggcccagaggctgggccctgagtgggagcccatggtgctgtctctgggactgtcccagacggatatctaccgctgtaaggccaaccacccccacaacgtgcagtcgcaggtggtggaggccttcatccgttggcggcagcgcttcgggaagcaggccaccttccagagcctgcacaacgggctgcgggctgtggaggtggacccctcgctgctcctgcacatgttggagtgatggtgcctccagcaaccgctggggagtgtgtccctgagtcatgtgggctgaatcctgactttcactcagagcaggtggttttttgtgtaggtttgttttttatttttgatgatcttcagatggaaggagaaaacagggtttccactagacattacttgaaaggccagattactcagcagatctcccatgttggctcaacaattctttgtttttaattgcttgaagattgcattgttgtaattgttcagtttttaaatgtgtaatggcattttaatagactagtaaatcacagtggttcaaaatatatatccatatatatatatatccatatatatatctcatgtcatcacattacaggcaggtgtctcatatgtaaaacatttacctgaatgttgtctgaggactgaactgtggactttactattcataatgataaaataataaaatgcgaattactatatataatgtgcctcactcatgagaaa

SEQ ID NO: 782 - DNA, 1293 bp, Homo sapiens
ggggcaggttccctaacagtcaggattccggttgcagtttttctcccccgccccaaagatacgtggttgcagacggagaaatggaggccagagacaaacaagtactccgctcacttcgcctggagctgggtgcagaggtattggtggagggactggttcttcagtacctctaccaggaaggaatcttgacggaaaaccatattcaagaaatcaatgctcaaaccacaggcctccggaaaacaatgctcctgctggatatcctaccttccaggggccctaaagcatttgatacattcctagattccctacaggagtttccctgggtcagggagaagctgaagaaggcaagggaagaggccatgaccgacctgcctgcagggtgttggccatgatccttatgatggggaggaagggaatcaccaattttctaccccatcccactgagcaacttagagatgacctaaggcctcgttacctgtgtggagtaactgggaattggaagagatgaggaaactgaggccaaaggattctgttacttgcctggcttcacagctcacctggagattctgaactggcatcttcctctctctgccatcaccccagaccctaccctctttcctctacaccagtggttctcaatcaagggcgattttgccttccaggggacatttgacaatgtctggaggcgtttttggttgtcacaattctgtgtatgtgtgtgggtgggcggggggcaggggattatgttggcatctagtgagtagataacagagatgctgctaaacctacaatgctcagatggcccctaacaaagaagtatgttgtccaaaatgtcaatggtgcagagggtgagaagccctggtctatacagagctcagcagtccagagcaattgcaacctctgggagttgccaagagctcctctgcccagcaacaggcttggcctctctcctgtggctgccacaagagttaaagccactgtctggaatgccctttggcagtggccaagtgtcccctgcagaactgactgcgggacatgcggtgcatcagccggagctgatgtgttttgtaatttatagtcacagggcgcctgtcttcatttagcagtaggcctgctggcagcttccctgccagggaggaagcaagttccacagaggcccacagcccccgccagctgccggcccgtggtatttggggacggctgttgctcagagacacctgggaataggccggggccgagatggcgctgagcactcggtctccccttcagacccatccatcagcagcggtccct

SEQ ID NO: 783 - DNA, 4521 bp, Homo sapiens
ccgctgaggccgcggcgcccgccagcctgtcccgcgccatggccccgcgcgcccggcggcgccgcccgctgttcgcgctgctgctgctctgcgcgctgctcgcccggctgcaggtggctttgcagatcgctcctccatgtaccagtgagaagcattatgagcatctgggacggtgctgtaacaaatgtgaaccaggaaagtacatgtcttctaaatgcactactacctctgacagtgtatgtctgccctgtggcccggatgaatacttggatagctggaatgaagaagataaatgcttgctgcataaagtttgtgatacaggcaaggccctggtggccgtggtcgccggcaacagcacgaccccccggcgctgcgcgtgcacggctgggtaccactggagccaggactgcgagtgctgccgccgcaacaccgagtgcgcgccgggcctgggcgcccagcacccgttgcagctcaacaaggacacagtgtgcaaaccttgccttgcaggctacttctctgatgccttttcctccacggacaaatgcagaccctggaccaactgtaccttccttggaaagagagtagaacatcatgggacagagaaatccgatgcggtttgcagttcttctctgccagctagaaaaccaccaaatgaaccccatgtttacttgcccggtttaataattctgcttctcttcgcgtctgtggccctggtggctgccatcatctttggcgtttgctataggaaaaaagggaaagcactcacagctaatttgtggcactggatcaatgaggcttgtggccgcctaagtggagataaggagtcctcaggtgacagttgtgtcagtacacacacggcaaactttggtcagcagggagcatgtgaaggtgtcttactgctgactctggaggagaagacatttccagaagatatgtgctacccagatcaaggtggtgtctgtcagggcacatgtgtaggaggtggtccctacgcacaaggcgaagatgccaggatgctctcattggtcagcaagaccgagatagaggaagacagcttcagacagatgcccacagaagatgaatacatggacaggccctcccagcccacagaccagttactgttcctcactgagcctggaagcaaatccacacctcctttctctgaacccctggaggtgggggagaatgacagtttaagccagtgcttcacggggacacagagcacagtgggttcagaaagctgcaactgcactgagcccctgtgcaggactgattggactcccatgtcctctgaaaactacttgcaaaaagaggtggacagtggccattgcccgcactgggcagccagccccagccccaactgggcagatgtctgcacaggctgccggaaccctcctggggaggactgtgaacccctcgtgggttccccaaaacgtggacccttgccccagtgcgcctatggcatgggccttccccctgaagaagaagccagcaggacggaggccagagaccagcccgaggatggggctgatgggaggctcccaagctcagcgagggcaggtgccgggtctggaagctcccctggtggccagtcccctgcatctggaaatgtgactggaaacagtaactccacgttcatctccagcgggcaggtgatgaacttcaagggcgacatcatcgtggtctacgtcagccagacctcgcaggagggcgcggcggcggctgcggagcccatgggccgcccggtgcaggaggagaccctggcgcgccgagactccttcgcggggaacggcccgcgcttcccggacccgtgcggcggccccgaggggctgcgggagccggagaaggcctcgaggccggtgcaggagcaaggcggggccaaggcttgagcgccccccatggctgggagcccgaagctcggagccagggctcgcgagggcagcaccgcagcctctgccccagccccggccacccagggatcgatcggtacagtcgaggaagaccacccggcattctctgcccactttgccttccaggaaatgggcttttcaggaagtgaattgatgaggactgtccccatgcccacggatgctcagcagcccgccgcactggggcagatgtctcccctgccactcctcaaactcgcagcagtaatttgtggcactatgacagctatttttatgactatcctgttctgtgggggggggggtctgttttccccccatatttgtattccttttcataacttttcttgatatctttcctccctcttttttaatgtaaaggttttctcaaaaattctcctaaaggtgagggtctctttcttttctcttttccttttttttttctttttttggcaacctggctctggcccaggctagagtgcagtggtgcgattatagcccggtgcagcctctaactcctgggctcaagcaatccaagtgatcctcccacctcaaccttcggagtagctgggatcacagctgcaggccacgcccagcttcctccccccgactccccccccagagacacggtcccaccatgttacccagcctggtctcaaactccccagctaaagcagtcctccagcctcggcctcccaaagtactgggattacaggcgtgagcccccacgctggcctgctttacgtattttcttttgtgcccctgctcacagtgttttagagatggctttcccagtgtgtgttcattgtaaacacttttgggaaagggctaaacatgtgaggcctggagatagttgctaagttgctaggaacatgtggtgggactttcatattctgaaaaatgttctatattctcatttttctaaaagaaagaaaaaaggaaacccgatttatttctcctgaatctttttaagtttgtgtcgttccttaagcagaactaagctcagtatgtgaccttacccgctaggtggttaatttatccatgctggcagaggcactcaggtacttggtaagcaaatttctaaaactccaagttgctgcagcttggcattcttcttattctagaggtctctctggaaaagatggagaaaatgaacaggacatggggctcctggaaagaaagggcccgggaagttcaaggaagaataaagttgaaattttaatttgcattttttttgtctagataagaatagcgtgaatagatcctcttttattcgtaaataatcgtgcatctgtgggttagccttgtagaagtggaaaacattccattttccaatgcatttaaatgtaaagccaaatctgcatgttgtgaatttaagaaaacttattatcctaaaggtgcctttctcttggcatcatcccgcttgtgagaagcctagaggacgctccaggtggaaggaaatcccctgggtggttttatcttttgttacccagtgagcactggttccccgcaaatactggggaaaagcaaaaatacacaagcaagttaaaattaattttgcacatctgggaggttataaaagaaagcactaatagtagtcactgcccagactttactggccacaaatgcccagctgaagagcatgactgtggatcactggtttttccctcctgctggaaatgctggggtggtagcggtcgattaggattttcagtggagaagcacaggacagttctgtaatttatgggactccttagccaacataaagaactgcaggaaataactgcacagccaggaggatccgttggtgggaatttaccgtcattcctgcccttttatttaacatcatccacagagagatgttatacaaatggaggaaaccattataccttttgatatggaatatattacagagttacagttcacaaagtagaatgctgagctgaaaacccgagtttctgctgtgactgtcatctcactgagcacttcgcttttctttgcttttattttttccttctataaaaaggcaataatgataatttataatagtttccctacccagagatattagaagtatgctacagtgaatgttaaagtaccttgagatccttaaatcaaaggtgctatatacataagtaagactctactttcagaaaaaggtaatattatttcctgcactgatccctactaattctatattgatccaaaggcaactcaatgctaaaaaatgtatagaaaatataagtctgtgtctgtgtactgtagagatgtatgtgacaagtgtaaacaaaatgaactgaagcagtaatgaacagttattagggggaacatgataaagagattatattaagcttatgtttcaccataaaatcctttttatggcttactaaaaccgagctcactgtaaaatcatgatccaacttattgctaatctttatgatatgcttattcctaatctttatggtatggtgtcaaccgttcatttgtatcttattgctcattccctggaccacagactagggacagaaaatacttgctttaataatatatatgctgttgatttcacaaaaatttattaaaatacagcctgggtacccagtgaaagagctgaaatgga

SEQ ID NO: 784 - DNA, 3591 bp, Homo sapiens
ggcagccgcgcccgctgggccacagaggccgctgaggccgcggcgcccgccagcctgtcccgcgccatggccccgcgcgcccggcggcgccgcccgctgttcgcgctgctgctgctctgcgcgctgctcgcccggctgcaggtggctttgcagatcgctcctccatgtaccagtgagaagcattatgagcatctgggacggtgctgtaacaaatgtgaaccaggaaagtacatgtcttctaaatgcactactacctctgacagtgtatgtctgccctgtggcccggatgaatacttggatagctggaatgaagaagataaatgcttgctgcataaagtttgtgatacaggcaaggccctggtggccgtggtcgccggcaacagcacgaccccccggcgctgcgcgtgcacggctgggtaccactggagccaggactgcgagtgctgccgccgcaacaccgagtgcgcgccgggcctgggcgcccagcacccgttgcagctcaacaaggacacagtgtgcaaaccttgccttgcaggctacttctctgatgccttttcctccacggacaaatgcagaccctggaccaactgtaccttccttggaaagagagtagaacatcatgggacagagaaatccgatgcggtttgcagttcttctctgccagctagaaaaccaccaaatggaaatgtgactggaaacagtaactccacgttcatctccagcgggcaggtgatgaacttcaagggcgacatcatcgtggtctacgtcagccagacctcgcaggagggcgcggcggcggctgcggagcccatgggccgcccggtgcaggaggagaccctggcgcgccgagactccttcgcggggaacggcccgcgcttcccggacccgtgcggcggccccgaggggctgcgggagccggagaaggcctcgaggccggtgcaggagcaaggcggggccaaggcttgagcgccccccatggctgggagcccgaagctcggagccagggctcgcgagggcagcaccgcagcctctgccccagccccggccacccagggatcgatcggtacagtcgaggaagaccacccggcattctctgcccactttgccttccaggaaatgggcttttcaggaagtgaattgatgaggactgtccccatgcccacggatgctcagcagcccgccgcactggggcagatgtctcccctgccactcctcaaactcgcagcagtaatttgtggcactatgacagctatttttatgactatcctgttctgtgggggggggggtctgttttccccccatatttgtattccttttcataacttttcttgatatctttcctccctcttttttaatgtaaaggttttctcaaaaattctcctaaaggtgagggtctctttcttttctcttttccttttttttttctttttttggcaacctggctctggcccaggctagagtgcagtggtgcgattatagcccggtgcagcctctaactcctgggctcaagcaatccaagtgatcctcccacctcaaccttcggagtagctgggatcacagctgcaggccacgcccagcttcctccccccgactccccccccagagacacggtcccaccatgttacccagcctggtctcaaactccccagctaaagcagtcctccagcctcggcctcccaaagtactgggattacaggcgtgagcccccacgctggcctgctttacgtattttcttttgtgcccctgctcacagtgttttagagatggctttcccagtgtgtgttcattgtaaacacttttgggaaagggctaaacatgtgaggcctggagatagttgctaagttgctaggaacatgtggtgggactttcatattctgaaaaatgttctatattctcatttttctaaaagaaagaaaaaaggaaacccgatttatttctcctgaatctttttaagtttgtgtcgttccttaagcagaactaagctcagtatgtgaccttacccgctaggtggttaatttatccatgctggcagaggcactcaggtacttggtaagcaaatttctaaaactccaagttgctgcagcttggcattcttcttattctagaggtctctctggaaaagatggagaaaatgaacaggacatggggctcctggaaagaaagggcccgggaagttcaaggaagaataaagttgaaattttaatttgcattttttttgtctagataagaatagcgtgaatagatcctcttttattcgtaaataatcgtgcatctgtgggttagccttgtagaagtggaaaacattccattttccaatgcatttaaatgtaaagccaaatctgcatgttgtgaatttaagaaaacttattatcctaaaggtgcctttctcttggcatcatcccgcttgtgagaagcctagaggacgctccaggtggaaggaaatcccctgggtggttttatcttttgttacccagtgagcactggttccccgcaaatactggggaaaagcaaaaatacacaagcaagttaaaattaattttgcacatctgggaggttataaaagaaagcactaatagtagtcactgcccagactttactggccacaaatgcccagctgaagagcatgactgtggatcactggtttttccctcctgctggaaatgctggggtggtagcggtcgattaggattttcagtggagaagcacaggacagttctgtaatttatgggactccttagccaacataaagaactgcaggaaataactgcacagccaggaggatccgttggtgggaatttaccgtcattcctgcccttttatttaacatcatccacagagagatgttatacaaatggaggaaaccattataccttttgatatggaatatattacagagttacagttcacaaagtagaatgctgagctgaaaacccgagtttctgctgtgactgtcatctcactgagcacttcgcttttctttgcttttattttttccttctataaaaaggcaataatgataatttataatagtttccctacccagagatattagaagtatgctacagtgaatgttaaagtaccttgagatccttaaatcaaaggtgctatatacataagtaagactctactttcagaaaaaggtaatattatttcctgcactgatccctactaattctatattgatccaaaggcaactcaatgctaaaaaatgtatagaaaatataagtctgtgtctgtgtactgtagagatgtatgtgacaagtgtaaacaaaatgaactgaagcagtaatgaacagttattagggggaacatgataaagagattatattaagcttatgtttcaccataaaatcctttttatggcttactaaaaccgagctcactgtaaaatcatgatccaacttattgctaatctttatgatatgcttattcctaatctttatggtatggtgtcaaccgttcatttgtatcttattgctcattccctggaccacagactagggacagaaaatacttgctttaataatatatatgctgttgatttcacaaaaatttattaaaatacagcctgggtacccagtgaaagagctg

SEQ ID NO: 785 - DNA, 2195 bp, Homo sapiens
cccgctcgcccgcgcgccccaggacccaaagccgggctccaagtcggcgccccacgtcgaggctccgccgcagcctccggagttggccgcagacaagaaggggagggagcgggagagggaggagagctccgaagcgagagggccgagcgccatgcgccgcgccagcagagactacaccaagtacctgcgtggctcggaggagatgggcggcggccccggagccccgcacgagggccccctgcacgccccgccgccgcctgcgccgcaccagccccctgccgcctcccgctccatgttcgtggccctcctggggctggggctgggccaggttgtctgcagcgtcgccctgttcttctatttcagagcgcagatggatcctaatagaatatcagaagatggcactcactgcatttatagaattttgagactccatgaaaatgcagattttcaagacacaactctggagagtcaagatacaaaattaatacctgattcatgtaggagaattaaacaggcctttcaaggagctgtgcaaaaggaattacaacatatcgttggatcacagcacatcagagcagagaaagcgatggtggatggctcatggttagatctggccaagaggagcaagcttgaagctcagccttttgctcatctcactattaatgccaccgacatcccatctggttcccataaagtgagtctgtcctcttggtaccatgatcggggttgggccaagatctccaacatgacttttagcaatggaaaactaatagttaatcaggatggcttttattacctgtatgccaacatttgctttcgacatcatgaaacttcaggagacctagctacagagtatcttcaactaatggtgtacgtcactaaaaccagcatcaaaatcccaagttctcataccctgatgaaaggaggaagcaccaagtattggtcagggaattctgaattccatttttattccataaacgttggtggattttttaagttacggtctggagaggaaatcagcatcgaggtctccaacccctccttactggatccggatcaggatgcaacatactttggggcttttaaagttcgagatatagattgagccccagtttttggagtgttatgtatttcctggatgtttggaaacattttttaaaacaagccaagaaagatgtatataggtgtgtgagactactaagaggcatggccccaacggtacacgactcagtatccatgctcttgaccttgtagagaacacgcgtatttacagccagtgggagatgttagactcatggtgtgttacacaatggtttttaaattttgtaatgaattcctagaattaaaccagattggagcaattacggggtgaccttatgagaaactgcatgtgggctatgggaggggttggtccctggtcatgtgccccttcgcagctgaagtggagagggtgtcatctagcgcaattgaaggatcatctgaaggggcaaattcttttgaattgttacatcatgctggaacctgcaaaaaatactttttctaatgaggagagaaaatatatgtatttttatataatatctaaagttatatttcagatgtaatgttttctttgcaaagtattgtaaattatatttgtgctatagtatttgattcaaaatatttaaaaatgtcttgctgttgacatatttaatgttttaaatgtacagacatatttaactggtgcactttgtaaattccctggggaaaacttgcagctaaggaggggaaaaaaatgttgtttcctaatatcaaatgcagtatatttcttcgttctttttaagttaatagattttttcagacttgtcaagcctgtgcaaaaaaattaaaatggatgccttgaataataagcaggatgttggccaccaggtgcctttcaaatttagaaactaattgactttagaaagctgacattgccaaaaaggatacataatgggccactgaaatctgtcaagagtagttatataattgttgaacaggtgtttttccacaagtgccgcaaattgtaccttttttgttttttcaaaatagaaaagttattagtggtttatcagcaaaaaagtccaattttaatttagtaaatgttatcttatactgtacaataaaaacattgcctttgaatgttaattttttggtacaaaaataaatttatatgaaaa

SEQ ID NO: 786 - DNA, 1520 bp, Homo sapiens
ctgaaagcaaatggtgtggccgaagctgcctctctggtggcatagctaagaccaagctgcacgcagtgaaaacacagtttgttttcactgacaacaaggcagaatgtgtaccagggatgtgacgtggggaaccaggaagaggacagtctgaggatcattattaaagggactccatccaagaaggtttccagccagaggcaagctgtagccagaagaaaagaatgagagatcacctgaataatagaacagaaactgctgaaatattgaacacagatctagatcaaatgaaggaacatattcaggatgaagcataaataaaggccaggcgtggtggctcatgcctggaatctcagctctttgggaggccgaggctattctccatctcctgggctccagtgatcctcacgcctcggccacccaaagtgctgggattatagaagtgaaccactgcgcctggcctattgaaggtttttaatcttcagagtttcgactttatcaacaacacttagaagccaccaaagaattgcagatggatcctaatagaatatcagaagatggcactcactgcatttatagaattttgagactccatgaaaatgcagattttcaagacacaactctggagagtcaagatacaaaattaatacctgattcatgtaggagaattaaacaggcctttcaaggagctgtgcaaaaggaattacaacatatcgttggatcacagcacatcagagcagagaaagcgatggtggatggctcatggttagatctggccaagaggagcaagcttgaagctcagccttttgctcatctcactattaatgccaccgacatcccatctggttcccataaagtgagtctgtcctcttggtaccatgatcggggttgggccaagatctccaacatgacttttagcaatggaaaactaatagttaatcaggatggcttttattacctgtatgccaacatttgctttcgacatcatgaaacttcaggagacctagctacagagtatcttcaactaatggtgtacgtcactaaaaccagcatcaaaatcccaagttctcataccctgatgaaaggaggaagcaccaagtattggtcagggaattctgaattccatttttattccataaacgttggtggattttttaagttacggtctggagaggaaatcagcatcgaggtctccaacccctccttactggatccggatcaggatgcaacatactttggggcttttaaagttcgagatatagattgagccccagtttttggagtgttatgtatttcctggatgtttggaaacattttttaaaacaagccaagaaagatgtatataggtgtgtgagactactaagaggcatggccccaacggtacacgactcagtatccatgctcttgaccttgtagagaacacgcgtatttacagccagtgggagatgttagactcatggtgtgttacacaatggtttttaaattttgtaatgaattcctagaattaaaccagattggagcaa

SEQ ID NO: 787 - DNA, 2198 bp, Homo sapiens
cgctcgcccgcgcgccccaggacccaaagccgggctccaagtcggcgccccacgtcgaggctccgccgcagcctccggagttggccgcagacaagaaggggagggagcgggagagggaggagagctccgaagcgagagggccgagcgccatgcgccgcgccagcagagactacaccaagtacctgcgtggctcggaggagatgggcggcggccccggagccccgcacgagggccccctgcacgccccgccgccgcctgcgccgcaccagccccctgccgcctcccgctccatgttcgtggccctcctggggctggggctgggccaggttgtctgcagcgtcgccctgttcttctatttcagagcgcagatggatcctaatagaatatcagaagatggcactcactgcatttatagaattttgagactccatgaaaatgcagattttcaagacacaactctggagagtcaagatacaaaattaatacctgattcatgtaggagaattaaacaggcctttcaaggagctgtgcaaaaggaattacaacatatcgttggatcacagcacatcagagcagagaaagcgatggtggatggctcatggttagatctggccaagaggagcaagcttgaagctcagccttttgctcatctcactattaatgccaccgacatcccatctggttcccataaagtgagtctgtcctcttggtaccatgatcggggttgggccaagatctccaacatgacttttagcaatggaaaactaatagttaatcaggatggcttttattacctgtatgccaacatttgctttcgacatcatgaaacttcaggagacctagctacagagtatcttcaactaatggtgtacgtcactaaaaccagcatcaaaatcccaagttctcataccctgatgaaaggaggaagcaccaagtattggtcagggaattctgaattccatttttattccataaacgttggtggattttttaagttacggtctggagaggaaatcagcatcgaggtctccaacccctccttactggatccggatcaggatgcaacatactttggggcttttaaagttcgagatatagattgagccccagtttttggagtgttatgtatttcctggatgtttggaaacattttttaaaacaagccaagaaagatgtatataggtgtgtgagactactaagaggcatggccccaacggtacacgactcagtatccatgctcttgaccttgtagagaacacgcgtatttacagccagtgggagatgttagactcatggtgtgttacacaatggtttttaaattttgtaatgaattcctagaattaaaccagattggagcaattacggggtgaccttatgagaaactgcatgtgggctatgggaggggttggtccctggtcatgtgccccttcgcagctgaagtggagagggtgtcatctagcgcaattgaaggatcatctgaaggggcaaattcttttgaattgttacatcatgctggaacctgcaaaaaatactttttctaatgaggagagaaaatatatgtatttttatataatatctaaagttatatttcagatgtaatgttttctttgcaaagtattgtaaattatatttgtgctatagtatttgattcaaaatatttaaaaatgtcttgctgttgacatatttaatgttttaaatgtacagacatatttaactggtgcactttgtaaattccctggggaaaacttgcagctaaggaggggaaaaaaatgttgtttcctaatatcaaatgcagtatatttcttcgttctttttaagttaatagattttttcagacttgtcaagcctgtgcaaaaaaattaaaatggatgccttgaataataagcaggatgttggccaccaggtgcctttcaaatttagaaactaattgactttagaaagctgacattgccaaaaaggatacataatgggccactgaaatctgtcaagagtagttatataattgttgaacaggtgtttttccacaagtgccgcaaattgtaccttttttgttttttcaaaatagaaaagttattagtggtttatcagcaaaaaagtccaattttaatttagtaaatgttatcttatactgtacaataaaaacattgcctttgaatgttaattttttggtacaaaaataaatttatatgaaaacctgc

SEQ ID NO: 788 - DNA, 2135 bp, Homo sapiens
acagatcacctgaataatagaacagaaactgctgaaatattgaacacagatctagatcaaatgaaggaacatattcaggatgaagcataaataaaggccaggcgtggtggctcatgcctggaatctcagctctttgggaggccgaggctattctccatctcctgggctccagtgatcctcacgcctcggccacccaaagtgctgggattatagaagtgaaccactgcgcctggcctattgaaggtttttaatcttcagagtttcgactttatcaacaacacttagaagccaccaaagaattgcagatggatcctaatagaatatcagaagatggcactcactgcatttatagaattttgagactccatgaaaatgcagattttcaagacacaactctggagagtcaagatacaaaattaatacctgattcatgtaggagaattaaacaggcctttcaaggagctgtgcaaaaggaattacaacatatcgttggatcacagcacatcagagcagagaaagcgatggtggatggctcatggttagatctggccaagaggagcaagcttgaagctcagccttttgctcatctcactattaatgccaccgacatcccatctggttcccataaagtgagtctgtcctcttggtaccatgatcggggttgggccaagatctccaacatgacttttagcaatggaaaactaatagttaatcaggatggcttttattacctgtatgccaacatttgctttcgacatcatgaaacttcaggagacctagctacagagtatcttcaactaatggtgtacgtcactaaaaccagcatcaaaatcccaagttctcataccctgatgaaaggaggaagcaccaagtattggtcagggaattctgaattccatttttattccataaacgttggtggattttttaagttacggtctggagaggaaatcagcatcgaggtctccaacccctccttactggatccggatcaggatgcaacatactttggggcttttaaagttcgagatatagattgagccccagtttttggagtgttatgtatttcctggatgtttggaaacattttttaaaacaagccaagaaagatgtatataggtgtgtgagactactaagaggcatggccccaacggtacacgactcagtatccatgctcttgaccttgtagagaacacgcgtatttacagccagtgggagatgttagactcatggtgtgttacacaatggtttttaaattttgtaatgaattcctagaattaaaccagattggagcaattacggggtgaccttatgagaaactgcatgtgggctatgggaggggttggtccctggtcatgtgccccttcgcagctgaagtggagagggtgtcatctagcgcaattgaaggatcatctgaaggggcaaattcttttgaattgttacatcatgctggaacctgcaaaaaatactttttctaatgaggagagaaaatatatgtatttttatataatatctaaagttatatttcagatgtaatgttttctttgcaaagtattgtaaattatatttgtgctatagtatttgattcaaaatatttaaaaatgtcttgctgttgacatatttaatgttttaaatgtacagacatatttaactggtgcactttgtaaattccctggggaaaacttgcagctaaggaggggaaaaaaatgttgtttcctaatatcaaatgcagtatatttcttcgttctttttaagttaatagattttttcagacttgtcaagcctgtgcaaaaaaattaaaatggatgccttgaataataagcaggatgttggccaccaggtgcctttcaaatttagaaactaattgactttagaaagctgacattgccaaaaaggatacataatgggccactgaaatctgtcaagagtagttatataattgttgaacaggtgtttttccacaagtgccgcaaattgtaccttttttgttttttcaaaatagaaaagttattagtggtttatcagcaaaaaagtccaattttaatttagtaaatgttatcttatactgtacaataaaaacattgcctttgaatgttaattttttggtacaaaaataaatttatatgaaaacctgc

SEQ ID NO: 789 - DNA, 818 bp, Homo sapiens
agcctccggagttggccgcagacaagaaggggctgggccaggttgtctgcagcgtcgccctgttcttctatttcagagcgcagatggatcctaatagaatatcagaagatggcactcactgcatttatagaattttgagactccatgaaaatgcagattttcaagacacaactctggagagtcaagatacaaaattaatacctgattcatgtaggagaattaaacaggcctttcaaggagctgtgcaaaaggaattacaacatatcgttggatcacagcacatcagagcagagaaagcgatggtggatggctcatggttagatctggccaagaggagcaagcttgaagctcagccttttgctcatctcactattaatgccaccgacatcccatctggttcccataaagtgagtctgtcctcttggtaccatgatcggggttgggccaagatctccaacatgacttttagcaatggaaaactaatagttaatcaggatggcttttattacctgtatgccaacatttgctttcgacatcatgaaacttcaggagacctagctacagagtatcttcaactaatggtgtacgtcactaaaaccagcatcaaaatcccaagttctcataccctgatgaaaggaggaagcaccaagtattggtcagggaattctgaattccatttttattccataaacgttggtggattttttaagttacggtctggagaggaaatcagcatcgaggtctccaacccctccttactggatccggatcaggatgcaacatactttggggcttttaaagttcgagatatagattga

SEQ ID NO: 790 - DNA, 2681 bp, Homo sapiens
cgtcctcggcgaggcgcgcacttggccccgacccccggcagcggctgtgcgtgcagcctcttcgtcctccgcgcggcgtgcacttgctcccggcccctgcgccgggcggcggcggggcagcgcgcaggcgcggccggattccgggcagtgacgcgacggcgggccgcgcggcgcatttccgcctctggcgaatggctcgtctgtagtgcacgccgcgggcccagctgcgaccccggccccgcccccgggaccccggccatggacgaactgttccccctcatcttcccggcagagccagcccaggcctctggcccctatgtggagatcattgagcagcccaagcagcggggcatgcgcttccgctacaagtgcgaggggcgctccgcgggcagcatcccaggcgagaggagcacagataccaccaagacccaccccaccatcaagatcaatggctacacaggaccagggacagtgcgcatctccctggtcaccaaggaccctcctcaccggcctcacccccacgagcttgtaggaaaggactgccgggatggcttctatgaggctgagctctgcccggaccgctgcatccacagtttccagaacctgggaatccagtgtgtgaagaagcgggacctggagcaggctatcagtcagcgcatccagaccaacaacaaccccttccaagaagagcagcgtggggactacgacctgaatgctgtgcggctctgcttccaggtgacagtgcgggacccatcaggcaggcccctccgcctgccgcctgtcctttctcatcccatctttgacaatcgtgcccccaacactgccgagctcaagatctgccgagtgaaccgaaactctggcagctgcctcggtggggatgagatcttcctactgtgtgacaaggtgcagaaagaggacattgaggtgtatttcacgggaccaggctgggaggcccgaggctccttttcgcaagctgatgtgcaccgacaagtggccattgtgttccggacccctccctacgcagaccccagcctgcaggctcctgtgcgtgtctccatgcagctgcggcggccttccgaccgggagctcagtgagcccatggaattccagtacctgccagatacagacgatcgtcaccggattgaggagaaacgtaaaaggacatatgagaccttcaagagcatcatgaagaagagtcctttcagcggacccaccgacccccggcctccacctcgacgcattgctgtgccttcccgcagctcagcttctgtccccaagccagcaccccagccctatccctttacgtcatccctgagcaccatcaactatgatgagtttcccaccatggtgtttccttctgggcagatcagccaggcctcggccttggccccggcccctccccaagtcctgccccaggctccagcccctgcccctgctccagccatggtatcagctctggcccaggccccagcccctgtcccagtcctagccccaggccctcctcaggctgtggccccacctgcccccaagcccacccaggctggggaaggaacgctgtcagaggccctgctgcagctgcagtttgatgatgaagacctgggggccttgcttggcaacagcacagacccagctgtgttcacagacctggcatccgtcgacaactccgagtttcagcagctgctgaaccagggcatacctgtggccccccacacaactgagcccatgctgatggagtaccctgaggctataactcgcctagtgacaggggcccagaggccccccgacccagctcctgctccactgggggccccggggctccccaatggcctcctttcaggagatgaagacttctcctccattgcggacatggacttctcagccctgctgagtcagatcagctcctaagggggtgacgcctgccctccccagagcactgggttgcaggggattgaagccctccaaaagcacttacggattctggtggggtgtgttccaactgcccccaactttgtggatgtcttccttggaggggggagccatattttattcttttattgtcagtatctgtatctctctctctttttggaggtgcttaagcagaagcattaacttctctggaaaggggggagctggggaaactcaaacttttcccctgtcctgatggtcagctcccttctctgtagggaactctggggtcccccatccccatcctccagcttctggtactctcctagagacagaagcaggctggaggtaaggcctttgagcccacaaagccttatcaagtgtcttccatcatggattcattacagcttaatcaaaataacgccccagataccagcccctgtatggcactggcattgtccctgtgcctaacaccagcgtttgaggggctggccttcctgccctacagaggtctctgccggctctttccttgctcaaccatggctgaaggaaaccagtgcaacagcactggctctctccaggatccagaaggggtttggtctgggacttccttgctctccctcttctcaagtgccttaatagtagggtaagttgttaagagtgggggagagcaggctggcagctctccagtcaggaggcatagtttttactgaacaatcaaagcacttggactcttgctctttctactctgaactaataaatctgttgccaagctg

SEQ ID NO: 791 - DNA, 2700 bp, Homo sapiens
tcttcgtcctcggcgaggcgcgcacttggccccgacccccggcagcggctgtgcgtgcagcctcttcgtcctccgcgcggcgtgcacttgctcccggcccctgcgccgggcggcggcggggcagcgcgcaggcgcggccggattccgggcagtgacgcgacggcgggccgcgcggcgcatttccgcctctggcgaatggctcgtctgtagtgcacgccgcgggcccagctgcgaccccggccccgcccccgggaccccggccatggacgaactgttccccctcatcttcccggcagagccagcccaggcctctggcccctatgtggagatcattgagcagcccaagcagcggggcatgcgcttccgctacaagtgcgaggggcgctccgcgggcagcatcccaggcgagaggagcacagataccaccaagacccaccccaccatcaagatcaatggctacacaggaccagggacagtgcgcatctccctggtcaccaaggaccctcctcaccggcctcacccccacgagcttgtaggaaaggactgccgggatggcttctatgaggctgagctctgcccggaccgctgcatccacagtttccagaacctgggaatccagtgtgtgaagaagcgggacctggagcaggctatcagtcagcgcatccagaccaacaacaaccccttccaagttcctatagaagagcagcgtggggactacgacctgaatgctgtgcggctctgcttccaggtgacagtgcgggacccatcaggcaggcccctccgcctgccgcctgtcctttctcatcccatctttgacaatcgtgcccccaacactgccgagctcaagatctgccgagtgaaccgaaactctggcagctgcctcggtggggatgagatcttcctactgtgtgacaaggtgcagaaagaggacattgaggtgtatttcacgggaccaggctgggaggcccgaggctccttttcgcaagctgatgtgcaccgacaagtggccattgtgttccggacccctccctacgcagaccccagcctgcaggctcctgtgcgtgtctccatgcagctgcggcggccttccgaccgggagctcagtgagcccatggaattccagtacctgccagatacagacgatcgtcaccggattgaggagaaacgtaaaaggacatatgagaccttcaagagcatcatgaagaagagtcctttcagcggacccaccgacccccggcctccacctcgacgcattgctgtgccttcccgcagctcagcttctgtccccaagccagcaccccagccctatccctttacgtcatccctgagcaccatcaactatgatgagtttcccaccatggtgtttccttctgggcagatcagccaggcctcggccttggccccggcccctccccaagtcctgccccaggctccagcccctgcccctgctccagccatggtatcagctctggcccaggccccagcccctgtcccagtcctagccccaggccctcctcaggctgtggccccacctgcccccaagcccacccaggctggggaaggaacgctgtcagaggccctgctgcagctgcagtttgatgatgaagacctgggggccttgcttggcaacagcacagacccagctgtgttcacagacctggcatccgtcgacaactccgagtttcagcagctgctgaaccagggcatacctgtggccccccacacaactgagcccatgctgatggagtaccctgaggctataactcgcctagtgacaggggcccagaggccccccgacccagctcctgctccactgggggccccggggctccccaatggcctcctttcaggagatgaagacttctcctccattgcggacatggacttctcagccctgctgagtcagatcagctcctaagggggtgacgcctgccctccccagagcactgggttgcaggggattgaagccctccaaaagcacttacggattctggtggggtgtgttccaactgcccccaactttgtggatgtcttccttggaggggggagccatattttattcttttattgtcagtatctgtatctctctctctttttggaggtgcttaagcagaagcattaacttctctggaaaggggggagctggggaaactcaaacttttcccctgtcctgatggtcagctcccttctctgtagggaactctggggtcccccatccccatcctccagcttctggtactctcctagagacagaagcaggctggaggtaaggcctttgagcccacaaagccttatcaagtgtcttccatcatggattcattacagcttaatcaaaataacgccccagataccagcccctgtatggcactggcattgtccctgtgcctaacaccagcgtttgaggggctggccttcctgccctacagaggtctctgccggctctttccttgctcaaccatggctgaaggaaaccagtgcaacagcactggctctctccaggatccagaaggggtttggtctgggacttccttgctctccctcttctcaagtgccttaatagtagggtaagttgttaagagtgggggagagcaggctggcagctctccagtcaggaggcatagtttttactgaacaatcaaagcacttggactcttgctctttctactctgaactaataaatctgttgccaagctggctaga

SEQ ID NO: 792 - DNA, 2163 bp, Homo sapiens
ggcgaatggctcgtctgtagtgcacgccgcgggcccagctgcgaccccggccccgcccccgggaccccggccatggacgaactgttccccctcatcttcccggcagagccagcccaggcctctggcccctatgtggagatcattgagcagcccaagcagcggggcatgcgcttccgctacaagtgcgaggggcgctccgcgggcagcatcccaggcgagaggagcacagataccaccaagacccaccccaccatcaagatcaatggctacacaggaccagggacagtgcgcatctccctggtcaccaaggaccctcctcaccggcctcacccccacgagcttgtaggaaaggactgccgggatggcttctatgaggctgagctctgcccggaccgctgcatccacagtttccagaacctgggaatccagtgtgtgaagaagcgggacctggagcaggctatcagtcagcgcatccagaccaacaacaaccccttccaagttcctatagaagagcagcgtggggactacgacctgaatgctgtgcggctctgcttccaggtgacagtgcgggacccatcaggcaggcccctccgcctgccgcctgtcctttctcatcccatctttgacaatcgtgcccccaacactgccgagctcaagatctgccgagtgaaccgaaactctggcagctgcctcggtggggatgagatcttcctactgtgtgacaaggtgcagaaagaggacattgaggtctgtccccaagccagcaccccagccctatccctttacgtcatccctgagcaccatcaactatgatgagtttcccaccatggtgtttccttctgggcagatcagccaggcctcggccttggccccggcccctccccaagtcctgccccaggctccagcccctgcccctgctccagccatggtatcagctctggcccaggccccagcccctgtcccagtcctagccccaggccctcctcaggctgtggccccacctgcccccaagcccacccaggctggggaaggaacgctgtcagaggccctgctgcagctgcagtttgatgatgaagacctgggggccttgcttggcaacagcacagacccagctgtgttcacagacctggcatccgtcgacaactccgagtttcagcagctgctgaaccagggcatacctgtggccccccacacaactgagcccatgctgatggagtaccctgaggctataactcgcctagtgacaggggcccagaggccccccgacccagctcctgctccactgggggccccggggctccccaatggcctcctttcaggagatgaagacttctcctccattgcggacatggacttctcagccctgctgagtcagatcagctcctaagggggtgacgcctgccctccccagagcactgggttgcaggggattgaagccctccaaaagcacttacggattctggtggggtgtgttccaactgcccccaactttgtggatgtcttccttggaggggggagccatattttattcttttattgtcagtatctgtatctctctctctttttggaggtgcttaagcagaagcattaacttctctggaaaggggggagctggggaaactcaaacttttcccctgtcctgatggtcagctcccttctctgtagggaactctggggtcccccatccccatcctccagcttctggtactctcctagagacagaagcaggctggaggtaaggcctttgagcccacaaagccttatcaagtgtcttccatcatggattcattacagcttaatcaaaataacgccccagataccagcccctgtatggcactggcattgtccctgtgcctaacaccagcgtttgaggggctggccttcctgccctacagaggtctctgccggctctttccttgctcaaccatggctgaaggaaaccagtgcaacagcactggctctctccaggatccagaaggggtttggtctgggacttccttgctctccctcttctcaagtgccttaatagtagggtaagttgttaagagtgggggagagcaggctggcagctctccagtcaggaggcatagtttttactgaacaatcaaagcacttggactcttgctctttctactctgaactaataaatctgttgccaagctg

SEQ ID NO: 793 - DNA, 3183 bp, Homo sapiens
ctcgtctgtagtgcacgccgcgggcccagctgcgaccccggccccgcccccgggaccccggccatggacgaactgttccccctcatcttcccggcagagccagcccaggcctctggcccctatgtggagatcattgagcagcccaagcagcggggcatgcgcttccgctacaagtgcgaggggcgctccgcgggcagcatcccaggcgagaggagcacagataccaccaagacccaccccaccatcaagatcaatggctacacaggaccagggacagtgcgcatctccctggtcaccaaggaccctcctcaccggcctcacccccacgagcttgtaggaaaggactgccgggatggcttctatgaggctgagctctgcccggaccgctgcatccacagtttccagaacctgggaatccagtgtgtgaagaagcgggacctggagcaggctatcagtcagcgcatccagaccaacaacaaccccttccaagttcctatagaagagcagcgtggggactacgacctgaatgctgtgcggctctgcttccaggtgacagtgcgggacccatcaggcaggcccctccgcctgccgcctgtcctttctcatcccatctttgacaatcgtgcccccaacactgccgagctcaagatctgccgagtgaaccgaaactctggcagctgcctcggtggggatgagatcttcctactgtgtgacaaggtgcagaaagaggacattgaggtgtatttcacgggaccaggctgggaggcccgaggctccttttcgcaagctgatgtgcaccgacaagtggccattgtgttccggacccctccctacgcagaccccagcctgcaggctcctgtgcgtgtctccatgcagctgcggcggccttccgaccgggagctcagtgagcccatggaattccagtacctgccagatacagacgatcgtcaccggattgaggagaaacgtaaaaggacatatgagaccttcaagagcatcatgaagaagagtcctttcagcggacccaccgacccccggcctccacctcgacgcattgctgtgccttcccgcagctcagcttctgtccccaagccaggtaaggatttccttttgtcccactggaacgacaggttcagctctgttcagctgaggagcagtggagatgaagactcctgggccccattacagacctactgaatcagaggctttgaaaggatggcgcaggaaccagcgacttcctgggatgctaatgcacactgaagcctgggaaccaccgtgccacttaaattctatattgggtatcttgggaatcagaagttaaaaatgcagaatctctgctctcatctctcacttgaattgggggaacaaaaatcacctctaaattagcaagatgtgtgtgcctgtgcgaggctcaaaaactgacaagctctgcacttcaggccgctgctcacttggtgctccatgggctcattgcctctcaggacttagtttttcagctgtaaactgaggagtccagcttatctctccaagtgtcccttcctctaaaaggctggaagagtttcgtgggcttgagtagtcagggaggactccaaggtggaggtgtggctagaactggaccctacaggctgggtcagatggggtaagaggaaggagatagggtgttggcagtgactccctagagagggattgagcctgagcaccatgaagaggggctggggtacagaggacggggtggatctctagggctttctctgacccctgcctctctgtctctctcctccagcaccccagccctatccctttacgtcatccctgagcaccatcaactatgatgagtttcccaccatggtgtttccttctgggcagatcagccaggcctcggccttggccccggcccctccccaagtcctgccccaggctccagcccctgcccctgctccagccatggtatcagctctggcccaggccccagcccctgtcccagtcctagccccaggccctcctcaggctgtggccccacctgcccccaagcccacccaggctggggaaggaacgctgtcagaggccctgctgcagctgcagtttgatgatgaagacctgggggccttgcttggcaacagcacagacccagctgtgttcacagacctggcatccgtcgacaactccgagtttcagcagctgctgaaccagggcatacctgtggccccccacacaactgagcccatgctgatggagtaccctgaggctataactcgcctagtgacaggggcccagaggccccccgacccagctcctgctccactgggggccccggggctccccaatggcctcctttcaggagatgaagacttctcctccattgcggacatggacttctcagccctgctgagtcagatcagctcctaagggggtgacgcctgccctccccagagcactgggttgcaggggattgaagccctccaaaagcacttacggattctggtggggtgtgttccaactgcccccaactttgtggatgtcttccttggaggggggagccatattttattcttttattgtcagtatctgtatctctctctctttttggaggtgcttaagcagaagcattaacttctctggaaaggggggagctggggaaactcaaacttttcccctgtcctgatggtcagctcccttctctgtagggaactctggggtcccccatccccatcctccagcttctggtactctcctagagacagaagcaggctggaggtaaggcctttgagcccacaaagccttatcaagtgtcttccatcatggattcattacagcttaatcaaaataacgccccagataccagcccctgtatggcactggcattgtccctgtgcctaacaccagcgtttgaggggctggccttcctgccctacagaggtctctgccggctctttccttgctcaaccatggctgaaggaaaccagtgcaacagcactggctctctccaggatccagaaggggtttggtctgggacttccttgctctccctcttctcaagtgccttaatagtagggtaagttgttaagagtgggggagagcaggctggcagctctccagtcaggaggcatagtttttactgaacaatcaaagcacttggactcttgctctttctactctgaactaataaatctgttgccaagctgg

SEQ ID NO: 794 - DNA, 1113 bp, Homo sapiens
ctcgtctgtagtgcacgccgcgggcccagctgcgaccccggccccgcccccgggaccccggccatggacgaactgttccccctcatcttcccggcagagccagcccaggcctctggcccctatgtggagatcattgagcagcccaagcagcggggcatgcgcttccgctacaagtgcgaggggcgctccgcgggcagcatcccaggcgagaggagcacagataccaccaagacccaccccaccatcaagatcaatggctacacaggaccagggacagtgcgcatctccctggtcaccaaggaccctcctcaccggcctcacccccacgagcttgtaggaaaggactgccgggatggcttctatgaggctgagctctgcccggaccgctgcatccacagtttccagaacctgggaatccagtgtgtgaagaagcgggacctggagcaggctatcagtcagcgcatccagaccaacaacaaccccttccaagttcctatagaagagcagcgtggggactacgacctgaatgctgtgcggctctgcttccaggtgacagtgcgggacccatcaggcaggcccctccgcctgccgcctgtcctttctcatcccatctttgacaatcgtgcccccaacactgccgagctcaagatctgccgagtgaaccgaaactctggcagctgcctcggtggggatgagatcttcctactgtgtgacaaggtgcagaaagcccatggaattccagtacctgccagatacagacgatcgtcaccggattgaggagaaacgtaaaaggacatatgagaccttcaagagcatcatgaagaagagtcctttcagcggacccaccgacccccggcctccacctcgacgcattgctgtgccttcccgcagctcagcttctgtccccaagccagcaccccagccctatccctttacgtcatccctgagcaccatcaactatgatgagtttcccaccatggtgtttccttctgggcagatcagccaggcctcggccttggccccggcccctccccaagtcctgccccaggctccagcccctgcccctgctccagccatggtatcagctctggcccagaggccccccgacccagc

SEQ ID NO: 795 - DNA, 1437 bp, Homo sapiens
gcatttccgcctctggcgaatggctcgtctgtagtgcacgccgcgggcccagctgcgaccccggccccgcccccgggaccccggccatggacgaactgttccccctcatcttcccggcagagccagcccaggcctctggcccctatgtggagatcattgagcagcccaagcagcggggcatgcgcttccgctacaagtgcgaggggcgctccgcgggcagcatcccaggcgagaggagcacagataccaccaagacccaccccaccatcaaggtttggatgtctgggcctctgtactttggacagatcaatggctacacaggaccagggacagtgcgcatctccctggtcaccaaggaccctcctcaccggcctcacccccacgagcttgtaggaaaggactgccgggatggcttctatgaggctgagctctgcccggaccgctgcatccacagtttccagaacctgggaatccagtgtgtgaagaagcgggacctggagcaggctatcagtcagcgcatccagaccaacaacaaccccttccaagttcctatagaagagcagcgtggggactacgacctgaatgctgtgcggctctgcttccaggtgacagtgcgggacccatcaggcaggcccctccgcctgccgcctgtcctttctcatcccatctttgacaatcgtgcccccaacactgccgagctcaagatctgccgagtgaaccgaaactctggcagctgcctcggtggggatgagatcttcctactgtgtgacaaggtgcagaaagaggacattgaggtgtatttcacgggaccaggctgggaggcccgaggctccttttcgcaagctgatgtgcaccgacaagtggccattgtgttccggacccctccctacgcagaccccagcctgcaggctcctgtgcgtgtctccatgcagctgcggcggccttccgaccgggagctcagtgagcccatggaattccagtacctgccagatacagacgatcgtcaccggattgaggagaaacgtaaaaggacatatgagaccttcaagagcatcatgaagaagagtcctttcagcggacccaccgacccccggcctccacctcgacgcattgctgtgccttcccgcagctcagcttctgtccccaagccagcaccccagccctatccctttacgtcatccctgagcaccatcaactatgatgagtttcccaccatggtgtttccttctgggcagatcagccaggcctcggccttggccccggcccctccccaagtcctgccccaggctccagcccctgcccctgctccagccatggtatcagctctggcccaggccccagagcactgggttgcaggggattgaagccctccaaaagcacttacggattctggtggggtgtgttccaactgcccccaactttgtggatgtcttcctt

SEQ ID NO: 796 - DNA, 4145 bp, Homo sapiens
cagccgggcgcgctcgacgcggacggcgggccagctgccggagcgcggcgactccaggggacccacagctggggcgccagagcgcggccatccgggcggggccgacggagcgcggcaggacttggctggacggcgcggccacggagaagggcgcggtgagcggactggcaccgcgcggggaacattccggaggccgccgggctcagtcccggtgacccccctgggtacagctctgccggggggggaaaaagtggtaccattttgggcgttcttgagcttcagaatgcaaccagacatgtccttgaatgtcattaagatgaaatccagtgacttcctggagagtgcagaactggacagcggaggctttgggaaggtgtctctgtgtttccacagaacccagggactcatgatcatgaaaacagtgtacaaggggcccaactgcattgagcacaacgaggccctcttggaggaggcgaagatgatgaacagactgagacacagccgggtggtgaagctcctgggcgtcatcatagaggaagggaagtactccctggtgatggagtacatggagaagggcaacctgatgcacgtgctgaaagccgagatgagtactccgctttctgtaaaaggaaggataattttggaaatcattgaaggaatgtgctacttacatggaaaaggcgtgatacacaaggacctgaagcctgaaaatatccttgttgataatgacttccacattaagatcgcagacctcggccttgcctcctttaagatgtggagcaaactgaataatgaagagcacaatgagctgagggaagtggacggcaccgctaagaagaatggcggcaccctctactacatggcgcccgagcacctgaatgacgtcaacgcaaagcccacagagaagtcggatgtgtacagctttgctgtagtactctgggcgatatttgcaaataaggagccatatgaaaatgctatctgtgagcagcagttgataatgtgcataaaatctgggaacaggccagatgtggatgacatcactgagtactgcccaagagaaattatcagtctcatgaagctctgctgggaagcgaatccggaagctcggccgacatttcctggcattgaagaaaaatttaggcctttttatttaagtcaattagaagaaagtgtagaagaggacgtgaagagtttaaagaaagagtattcaaacgaaaatgcagttgtgaagagaatgcagtctcttcaacttgattgtgtggcagtaccttcaagccggtcaaattcagccacagaacagcctggttcactgcacagttcccagggacttgggatgggtcctgtggaggagtcctggtttgctccttccctggagcacccacaagaagagaatgagcccagcctgcagagtaaactccaagacgaagccaactaccatctttatggcagccgcatggacaggcagacgaaacagcagcccagacagaatgtggcttacaacagagaggaggaaaggagacgcagggtctcccatgacccttttgcacagcaaagaccttacgagaattttcagaatacagagggaaaaggcactgcttattccagtgcagccagtcatggtaatgcagtgcaccagccctcagggctcaccagccaacctcaagtactgtatcagaacaatggattatatagctcacatggctttggaacaagaccactggatccaggaacagcaggtcccagagtttggtacaggccaattccaagtcatatgcctagtctgcataatatcccagtgcctgagaccaactatctaggaaatacacccaccatgccattcagctccttgccaccaacagatgaatctataaaatataccatatacaatagtactggcattcagattggagcctacaattatatggagattggtgggacgagttcatcactactagacagcacaaatacgaacttcaaagaagagccagctgctaagtaccaagctatctttgataataccactagtctgacggataaacacctggacccaatcagggaaaatctgggaaagcactggaaaaactgtgcccgtaaactgggcttcacacagtctcagattgatgaaattgaccatgactatgagcgagatggactgaaagaaaaggtttaccagatgctccaaaagtgggtgatgagggaaggcataaagggagccacggtggggaagctggcccaggcgctccaccagtgttccaggatcgaccttctgagcagcttgatttacgtcagccagaactaaccctggatgggctacggcagctgaagtggacgcctcacttagtggataaccccagaaagttggctgcctcagagcattcagaattctgtcctcactgataggggttctgtgtctgcagaaattttgtttcctgtacttcatagctggagaatggggaaagaaatctgcagcaaaggggtctcactctgttgccaggctggtctcaaacttctggactcaagtgatcctcccgcctcggccttccaaagtgctgggatatcaggcactgagccactgcgcccagccaacaatccgctctgaggaaagcgtaagcaggaagacctcttaatggcatagcaccaataaaaaaatgactcctagttgtgtttggaaagggagagaagagatgtctgaggaaggtcatgttctttcagcttatggcatttcctagagttttgttgaagcaagaagaaaaactcagagaatataaaatcaacttttaaaattgtgtgctctcttcttcacgtaggctcctgttaaaaacaaagtgcagtcagattctaagccctgttcagagacttcgtggatcacagctgcagctcaccgccacatcacaggatccgttaacgttaatacccaatactctgtcagccactgtaggctctaagaaccacgtgcagtcttcagcccattaaattatcgattattttttaatgaattgaatttatattgagtcttcaaattaactgaatggatttaaaggggtaccaaggaggggggaaacatcagaatttcccaggcagttgttgcaaggaattggtactaaccgtgactacaacaaaaattcttgattgacttttaaagttatttcctggcattctggtaccttcacccagcctgagtgccctggagagggaacaggaaatgctgatctctacccctgggtgagaccagaacctcagggctgatactgttgagtggcttcctcggtttactctgtgtactgtgaaagtattttcatattttttctgtgtgccagagtgaaaaaggacagcttctgagtgtggtaattgtgcctctagcacccagcctttcaaagcccacctgaaacctgggggtggatgaaagaactagaatagaagactgaagctgggtaggccgctcagtgtccactggcattttgctaaaccgacaaggaaggctgtgtgcttagctctccccagagggagggcgagaagggtgtggtgatggtcaatctggctgtcggaacagattctggtgtcttgggctgataacagtgttgttgattctgattgtgaatcccctcaactctagcagacacatacacacccctgaaatggggctgcagagcaggctgtctcagccttgccactgtcggcatctcggcctgggtaattctgttgtggggactgtcctgttccttgtaggatgtttagtagcatccctgcccccacctactagatgccaggggcactgttctccccagccccccgccccagttgtgacaatagtctctaaacattgtcaaatggtccaaggaaaggggaaaattgccccggttgagaagagcactgctgtaaagtaatgagcctcggctctcctgtctgcacctgtccggttactacttggccaccacgcagccttggctcctacagcccaaaagggagaatggagggaggctccaggctttgctggaggggcctgggtgagttctgtttgctccttgtaccaccatccaaatggtgttatcaaatctcttagattccaaagaggttgaataattaatgttcaaaggcaagagggcaaggcattttttaacactttttaaaataaaaatttataccac

SEQ ID NO: 797 - DNA, 3864 bp, Homo sapiens
atgcaaccagacatgtccttgaatgtcattaagatgaaatccagtgacttcctggagagtgcagaactggacagcggaggctttgggaaggtgtctctgtgtttccacagaacccagggactcatgatcatgaaaacagtgtacaaggggcccaactgcattgagcacaacgaggccctcttggaggaggcgaagatgatgaacagactgagacacagccgggtggtgaagctcctgggcgtcatcatagaggaagggaagtactccctggtgatggagtacatggagaagggcaacctgatgcacgtgctgaaagccgagatgagtactccgctttctgtaaaaggaaggataattttggaaatcattgaaggaatgtgctacttacatggaaaaggcgtgatacacaaggacctgaagcctgaaaatatccttgttgataatgacttccacattaagatcgcagacctcggccttgcctcctttaagatgtggagcaaactgaataatgaagagcacaatgagctgagggaagtggacggcaccgctaagaagaatggcggcaccctctactacatggcgcccgagcacctgaatgacgtcaacgcaaagcccacagagaagtcggatgtgtacagctttgctgtagtactctgggcgatatttgcaaataaggagccatatgaaaatgctatctgtgagcagcagttgataatgtgcataaaatctgggaacaggccagatgtggatgacatcactgagtactgcccaagagaaattatcagtctcatgaagctctgctgggaagcgaatccggaagctcggccgacatttcctggcattgaagaaaaatttaggcctttttatttaagtcaattagaagaaagtgtagaagaggacgtgaagagtttaaagaaagagtattcaaacgaaaatgcagttgtgaagagaatgcagtctcttcaacttgattgtgtggcagtaccttcaagccggtcaaattcagccacagaacagcctggttcactgcacagttcccagggacttgggatgggtcctgtggaggagtcctggtttgctccttccctggagcacccacaagaagagaatgagcccagcctgcagagtaaactccaagacgaagccaactaccatctttatggcagccgcatggacaggcagacgaaacagcagcccagacagaatgtggcttacaacagagaggaggaaaggagacgcagggtctcccatgacccttttgcacagcaaagaccttacgagaattttcagaatacagagggaaaaggcactgcttattccagtgcagccagtcatggtaatgcagtgcaccagccctcagggctcaccagccaacctcaagtactgtatcagaacaatggattatatagctcacatggctttggaacaagaccactggatccaggaacagcaggtcccagagtttggtacaggccaattccaagtcatatgcctagtctgcataatatcccagtgcctgagaccaactatctaggaaatacacccaccatgccattcagctccttgccaccaacagatgaatctataaaatataccatatacaatagtactggcattcagattggagcctacaattatatggagattggtgggacgagttcatcactactagacagcacaaatacgaacttcaaagaagagccagctgctaagtaccaagctatctttgataataccactagtctgacggataaacacctggacccaatcagggaaaatctgggaaagcactggaaaaactgtgcccgtaaactgggcttcacacagtctcagattgatgaaattgaccatgactatgagcgagatggactgaaagaaaaggtttaccagatgctccaaaagtgggtgatgagggaaggcataaagggagccacggtggggaagctggcccaggcgctccaccagtgttccaggatcgaccttctgagcagcttgatttacgtcagccagaactaaccctggatgggctacggcagctgaagtggacgcctcacttagtggataaccccagaaagttggctgcctcagagcattcagaattctgtcctcactgataggggttctgtgtctgcagaaattttgtttcctgtacttcatagctggagaatggggaaagaaatctgcagcaaaggggtctcactctgttgccaggctggtctcaaacttctggactcaagtgatcctcccgcctcggccttccaaagtgctgggatatcaggcactgagccactgcgcccagccaacaatccgctctgaggaaagcgtaagcaggaagacctcttaatggcatagcaccaataaaaaaatgactcctagttgtgtttggaaagggagagaagagatgtctgaggaaggtcatgttctttcagcttatggcatttcctagagttttgttgaagcaagaagaaaaactcagagaatataaaatcaacttttaaaattgtgtgctctcttcttcacgtaggctcctgttaaaaacaaagtgcagtcagattctaagccctgttcagagacttcgtggatcacagctgcagctcaccgccacatcacaggatccgttaacgttaatacccaatactctgtcagccactgtaggctctaagaaccacgtgcagtcttcagcccattaaattatcgattattttttaatgaattgaatttatattgagtcttcaaattaactgaatggatttaaaggggtaccaaggaggggggaaacatcagaatttcccaggcagttgttgcaaggaattggtactaaccgtgactacaacaaaaattcttgattgacttttaaagttatttcctggcattctggtaccttcacccagcctgagtgccctggagagggaacaggaaatgctgatctctacccctgggtgagaccagaacctcagggctgatactgttgagtggcttcctcggtttactctgtgtactgtgaaagtattttcatattttttctgtgtgccagagtgaaaaaggacagcttctgagtgtggtaattgtgcctctagcacccagcctttcaaagcccacctgaaacctgggggtggatgaaagaactagaatagaagactgaagctgggtaggccgctcagtgtccactggcattttgctaaaccgacaaggaaggctgtgtgcttagctctccccagagggagggcgagaagggtgtggtgatggtcaatctggctgtcggaacagattctggtgtcttgggctgataacagtgttgttgattctgattgtgaatcccctcaactctagcagacacatacacacccctgaaatggggctgcagagcaggctgtctcagccttgccactgtcggcatctcggcctgggtaattctgttgtggggactgtcctgttccttgtaggatgtttagtagcatccctgcccccacctactagatgccaggggcactgttctccccagccccccgccccagttgtgacaatagtctctaaacattgtcaaatggtccaaggaaaggggaaaattgccccggttgagaagagcactgctgtaaagtaatgagcctcggctctcctgtctgcacctgtccggttactacttggccaccacgcagccttggctcctacagcccaaaagggagaatggagggaggctccaggctttgctggaggggcctgggtgagttctgtttgctccttgtaccaccatccaaatggtgttatcaaatctcttagattccaaagaggttgaataattaatgttcaaaggcaagagggcaaggcattttttaacactttttaaaataaaaatttataccacaa

SEQ ID NO: 798 - DNA, 2670 bp, Homo sapiens
atgagcccagcctgcagagtaaactccaagacgaagccaactaccatctttatggcagccgcatggacaggcagacgaaacagcagcccagacagaatgtggcttacaacagagaggaggaaaggagacgcagggtctcccatgacccttttgcacaggccctcagggctcaccagccaacctcaagtactgtatcagaacaatggattatatagctcacatggctttggaacaagaccactggatccaggaacagcaggtcccagagtttggtacaggccaattccaagtcatatgcctagtctgcataatatcccagtgcctgagaccaactatctaggaaatacacccaccatgccattcagctccttgccaccaacagatgaatctataaaatataccatatacaatagtactggcattcagattggagcctacaattatatggagattggtgggacgagttcatcactactagacagcacaaatacgaacttcaaagaagagccagctgctaagtaccaagctatctttgataataccactagtctgacggataaacacctggacccaatcagggaaaatctgggaaagcactggaaaaactgtgcccgtaaactgggcttcacacagtctcagattgatgaaattgaccatgactatgagcgagatggactgaaagaaaaggtttaccagatgctccaaaagtgggtgatgagggaaggcataaagggagccacggtggggaagctggcccaggcgctccaccagtgttccaggatcgaccttctgagcagcttgatttacgtcagccagaactaaccctggatgggctacggcagctgaagtggacgcctcacttagtggataaccccagaaagttggctgcctcagagcattcagaattctgtcctcactgataggggttctgtgtctgcagaaattttgtttcctgtacttcatagctggagaatggggaaagaaatctgcagcaaaggggtctcactctgttgccaggctggtctcaaacttctggactcaagtgatcctcccgcctcggccttccaaagtgctgggatatcaggcactgagccactgcgcccagccaacaatccgctctgaggaaagcgtaagcaggaagacctcttaatggcatagcaccaataaaaaaatgactcctagttgtgtttggaaagggagagaagagatgtctgaggaaggtcatgttctttcagcttatggcatttcctagagttttgttgaagcaagaagaaaaactcagagaatataaaatcaacttttaaaattgtgtgctctcttcttcacgtaggctcctgttaaaaacaaagtgcagtcagattctaagccctgttcagagacttcgtggatcacagctgcagctcaccgccacatcacaggatccgttaacgttaatacccaatactctgtcagccactgtaggctctaagaaccacgtgcagtcttcagcccattaaattatcgattattttttaatgaattgaatttatattgagtcttcaaattaactgaatggatttaaaggggtaccaaggaggggggaaacatcagaatttcccaggcagttgttgcaaggaattggtactaaccgtgactacaacaaaaattcttgattgacttttaaagttatttcctggcattctggtaccttcacccagcctgagtgccctggagagggaacaggaaatgctgatctctacccctgggtgagaccagaacctcagggctgatactgttgagtggcttcctcggtttactctgtgtactgtgaaagtattttcatattttttctgtgtgccagagtgaaaaaggacagcttctgagtgtggtaattgtgcctctagcacccagcctttcaaagcccacctgaaacctgggggtggatgaaagaactagaatagaagactgaagctgggtaggccgctcagtgtccactggcattttgctaaaccgacaaggaaggctgtgtgcttagctctccccagagggagggcgagaagggtgtggtgatggtcaatctggctgtcggaacagattctggtgtcttgggctgataacagtgttgttgattctgattgtgaatcccctcaactctagcagacacatacacacccctgaaatggggctgcagagcaggctgtctcagccttgccactgtcggcatctcggcctgggtaattctgttgtggggactgtcctgttccttgtaggatgtttagtagcatccctgcccccacctactagatgccaggggcactgttctccccagccccccgccccagttgtgacaatagtctctaaacattgtcaaatggtccaaggaaaggggaaaattgccccggttgagaagagcactgctgtaaagtaatgagcctcggctctcctgtctgcacctgtccggttactacttggccaccacgcagccttggctcctacagcccaaaagggagaatggagggaggctccaggctttgctggaggggcctgggtgagttctgtttgctccttgtaccaccatccaaatggtgttatcaaatctcttagattccaaagaggttgaataattaatgttcaaaggcaagagggcaaggcattttttaacactttttaaaataaaaatttataccacaa

SEQ ID NO: 799 - DNA, 3133 bp, Homo sapiens
cattttgggcgttcttgagcttcagaatgcaaccagacatgtccttgaatgtcattaagatgaaatccagtgacttcctggagagtgcagaactggacagcggaggctttgggaaggtgtctctgtgtttccacagaacccagggactcatgatcatgaaaacagtgtacaaggggcccaactgcattgagcacaacgaggccctcttggaggaggcgaagatgatgaacagactgagacacagccgggtggtgaagctcctgggcgtcatcatagaggaagggaagtactccctggtgatggagtacatggagaagggcaacctgatgcacgtgctgaaagccgagatcgcagacctcggccttgcctcctttaagatgtggagcaaactgaataatgaagagcacaatgagctgagggaagtggacggcaccgctaagaagaatggcggcaccctctactacatggcgcccgagcacctgaatgacgtcaacgcaaagcccacagagaagtcggatgtgtacagctttgctgtagtactctgggcgatatttgcaaataaggagccatatgaaaatgctatctgtgagcagcagttgataatgtgcataaaatctgggaacaggccagatgtggatgacatcactgagtactgcccaagagaaattatcagtctcatgaagctctgctgggaagcgaatccggaagctcggccgacatttcctggcattgaagaaaaatttaggcctttttatttaagtcaattagaagaaagtgtagaagaggacgtgaagagtttaaagaaagagtattcaaacgaaaatgcagttgtgaagagaatgcagtctcttcaacttgattgtgtggcagtaccttcaagccggtcaaattcagccacagaacagcctggttcactgcacagttcccagggacttgggatgggtcctgtggaggagtcctggtttgctccttccctggagcacccacaagaagagaatgagcccagcctgcagagtaaactccaagacgaagccaactaccatctttatggcagccgcatggacaggcagacgaaacagcagcccagacagaatgtggcttacaacagagaggaggaaaggagacgcagggtctcccatgacccttttgcacagcaaagaccttacgagaattttcagaatacagagggaaaaggcactgcttattccagtgcagccagtcatggtaatgcagtgcaccagccctcagggctcaccagccaacctcaagtactgtatcagaacaatggattatatagctcacatggctttggaacaagaccactggatccaggaacagcaggtcccagagtttggtacaggccaattccaagtcatatgcctagtctgcataatatcccagtgcctgagaccaactatctaggaaatacacccaccatgccattcagctccttgccaccaacagatgaatctataaaatataccatatacaatagtactggcattcagattggagcctacaattatatggagattggtgggacgagttcatcactactagacagcacaaatacgaacttcaaagaagagccagctgctaagtaccaagctatctttgataataccactagtctgacggataaacacctggacccaatcagggaaaatctgggaaagcactggaaaaactgtgcccgtaaactgggcttcacacagtctcagattgatgaaattgaccatgactatgagcgagatggactgaaagaaaaggtttaccagatgctccaaaagtgggtgatgagggaaggcataaagggagccacggtggggaagctggcccaggcgctccaccagtgttccaggatcgaccttctgagcagcttgatttacgtcagccagaactaaccctggatgggctacggcagctgaagtggacgcctcacttagtggataaccccagaaagttggctgcctcagagcattcagaattctgtcctcactgataggggttctgtgtctgcagaaattttgtttcctgtacttcatagctggagaatggggaaagaaatctgcagcaaaggggtctcactctgttgccaggctggtctcaaacttctggactcaagtgatcctcccgcctcggccttccaaagtgctgggatatcaggcactgagccactgcgcccagccaacaatccgctctgaggaaagcgtaagcaggaagacctcttaatggcatagcaccaataaaaaaatgactcctagttgtgtttggaaagggagagaagagatgtctgaggaaggtcatgttctttcagcttatggcatttcctagagttttgttgaagcaagaagaaaaactcagagaatataaaatcaacttttaaaattgtgtgctctcttcttcacgtaggctcctgttaaaaacaaagtgcagtcagattctaagccctgttcagagacttcgtggatcacagctgcagctcaccgccacatcacaggatccgttaacgttaatacccaatactctgtcagccactgtaggctctaagaaccacgtgcagtcttcagcccattaaattatcgattattttttaatgaattgaatttatattgagtcttcaaattaactgaatggatttaaaggggtaccaaggaggggggaaacatcagaatttcccaggcagttgttgcaaggaattggtactaaccgtgactacaacaaaaattcttgattgacttttaaagttatttcctggcattctggtaccttcacccagcctgagtgccctggagagggaacaggaaatgctgatctctacccctgggtgagaccagaacctcagggctgatactgttgagtggcttcctcggtttactctgtgtactgtgaaagtattttcatattttttctgtgtgccagagtgaaaaaggacagcttctgagtgtggtaattgtgcctctagcacccagcctttcaaagcccacctgaaacctgggggtggatgaaagaactagaatagaagactgaagctgggtaggccgctcagtgtccactggcattttgctaaaccgacaaggaaggctgtgtgcttagctctccccagagggagggcgagaagggtgtggtgatg

SEQ ID NO: 800 - DNA, 2253 bp, Homo sapiens
gttagggaaggaagcaggcagatgcccttgtcttctcctttactcccaagccactagaagtctaaggcctttgtggggctgggcccctcaggagcaggtcacaggcagggatctcccacagttgaagacggacatgggcctggtcggatggggaatgaggtggcacgtttctgaaaaggcagctggcccaaggctaaataagtgcagcagccaaagctgctgcccctgtgcacaggccctccgccccctgcatgtggctgtggtccagggcccaggtcggagcactcaccttccaggaggtgccagagcaagggggtagtcttgcctctcactcctgccctctgtggctcaagtaggtgtgtttgtttatagccctgtgagtgtccctttcatacttgcctcagcccattccagcagcttatgtccagctgagaacccctgggtgctcacgtgctgtcttttaaacaatctagatgaggacggggacttggttgccttttccagtgacgaggaattgacaatggccatgtcctacgtgaaggatgacatcttccgaatctacattaaagagaaaaaagagtgccggcgggaccaccgcccaccgtgtgctcaggaggcgccccgcaacatggtgcaccccaatgtgatctgcgatggctgcaatgggcctgtggtaggaacccgctacaagtgcagcgtctgcccagactacgacttgtgtagcgtctgcgagggaaagggcttgcaccgggggcacaccaagctcgcattccccagccccttcgggcacctgtctgagggcttctcgcacagccgctggctccggaaggtgaaacacggacacttcgggtggccaggatgggaaatgggtccaccaggaaactggagcccacgtcctcctcgtgcaggggaggcccgccctggccccacggcagaatcagcttctggtccatcggaggatccgagtgtgaatttcctgaagaacgttggggagagtgtggcagctgcccttagccctctgggcattgaagttgatatcgatgtggagcacggagggaaaagaagccgcctgacccccgtctctccagagagttccagcacagaggagaagagcagctcacagccaagcagctgctgctctgaccccagcaagccgggtgggaatgttgagggcgccacgcagtctctggcggagcagatgaggaagatcgccttggagtccgaggggcgccctgaggaacagatggagtcggataactgttcaggaggagatgatgactggacccatctgtcttcaaaagaagtggacccgtctacaggtgaactccagtccctacagatgccagaatccgaagggccaagctctctggacccctcccaggagggacccacagggctgaaggaagctgccttgtacccacatctcccgccagaggctgacccgcggctgattgagtccctctcccagatgctgtccatgggcttctctgatgaaggcggctggctcaccaggctcctgcagaccaagaactatgacatcggagcggctctggacaccatccagtattcaaagcatcccccgccgttgtgaccacttttgcccacctcttctgcgtgcccctcttctgtctcatagttgtgttaagcttgcgtagaattgcaggtctctgtacgggccagtttctctgccttcttccaggatcaggggttagggtgcaagaagccatttagggcagcaaaacaagtgacatgaagggagggtccctgtgtgtgtgtgtgctgatgtttcctgggtgccctggctccttgcagcagggctgggcctgcgagacccaaggctcactgcagcgcgctcctgacccctccctgcaggggctacgttagcagcccagcacatagcttgcctaatggctttcactttctcttttgttttaaatgactcataggtccctgacatttagttgattattttctgctacagacctggtacactctgattttagataaagtaagcctaggtgttgtcagcaggcaggctggggaggccagtgttgtgggcttcctgctgggactgagaaggctcacgaagggcatccgcaatgttggtttcactgagagctgcctcctggtctcttcaccactgtagttctctcatttccaaaccatcagctgcttttaaaataagatctctttgtagccatcctgttaaatttgtaaacaatctaattaaatggcatcagcactttaaccaat

SEQ ID NO: 801 - DNA, 2913 bp, Homo sapiens
gcgtcggcttccggccgccttccgcggccaccgccgggcccgctcccgccgccgacgcccaggtgcgccaggtgcgggccgggcgggggtcgcgctcacctttctggccgctgagtgccgcgtaccaggacagcgagaggaaggcgcacaggcagaagagcagcagcgtcaggaaggtgccattgcggagcctcatctcctcggtgtctgcgagattaatctctcatggccgctgcacaagaacctggcttttagctgaactaaggagaaagtcctacaacagtttggcgtgcaacatggggcttgagaaaggatgaggacggggacttggttgccttttccagtgacgaggaattgacaatggccatgtcctacgtgaaggatgacatcttccgaatctacattaaagagaaaaaagagtgccggcgggaccaccgcccaccgtgtgctcaggaggcgccccgcaacatggtgcaccccaatgtgatctgcgatggctgcaatgggcctgtggtaggaacccgctacaagtgcagcgtctgcccagactacgacttgtgtagcgtctgcgagggaaagggcttgcaccgggggcacaccaagctcgcattccccagccccttcgggcacctgtctgagggcttctcgcacagccgctggctccggaaggtgaaacacggacacttcgggtggccaggatgggaaatgggtccaccaggaaactggagcccacgtcctcctcgtgcaggggaggcccgccctggccccacggcagaatcagcttctggtccatcggaggatccgagtgtgaatttcctgaagaacgttggggagagtgtggcagctgcccttagccctctgggcattgaagttgatatcgatgtggagcacggagggaaaagaagccgcctgacccccgtctctccagagagttccagcacagaggagaagagcagctcacagccaagcagctgctgctctgaccccagcaagccgggtgggaatgttgagggcgccacgcagtctctggcggagcagatgaggaagatcgccttggagtccgaggggcgccctgaggaacagatggagtcggataactgttcaggaggagatgatgactggacccatctgtcttcaaaagaagtggacccgtctacaggtgaactccagtccctacagatgccagaatccgaagggccaagctctctggacccctcccaggagggacccacagggctgaaggaagctgccttgtacccacatctcccgccagaggctgacccgcggctgattgagtccctctcccagatgctgtccatgggcttctctgatgaaggcggctggctcaccaggctcctgcagaccaagaactatgacatcggagcggctctggacaccatccagtattcaaagcatcccccgccgttgtgaccacttttgcccacctcttctgcgtgcccctcttctgtctcatagttgtgttaagcttgcgtagaattgcaggtctctgtacgggccagtttctctgccttcttccaggatcaggggttagggtgcaagaagccatttagggcagcaaaacaagtgacatgaagggagggtccctgtgtgtgtgtgtgctgatgtttcctgggtgccctggctccttgcagcagggctgggcctgcgagacccaaggctcactgcagcgcgctcctgacccctccctgcaggggctacgttagcagcccagcacatagcttgcctaatggctttcactttctcttttgttttaaatgactcataggtccctgacatttagttgattattttctgctacagacctggtacactctgattttagataaagtaagcctaggtgttgtcagcaggcaggctggggaggccagtgttgtgggcttcctgctgggactgagaaggctcacgaagggcatccgcaatgttggtttcactgagagctgcctcctggtctcttcaccactgtagttctctcatttccaaaccatcagctgcttttaaaataagatctctttgtagccatcctgttaaatttgtaaacaatctaattaaatggcatcagcactttaaccaatgacgtttgcatagagagaaatgattgacagtaagtttattgttaatggttcttacagagtatctttaaaagtgccttaggggaaccctgtccctcctaacaagtgtatctcgattaataacctgccagtcccagatcacacatcatcatcgaagtcttccccagttataaagaggtcacatagtcgtgtgggtcgaggattctgtgcctccaggaccaggggcccaccctctgcccagggagtccttgcgtcccatgaggtcttcccgcaaggcctctcagacccagatgtgacggggtgtgtggcccgaggaagctggacagcggcagtgggcctgctgaggccttctcttgaggcctgtgctctgggggtcccttgcttagcctgtgctggaccagctggcctggggtccctctgaagagaccttggctgctcactgtccacatgtgaactttttctaggtggcaggacaaattgcgcccatttagaggatgtggctgtaacctgctggatgggactccatagctccttcccaggacccctcagctccccggcactgcagtctgcagagttctcctggaggcaggggctgctgccttgtttcaccttccatgtcaggccagcctgtccctgaaagagaagatggccatgccctccatgtgtaagaacaatgccagggcccaggaggaccgcctgccctgcctgggccttggctgggcctctggttctgacactttctgctggaagctgtcaggctgggacaggctttgattttgagggttagcaagacaaagcaaataaatgccttccacctcaccgc

SEQ ID NO: 802 - DNA, 2986 bp, Homo sapiens
agagtagtgaaggggcctctgcagggcggctctcgcgccgcgacgacggtggcgggggcggggagggcgcgagagactccgcccctctcgaggcggggcggggcctccgcgttcgctacaaaagccgcgcggcggctgcgaccgggacggcccgttttccgccagctcgccgctcgctatggcgtcgctcaccgtgaaggcctaccttctgggcaaggaggacgcggcgcgcgagattcgccgcttcagcttctgctgcagccccgagcctgaggcggaagccgaggctgcggcgggtccgggaccctgcgagcggctgctgagccgggtggccgccctgttccccgcgctgcggcctggcggcttccaggcgcactaccgcgatgaggacggggacttggttgccttttccagtgacgaggaattgacaatggccatgtcctacgtgaaggatgacatcttccgaatctacattaaagagaaaaaagagtgccggcgggaccaccgcccaccgtgtgctcaggaggcgccccgcaacatggtgcaccccaatgtgatctgcgatggctgcaatgggcctgtggtaggaacccgctacaagtgcagcgtctgcccagactacgacttgtgtagcgtctgcgagggaaagggcttgcaccgggggcacaccaagctcgcattccccagccccttcgggcacctgtctgagggcttctcgcacagccgctggctccggaaggtgaaacacggacacttcgggtggccaggatgggaaatgggtccaccaggaaactggagcccacgtcctcctcgtgcaggggaggcccgccctggccccacggcagaatcagcttctggtccatcggaggatccgagtgtgaatttcctgaagaacgttggggagagtgtggcagctgcccttagccctctgggcattgaagttgatatcgatgtggagcacggagggaaaagaagccgcctgacccccgtctctccagagagttccagcacagaggagaagagcagctcacagccaagcagctgctgctctgaccccagcaagccgggtgggaatgttgagggcgccacgcagtctctggcggagcagatgaggaagatcgccttggagtccgaggggcgccctgaggaacagatggagtcggataactgttcaggaggagatgatgactggacccatctgtcttcaaaagaagtggacccgtctacaggtgaactccagtccctacagatgccagaatccgaagggccaagctctctggacccctcccaggagggacccacagggctgaaggaagctgccttgtacccacatctcccgccagaggctgacccgcggctgattgagtccctctcccagatgctgtccatgggcttctctgatgaaggcggctggctcaccaggctcctgcagaccaagaactatgacatcggagcggctctggacaccatccagtattcaaagcatcccccgccgttgtgaccacttttgcccacctcttctgcgtgcccctcttctgtctcatagttgtgttaagcttgcgtagaattgcaggtctctgtacgggccagtttctctgccttcttccaggatcaggggttagggtgcaagaagccatttagggcagcaaaacaagtgacatgaagggagggtccctgtgtgtgtgtgtgctgatgtttcctgggtgccctggctccttgcagcagggctgggcctgcgagacccaaggctcactgcagcgcgctcctgacccctccctgcaggggctacgttagcagcccagcacatagcttgcctaatggctttcactttctcttttgttttaaatgactcataggtccctgacatttagttgattattttctgctacagacctggtacactctgattttagataaagtaagcctaggtgttgtcagcaggcaggctggggaggccagtgttgtgggcttcctgctgggactgagaaggctcacgaagggcatccgcaatgttggtttcactgagagctgcctcctggtctcttcaccactgtagttctctcatttccaaaccatcagctgcttttaaaataagatctctttgtagccatcctgttaaatttgtaaacaatctaattaaatggcatcagcactttaaccaatgacgtttgcatagagagaaatgattgacagtaagtttattgttaatggttcttacagagtatctttaaaagtgccttaggggaaccctgtccctcctaacaagtgtatctcgattaataacctgccagtcccagatcacacatcatcatcgaagtcttccccagttataaagaggtcacatagtcgtgtgggtcgaggattctgtgcctccaggaccaggggcccaccctctgcccagggagtccttgcgtcccatgaggtcttcccgcaaggcctctcagacccagatgtgacggggtgtgtggcccgaggaagctggacagcggcagtgggcctgctgaggccttctcttgaggcctgtgctctgggggtcccttgcttagcctgtgctggaccagctggcctggggtccctctgaagagaccttggctgctcactgtccacatgtgaactttttctaggtggcaggacaaattgcgcccatttagaggatgtggctgtaacctgctggatgggactccatagctccttcccaggacccctcagctccccggcactgcagtctgcagagttctcctggaggcaggggctgctgccttgtttcaccttccatgtcaggccagcctgtccctgaaagagaagatggccatgccctccatgtgtaagaacaatgccagggcccaggaggaccgcctgccctgcctgggccttggctgggcctctggttctgacactttctgctggaagctgtcaggctgggacaggctttgattttgagggttagcaagacaaagcaaataaatgccttccacctcaccgcaaa

SEQ ID NO: 803 - DNA, 2000 bp, Homo sapiens
gccagctcgccgctcgctatggcgtcgctcaccgtgaaggcctaccttctgggcaaggaggacgcggcgcgcgagattcgccgcttcagcttctgctgcagccccgagcctgaggcggaagccgaggctgcggcgggtccgggaccctgcgagcggctgctgagccgggtggccgccctgttccccgcgctgcggcctggcggcttccaggcgcactaccgcgatgaggacggggacttggttgccttttccagtgacgaggaattgacaatggccatgtcctacgtgaaggatgacatcttccgaatctacattaaagagaaaaaagagtgccggcgggaccaccgcccaccgtgtgctcaggaggcgccccgcaacatggtgcaccccaatgtgatctgcgatggctgcaatgggcctgtggtaggaacccgctacaagtgcagcgtctgcccagactacgacttgtgtagcgtctgcgagggaaagggcttgcaccgggggcacaccaagctcgcattccccagccccttcgggcacctgtctgagggcttctcgcacagccgctggctccggaaggtgaaacacggacacttcgggtggccaggatgggaaatgggtccaccaggaaactggagcccacgtcctcctcgtgcaggggaggcccgccctggccccacggcagaatcagcttctggtccatcggaggatccgagtgtgaatttcctgaagaacgttggggagagtgtggcagctgcccttagccctctgggcattgaagttgatatcgatgtggagcacggagggaaaagaagccgcctgacccccgtctctccagagagttccagcacagaggagaagagcagctcacagccaagcagctgctgctctgaccccagcaagccgggtgggaatgttgagggcgccacgcagtctctggcggagcagatgaggaagatcgccttggagtccgaggggcgccctgaggaacagatggagtcggataactgttcaggaggagatgatgactggacccatctgtcttcaaaagaagtggacccgtctacaggtgaactccagtccctacagatgccagaatccgaagggccaagctctctggacccctcccaggagggacccacagggctgaaggaagctgccttgtacccacatctcccgccagaggctgacccgcggctgattgagtccctctcccagatgctgtccatgggcttctctgatgaaggcggctggctcaccaggctcctgcagaccaagaactatgacatcggagcggctctggacaccatccagtattcaaagcatcccccgccgttgtgaccacttttgcccacctcttctgcgtgcccctcttctgtctcatagttgtgttaagcttgcgtagaattgcaggtctctgtacgggccagtttctctgccttcttccaggatcaggggttagggtgcaagaagccatttagggcagcaaaacaagtgacatgaagggagggtccctgtgtgtgtgtgtgctgatgtttcctgggtgccctggctccttgcagcagggctgggcctgcgagacccaaggctcactgcagcgcgctcctgacccctccctgcaggggctacgttagcagcccagcacatagcttgcctaatggctttcactttctcttttgttttaaatgactcataggtccctgacatttagttgattattttctgctacagacctggtacactctgattttagataaagtaagcctaggtgttgtcagcaggcaggctggggaggccagtgttgtgggcttcctgctgggactgagaaggctcacgaagggcatccgcaatgttggtttcactgagagctgcctcctggtctcttcaccactgtagttctctcatttccaaaccatcagctgcttttaaaataagatctctttgtagccatcctgttaaatttgtaaacaatctaattaaatggcatcagcactttaacc

SEQ ID NO: 804 - DNA, 628 bp, Homo sapiens
agtggacgcggggagcctgcggggtgggactgcatcgggaaaggggaaggagtcagaggcgagaagggggagagtgtctgtctggctccagccgctgcacgctcttcctgctcaggggactcacggtgaccccggagccactccccagcccagcctccagatgaggacggggacttggttgccttttccagtgacgaggaattgacaatggccatgtcctacgtgaaggatgacatcttccgaatctacattaaagagaaaaaagagtgccggcgggaccaccgcccaccgtgtgctcaggaggcgccccgcaacatggtgcaccccaatgtgatctgcgatggctgcaatgggcctgtggtaggaacccgctacaagtgcagcgtctgcccagactacgacttgtgtagcgtctgcgagggaaagggcttgcaccgggggcacaccaagctcgcattccccagccccttcgggcacctgtctgagggcttctcgcacagccgctggctccggaaggtgaaacacggacacttcgggtggccaggatgggaaatgggtccaccaggaaactggagcccacgtcctcctcgtgcaggggaggcccgccctggccccacggcagaatcag

SEQ ID NO: 805 - DNA, 1506 bp, Homo sapiens
acggcccgttttccgccagctcgccgctcgctatggcgtcgctcaccgtgaaggcctaccttctgggcaaggaggacgcggcgcgcgagattcgccgcttcagcttctgctgcagccccgagcctgaggcggaagccgaggctgcggcgggtccgggaccctgcgagcggctgctgagccgggtggccgccctgttccccgcgctgcggcctggcggcttccaggcgcactaccgcgatgaggacggggacttggttgccttttccagtgacgaggaattgacaatggccatgtcctacgtgaaggatgacatcttccgaatctacattaaagagaaaaaagagtgccggcgggaccaccgcccaccgtgtgctcaggaggcgccccttcgggcacctgtctgagggcttctcgcacagccgctggctccggaaggtgaaacacggacacttcgggtggccaggatgggaaatgggtccaccaggaaactggagcccacgtcctcctcgtgcaggggaggcccgccctggccccacggcagaatcagcttctggtccatcggaggatccgagtgtgaatttcctgaagaacgttggggagagtgtggcagctgcccttagccctctgggcattgaagttgatatcgatgtggagcacggagggaaaagaagccgcctgacccccgtctctccagagagttccagcacagaggagaagagcagctcacagccaagcagctgctgctctgaccccagcaagccgggtgggaatgttgagggcgccacgcagtctctggcggagcagatgaggaagatcgccttggagtccgaggggcgccctgaggaacagatggagtcggataactgttcaggaggagatgatgactggacccatctgtcttcaaaagaagtggacccgtctacaggtgaactccagtccctacagatgccagaatccgaagggccaagctctctggacccctcccaggagggacccacagggctgaaggaagctgccttgtacccacatctcccgccagaggctgacccgcggctgattgagtccctctcccagatgctgtccatgggcttctctgatgaaggcggctggctcaccaggctcctgcagaccaagaactatgacatcggagcggctctggacaccatccagtattcaaagcatcccccgccgttgtgaccacttttgcccacctcttctgcgtgcccctcttctgtctcatagttgtgttaagcttgcgtagaattgcaggtctctgtacgggccagtttctctgccttcttccaggatcaggggttagggtgcaagaagccatttagggcagcaaaacaagtgacatgaagggagggtccctgtgtgtgtgtgtgctgatgtttcctgggtgccctggctccttgcagcagggctgggcctgcgagacccaaggctcactgcagcgcgctcctgacccctccctgcaggggctacgttagcagcccagcacatagc

SEQ ID NO: 806 - DNA, 842 bp, Homo sapiens
tccgcggccaccgccgggcccgctcccgccgccgacgcccaggtgcgccaggtgcgggccgggcgggggtcgcgctcacctttctggccgctgagtgccgcgtaccaggacagcgagaggaaggcgcacaggcagaagagcagcagcgtcaggaaggtgccattgcggagcctcatctcctcggtgtctgcgagattaatctctcatggccgctgcacaagaacctggcttttagctgaactaaggagaaagtcctacaacagtttggcgtgcaacatggggcttgagaaaggatgaggacggggacttggttgccttttccagtgacgaggaattgacaatggccatgtcctacgtgaaggatgacatcttccgaatctacattaaagagaaaaaagagtgccggcgggaccaccgcccaccgtgtgctcaggaggcgccccgcaacatggtgcaccccaatgtgatctgcgatggctgcaatgggcctgtggtaggaacccgctacaagtgcagcgtctgcccagactacgacttgtgtagcgtctgcgagggaaagggcttgcaccgggggcacaccaagctcgcattccccagccccttcgggcacctgtctgagggcttctcgcacagccgctggctccggaaggtgaaacacggacacttcgggtggccaggatgggaaatgggtccaccaggaaactggagcccacgtcctcctcgtgcaggggaggcccgccctggccccacggcagaatcagcttctggtccatcggaggatccgagtgtgaatttcctgaagaacgttggggagagtgtggcagctgcccttagccctctgg

SEQ ID NO: 807 - DNA, 2490 bp, Homo sapiens
atgacgcagggtccgggcgggcgcgcgcccccggcgccccccgcgccccccgagcccgaggcgcccaccaccttctgcgcgttgctgccccgaatgccgcagtggaagttcgcggccccgggcggcttcctgggccgcggcccggcggcggcgcgggcggctggggcctcggggggcgcggacccccaacccgagccggcgggcccggggggcgtcccggcgctggcggccgccgtcctgggcgcctgcgagccccgctgcgccgcgccctgtcccctgcccgcgctcagccgctgtcggggcgcggggtcgcgggggtcgcggggcgggcggggggcggcggggtccggggacgccgccgccgccgccgagtggatccggaagggcagcttcatccacaaacccgcgcacggctggctacaccccgacgccagggtcctggggcccggggtctcctacgtcgtgcggtacatgggctgcatcgaggttctccgctctatgcgctccctggactttaacacgcgcacgcaggtgaccagggaagccatcaaccggctccatgaggccgtgcctggcgtccggggatcctggaagaaaaaggcccccaacaaggccctggcgtccgtcctgggcaagagcaaccttcgctttgccggcatgagcatctccatccacatctccactgatggcctcagcctctccgtgcctgccacgcgccaggtcatcgccaaccaccacatgccgtccatctccttcgcgtcaggcggagacacggacatgacggattacgtggcctacgtcgccaaggaccccatcaaccagagagcctgccacatcctggagtgctgtgagggcctggcacagagcatcatcagcaccgtgggccaagctttcgagctgcgcttcaagcagtacctgcacagcccgcccaaggtggcgctgcccccagaaaggctggcagggccggaggagtcggcctggggggacgaggaggactctttggagcacaattactacaacagcatcccggggaaggagccgccgctgggcgggctagtggactccaggctggccctgacacagccctgcgccctcacggccctcgaccagggcccatctccttctctaagagatgcctgcagcctgccatgggacgtggggtccaccggtacagctccaccgggggacggctacgtgcaggcggacgcccggggccccccggaccacgaggagcacctgtatgtcaacacccagggtctggacgcccccgagccggaggacagccccaaaaaggatctgtttgacatgcgaccctttgaggatgccctgaagttgcatgagtgctcagtggcggcaggcgtgacagcagcccctcttcccttggaggaccagtggcccagcccccctacccgccgggcccctgtggcccccacggaggaacagctgcgtcaggagccctggtaccacggccggatgagccgccgggcggcagagaggatgcttcgagctgacggggacttccttgtgcgagacagcgtcaccaaccccgggcagtatgtcctcaccggcatgcacgccgggcagcccaagcacctgctgctcgtggaccccgagggcgtggtacggacgaaggacgtgctgtttgagagcatcagccacctgatcgaccaccacctgcagaacgggcagcccatcgtggccgccgagagtgagctgcacctgcgtggcgtggtctcacgggagccctgagccaggtgaccgttctcagccctggctcctgcctgttctcagccccggctcctgcctgtcatggccttggggctctcagccctcctcctggatcctggtcaggccgaaccaccgctgcctctccttcctccgcatgagcctctggcatggtccttcctccagctggccccgggctgggcagagcctcctcctgccggggcccctgcccaccccctcctttgcctggagtgagggtgttcataccaaagacggaaccatttcgcctttaaagaaaatatatccagaagcagccgctgcctcggagccctggcccttgggtccccctctcgcctggctggttcggtctaacgccccggagagtcagggctcccaggaccctggggaggaggcggattccgggcctggctgggcttcctcttcccacctgaggactgggtgcacagttgtctttgaggggggacgcttaaggtgctttggggttctcaggccaggatacatgctggcgctgaagtgcaggcagccttgaggtcacctgggatctcggggtagccaggctgctccaagacagtggatatcgaggcagtcgtgaggcccctactccacctgggagcaggggaaggacgtggttgcctggcctgggctgcgcccagcagcttccccccagtcctgccctcccagctgtcgacccagatgggatgttcggatcggtttgtaattaaacctgggaatggccacaagagc

SEQ ID NO: 808 - DNA, 780 bp, Homo sapiens
ggttagtgaggccggaagtgagtgtaataaagtttctccagggaggcagggcccggggagaaagttggagcggtaacctaagctggcagtggcgtgatccggcaccaaatcggcccgcggtgcggtgcggagactccatgaggccctgacggagtttcgctcttatcgtccaggctggagtgcaatggtgcgatctcggctcactgcaacctccgcctcctgagttcaagtgattctcctgcctcagcctcctgagtagctgggattacaggcgcccaccaccacgcccggctaatttttgtatttttagtagagacggggtttccccatgttggctaggctagcctcgaactcctgacctcaggacatgaacaagctgagtggaggcggcgggcgcaggactcgggtggaagggggccagcttgggggcgaggagtggacccgccacgggagctttgtcaataagcccacgcggggctggctgcatcccaacgacaaagtcatgggacccggggtttcctacttggttcggtacatgggttgtgtggaggtcctccagtcaatgcgtgccctggacttcaacacccggactcaggtcaccagggaggccatcagtctggtgtgtgaggctgtgccgggtgctaagggggcgacaaggaggagaaagccctgtagccgcccgctcagctctatcctggggaggagtaacctgaaatttgctggaatgccaatcactctcaccgtctccaccagcagcctcaacctcatggccgcagactg

SEQ ID NO: 809 - DNA, 1692 bp, Homo sapiens
gtttctccagggaggcagggcccggggagaaagttggagcggtaacctaagctggcagtggcgtgatccggcaccaaatcggcccgcggtgcggtgcggagactccatgaggccctggacatgaacaagctgagtggaggcggcgggcgcaggactcgggtggaagggggccagcttgggggcgaggagtggacccgccacgggagctttgtcaataagcccacgcggggctggctgcatcccaacgacaaagtcatgggacccggggtttcctacttggttcggtacatgggttgtgtggaggtcctccagtcaatgcgtgccctggacttcaacacccggactcaggtcaccagggaggccatcagtctggtgtgtgaggctgtgccgggtgctaagggggcgacaaggaggagaaagccctgtagccgcccgctcagctctatcctggggaggagtaacctgaaatttgctggaatgccaatcactctcaccgtctccaccagcagcctcaacctcatggccgcagactgcaaacagatcatcgccaaccaccacatgcaatctatctcatttgcatccggcggggatccggacacagccgagtatgtcgcctatgttgccaaagaccctgtgaatcagagagcctgccacattctggagtgtcccgaagggcttgcccaggatgtcatcagcaccattggccaggccttcgagttgcgcttcaaacaatacctcaggaacccacccaaactggtcacccctcatgacaggatggctggctttgatggctcagcatgggatgaggaggaggaagagccacctgaccatcagtactataatgacttcccggggaaggaaccccccttggggggggtggtagacatgaggcttcgggaaggagccgctccaggggctgctcgacccactgcacccaatgcccagacccccagccacttgggagctacattgcctgtaggacagcctgttgggggagatccagaagtccgcaaacagatgccacctccaccaccctgtccaggcagagagctttttgatgatccctcctatgtcaacgtccagaacctagacaaggcccggcaagcagtgggtggtgctgggccccccaatcctgctatcaatggcagtgcaccccgggacctgtttgacatgaagcccttcgaagatgctcttcgcgtgcctccacctccccagtcggtgtccatggctgagcagctccgaggggagccctggttccatgggaagctgagccggcgggaggctgaggcactgctgcagctcaatggggacttcctggtacgggagagcacgaccacacctggccagtatgtgctcactggcttgcagagtgggcagcctaagcatttgctactggtggaccctgagggtgtgagatggggtttcgccatgttgcccaagctgttcttgaactcccgggctcaagtgatccgcctccctcggcctcccagagtgctgggattacaggcacggaccaccatgcccagcctccacatctttttttgcactgtgtatactcttctgagacatgccaacttcctccaggtcaagaaaggggtatatagctctcagcttcactctttcagggctgatgtcgcctttgccttttctcacttcactgacctgtctattcctacaactgtctctttctag

SEQ ID NO: 810 - DNA, 2288 bp, Homo sapiens
gaagaggctccacgttgggcggggatggggcctgaaactgtctgggtctgagccccaagtacaatccactccggaatgagtctctgtcatcgctggaggaaggggcttctgggtccacccccccggaggagctgccttccccatcagcttcatccctggggcccatcctgcctcctctgcctggggacgatagtcccactaccctgtgctccttcttcccccggatgagcaacctgaggctggccaacccggctggggggcgcccagggtctaagggggagccaggaagggcagctgatgatggggaggggatcgtaggggcagccatgccagactcaggccccctacccctcctccaggacatgaacaagctgagtggaggcggcgggcgcaggactcgggtggaagggggccagcttgggggcgaggagtggacccgccacgggagctttgtcaataagcccacgcggggctggctgcatcccaacgacaaagtcatgggacccggggtttcctacttggttcggtacatgggttgtgtggaggtcctccagtcaatgcgtgccctggacttcaacacccggactcaggtcaccagggaggccatcagtctggtgtgtgaggctgtgccgggtgctaagggggcgacaaggaggagaaagccctgtagccgcccgctcagctctatcctggggaggagtaacctgaaatttgctggaatgccaatcactctcaccgtctccaccagcagcctcaacctcatggccgcagactgcaaacagatcatcgccaaccaccacatgcaatctatctcatttgcatccggcggggatccggacacagccgagtatgtcgcctatgttgccaaagaccctgtgaatcagagagcctgccacattctggagtgtcccgaagggcttgcccaggatgtcatcagcaccattggccaggccttcgagttgcgcttcaaacaatacctcaggaacccacccaaactggtcacccctcatgacaggatggctggctttgatggctcagcatgggatgaggaggaggaagagccacctgaccatcagtactataatgacttcccggggaaggaaccccccttggggggggtggtagacatgaggcttcgggaaggagccgctccaggggctgctcgacccactgcacccaatgcccagacccccagccacttgggagctacattgcctgtaggacagcctgttgggggagatccagaagtccgcaaacagatgccacctccaccaccctgtccagcaggcagagagctttttgatgatccctcctatgtcaacgtccagaacctagacaaggcccggcaagcagtgggtggtgctgggccccccaatcctgctatcaatggcagtgcaccccgggacctgtttgacatgaagcccttcgaagatgctcttcgcgtgcctccacctccccagtcggtgtccatggctgagcagctccgaggggagccctggttccatgggaagctgagccggcgggaggctgaggcactgctgcagctcaatggggacttcctggtacgggagagcacgaccacacctggccagtatgtgctcactggcttgcagagtgggcagcctaagcatttgctactggtggaccctgagggtgtggttcggactaaggatcaccgctttgaaagtgtcagtcaccttatcagctaccacatggacaatcacttgcccatcatctctgcgggcagcgaactgtgtctacagcaacctgtggagcggaaactgtgatctgccctagcgctctcttccagaagatgccctccaatcctttccaccctattccctaactctcgggacctcgtttgggagtgttctgtgggcttggccttgtgtcagagctgggagtagcatggactctgggtttcatatccagctgagtgagagggtttgagtcaaaagcctgggtgagaatcctgcctctccccaaacattaatcaccaaagtattaatgtacagagtggcccctcacctgggcctttcctgtgccaacctgatgccccttccccaagaaggtgagtgcttgtcatggaaaatgtcctgtggtgacaggcccagtggaacagtcacccttctgggcaagggggaacaaatcacacctctgggcttcagggtatcccagacccctctcaacacccgccccccccatgtttaaactttgtgcctttgaccatctcttaggtctaatgatattttatgcaaacagttcttggacccctgaattcaatgaca

SEQ ID NO: 811 - DNA, 3472 bp, Homo sapiens
gaggctccacgttgggcggggatggggcctgaaactgtctgggtctgagctggggagcggaagccacttgtccctctccctccccaggacttctgtgactcctgggccacagaggtccaaccaggctaagggcctggggataccccctgcctggcccccttgcccaaactggcaggggggccaggctgggcagcagcccctctttcacctcaactatggatctcctgccccccaagcccaagtacaatccactccggaatgagtctctgtcatcgctggaggaaggggcttctgggtccacccccccggaggagctgccttccccatcagcttcatccctggggcccatcctgcctcctctgcctggggacgatagtcccactaccctgtgctccttcttcccccggatgagcaacctgaggctggccaacccggctggggggcgcccagggtctaagggggagccaggaagggcagctgatgatggggaggggatcgtaggggcagccatgccagactcaggccccctacccctcctccaggacatgaacaagctgagtggaggcggcgggcgcaggactcgggtggaagggggccagcttgggggcgaggagtggacccgccacgggagctttgtcaataagcccacgcggggctggctgcatcccaacgacaaagtcatgggacccggggtttcctacttggttcggtacatgggttgtgtggaggtcctccagtcaatgcgtgccctggacttcaacacccggactcaggtcaccagggaggccatcagtctggtgtgtgaggctgtgccgggtgctaagggggcgacaaggaggagaaagccctgtagccgcccgctcagctctatcctggggaggagtaacctgaaatttgctggaatgccaatcactctcaccgtctccaccagcagcctcaacctcatggccgcagactgcaaacagatcatcgccaaccaccacatgcaatctatctcatttgcatccggcggggatccggacacagccgagtatgtcgcctatgttgccaaagaccctgtgaatcagagagcctgccacattctggagtgtcccgaagggcttgcccaggatgtcatcagcaccattggccaggccttcgagttgcgcttcaaacaatacctcaggaacccacccaaactggtcacccctcatgacaggatggctggctttgatggctcagcatgggatgaggaggaggaagagccacctgaccatcagtactataatgacttcccggggaaggaaccccccttggggggggtggtagacatgaggcttcgggaaggagccgctccaggggctgctcgacccactgcacccaatgcccagacccccagccacttgggagctacattgcctgtaggacagcctgttgggggagatccagaagtccgcaaacagatgccacctccaccaccctgtccaggcagagagctttttgatgatccctcctatgtcaacgtccagaacctagacaaggcccggcaagcagtgggtggtgctgggccccccaatcctgctatcaatggcagtgcaccccgggacctgtttgacatgaagcccttcgaagatgctcttcgcgtgcctccacctccccagtcggtgtccatggctgagcagctccgaggggagccctggttccatgggaagctgagccggcgggaggctgaggcactgctgcagctcaatggggacttcctggtacgggagagcacgaccacacctggccagtatgtgctcactggcttgcagagtgggcagcctaagcatttgctactggtggaccctgagggtgtggttcggactaaggatcaccgctttgaaagtgtcagtcaccttatcagctaccacatggacaatcacttgcccatcatctctgcgggcagcgaactgtgtctacagcaacctgtggagcggaaactgtgatctgccctagcgctctcttccagaagatgccctccaatcctttccaccctattccctaactctcgggacctcgtttgggagtgttctgtgggcttggccttgtgtcagagctgggagtagcatggactctgggtttcatatccagctgagtgagagggtttgagtcaaaagcctgggtgagaatcctgcctctccccaaacattaatcaccaaagtattaatgtacagagtggcccctcacctgggcctttcctgtgccaacctgatgccccttccccaagaaggtgagtgcttgtcatggaaaatgtcctgtggtgacaggcccagtggaacagtcacccttctgggcaagggggaacaaatcacacctctgggcttcagggtatcccagacccctctcaacacccgccccccccatgtttaaactttgtgcctttgaccatctcttaggtctaatgatattttatgcaaacagttcttggacccctgaattcaatgacagggatgccaacaccttcttggcttctgggacctgtgttcttgctgagcaccctctccggtttgggttgggataacagaggcaggagtggcagctgtcccctctccctggggatatgcaacccttagagattgccccagagccccactcccggccaggcgggagatggacccctcccttgctcagtgcctcctggccggggcccctcaccccaaggggtctgtatatacatttcataaggcctgccctcccatgttgcatgcctatgtactctacgccaaagtgcagcccttcctcctgaagcctctgccctgcctccctttctgggagggcggggtgggggtgactgaatttgggcctcttgtacagttaactctcccaggtggattttgtggaggtgagaaaaggggcattgagactataaagcagtagacaatccccacataccatctgtagagttggaactgcattcttttaaagttttatatgcatatattttagggctgtagacttactttcctattttcttttccattgcttattcttgagcacaaaatgataatcaattattacatttatacatcacctttttgacttttccaagcccttttacagctcttggcattttcctcgcctaggcctgtgaggtaactgggatcgcaccttttataccagagacctgaggcagatgaaatttatttccatctaggactagaaaaacttgggtctcttaccgcgagactgagaggcagaagtcagcccgaatgcctgtcagtttcatggaggggaaacgcaaaacctgcagttcctgagtaccttctacaggcccggcccagcctaggcccggggtggccacaccacagcaagccggccccccctcttttggccttgtggataagggagagttgaccgttttcatcctggcctccttttgctgtttggatgtttccacgggtctcacttataccaaagggaaaactcttcattaaagtccgtatttcttcta

SEQ ID NO: 812 - DNA, 2881 bp, Homo sapiens
agagaagaggctccacgttgggcggggatggggcctgaaactgtctgggtctgagctggggagcggaagccacttgtccctctccctccccaggacttctgtgactcctgggccacagaggtccaaccaggctaagggcctggggataccccctgcctggcccccttgcccaaactggcaggggggccaggctgggcagcagcccctctttcacctcaactatggatctcctgccccccaagcccaagtacaatccactccggaatgagtctctctctatcctggggaggagtaacctgaaatttgctggaatgccaatcactctcaccgtctccaccagcagcctcaacctcatggccgcagactgcaaacagatcatcgccaaccaccacatgcaatctatctcatttgcatccggcggggatccggacacagccgagtatgtcgcctatgttgccaaagaccctgtgaatcagagagcctgccacattctggagtgtcccgaagggcttgcccaggatgtcatcagcaccattggccaggccttcgagttgcgcttcaaacaatacctcaggaacccacccaaactggtcacccctcatgacaggatggctggctttgatggctcagcatgggatgaggaggaggaagagccacctgaccatcagtactataatgacttcccggggaaggaaccccccttggggggggtggtagacatgaggcttcgggaaggagccgctccaggggctgctcgacccactgcacccaatgcccagacccccagccacttgggagctacattgcctgtaggacagcctgttgggggagatccagaagtccgcaaacagatgccacctccaccaccctgtccaggcagagagctttttgatgatccctcctatgtcaacgtccagaacctagacaaggcccggcaagcagtgggtggtgctgggccccccaatcctgctatcaatggcagtgcaccccgggacctgtttgacatgaagcccttcgaagatgctcttcgcgtgcctccacctccccagtcggtgtccatggctgagcagctccgaggggagccctggttccatgggaagctgagccggcgggaggctgaggcactgctgcagctcaatggggacttcctggtacgggagagcacgaccacacctggccagtatgtgctcactggcttgcagagtgggcagcctaagcatttgctactggtggaccctgagggtgtggttcggactaaggatcaccgctttgaaagtgtcagtcaccttatcagctaccacatggacaatcacttgcccatcatctctgcgggcagcgaactgtgtctacagcaacctgtggagcggaaactgtgatctgccctagcgctctcttccagaagatgccctccaatcctttccaccctattccctaactctcgggacctcgtttgggagtgttctgtgggcttggccttgtgtcagagctgggagtagcatggactctgggtttcatatccagctgagtgagagggtttgagtcaaaagcctgggtgagaatcctgcctctccccaaacattaatcaccaaagtattaatgtacagagtggcccctcacctgggcctttcctgtgccaacctgatgccccttccccaagaaggtgagtgcttgtcatggaaaatgtcctgtggtgacaggcccagtggaacagtcacccttctgggcaagggggaacaaatcacacctctgggcttcagggtatcccagacccctctcaacacccgccccccccatgtttaaactttgtgcctttgaccatctcttaggtctaatgatattttatgcaaacagttcttggacccctgaattcaatgacagggatgccaacaccttcttggcttctgggacctgtgttcttgctgagcaccctctccggtttgggttgggataacagaggcaggagtggcagctgtcccctctccctggggatatgcaacccttagagattgccccagagccccactcccggccaggcgggagatggacccctcccttgctcagtgcctcctggccggggcccctcaccccaaggggtctgtatatacatttcataaggcctgccctcccatgttgcatgcctatgtactctacgccaaagtgcagcccttcctcctgaagcctctgccctgcctccctttctgggagggcggggtgggggtgactgaatttgggcctcttgtacagttaactctcccaggtggattttgtggaggtgagaaaaggggcattgagactataaagcagtagacaatccccacataccatctgtagagttggaactgcattcttttaaagttttatatgcatatattttagggctgtagacttactttcctattttcttttccattgcttattcttgagcacaaaatgataatcaattattacatttatacatcacctttttgacttttccaagcccttttacagctcttggcattttcctcgcctaggcctgtgaggtaactgggatcgcaccttttataccagagacctgaggcagatgaaatttatttccatctaggactagaaaaacttgggtctcttaccgcgagactgagaggcagaagtcagcccgaatgcctgtcagtttcatggaggggaaacgcaaaacctgcagttcctgagtaccttctacaggcccggcccagcctaggcccggggtggccacaccacagcaagccggccccccctcttttggccttgtggataagggagagttgaccgttttcatcctggcctccttttgctgtttggatgtttccacgggtctcacttataccaaagggaaaactcttcattaaagtccgtatttcttcta

SEQ ID NO: 813 - DNA, 3059 bp, Homo sapiens
gagtgtaataaagtttctccagggaggcagggcccggggagaaagttggagcggtaacctaagctggcagtggcgtgatccggcaccaaatcggcccgcggtgcggtgcggagactccatgaggccctggacatgaacaagctgagtggaggcggcgggcgcaggactcgggtggaagggggccagcttgggggcgaggagtggacccgccacgggagctttgtcaataagcccacgcggggctggctgcatcccaacgacaaagtcatgggacccggggtttcctacttggttcggtacatgggttgtgtggaggtcctccagtcaatgcgtgccctggacttcaacacccggactcaggtcaccagggaggccatcagtctggtgtgtgaggctgtgccgggtgctaagggggcgacaaggaggagaaagccctgtagccgcccgctcagctctatcctggggaggagtaacctgaaatttgctggaatgccaatcactctcaccgtctccaccagcagcctcaacctcatggccgcagactgcaaacagatcatcgccaaccaccacatgcaatctatctcatttgcatccggcggggatccggacacagccgagtatgtcgcctatgttgccaaagaccctgtgaatcagagagcctgccacattctggagtgtcccgaagggcttgcccaggatgtcatcagcaccattggccaggccttcgagttgcgcttcaaacaatacctcaggaacccacccaaactggtcacccctcatgacaggatggctggctttgatggctcagcatgggatgaggaggaggaagagccacctgaccatcagtactataatgacttcccggggaaggaaccccccttggggggggtggtagacatgaggcttcgggaaggagccgctccaggggctgctcgacccactgcacccaatgcccagacccccagccacttgggagctacattgcctgtaggacagcctgttgggggagatccagaagtccgcaaacagatgccacctccaccaccctgtccaggcagagagctttttgatgatccctcctatgtcaacgtccagaacctagacaaggcccggcaagcagtgggtggtgctgggccccccaatcctgctatcaatggcagtgcaccccgggacctgtttgacatgaagcccttcgaagatgctcttcgcgtgcctccacctccccagtcggtgtccatggctgagcagctccgaggggagccctggttccatgggaagctgagccggcgggaggctgaggcactgctgcagctcaatggggacttcctggtacgggagagcacgaccacacctggccagtatgtgctcactggcttgcagagtgggcagcctaagcatttgctactggtggaccctgagggtgtggttcggactaaggatcaccgctttgaaagtgtcagtcaccttatcagctaccacatggacaatcacttgcccatcatctctgcgggcagcgaactgtgtctacagcaacctgtggagcggaaactgtgatctgccctagcgctctcttccagaagatgccctccaatcctttccaccctattccctaactctcgggacctcgtttgggagtgttctgtgggcttggccttgtgtcagagctgggagtagcatggactctgggtttcatatccagctgagtgagagggtttgagtcaaaagcctgggtgagaatcctgcctctccccaaacattaatcaccaaagtattaatgtacagagtggcccctcacctgggcctttcctgtgccaacctgatgccccttccccaagaaggtgagtgcttgtcatggaaaatgtcctgtggtgacaggcccagtggaacagtcacccttctgggcaagggggaacaaatcacacctctgggcttcagggtatcccagacccctctcaacacccgccccccccatgtttaaactttgtgcctttgaccatctcttaggtctaatgatattttatgcaaacagttcttggacccctgaattcaatgacagggatgccaacaccttcttggcttctgggacctgtgttcttgctgagcaccctctccggtttgggttgggataacagaggcaggagtggcagctgtcccctctccctggggatatgcaacccttagagattgccccagagccccactcccggccaggcgggagatggacccctcccttgctcagtgcctcctggccggggcccctcaccccaaggggtctgtatatacatttcataaggcctgccctcccatgttgcatgcctatgtactctacgccaaagtgcagcccttcctcctgaagcctctgccctgcctccctttctgggagggcggggtgggggtgactgaatttgggcctcttgtacagttaactctcccaggtggattttgtggaggtgagaaaaggggcattgagactataaagcagtagacaatccccacataccatctgtagagttggaactgcattcttttaaagttttatatgcatatattttagggctgtagacttactttcctattttcttttccattgcttattcttgagcacaaaatgataatcaattattacatttatacatcacctttttgacttttccaagcccttttacagctcttggcattttcctcgcctaggcctgtgaggtaactgggatcgcaccttttataccagagacctgaggcagatgaaatttatttccatctaggactagaaaaacttgggtctcttaccgcgagactgagaggcagaagtcagcccgaatgcctgtcagtttcatggaggggaaacgcaaaacctgcagttcctgagtaccttctacaggcccggcccagcctaggcccggggtggccacaccacagcaagccggccccccctcttttggccttgtggataagggagagttgaccgttttcatcctggcctccttttgctgtttggatgtttccacgggtctcacttataccaaagggaaaactcttcattaaagtccgtatttcttcta

SEQ ID NO: 814 - DNA, 3062 bp, Homo sapiens
gagtgtaataaagtttctccagggaggcagggcccggggagaaagttggagcggtaacctaagctggcagtggcgtgatccggcaccaaatcggcccgcggtgcggtgcggagactccatgaggccctggacatgaacaagctgagtggaggcggcgggcgcaggactcgggtggaagggggccagcttgggggcgaggagtggacccgccacgggagctttgtcaataagcccacgcggggctggctgcatcccaacgacaaagtcatgggacccggggtttcctacttggttcggtacatgggttgtgtggaggtcctccagtcaatgcgtgccctggacttcaacacccggactcaggtcaccagggaggccatcagtctggtgtgtgaggctgtgccgggtgctaagggggcgacaaggaggagaaagccctgtagccgcccgctcagctctatcctggggaggagtaacctgaaatttgctggaatgccaatcactctcaccgtctccaccagcagcctcaacctcatggccgcagactgcaaacagatcatcgccaaccaccacatgcaatctatctcatttgcatccggcggggatccggacacagccgagtatgtcgcctatgttgccaaagaccctgtgaatcagagagcctgccacattctggagtgtcccgaagggcttgcccaggatgtcatcagcaccattggccaggccttcgagttgcgcttcaaacaatacctcaggaacccacccaaactggtcacccctcatgacaggatggctggctttgatggctcagcatgggatgaggaggaggaagagccacctgaccatcagtactataatgacttcccggggaaggaaccccccttggggggggtggtagacatgaggcttcgggaaggagccgctccaggggctgctcgacccactgcacccaatgcccagacccccagccacttgggagctacattgcctgtaggacagcctgttgggggagatccagaagtccgcaaacagatgccacctccaccaccctgtccagcaggcagagagctttttgatgatccctcctatgtcaacgtccagaacctagacaaggcccggcaagcagtgggtggtgctgggccccccaatcctgctatcaatggcagtgcaccccgggacctgtttgacatgaagcccttcgaagatgctcttcgcgtgcctccacctccccagtcggtgtccatggctgagcagctccgaggggagccctggttccatgggaagctgagccggcgggaggctgaggcactgctgcagctcaatggggacttcctggtacgggagagcacgaccacacctggccagtatgtgctcactggcttgcagagtgggcagcctaagcatttgctactggtggaccctgagggtgtggttcggactaaggatcaccgctttgaaagtgtcagtcaccttatcagctaccacatggacaatcacttgcccatcatctctgcgggcagcgaactgtgtctacagcaacctgtggagcggaaactgtgatctgccctagcgctctcttccagaagatgccctccaatcctttccaccctattccctaactctcgggacctcgtttgggagtgttctgtgggcttggccttgtgtcagagctgggagtagcatggactctgggtttcatatccagctgagtgagagggtttgagtcaaaagcctgggtgagaatcctgcctctccccaaacattaatcaccaaagtattaatgtacagagtggcccctcacctgggcctttcctgtgccaacctgatgccccttccccaagaaggtgagtgcttgtcatggaaaatgtcctgtggtgacaggcccagtggaacagtcacccttctgggcaagggggaacaaatcacacctctgggcttcagggtatcccagacccctctcaacacccgccccccccatgtttaaactttgtgcctttgaccatctcttaggtctaatgatattttatgcaaacagttcttggacccctgaattcaatgacagggatgccaacaccttcttggcttctgggacctgtgttcttgctgagcaccctctccggtttgggttgggataacagaggcaggagtggcagctgtcccctctccctggggatatgcaacccttagagattgccccagagccccactcccggccaggcgggagatggacccctcccttgctcagtgcctcctggccggggcccctcaccccaaggggtctgtatatacatttcataaggcctgccctcccatgttgcatgcctatgtactctacgccaaagtgcagcccttcctcctgaagcctctgccctgcctccctttctgggagggcggggtgggggtgactgaatttgggcctcttgtacagttaactctcccaggtggattttgtggaggtgagaaaaggggcattgagactataaagcagtagacaatccccacataccatctgtagagttggaactgcattcttttaaagttttatatgcatatattttagggctgtagacttactttcctattttcttttccattgcttattcttgagcacaaaatgataatcaattattacatttatacatcacctttttgacttttccaagcccttttacagctcttggcattttcctcgcctaggcctgtgaggtaactgggatcgcaccttttataccagagacctgaggcagatgaaatttatttccatctaggactagaaaaacttgggtctcttaccgcgagactgagaggcagaagtcagcccgaatgcctgtcagtttcatggaggggaaacgcaaaacctgcagttcctgagtaccttctacaggcccggcccagcctaggcccggggtggccacaccacagcaagccggccccccctcttttggccttgtggataagggagagttgaccgttttcatcctggcctccttttgctgtttggatgtttccacgggtctcacttataccaaagggaaaactcttcattaaagtccgtatttcttcta

SEQ ID NO: 815 - DNA, 1981 bp, Homo sapiens
tgcttttgctgtgagcagccccaagcagctgggcgctccatcagaggcaactatgacttttgcaaagcaaacgtgcaaccccaagcagcggtctcccgggccggggctgcgcggccgccgctgtgctggcttttaacggtgggagggcaccatcctcttgctctgctctcgttctccagaaggctgtcccggggcccccactctccgtcccgctccggggacagtggctcgcctgctatgcgcggcagcccgcgccggggccggcaccagcagcgcccgggcggatgcagcgagcccacggaggggcatgcttccacgcaccaagtataaccgcttcaggaatgactcggtgacatcggtcgatgaccttctccacagcctgtcggtgagcggcggcggaggcaaggtttcggcggcgcgcgcgaccccggcggcggctccctacttggtgtccggcgaggcgctgcgcaaggcgcccgacgatgggcccggcagcctgggccacctgctccacaaggtgtcccacctgaaactctccagctcgggcctccgcggcctgtcgtcggccgcccgggagcgggcgggcgcgcggctctcgggcagctgcagcgcgcccagcctggccgccccggacggcagtgcgccctcggcgccccgcgccccggccatgagcgccgccaggaagggccggcccggcgacgagccgctgcccaggccccctcggggggcgccgcacgccagcgaccaggtgctggggcccggagtcacctacgtggtcaagtacttggggtgcattgaagttctgcgctcaatgaggtctcttgacttcagtacaagaacacaaattaccagggaagccatcagccgcgtctgtgaagctgtgcctggtgcgaagggagccttcaagaagagaaagcctccaagcaaaatgctgtccagcatcttgggaaagagcaacctccagtttgcgggaatgagcatctctctgaccatctccacggccagtctgaacctgcgaactccggactccaaacagatcatagcgaatcaccacatgcggtccatctccttcgcctctgggggagacccggacacaactgactatgttgcatatgtggctaaggaccctgttaatcgcagagcttgtcacattttggaatgctgtgatgggctggcccaggatgtcatcggctccatcggacaagcctttgagctccggtttaagcaatatttacagtgtcctaccaagattcccgctctccatgatcgaatgcagagtctggatgagccatggacggaagaggagggagatggctcagaccacccatactacaacagcatcccaagcaagatgcctcctccagggggctttcttgatactagactgaaacccagaccccatgctcctgacacagcccagtttgcaggaaaagagcagacttattaccagggaagacacttaggagacacttttggcgaagactggcagcaaacacctttaaggcaagggtcctcggacatctacagcacgccagaagggaaactgcacgtggcccccacgggagaagcacccacctacgtcaacactcagcagatcccaccacaggcctggccggctgcggtcagcagtgctgagagcagcccaaggaaagacctctttgacatgaaaccttttgaagatgctctcaagaaccagcccttggggcccgtgttaagcaaggcagcctccgtggagtgcatcagccctgtgtcacctagagccccagatgccaagatgctggaggaactgcaagccgagacttggtaccaaggagagatgagcaggaaggaggcagaggggctgctggagaaagacggagacttcctggtcaggaagagcaccaccaacccgggctcctttgtcctcacgggcatgcacaatggccaggccaagcacctgctgctcgtggacccagaaggcacgagaagtaactcctactga

SEQ ID NO: 816 - DNA, 569 bp, Homo sapiens
cccacgggagaagcacccacctacgtcaacactcagcagatcccaccacaggcctggccggctgcggtcagcagtgctgagagcagcccaaggaaagacctctttgacatgaaaccttttgaagatgctctcaagaaccagcccttggggcccgtgttaagcaaggcagcctccgtggagtgcatcagccctgtgtcacctagagccccagatgccaagatgctggaggaactgcaagccgagacttggtaccaaggagagatgagcaggaaggaggcagaggggctgctggagaaagacggagacttcctggtcaggaagagcaccaccaacccgggctcctttgtcctcacgggcatgcacaatggccaggccaagcacctgctgctcgtggacccagaaggcacgagaagtaactcctactgatgttggccatccctggcactacagctgtatctgaataatcccgtaggtttggctgaatttttcatcttcccgtcaagaaagacattcatctttacctggggcatagtccaagaattgctaagtttaataaatgcagttaaatc

SEQ ID NO: 817 - DNA, 2394 bp, Homo sapiens
tgcttttgctgtgagcagccccaagcagctgggcgctccatcagaggcaactatgacttttgcaaagcaaacgtgcaaccccaagcagcggtctcccgggccggggctgcgcggccgccgctgtgctggcttttaacggtgggagggcaccatcctcttgctctgctctcgttctccagaaggctgtcccggggcccccactctccgtcccgctccggggacagtggctcgcctgctatgcgcggcagcccgcgccggggccggcaccagcagcgcccgggcggatgcagcgagcccacggaggggcatgcttccacgcaccaagtataaccgcttcaggaatgactcggtgacatcggtcgatgaccttctccacagcctgtcggtgagcggcggcggaggcaaggtttcggcggcgcgcgcgaccccggcggcggctccctacttggtgtccggcgaggcgctgcgcaaggcgcccgacgatgggcccggcagcctgggccacctgctccacaaggtgtcccacctgaaactctccagctcgggcctccgcggcctgtcgtcggccgcccgggagcgggcgggcgcgcggctctcgggcagctgcagcgcgcccagcctggccgccccggacggcagtgcgccctcggcgccccgcgccccggccatgagcgccgccaggaagggccggcccggcgacgagccgctgcccaggccccctcggggggcgccgcacgccagcgaccaggtgctggggcccggagtcacctacgtggtcaagtacttggggtgcattgaagttctgcgctcaatgaggtctcttgacttcagtacaagaacacaaattaccagggaagccatcagccgcgtctgtgaagctgtgcctggtgcgaagggagccttcaagaagagaaagcctccaagcaaaatgctgtccagcatcttgggaaagagcaacctccagtttgcgggaatgagcatctctctgaccatctccacggccagtctgaacctgcgaactccggactccaaacagatcatagcgaatcaccacatgcggtccatctccttcgcctctgggggagacccggacacaactgactatgttgcatatgtggctaaggaccctgttaatcgcagagcttgtcacattttggaatgctgtgatgggctggcccaggatgtcatcggctccatcggacaagcctttgagctccggtttaagcaatatttacagtgtcctaccaagattcccgctctccatgatcgaatgcagagtctggatgagccatggacggaagaggagggagatggctcagaccacccatactacaacagcatcccaagcaagatgcctcctccagggggctttcttgatactagactgaaacccagaccccatgctcctgacacagcccagtttgcaggaaaagagcagacttattaccagggaagacacttaggagacacttttggcgaagactggcagcaaacacctttaaggcaagggtcctcggacatctacagcacgccagaagggaaactgcacgtggcccccacgggagaagcacccacctacgtcaacactcagcagatcccaccacaggcctggccggctgcggtcagcagtgctgagagcagcccaaggaaagacctctttgacatgaaaccttttgaagatgctctcaagaaccagcccttggggcccgtgttaagcaaggcagcctccgtggagtgcatcagccctgtgtcacctagagccccagatgccaagatgctggaggaactgcaagccgagacttggtaccaaggagagatgagcaggaaggaggcagaggggctgctggagaaagacggagacttcctggtcaggaagagcaccaccaacccgggctcctttgtcctcacgggcatgcacaatggccaggccaagcacctgctgctcgtggacccagaaggcacgatccggacaaaggacagagtctttgacagtatcagccacctcatcaaccaccacctagaaagcagcctgcccattgtctctgcagggagtgagctgtgtctccagcagccagtggagaggaagcagtgacctggccagcactgctcccagcactgcgcaccaggtcaggaggacctggagtggactagaatcggggctgctggaactgggacagctgcctgtggctcagagccttcttcaaaagcttcaaaaggaaggcttcctttaaggtcaagtttcataaacttggttctgaatttctcatatgcatattaaaggtgtacatacctatacatcctgtacaaattatccctctatatttatattttttaagactaagaaagatgtaagactaatgttctgtgctgtatgtttttaatgaaaaaaaaaaa

SEQ ID NO: 818 - DNA, 692 bp, Homo sapiens
gaaagttggagcggtaacctaagctggcagtggcgtgatccggcaccaaatcggcccgcggtgcggtgcggagactccatgaggccctggacatgaacaagctgagtggaggcggcgggcgcaggactcgggtggaagggggccagcttgggggcgaggagtggacccgccacgggagctttgtcaataagcccacgcggggctggctgcatcccaacgacaaagtcatgggacccggggtttcctacttggttcggtacatgggttgtgtggaggtcctccagtcaatgcgtgccctggacttcaacacccggactcaggtcaccagggaggccatcagtctggtgtgtgaggctgtgccgggtgctaagggggcgacaaggaggagaaagccctgtagccgcccgctcagctctatcctggggaggagtaacctgaaatttgctggaatgccaatcactctcaccgtctccaccagcagcctcaacctcatggccgcagactgcaaacaggacacagccgagtatgtcgcctatgttgccaaagaccctgtgaatcagagagcctgccacattctggagtgtcccgaagggcttgcccaggatgtcatcagcaccattggccaggccttcgagttgcgcttcaaacaatacctcaggaacccacccaaactggtcacccctcatgacagg

SEQ ID NO: 819 - DNA, 780 bp, Homo sapiens
cccagttgagtgggaggcaggcaggcaggcgctgggtctgagtacccctctttccccagggaggccatcagtctggtgtgtgaggctgtgccgggtgctaagggggcgacaaggaggagaaagccctgtagccgcccgctcagctctatcctggggaggagtaacctgaaatttgctggaatgccaatcactctcaccgtctccaccagcagcctcaacctcatggccgcagactgcaaacaggacacagccgagtatgtcgcctatgttgccaaagaccctgtgaatcagagagcctgccacattctggagtgtcccgaagggcttgcccaggatgtcatcagcaccattggccaggccttcgagttgcgcttcaaacaatacctcaggaacccacccaaactggtcacccctcatgacaggatggctggctttgatggctcagcatgggatgaggaggaggaagagccacctgaccatcagtactataatgacttcccggggaaggaaccccccttggggggggtggtagacatgaggcttcgggaaggagccgctccaggggctgctcgacccactgcacccaatgcccagacccccagccacttgggagctacattgcctgtaggacagcctgttgggggagatccagaagtccgcaaacagatgccacctccaccaccctgtccagcaggcagagagctttttgatgatccctcctatgtcaacgtccagaacctagacaaggcccggcaagcagtgggtggtgctgggcccccc

SEQ ID NO: 820 - DNA, 550 bp, Homo sapiens
ggcaggcaggcgctgggtctgagtacccctctttccccagggaggccatcagtctggtgtgtgaggctgtgccgggtgctaagggggcgacaaggaggagaaagccctgtagccgcccgctcagctctatcctggggaggagtaacctgaaatttgctggaatgccaatcactctcaccgtctccaccagcagcctcaacctcatggccgcagactgcaaacagatcatcgccaaccaccacatgcaatctatctcatttgcatccggcggggatccggacacagccgagtatgtcgcctatgttgccaaagaccctgtgaatcagagagcctgccacattctggagtgtcccgaagggcttgcccaggatgtcatcagcaccattggccaggccttcgagttgcgcttcaaacaatacctcaggaacccacccaaactggtcacccctcatgacaggatggctggctttgatggctcagcatgggatgaggaggaggaagagccacctgaccatcagtactataatgacttcccggggaaggaaccccc

SEQ ID NO: 821 - DNA, 1305 bp, Homo sapiens
ggatgaggaggaggaagagccacctgaccatcagtactataatgacttcccggggaaggaaccccccttggggggggtggtagacatgaggcttcgggaaggagccgctccaggggctgctcgacccactgcacccaatgcccagacccccagccacttgggagctacattgcctgtaggacagcctgttgggggagatccagaagtccgcaaacagatgccacctccaccaccctgtccaggcagagagctttttgatgatccctcctatgtcaacgtccagaacctagacaaggcccggcaagcagtgggtggtgctgggccccccaatcctgctatcaatggcagtgcaccccgggacctgtttgacatgaagcccttcgaagatgctcttcgcgtgcctccacctccccagtcggtgtccatggctgagcagctccgaggggagccctggttccatgggaagctgagccggcgggaggctgaggcactgctgcagctcaatggggacttcctggtacgggagagcacgaccacacctggccagtatgtgctcactggcttgcagagtgggcagcctaagcatttgctactggtggaccctgagggtgtgagatggggtttcgccatgttgcccaagctgttcttgaactcccgggctcaagtgatccgcctccctcggcctcccagagtgctgggattacaggcacggaccaccatgcccagcctccacatctttttttgcactgtgtatactcttctgagacatgccaacttcctccaggtcaagaaaggggtatatagctctcagcttcactctttcagggctgatgtcgcctttgccttttctcacttcactgacctgtctattcctacaactgtctctttctagagaagcctcaatgatcaggattgacaggccacactctcccccaccatttttttctcctccttcaagcctcttgtctgtttcaccctcttccaccttggaggctgaggtcttatttgactcttcacctgaattgaccttcttccttcccaccctcccaggttcggactaaggatcaccgctttgaaagtgtcagtcaccttatcagctaccacatggacaatcacttgcccatcatctctgcgggcagcgaactgtgtctacagcaacctgtggagcggaaactgtgatctgccctagcgctctcttccagaagatgccctccaatcctttccaccctattccctaactctcgggacctcgtttgggagtgttctgtgggcttggccttgtgtcagagctgggagtagcatgga

SEQ ID NO: 822 - DNA, 3481 bp, Homo sapiens
agagaagaggctccacgttgggcggggatggggcctgaaactgtctgggtctgagctggggagcggaagccacttgtccctctccctccccaggacttctgtgactcctgggccacagaggtccaaccaggctaagggcctggggataccccctgcctggcccccttgcccaaactggcaggggggccaggctgggcagcagcccctctttcacctcaactatggatctcctgccccccaagcccaagtacaatccactccggaatgagtctctgtcatcgctggaggaaggggcttctgggtccacccccccggaggagctgccttccccatcagcttcatccctggggcccatcctgcctcctctgcctggggacgatagtcccactaccctgtgctccttcttcccccggatgagcaacctgaggctggccaacccggctggggggcgcccagggtctaagggggagccaggaagggcagctgatgatggggaggggatcgtaggggcagccatgccagactcaggccccctacccctcctccaggacatgaacaagctgagtggaggcggcgggcgcaggactcgggtggaagggggccagcttgggggcgaggagtggacccgccacgggagctttgtcaataagcccacgcggggctggctgcatcccaacgacaaagtcatgggacccggggtttcctacttggttcggtacatgggttgtgtggaggtcctccagtcaatgcgtgccctggacttcaacacccggactcaggtcaccagggaggccatcagtctggtgtgtgaggctgtgccgggtgctaagggggcgacaaggaggagaaagccctgtagccgcccgctcagctctatcctggggaggagtaacctgaaatttgctggaatgccaatcactctcaccgtctccaccagcagcctcaacctcatggccgcagactgcaaacagatcatcgccaaccaccacatgcaatctatctcatttgcatccggcggggatccggacacagccgagtatgtcgcctatgttgccaaagaccctgtgaatcagagagcctgccacattctggagtgtcccgaagggcttgcccaggatgtcatcagcaccattggccaggccttcgagttgcgcttcaaacaatacctcaggaacccacccaaactggtcacccctcatgacaggatggctggctttgatggctcagcatgggatgaggaggaggaagagccacctgaccatcagtactataatgacttcccggggaaggaaccccccttggggggggtggtagacatgaggcttcgggaaggagccgctccaggggctgctcgacccactgcacccaatgcccagacccccagccacttgggagctacattgcctgtaggacagcctgttgggggagatccagaagtccgcaaacagatgccacctccaccaccctgtccagcaggcagagagctttttgatgatccctcctatgtcaacgtccagaacctagacaaggcccggcaagcagtgggtggtgctgggccccccaatcctgctatcaatggcagtgcaccccgggacctgtttgacatgaagcccttcgaagatgctcttcgcgtgcctccacctccccagtcggtgtccatggctgagcagctccgaggggagccctggttccatgggaagctgagccggcgggaggctgaggcactgctgcagctcaatggggacttcctggtacgggagagcacgaccacacctggccagtatgtgctcactggcttgcagagtgggcagcctaagcatttgctactggtggaccctgagggtgtggttcggactaaggatcaccgctttgaaagtgtcagtcaccttatcagctaccacatggacaatcacttgcccatcatctctgcgggcagcgaactgtgtctacagcaacctgtggagcggaaactgtgatctgccctagcgctctcttccagaagatgccctccaatcctttccaccctattccctaactctcgggacctcgtttgggagtgttctgtgggcttggccttgtgtcagagctgggagtagcatggactctgggtttcatatccagctgagtgagagggtttgagtcaaaagcctgggtgagaatcctgcctctccccaaacattaatcaccaaagtattaatgtacagagtggcccctcacctgggcctttcctgtgccaacctgatgccccttccccaagaaggtgagtgcttgtcatggaaaatgtcctgtggtgacaggcccagtggaacagtcacccttctgggcaagggggaacaaatcacacctctgggcttcagggtatcccagacccctctcaacacccgccccccccatgtttaaactttgtgcctttgaccatctcttaggtctaatgatattttatgcaaacagttcttggacccctgaattcaatgacagggatgccaacaccttcttggcttctgggacctgtgttcttgctgagcaccctctccggtttgggttgggataacagaggcaggagtggcagctgtcccctctccctggggatatgcaacccttagagattgccccagagccccactcccggccaggcgggagatggacccctcccttgctcagtgcctcctggccggggcccctcaccccaaggggtctgtatatacatttcataaggcctgccctcccatgttgcatgcctatgtactctacgccaaagtgcagcccttcctcctgaagcctctgccctgcctccctttctgggagggcggggtgggggtgactgaatttgggcctcttgtacagttaactctcccaggtggattttgtggaggtgagaaaaggggcattgagactataaagcagtagacaatccccacataccatctgtagagttggaactgcattcttttaaagttttatatgcatatattttagggctgtagacttactttcctattttcttttccattgcttattcttgagcacaaaatgataatcaattattacatttatacatcacctttttgacttttccaagcccttttacagctcttggcattttcctcgcctaggcctgtgaggtaactgggatcgcaccttttataccagagacctgaggcagatgaaatttatttccatctaggactagaaaaacttgggtctcttaccgcgagactgagaggcagaagtcagcccgaatgcctgtcagtttcatggaggggaaacgcaaaacctgcagttcctgagtaccttctacaggcccggcccagcctaggcccggggtggccacaccacagcaagccggccccccctcttttggccttgtggataagggagagttgaccgttttcatcctggcctccttttgctgtttggatgtttccacgggtctcacttataccaaagggaaaactcttcattaaagtccgtatttcttcta

SEQ ID NO: 823 - DNA, 2415 bp, Homo sapiens
gcaggcaggctcctgcagtaactcttgagctggctcagggagcgcacttccttctcagccagcgcgtcgccccctgcatccgtggcctccactggagctgggcaggaccctacccagtgaatctggagaaaacaaacttgggagacagacgaaagcttagggcacattggaggacagcgcagctgtggctcccatttttggagatgcagtcgaatttgagctcacagggaggtgtggttgcctcctggggatggaaaggcttcctttctccacctctgtaactggtgcttctgagaagtaaatggtatttggatcctgacctcagacgcgaatttgggtcttctgtgcttaggagcagaaagagcccaggaggggcctgttcctttacttcttgggggaaacgcaatgcgtggcctgacttctcatgacgggaaaggctactccaccttctctgtactcctggaggggagtcttgttcacatgtttaccagcggccaggacaaggaagagaaaagaaatgagccgtcagactgctacagcattacctaccggtacctcgaagtgtccaccatcccagagggtgcctgccctgactggcacaactgcatccaacaatgacttggcgagtctttttgagtgtccagtctgctttgactatgtgttaccgcccattcttcaatgtcagagtggccatcttgtttgtagcaactgtcgcccaaagctcacatgttgtccaacttgccggggccctttgggatccattcgcaacttggctatggagaaagtggctaattcagtacttttcccctgtaaatatgcgtcttctggatgtgaaataactctgccacacacagaaaaagcagaccatgaagagctctgtgagtttaggccttattcctgtccgtgccctggtgcttcctgtaaatggcaaggctctctggatgctgtaatgccccatctgatgcatcagcataagtccattacaaccctacagggagaggatatagtttttcttgctacagacattaatcttcctggtgctgttgactgggtgatgatgcagtcctgttttggctttcacttcatgttagtcttagagaaacaggaaaaatacgatggtcaccagcagttcttcgcaatcgtacagctgataggaacacgcaagcaagctgaaaattttgcttaccgacttgagctaaatggtcataggcgacgattgacttgggaagcgactcctcgatctattcatgaaggaattgcaacagccattatgaatagcgactgtctagtctttgacaccagcattgcacagctttttgcagaaaatggcaatttaggcatcaatgtaactatttccatgtgttgaaatggcaatcaaacattttctggccagtgtttaaaacttcagtttcacagaaaataaggcacccatctgtctgccaacctaaaactctttcggtaggtggaagctagacacatgaaggtaaataaaaagaaaggctgttaaatacaggaaacagttgcatgtagtaacactaatatatttaaaaataagtcaacagtaaaccactgaaaaaatatatgtatatacacccaagatgggcatcttttgtattaagaaaggaagcattgtaaaataattctgagttttgtgtttgttgtagattgattgtattgttgaaaaagtttgtttttgcgtgggagtgtgtgcctgcgtgggtgtgtgcgtgtttgggtttttttcctttaactgacaagccatcttgagtggtcatgggccactgcttttccctttgtgagtcaatacatagtgctgctgtgtgctttttttgtgtgtatttgctaatttttattaattttagtttttcattaaataaatttgacttttctgtaattcaggtttttcctttttttgtaccattttaaagttagtatcttttgatatgcatatttgtttatggtaaaaaatttataacgtgttcaatattttcttttcccccattaatcagttcattagaaatattttaaaatcagctattttgtgaagccatgagttccagaaagtaaaggtgacatcggaaaaataatcaaaagctatttaaagcatctataaggtgctctctttctgtcttctacagatgagtcacacctttgagcttaatctttgaaaggttagagaataaattgatttttataaatactgcaaatcaggcttttgtttcctttttcagatatcttggacaaatcacatattttaaaatttgttcttgtatttattggttttgcagaagaaggcatcgtcatgcacagtatttgtaattaaaagcaaatcatttgtttaaaaaggcagtttgcaaaaaatgtttttggtcttttataattctcattaaaagaatatctggcaaattaaaaaaa

SEQ ID NO: 824 - DNA, 3352 bp, Homo sapiens
tttcacccccaagacaaatagtggcctgccattttccagcccaggtagcttcctgggaaaagttgcttgttttatctttgactcagcctggctagttacattgtcgattatttcttccagatgatatttacctgttaaataatgtttattactctgctgatgaatgttttcagcaacgctggagaaccctaggctgcaaggggttcttcacctgttgactccatcccccacccccagtatggcatatatctctgccgtgctatcatctttattctttcctttttcattgtctcttcctgactgtcctcctttgttcattatgtctgacacatattgtggattgaaagtagaacagaaagatatactttctctaccagactaaaaagttttgagatggccctccatttctcccatgcctcacttcaccttagttgtgtttttatttatttttatattttcgccaccttcactagcgagtacatcccctcactcttgaggtgggcactgatcagtaggaaataagattaatacctggctggtgataatttggggggaagacttaattagatagagatggataatgggatggcagcagacctttccccttgtgacccttcccctcatttccaaaatacacctctagagtagataattgcttaccattaagaagagttaatggaaggtgatactctgattctttggcattggaactacattcaatccgcggtatcctcggattagttctaggacccccttctccataccaaaacctgaggatgctcaagtccctgatagaaaatggtgtcatatttgtatgtgcatattctcttgtataatttaagtgatctctggattacttaatacaatgtaaacaatatgtaaatagttgttatagactgtattttaaaaattttgtattctttataaatttttctgaatattttcaatccatggctggtgaagtcctcggatgcagaccgtgtggatacagagtgccgattttatacaggagttcacctgtaactccctgtacctatcaacagctgactccaaattagaaagaaatagagtaagggagcctcagggagagtcctagcaaaacggattcgattaaacttcagttccttgtatagtttctttagttgtttatggtccattttctattttagcatttattattctatgtagtctatccaaagacgattaagggagttccacatgttttccggaacattttgaaaagagagcttatccagtgtacagatcctaataaagtgcacattcagtgtaattttatttttttaatatcttttttaatcctatttttcttcctcttttgctcagtaaattttgtatgaaactttaaaaggacttatggcatgtaaacattatttataaagtaagtcatggttataattatttttctcctgcctccttatgtatttatttcagaaatgagccgtcagactgctacagcattacctaccggtacctcgaagtgtccaccatcccagagggtgcctgccctgactggcacaactgcatccaacaatgacttggcgagtctttttgagtgtccagtctgctttgactatgtgttaccgcccattcttcaatgtcagagtggccatcttgtttgtagcaactgtcgcccaaagctcacatgttgtccaacttgccggggccctttgggatccattcgcaacttggctatggagaaagtggctaattcagtacttttcccctgtaaatatgcgtcttctggatgtgaaataactctgccacacacagaaaaagcagaccatgaagagctctgtgagtttaggccttattcctgtccgtgccctggtgcttcctgtaaatggcaaggctctctggatgctgtaatgccccatctgatgcatcagcataagtccattacaaccctacagggagaggatatagtttttcttgctacagacattaatcttcctggtgctgttgactgggtgatgatgcagtcctgttttggctttcacttcatgttagtcttagagaaacaggaaaaatacgatggtcaccagcagttcttcgcaatcgtacagctgataggaacacgcaagcaagctgaaaattttgcttaccgacttgagctaaatggtcataggcgacgattgacttgggaagcgactcctcgatctattcatgaaggaattgcaacagccattatgaatagcgactgtctagtctttgacaccagcattgcacagctttttgcagaaaatggcaatttaggcatcaatgtaactatttccatgtgttgaaatggcaatcaaacattttctggccagtgtttaaaacttcagtttcacagaaaataaggcacccatctgtctgccaacctaaaactctttcggtaggtggaagctagacacatgaaggtaaataaaaagaaaggctgttaaatacaggaaacagttgcatgtagtaacactaatatatttaaaaataagtcaacagtaaaccactgaaaaaatatatgtatatacacccaagatgggcatcttttgtattaagaaaggaagcattgtaaaataattctgagttttgtgtttgttgtagattgattgtattgttgaaaaagtttgtttttgcgtgggagtgtgtgcctgcgtgggtgtgtgcgtgtttgggtttttttcctttaactgacaagccatcttgagtggtcatgggccactgcttttccctttgtgagtcaatacatagtgctgctgtgtgctttttttgtgtgtatttgctaatttttattaattttagtttttcattaaataaatttgacttttctgtaattcaggtttttcctttttttgtaccattttaaagttagtatcttttgatatgcatatttgtttatggtaaaaaatttataacgtgttcaatattttcttttcccccattaatcagttcattagaaatattttaaaatcagctattttgtgaagccatgagttccagaaagtaaaggtgacatcggaaaaataatcaaaagctatttaaagcatctataaggtgctctctttctgtcttctacagatgagtcacacctttgagcttaatctttgaaaggttagagaataaattgatttttataaatactgcaaatcaggcttttgtttcctttttcagatatcttggacaaatcacatattttaaaatttgttcttgtatttattggttttgcagaagaaggcatcgtcatgcacagtatttgtaattaaaagcaaatcatttgtttaaaaaggcagtttgcaaaaaatgtttttggtcttttataattctcattaaaagaatatctggcaaattaaaaaaa

SEQ ID NO: 825 - DNA, 2147 bp, Homo sapiens
cagtgtgtggtatttagcgggggcgcgcggcgggctcgaggacgcgcgaaacggcggcggcggcggcggccaggggggagccggggcggccgttgcggggcgcgctctcgagaggcggcggcggcccagggtgtcccgtcggtctcggcgccgggaagaggcggtggcgctgcccgcggtggcgggggttggcgacggagcgcgttggtgccaggaccggggtccgaggcgcgctctccgcccacagaaatgagccgtcagactgctacagcattacctaccggtacctcgaagtgtccaccatcccagagggtgcctgccctgactggcacaactgcatccaacaatgacttggcgagtctttttgagtgtccagtctgctttgactatgtgttaccgcccattcttcaatgtcagagtggccatcttgtttgtagcaactgtcgcccaaagctcacatgttgtccaacttgccggggccctttgggatccattcgcaacttggctatggagaaagtggctaattcagtacttttcccctgtaaatatgcgtcttctggatgtgaaataactctgccacacacagaaaaagcagaccatgaagagctctgtgagtttaggccttattcctgtccgtgccctggtgcttcctgtaaatggcaaggctctctggatgctgtaatgccccatctgatgcatcagcataagtccattacaaccctacagggagaggatatagtttttcttgctacagacattaatcttcctggtgctgttgactgggtgatgatgcagtcctgttttggctttcacttcatgttagtcttagagaaacaggaaaaatacgatggtcaccagcagttcttcgcaatcgtacagctgataggaacacgcaagcaagctgaaaattttgcttaccgacttgagctaaatggtcataggcgacgattgacttgggaagcgactcctcgatctattcatgaaggaattgcaacagccattatgaatagcgactgtctagtctttgacaccagcattgcacagctttttgcagaaaatggcaatttaggcatcaatgtaactatttccatgtgttgaaatggcaatcaaacattttctggccagtgtttaaaacttcagtttcacagaaaataaggcacccatctgtctgccaacctaaaactctttcggtaggtggaagctagacacatgaaggtaaataaaaagaaaggctgttaaatacaggaaacagttgcatgtagtaacactaatatatttaaaaataagtcaacagtaaaccactgaaaaaatatatgtatatacacccaagatgggcatcttttgtattaagaaaggaagcattgtaaaataattctgagttttgtgtttgttgtagattgattgtattgttgaaaaagtttgtttttgcgtgggagtgtgtgcctgcgtgggtgtgtgcgtgtttgggtttttttcctttaactgacaagccatcttgagtggtcatgggccactgcttttccctttgtgagtcaatacatagtgctgctgtgtgctttttttgtgtgtatttgctaatttttattaattttagtttttcattaaataaatttgacttttctgtaattcaggtttttcctttttttgtaccattttaaagttagtatcttttgatatgcatatttgtttatggtaaaaaatttataacgtgttcaatattttcttttcccccattaatcagttcattagaaatattttaaaatcagctattttgtgaagccatgagttccagaaagtaaaggtgacatcggaaaaataatcaaaagctatttaaagcatctataaggtgctctctttctgtcttctacagatgagtcacacctttgagcttaatctttgaaaggttagagaataaattgatttttataaatactgcaaatcaggcttttgtttcctttttcagatatcttggacaaatcacatattttaaaatttgttcttgtatttattggttttgcagaagaaggcatcgtcatgcacagtatttgtaattaaaagcaaatcatttgtttaaaaaggcagtttgcaaaaaatgtttttggtcttttataattctcattaaaagaatatctggcaaattaaaaaaa

SEQ ID NO: 826 - DNA, 906 bp, Homo sapiens
taatacgactcactatagggaaataagagagaaaagaagagtaagaagaaatataagagccaccatggcggctctgaagagttggctgtcgcgcagcgtaacttcattcttcaggtacagacagtgtttgtgtgttcctgttgtggctaactttaagaagcggtgtttctcagaattgataagaccatggcacaaaactgtgacgattggctttggagtaaccctgtgtgcggttcctattgcacagaaatcagagcctcattcccttagtagtgaagcattgatgaggagagcagtgtctttggtaacagatagcacctctacctttctctctcagaccacatatgcgttgattgaagctattactgaatatactaaggctgtttataccttaacttctctttaccgacaatatacaagtttacttgggaaaatgaattcagaggaggaagatgaagtgtggcaggtgatcataggagccagagctgagatgacttcaaaacaccaagagtacttgaagctggaaaccacttggatgactgcagttggtctttcagagatggcagcagaagctgcatatcaaactggcgcagatcaggcctctataaccgccaggaatcacattcagctggtgaaactgcaggtggaagaggtgcaccagctctcccggaaagcagaaaccaagctggcagaagcacagatagaagagctccgtcagaaaacacaggaggaaggggaggagcgggctgagtcggagcaggaggcctacctgcgtgaggattgataataggctggagcctcggtggccatgcttcttgccccttgggcctccccccagcccctcctccccttcctgcacccgtacccccgtggtctttgaataaagtctgagtgggcggctctaga

SEQ ID NO: 827 - DNA, 1316 bp, Homo sapiens
acttccggcgtgtgcgtctggcgtccgcgcgctgcacaatggcggctctgaagagttggctgtcgcgcagcgtaacttcattcttcaggttcctgcttggctcgagtttgagtttacagcccctgcaagtaaatccaagagcctgttacagattggcggtcgtgccttatgaaatctgacttctacttccagaaatcagagcctcattcccttagtagtgaagcattgatgaggagagcagtgtctttggtaacagatagcacctctacctttctctctcagaccacatatgcgttgattgaagctattactgaatatactaaggctgtttataccttaacttctctttaccgacaatatacaagtttacttgggaaaatgaattcagaggaggaagatgaagtgtggcaggtgatcataggagccagagctgagatgacttcaaaacaccaagagtacttgaagctggaaaccacttggatgactgcagttggtctttcagagatggcagcagaagctgcatatcaaactggcgcagatcaggcctctataaccgccaggaatcacattcagctggtgaaactgcaggtggaagaggtgcaccagctctcccggaaagcagaaaccaagctggcagaagcacagatagaagagctccgtcagaaaacacaggaggaaggggaggagcgggctgagtcggagcaggaggcctacctgcgtgaggattgagggcctgagcacactgccctgtctccccactcagtggggaaagcaggggcagatgccaccctgcccagggttggcatgactgtctgtgcaccgagaagaggcggcagatcctgccctggccaatcaggcgagacgcctttgtgagctgtgagtgcctcctgtggtctcaggcttgcgctggacctggttcttagcccttgggcactgcaccctgtttaacatttcaccccactctgtacagctgctcttacccattttttttacctcacacccaaagcattttgcctacctgggtcagagagaggagtcctttttgtcatgcccttaagttcagcaactgtttaacctgttttcagtcttatttacgtcgtcaaaaatgatttagtacttgttccctctgttgggatgccagttgtggcagggggaggggaacctgtccagtttgtacgatttctttgtatgtatttctgatgtgttctctgatctgcccccactgtcctgtgaggacagctgaggccaaggagtgaaaaacctattactactaagagaaggggtgcagagtgtttacctggtgctctcaacaggac

SEQ ID NO: 828 - DNA, 1338 bp, Homo sapiens
acttccggcgtgtgcgtctggcgtccgcgcgctgcacaatggcggctctgaagagttggctgtcgcgcagcgtaacttcattcttcaggtacagacagtgtttgtgtgttcctgttgtggctaactttaagaagcggtgtttctcagaattgataagaccatggcacaaaactgtgacgattggctttggagtaaccctgtgtgcggttcctattgcacaggctgtttataccttaacttctctttaccgacaatatacaagtttacttgggaaaatgaattcagaggaggaagatgaagtgtggcaggtgatcataggagccagagctgagatgacttcaaaacaccaagagtacttgaagctggaaaccacttggatgactgcagttggtctttcagagatggcagcagaagctgcatatcaaactggcgcagatcaggcctctataaccgccaggaatcacattcagctggtgaaactgcaggtggaagaggtgcaccagctctcccggaaagcagaaaccaagctggcagaagcacagatagaagagctccgtcagaaaacacaggaggaaggggaggagcgggctgagtcggagcaggaggcctacctgcgtgaggattgagggcctgagcacactgccctgtctccccactcagtggggaaagcaggggcagatgccaccctgcccagggttggcatgactgtctgtgcaccgagaagaggcggcagatcctgccctggccaatcaggcgagacgcctttgtgagctgtgagtgcctcctgtggtctcaggcttgcgctggacctggttcttagcccttgggcactgcaccctgtttaacatttcaccccactctgtacagctgctcttacccattttttttacctcacacccaaagcattttgcctacctgggtcagagagaggagtcctttttgtcatgcccttaagttcagcaactgtttaacctgttttcagtcttatttacgtcgtcaaaaatgatttagtacttgttccctctgttgggatgccagttgtggcagggggaggggaacctgtccagtttgtacgatttctttgtatgtatttctgatgtgttctctgatctgcccccactgtcctgtgaggacagctgaggccaaggagtgaaaaacctattactactaagagaaggggtgcagagtgtttacctggtgctctcaacaggacttaacatcaacaggacttaacacaggcctcttgttccttcctttctttccgtttctctattgtatccaaaggagaagagtgtaagattttgtttgcatctgaaagagaaaatgcgtctctcctgg

SEQ ID NO: 829 - DNA, 2111 bp, Homo sapiens
acgcggaggttgtaattggtctctagaccacacctagttgttgagtgccgctgcttgaaaatctcagttctgccgagatcgcagaatacacacaagctacctttgggcaccagagcagacagaaccgcggagcttcagggtggaagattcgtggaaactttgccaaggccaggacctcgtgtgttcccgtccgcccctctgggacggcgccagcccggcaggccgccgaccgtcctggggctcccgcgcagcgcgatgccggcctcgtccaccgtccacgtgctgcagctgctgcgggagctgctcgccttcgtgctcctcagctacacggtgctcatcggggcgctgctgctggccggctggaccacttacttcctggtgctgaagtgacagcgccgtcgccgcgcccggccccgcctcccgcccggccccgcctcccgcccggccccgcctccctaactcaccaggaaattcccttcaagccctggcccgaactgagtccccgcccacccgccagcgtcacggcgcccgactcagctccgcgccggacccacctccgcgccctcaggccctgcatatgccccgccccgcgcggaagttccggcggttggttgccttgcgcggccgttacagcctttgccctaagcctcgccccctttccccctgcctgcccaatcccgactgcttccttgggtgggggcgtggctatggggcgaggcgctctcaggtggaggccgtgccccgctccgcgctcacgaagctgcgtcacttccggcgtgtgcgtctggcgtccgcgcgctgcacaatggcggctctgaagagttggctgtcgcgcagcgtaacttcattcttcaggtacagacagtgtttgtgtgttcctgttgtggctaactttaagaagcggtgtttctcagaattgataagaccatggcacaaaactgtgacgattggctttggagtaaccctgtgtgcggttcctattgcacaggctgtttataccttaacttctctttaccgacaatatacaagtttacttgggaaaatgaattcagaggaggaagatgaagtgtggcaggtgatcataggagccagagctgagatgacttcaaaacaccaagagtacttgaagctggaaaccacttggatgactgcagttggtctttcagagatggcagcagaagctgcatatcaaactggcgcagatcaggcctctataaccgccaggaatcacattcagctggtgaaactgcaggtggaagaggtgcaccagctctcccggaaagcagaaaccaagctggcagaagcacagatagaagagctccgtcagaaaacacaggaggaaggggaggagcgggctgagtcggagcaggaggcctacctgcgtgaggattgagggcctgagcacactgccctgtctccccactcagtggggaaagcaggggcagatgccaccctgcccagggttggcatgactgtctgtgcaccgagaagaggcggcagatcctgccctggccaatcaggcgagacgcctttgtgagctgtgagtgcctcctgtggtctcaggcttgcgctggacctggttcttagcccttgggcactgcaccctgtttaacatttcaccccactctgtacagctgctcttacccattttttttacctcacacccaaagcattttgcctacctgggtcagagagaggagtcctttttgtcatgcccttaagttcagcaactgtttaacctgttttcagtcttatttacgtcgtcaaaaatgatttagtacttgttccctctgttgggatgccagttgtggcagggggaggggaacctgtccagtttgtacgatttctttgtatgtatttctgatgtgttctctgatctgcccccactgtcctgtgaggacagctgaggccaaggagtgaaaaacctattactactaagagaaggggtgcagagtgtttacctggtgctctcaacaggacttaacatcaacaggacttaacacaggcctcttgttccttcctttctttccgtttctctattgtatccaaaggagaagagtgtaagattttgtttgcatctgaaagagaaaatgcgtctctcctggggtcct

SEQ ID NO: 830 - DNA, 2250 bp, Homo sapiens
gagctcggggaccacgcggaggttgtaattggtctctagaccacacctagttgttgagtgccgctgcttgaaaatctcagttctgccgagatcgcagaatacacacaagctacctttgggcaccagagcagacagaaccgcggagcttcagggtggaagattcgtggaaactttgccaaggccaggacctcgtgtgttcccgtccgcccctctgggacggcgccagcccggcaggccgccgaccgtcctggggctcccgcgcagcgcgatgccggcctcgtccaccgtccacgtgctgcagctgctgcgggagctgctcgccttcgtgctcctcagctacacggtgctcatcggggcgctgctgctggccggctggaccacttacttcctggtgctgaagtgacagcgccgtcgccgcgcccggccccgcctcccgcccggccccgcctcccgcccggccccgcctccctaactcaccaggaaattcccttcaagccctggcccgaactgagtccccgcccacccgccagcgtcacggcgcccgactcagctccgcgccggacccacctccgcgccctcaggccctgcatatgccccgccccgcgcggaagttccggcggttggttgccttgcgcggccgttacagcctttgccctaagcctcgccccctttccccctgcctgcccaatcccgactgcttccttgggtgggggcgtggctatggggcgaggcgctctcaggtggaggccgtgccccgctccgcgctcacgaagctgcgtcacttccggcgtgtgcgtctggcgtccgcgcgctgcacaatggcggctctgaagagttggctgtcgcgcagcgtaacttcattcttcaggtacagacagtgtttgtgtgttcctgttgtggctaactttaagaagcggtgtttctcagaattgataagaccatggcacaaaactgtgacgattggctttggagtaaccctgtgtgcggttcctattgcacagaaatcagagcctcattcccttagtagtgaagcattgatgaggagagcagtgtctttggtaacagatagcacctctacctttctctctcagaccacatatgcgttgattgaagctattactgaatatactaaggctgtttataccttaacttctctttaccgacaatatacaagtttacttgggaaaatgaattcagaggaggaagatgaagtgtggcaggtgatcataggagccagagctgagatgacttcaaaacaccaagagtacttgaagctggaaaccacttggatgactgcagttggtctttcagagatggcagcagaagctgcatatcaaactggcgcagatcaggcctctataaccgccaggaatcacattcagctggtgaaactgcaggtggaagaggtgcaccagctctcccggaaagcagaaaccaagctggcagaagcacagatagaagagctccgtcagaaaacacaggaggaaggggaggagcgggctgagtcggagcaggaggcctacctgcgtgaggattgagggcctgagcacactgccctgtctccccactcagtggggaaagcaggggcagatgccaccctgcccagggttggcatgactgtctgtgcaccgagaagaggcggcagatcctgccctggccaatcaggcgagacgcctttgtgagctgtgagtgcctcctgtggtctcaggcttgcgctggacctggttcttagcccttgggcactgcaccctgtttaacatttcaccccactctgtacagctgctcttacccattttttttacctcacacccaaagcattttgcctacctgggtcagagagaggagtcctttttgtcatgcccttaagttcagcaactgtttaacctgttttcagtcttatttacgtcgtcaaaaatgatttagtacttgttccctctgttgggatgccagttgtggcagggggaggggaacctgtccagtttgtacgatttctttgtatgtatttctgatgtgttctctgatctgcccccactgtcctgtgaggacagctgaggccaaggagtgaaaaacctattactactaagagaaggggtgcagagtgtttacctggtgctctcaacaggacttaacatcaacaggacttaacacaggcctcttgttccttcctttctttccgtttctctattgtatccaaaggagaagagtgtaagattttgtttgcatctgaaagagaaaatgcgtctctcctgg

SEQ ID NO: 831 - DNA, 2569 bp, Homo sapiens
aagctgcgtcacttccggcgtgtgcgtctggcgtccgcgcgctgcacaatggcggctctgaagagttggctgtcgcgcagcgtaacttcattcttcaggtaccgctgcggccgcgtagaggggacaggaccagagggagggaccgacgcggacagcgctgtggcccggcccacggcgcccgccttccttacgcgctcatctctcgtccgcccagctgggtcgcggcgtctcgctccggtcgggaggactgaggacagccccgcctccgccccctgggtcaagcccggcttccttttcagttcgtccatcttctagaaacgagtccccgagaccccgggctgccttcttggggctgctccgcctcctgaccagccctcgtcagccactcgaagtccctgaggagacgtggagaggaggagggacacggcatggggggagtccgggaagggagacgagcgtctgaagacgtcctcccgagggcagaaggggccgggggagctggcgcagggctctctacctagcgctgcaggctcctgggcgattgtagcgggaccgtcacacacaactggcacccaggccaggggtccagagctaaattctgcctgcaggagcggttattgtggcatccgtttctaaaaagtttaaaggcaacattttattttattttaatttttttgagacaagatctgcctctgtcgcccaggctggagtgcagtggcgagatctcagctcactgcaacctgtgcctcccggcttcaagcgattctcagcctcagcctcccgagtagctgggattgcaggcgcccgccaccacgcccggctaatttttttttttctttttgttttgtttgagactcagtctcgctctgttgcccaggctgaagtgcagtggggcgctctcggctcactgcaacctctgcctcccaggttcaagcgattctcctgcctcagcctcccgagtagctgggattacaggagcgtgccaccactccgggctaatttttgtgttttaagtagagatggggtttcaccatgttggtcaggcagatttcgaattcctgacctcaagtgatccacccgcctcggcctttatttacttatttttttttaatagacacggggtcatgttgccagccatgttgcccaggctggtcgtgaactcctgggctcaagtgatcctcccgccttgcccttggccttccaagtgctaggattacaggcgtgagccaccaacaccctgcctgaggcaacattttaaacttggtgtatgttgaaaatttcaaaacccctcagctgtcctgcatcctcatttaggttcctgcttggctcgagtttgagtttacagcccctgcaagtaaatccaagagcctgttacagattggcggtcgtgccttatgaaatctgacttctacttccagaaatcagagcctcattcccttagtagtgaagcattgatgaggagagcagtgtctttggtaacagatagcacctctacctttctctctcagaccacatatgcgttgattgaagctattactgaatatactaaggctgtttataccttaacttctctttaccgacaatatacaagtttacttgggaaaatgaattcagaggaggaagatgaagtgtggcaggtgatcataggagccagagctgagatgacttcaaaacaccaagagtacttgaagctggaaaccacttggatgactgcagttggtctttcagagatggcagcagaagctgcatatcaaactggcgcagatcaggcctctataaccgccaggaatcacattcagctggtgaaactgcaggtggaagaggtgcaccagctctcccggaaagcagaaaccaagctggcagaagcacagatagaagagctccgtcagaaaacacaggaggaaggggaggagcgggctgagtcggagcaggaggcctacctgcgtgaggattgagggcctgagcacactgccctgtctccccactcagtggggaaagcaggggcagatgccaccctgcccagggttggcatgactgtctgtgcaccgagaagaggcggcagatcctgccctggccaatcaggcgagacgcctttgtgagctgtgagtgcctcctgtggtctcaggcttgcgctggacctggttcttagcccttgggcactgcaccctgtttaacatttcaccccactctgtacagctgctcttacccattttttttacctcacacccaaagcattttgcctacctgggtcagagagaggagtcctttttgtcatgcccttaagttcagcaactgtttaacctgttttcagtcttatttacgtcgtcaaaaatgatttagtacttgttccctctgttgggatgccagttgtggcagggggaggggaacctgtccagtttgtacgatttctttgtatgtatttctgatgtgttctctgatctgcccccactgtcctgtgaggacagctgaggccaaggagtgaaaaacctattactactaagagaaggggtgcagagtgtttacctggtgctctcaacaggacttaacatcaacaggacttaacacaggc

SEQ ID NO: 832 - DNA, 4453 bp, Homo sapiens
aactccattggataaatggcgaggaaacgtatactccctcttaaggaacacggtgtcttccttcgtctccgggttcccgagaccccagagtcactgacctccgtccctcagctttcggggttcggcagcagaaggggcgggcccgggcctgggattggctggcgtcgtccgacccccttcgctgctctccattcgcaatcgcccgcgggcgcctgcgcgatgggtcggccgtggggagcggggcgggaagcgcttcagggcagcggatcccatgtcggccctgaggcgctcgggctacggccccagtgacggtccgtcctacggccgctactacgggcctgggggtggagatgtgccggtacacccacctccacccttatatcctcttcgccctgaacctccccagcctcccatttcctggcgggtgcgcgggggcggcccggcggagaccacctggctgggagaaggcggaggaggcgatggctactatccctcgggaggcgcctggccagagcctggtcgagccggaggaagccaccaggagcagccaccatatcctagctacaattctaactattggaattctactgcgagatctagggctccttacccaagtacatatcctgtaagaccagaattgcaaggccagagtttgaattcttatacaaatggagcgtatggtccaacataccccccaggccctggggcaaatactgcctcatactcaggggcttattatgcacctggttatactcagaccagttactccacagaagttccaagtacttaccgttcatctggcaacagcccaactccagtctctcgttggatctatccccagcaggactgtcagactgaagcaccccctcttagggggcaggttccaggatatccgccttcacagaaccctggaatgaccctgccccattatccttatggagatggtaatcgtagtgttccacaatcaggaccgactgtacgaccacaagaagatgcgtgggcttctcctggtgcttatggaatgggtggccgttatccctggccttcatcagcgccctcagcaccacccggcaatctctacatgactgaaagtacttcaccatggcctagcagtggctctccccagtcacccccttcacccccagtccagcagcccaaggattcttcatacccctatagccaatcagatcaaagcatgaaccggcacaactttccttgcagtgtccatcagtacgaatcctcggggacagtgaacaatgatgattcagatcttttggattcccaagtccagtatagtgctgagcctcagctgtatggtaatgccaccagtgaccatcccaacaatcaagatcaaagtagcagtcttcctgaagaatgtgtaccttcagatgaaagtactcctccgagtattaaaaaaatcatacatgtgctggagaaggtccagtatcttgaacaagaagtagaagaatttgtaggaaaaaagacagacaaagcatactggcttctggaagaaatgctaaccaaggaacttttggaactggattcagttgaaactgggggccaggactctgtacggcaggccagaaaagaggctgtttgtaagattcaggccatactggaaaaattagaaaaaaaaggattatgaaaggatttagaacaaagtggaagcctgttactaacttgaccaaagaacacttgatttggttaattaccctctttttgaaatgcctgttgatgacaagaagcaatacattccagctttcctttgattttatacttgaaaaactggcaaaggaatggaagaatattttagtcatgagttgttttcagttttcagacgaatgaatgtaataggaaactatggagttaccaatattgccaagtagactcactccttaaaaaatttatggatatctacaagctgcttcttaccagcaggagggaaacacacttcacacaacaggcttatcagaaacctaccagatgaaactggatataatctgagacaaacaggatgtgtttttttaaacatctggatatcttgtcacatttttgtacattgtgactgctttcaacatatacttcatgtgtaattatagcttagactttagccttcttggacttctgttttgttttgttatttgcagtttacaaatatagtattattctctacttcttggtacattttgtagtaatatgtttaatataattattcaagagactatattgacagccagatagtatggcagttctgaaaaaatttatatcttttcaccacttgaatatactgcaatgtgtagtgagtaaattgtctccctttttctatagatcattaggttagagtttttttcttcttttttttttttttttttttttaccacttctgctgttcatggtagtagtggaaggtaaatttggaaatggcattgacataaaatgaaaatgtttacggacacttttcttttttgcttttttattgtatttggataaagatccacttaaaagttatctgttttttcctgttttttttttttttccccaaagtgtagttatgttttcactattgctgcttctatagagggcattgtgatagagagttacagatgaaacattaaatgccacagtgagtagaaataattactacaaaaagtaataaatatgattacttggtaatatcattctccatctaaaatactagtttcacctgtgagcagatttcagctcagtttatagttaaaaacaatgagggtaaaatgggattcatgctcagggaatgaatcagccatagttagagtgggaaattattattttcttcatttaaaggtagattttatgtttatttccctaaattgcataagataaaattgtctgtttaataaaaagacatttattaccattattaacagtcattttagagccaaatttaagaaaaggatattgaaagggtctttattggccttgtttgggtaactctatgctgttagatagaagagacttaggtaaataactttttatgtctgaggtgagtacacaatattggttcttggaaaaatagctgtttcttcataagatacccaagtgataattttttttcccctagactgtcaggcctatgagtaaatactaaatctattagctgtccccactcataaaccaaaccaaaccaatacaaacagatgaggagaggaaatgtagtaaaaatactggctgggtcttatgattgggatgagtgattttataagataatatggtgataattttattctaggattttatttttggcctaatataggaatgtttaaaaaaggcttttctatgaaaattagaaatttatacttgaaattaaaagtctagaagggggaggaccttaaagctaagctaccagtaagacaatgaataattcagaagagaacactattcttttactgactgagtgcccaagatgccaatttccatgaagtcttgatttatatatatgtacacatgttatgcacatacatgtttgttttctaacagttattttttaagcttttgagataattttagacttacagaagagttgtaaaagtagtagagttcttgtatactctgcacccaccttgcccttatgttaacatcttacgtaacaatagaacatttgtcaaaattaagaaattaaccttgatataatactaactaaagtagaaagtttaaaaagtagagattttagtcttttcactaatgtccttttactgttccaagacccagccttgcatttagctatcatgcctacgtcctgtcttccagtctgtgacagtgtatcataacaggggatacctgatgttgtaatgtatttctggtgttgttaaccttgatcactatgctaaggtggtgtctgctaggattcgctactgtaaacttactgtgttttccttgtaattattgaatatttgctggagatacccggagactatgcaaatgtcccgtttctgcttaaacttttgctcattttactatccattggcagatcttgcttgtggcagttactactgtggtgttctaatggtgattttctatttctctcaatccttctacatttattattggaattcttctgtaaggaagagttgtcagttctggatttatatttttaactataataagatattcaggataagtatagatttagaacttaaagatgttaaatcatgttaaaattattccaaataccaatatcaaagaaaactaagttggtaatctatctcagaaaatatatgaacttaagaaggaaaatagtatttatgatttgtagaattggttcaacttttgacttaatactgactttggactgaattcaaagttttcttgaaatttcacatctggactttttaaagtgtctacatttatattactttggggatcattttgtcaaagtcttgaataaagttacccagtcctggcatgataaacacaa

SEQ ID NO: 833 - DNA, 1943 bp, Homo sapiens
aggtaagaggaaactccattggataaatggcgaggaaacgtatactccctcttaaggaacacggtgtcttccttcgtctccgggttcccgagaccccagagtcactgacctccgtccctcagctttcggggttcggcagcagaaggggcgggcccgggcctgggattggctggcgtcgtccgacccccttcgctgctctccattcgcaatcgcccgcgggcgcctgcgcgatgggtcggccgtggggagcggggcgggaagcgcttcagggcagcggatcccatgtcggccctgaggcgctcgggctacggccccagtgacggtccgtcctacggccgctactacgggcctgggggtggagatgtgccggtacacccacctccacccttatatcctcttcgccctgaacctccccagcctcccatttcctggcgggtgcgcgggggcggcccggcggagaccacctggctgggagaaggcggaggaggcgatggctactatccctcgggaggcgcctggccagagcctggtcgagccggaggaagccaccagagtttgaattcttatacaaatggagcgtatggtccaacataccccccaggccctggggcaaatactgcctcatactcaggggcttattatgcacctggttatactcagaccagttactccacagaagttccaagtacttaccgttcatctggcaacagcccaactccagtctctcgttggatctatccccagcaggactgtcagactgaagcaccccctcttagggggcaggttccaggatatccgccttcacagaaccctggaatgaccctgccccattatccttatggagatggtaatcgtagtgttccacaatcaggaccgactgtacgaccacaagaagatgcgtgggcttctcctggtgcttatggaatgggtggccgttatccctggccttcatcagcgccctcagcaccacccggcaatctctacatgactgaaagtacttcaccatggcctagcagtggctctccccagtcacccccttcacccccagtccagcagcccaaggattcttcatacccctatagccaatcagatcaaagcatgaaccggcacaactttccttgcagtgtccatcagtacgaatcctcggggacagtgaacaatgatgattcagatcttttggattcccaagtccagtatagtgctgagcctcagctgtatggtaatgccaccagtgaccatcccaacaatcaagatcaaagtagcagtcttcctgaagaatgtgtaccttcagatgaaagtactcctccgagtattaaaaaaatcatacatgtgctggagaaggtccagtatcttgaacaagaagtagaagaatttgtaggaaaaaagacagacaaagcatactggcttctggaagaaatgctaaccaaggaacttttggaactggattcagttgaaactgggggccaggactctgtacggcaggccagaaaagaggctgtttgtaagattcaggccatactggaaaaattagaaaaaaaaggattatgaaaggatttagaacaaagtggaagcctgttactaacttgaccaaagaacacttgatttggttaattaccctctttttgaaatgcctgttgatgacaagaagcaatacattccagctttcctttgattttatacttgaaaaactggcaaaggaatggaagaatattttagtcatgagttgttttcagttttcagacgaatgaatgtaataggaaactatggagttaccaatattgccaagtagactcactccttaaaaaatttatggatatctacaagctgcttcttaccagcaggagggaaacacacttcacacaacaggcttatcagaaacctaccagatgaaactggatataatctgagacaaacaggatgtgtttttttaaacatctggatat

SEQ ID NO: 834 - DNA, 5489 bp, Homo sapiens
gggaaaggaggtcgccgcccggggtcgcccgggcttgcgggtcgccgcgcttcctctgcgggcgctgcgggaggcgagggccgcctcggcggaggaagccgaccccggggtctccgccagcccgccggcgccgcctccgagccgcctcggccgtagcctcggcccgggcgggaggcggcggccgccggcgaggcgaggcggcccgcgccctgcctgtcaggccaccggcccggcccgcgggctgcccccgatgcggaggcgctgtcgccggggccatgcagcaggcgccgcagccttacgagttcttcagcgaggagaacagtccgaaatggcggggactgttggtctcggccctgcggaaggttcaggaacaagtgcatcccactctctcagctaatgaagagtctctctattatattgaagagctgatttttcagctgcttaataaattatgcatggcccagccaaggactgttcaagatgtagaggagcgagttcagaagacctttcctcacccaattgataaatgggccattgctgatgcacaatctgctatagaaaaacgaaaacgaagaaatcctcttttactgcctgtggacaaaatccatccttcgttgaaggaagtattagggtacaaagtggactaccatgtatccctatatattgtggctgtactagagtatatctcagctgatattttaaaattggctggtaattatgtttttaatatccggcattatgaaatatctcagcaggacattaaagtgtcaatgtgtgcggataaggttttgatggacatgtttgatcaggatgacataggtttggtttctctctgtgaagatgaacctagttcttctggtgaattaaactactatgatcttgtcagaactgaaatcgcagaagaaagacagtatctacgggaattaaatatgatcataaaagtgtttcgagaagcctttctttctgatagaaagctgtttaaaccttctgatatcgaaaagatttttagtaacatttcagatatacatgaattgactgtgaaacttttaggtttgattgaagacacagttgaaatgactgatgaaagcagtcctcatcccttagctggcagctgttttgaagatttggcagaagagcaagcatttgatccttatgaaacattatcacaggacattctttcaccagagtttcatgaacatttcaataaattgatggccagacctgcagttgctctacactttcagtccattgctgatggttttaaagaggcagttcgttatgtccttccacgtcttatgctggtgccagtgtatcactgttggcactactttgagttactaaagcaattgaaagcatgtagtgaagaacaagaagacagagaatgtttgaaccaagctattactgctctcatgaatctccaaggtagcatggaccgaatttacaagcagtattcacctagacgtcgacctggagatcctgtttgccctttttatagtcaccaattaagaagcaaacacctggctatcaaaaaaatgaatgaaattcagaaaaatatcgatggatgggaaggcaaagatattggacagtgttgtaatgaattcattatggagggaccattgacaagaatcggtgccaaacatgaacggcatatttttctgtttgatggcttaatgatcagttgtaaacctaatcatggccagactcggcttccaggttacagtagtgcagaatacaggttaaaagaaaaatttgtcatgaggaaaatacaaatttgtgataaagaagatacttgtgagcacaagcatgcatttgaattagtatccaaagatgagaacagcataatatttgctgctaagtctgctgaagaaaaaaacaactggatggcagcccttatttctcttcattatcgtagtactctagatcgaatgttagattcagtattattgaaagaagaaaatgagcaaccactgagattaccaagtcctgaagtatatcgttttgtagtaaaagactctgaggaaaacattgtttttgaagacaacttgcaaagtagaagtggcatccccattattaaaggaggaactgtagtgaaattaattgaaaggttaacatatcatatgtatgcagatcccaattttgttcgtacttttcttaccacatatcgttcattttgtaaaccacaggaattgctgagcttactgattgaacggtttgaaattccagagccagaacctactgacgcagacaaattggcaatagagaaaggcgagcagccaatcagtgcagaccttaaaagatttcgcaaggaatatgtccaaccagtacaacttaggatcttaaatgtatttcggcattgggttgaacatcatttttatgactttgaaagagacttggaattgcttgaaagactagaatccttcatttcaagtgtaagagggaaagctatgaaaaaatgggtagagtcaattgctaagatcatcaggaggaagaagcaagctcaggcaaacggagtaagccataatattacctttgaaagtccacctccaccaattgaatggcatatcagcaaaccaggacagtttgaaacatttgatctcatgacacttcatccaatagaaattgcacgtcagctgacacttttggagtctgatctttacaggaaagttcaaccgtctgaacttgtagggagtgtgtggaccaaagaagataaagaaataaattctccaaatttattaaaaatgattcgccataccacaaatctcaccctctggtttgaaaaatgcattgtggaagcagaaaattttgaagaacgggtggcagtactaagtagaattatagaaattctgcaagtttttcaagatttgaataatttcaatggcgtattggagatagtcagtgcagtaaattcagtgtcagtatacagactagaccatacctttgaggcactgcaggaaaggaaaaggaaaattttggacgaagctgtggaattaagtcaagatcactttaaaaaatacctagtaaaacttaagtcaatcaatccaccttgtgtgcctttttttggaatatatttaacaaatattctgaagaccgaagaagggaataatgattttttaaaaaagaaagggaaagatttaatcaatttcagtaagaggaggaaagtagctgaaattactggagaaattcagcagtatcagaatcagccttactgtttacggatagaaccagatatgaggagattctttgaaaaccttaaccccatgggaagtgcatctgaaaaagagtttacagattatttgttcaacaagtcactagaaattgaacctcgaaactgcaaacagccacctcgatttcctaggaaatcaactttttccttaaaatctcctggaataaggcctaacacaggccgacatggctctacctcaggtactttacgaggtcacccaacaccattagaaagagaaccatgtaaaataagctttagtcggattgctgaaactgagctggaatcaacagtgtcagcaccaacctctccaaatacaccatctactccaccagtatctgcttcttcagaccttagtgtatttttagatgtggatctcaacagctcctgtggcagcaatagcatctttgctccagtgcttttgccacattcaaagtctttctttagttcatgtggtagtttacataaactaagtgaagagcccctgattcctcctcctcttcctcctcgaaaaaagtttgatcatgatgcttcaaattccaagggaaatatgaaatctgatgatgatcctcctgctattccaccgagacagcctcctcctccaaaggtaaaacccagagttcctgttcctactggtgcatttgatgggcctctgcatagtccacctccgccaccaccaagagatcctcttcctgatacccctccaccagttccccttcggcctccagaacactttataaactgtccatttaatcttcagccacctccactggggcatcttcacagagattcagactggctcagagacattagtacgtgtccaaattcgccaagcactcctcctagcacaccctctccaagggtaccgcgtcgatgctatgtgctcagttctagtcagaataatcttgctcatcctccagctccccctgttccaccaaggcagaattcaagccctcatctgccaaaactgccaccaaagacttacaaacgggagctttcgcaccccccattgtacagactgcctttgctagaaaatgcagaaactccccaatgaccttagccatatgtagtcattgacactggaatggtatttgtaaagttttttttttaatttattcaaaaaaagacatagtattttagtactttttacaaataatgctcttacaaaaatgctactgatcaaataagcttttaagaattggaaaaataaaaatacaaaagtccttcaccattatcctcaggtgatcagtagcattgccttgtcttggatcctcagtgctgccaaaaggccagtataaagaatttatatttgcactgtaaactctgcaaaaatatggtttaaagtgacatgattgcactgaaaagggatagtgcttttgtgaaatttttcaaatttgagtaatagatgcctttttaaggcagtgaatttacacaaatatgggaggggtatatggtgttactgatttttaaacctctttgaccatcttctagtttttacttctagtttttacatctaggagaattgtgaataacaccaactgttcttaaactctttaatgccatgtcttaaatgccggtatttgctgctgaagacaaaaatgaaaagtaggatgaaaataatagaatggcactgtaagtgtttattattttgtcaaaatgtaaacaaagactacataacccaatgatggagggaaaaagggcatgtatctcattcagatgtgccttttgtttttgcagactatgacgtctttagctaatgaattgcctattgttatggaaaacagttaatatgccatgtatgtacagttttgtttatattgtatatttaaagatactgctaataacctatataaatttaagtgacttgaggcctataatacaatctgctactttactaattcataaattcaaaaaaaattctatggcataggaaccaactgccttgccttcaagacctagtaactttctctataaatctcgtgttaactgaaattttttttaaatatattttttagattggtaatatttaaaccagcaaatacttaaagctttattaaacattttaatcagataagtgagtaaagcttttatttgccatttggatgccttcgttcaaagtgatagagtgttttgctgatagtgctgtagcagcagttgtaaagtagccaaaagccacgttgtttatttactggtttgtggccttttactgtgctttgtatcagagttcttaacaagattaataaatcaccccagtcttaatttttaaaag

SEQ ID NO: 835 - DNA, 3356 bp, Homo sapiens
ccgccgcccctctccccgcccagaggcgccccgggggcaccatgcaggcgcagcagctgccctacgagtttttcagcgaagagaacgcgcccaagtggcggggactactggtgcctgcgctgaaaaaggtccaggggcaagttcatcctactctcgagtctaatgatgatgctcttcagtatgttgaagaattaattttgcaattattaaatatgctatgccaagctcagccccgaagtgcttcagatgtagaggaacgtgttcaaaaaagtttccctcatccaattgataaatgggcaatagctgatgcccaatcagctattgaaaagaggaagcgaagaaaccctttatctctcccagtagaaaaaattcatcctttattaaaggaggtcctaggttataaaattgaccaccaggtttctgtttacatagtagcagtcttagaatacatttctgcagacattttaaagctggttgggaattatgtaagaaatatacggcattatgaaattacaaaacaagatattaaagtggcaatgtgtgctgacaaggtattgatggatatgtttcatcaagatgtagaagatattaatatattatctttaactgacgaagagccttccacctcaggagaacaaacttactatgatttggtaaaagcatttatggcagaaattcgacaatatataagggaactaaatctaattataaaagtttttagagagccctttgtctccaattcaaaattgttttcagctaatgatgtagaaaatatatttagtcgcatagtagatatacatgaacttagtgtaaagttactgggccatatagaagatacagtagaaatgacagatgaaggcagtccccatccactagtaggaagctgctttgaagacttagcagaggaactggcatttgatccatatgaatcgtatgctcgagatattttgcgacctggttttcatgatcgtttccttagtcagttatcaaagcctggggcagcactttatttgcagtcaataggcgaaggtttcaaagaagctgttcaatatgttttacccaggctgcttctggcccctgtttaccactgtctccattactttgaacttttgaagcagttagaagaaaaaagtgaagatcaagaagacaaggaatgtttaaaacaagcaataacagctttgcttaatgttcagagtggtatggaaaaaatatgttctaaaagtcttgcaaaacgaagactgagtgaatctgcatgtcggttttatagtcagcaaatgaaggggaaacaactagcaatcaagaagatgaacgagattcagaagaatattgatggttgggagggaaaagacattggacagtgttgtaatgaatttataatggaaggaactcttacacgtgtaggagccaaacatgagagacacatatttctctttgatggcttaatgatttgctgtaaatcaaatcatgggcagccaagacttcctggtgctagcaatgcagaatatcgtcttaaagaaaagttttttatgcgaaaggtacaaattaatgataaagatgacaccaatgaatacaagcatgcttttgaaataattttaaaagatgaaaatagtgttatattttctgccaagtcagctgaagagaaaaacaattggatggcagcattgatatctttacagtaccggagtacactggaaaggatgcttgatgtaacaatgctacaggaagagaaagaggagcagatgaggctgcctagtgctgatgtttatagatttgcagagcctgactctgaagagaatattatatttgaagagaacatgcagcccaaggctggaattccaattatcaaagcaggaactgttattaaacttatagagaggcttacgtaccatatgtacgcagatcccaattttgttcggacatttcttacaacatacagatccttttgcaaacctcaagaactactgagtcttataatagaaaggtttgaaattccagagcctgagccaacagaagctgatcgcatagctatagagaatggagatcaacccttgagtgcagaactgaaaagatttagaaaagaatatatacagcctgtgcaactgcgagtattaaatgtatgtcggcactgggtagagcaccacttctatgattttgaaagagatgcatatcttttgcaacgaatggaagaatttattggaacagtaagaggtaaagcaatgaaaaaatgggttgaatccatcactaaaataatccaaaggaaaaaaattgcaagagacaatggaccaggtcataatattacatttcagagttcacctcccacagttgagtggcatataagcagacctgggcacatagagacttttgacctgctcaccttacacccaatagaaattgctcgacaactcactttacttgaatcagatctataccgagctgtacagccatcagaattagttggaagtgtgtggacaaaagaagacaaagaaattaactctcctaatcttctgaaaatgattcgacataccaccaacctcactctgtggtttgagaaatgtattgtagaaactgaaaatttagaagaaagagtagctgtggtgagtcgaattattgagattctacaagtctttcaagagttgaacaactttaatggtgtccttgaggttgtcagtgctatgaattcatcacctgtttacagactagaccacacatttgagcaaataccaagtcgccagaagaaaattttagaagaagctcatgaattgagtgaagatcactataagaaatatttggcaaaactcaggtctattaatccaccatgtgtgcctttctttggaatttatctcactaatatcttgaaaacagaagaaggcaaccctgaggtcctaaaaagacatggaaaagagcttataaactttagcaaaaggaggaaagtagcagaaataacaggagagatccagcagtaccaaaatcagccttactgtttacgagtagaatcagatatcaaaaggttctttgaaaacttgaatccgatgggaaatagcatggagaaggaatttacagattatcttttcaacaaatccctagaaatagaaccacgaaaccctaagcctctcccaagatttccaaaaaaatatagctatcccctaaaatctcctggtgttcgtccatcaaacccaagaccaggtaccatgaggcatcccacacctctgcagcaggagccaaggaaaattagttatagtaggatccctgaaagtgaaacagaaagtacagcatctgcaccaaattctccaaacaccgttaacacctccgcctgcttctggtgcttccagtaccacagatgtttgcagtgtatttga

SEQ ID NO: 836 - DNA, 4123 bp, Homo sapiens
ccccgcccagaggcgccccgggggcaccatgcaggcgcagcagctgccctacgagtttttcagcgaagagaacgcgcccaagtggcggggactactggtgcctgcgctgaaaaaggtccaggggcaagttcatcctactctcgagtctaatgatgatgctcttcagtatgttgaagaattaattttgcaattattaaatatgctatgccaagctcagccccgaagtgcttcagatgtagaggaacgtgttcaaaaaagtttccctcatccaattgataaatgggcaatagctgatgcccaatcagctattgaaaagaggaagcgaagaaaccctttatctctcccagtagaaaaaattcatcctttattaaaggaggtcctaggttataaaattgaccaccaggtttctgtttacatagtagcagtcttagaatacatttctgcagacattttaaagctggttgggaattatgtaagaaatatacggcattatgaaattacaaaacaagatattaaagtggcaatgtgtgctgacaaggtattgatggatatgtttcatcaagatgtagaagatattaatatattatctttaactgacgaagagccttccacctcaggagaacaaacttactatgatttggtaaaagcatttatggcagaaattcgacaatatataagggaactaaatctaattataaaagtttttagagagccctttgtctccaattcaaaattgttttcagctaatgatgtagaaaatatatttagtcgcatagtagatatacatgaacttagtgtaaagttactgggccatatagaagatacagtagaaatgacagatgaaggcagtccccatccactagtaggaagctgctttgaagacttagcagaggaactggcatttgatccatatgaatcgtatgctcgagatattttgcgacctggttttcatgatcgtttccttagtcagttatcaaagcctggggcagcactttatttgcagtcaataggcgaaggtttcaaagaagctgttcaatatgttttacccaggctgcttctggcccctgtttaccactgtctccattactttgaacttttgaagcagttagaagaaaaaagtgaagatcaagaagacaaggaatgtttaaaacaagcaataacagctttgcttaatgttcagagtggtatggaaaaaatatgttctaaaagtcttgcaaaacgaagactgagtgaatctgcatgtcggttttatagtcagcaaatgaaggggaaacaactagcaatcaagaagatgaacgagattcagaagaatattgatggttgggagggaaaagacattggacagtgttgtaatgaatttataatggaaggaactcttacacgtgtaggagccaaacatgagagacacatatttctctttgatggcttaatgatttgctgtaaatcaaatcatgggcagccaagacttcctggtgctagcaatgcagaatatcgtcttaaagaaaagttttttatgcgaaaggtacaaattaatgataaagatgacaccaatgaatacaagcatgcttttgaaataattttaaaagatgaaaatagtgttatattttctgccaagtcagctgaagagaaaaacaattggatggcagcattgatatctttacagtaccggagtacactggaaaggatgcttgatgtaacaatgctacaggaagagaaagaggagcagatgaggctgcctagtgctgatgtttatagatttgcagagcctgactctgaagagaatattatatttgaagagaacatgcagcccaaggctggaattccaattatcaaagcaggaactgttattaaacttatagagaggcttacgtaccatatgtacgcagatcccaattttgttcggacatttcttacaacatacagatccttttgcaaacctcaagaactactgagtcttataatagaaaggtttgaaattccagagcctgagccaacagaagctgatcgcatagctatagagaatggagatcaacccttgagtgcagaactgaaaagatttagaaaagaatatatacagcctgtgcaactgcgagtattaaatgtatgtcggcactgggtagagcaccacttctatgattttgaaagagatgcatatcttttgcaacgaatggaagaatttattggaacagtaagaggtaaagcaatgaaaaaatgggttgaatccatcactaaaataatccaaaggaaaaaaattgcaagagacaatggaccaggtcataatattacatttcagagttcacctcccacagttgagtggcatataagcagacctgggcacatagagacttttgacctgctcaccttacacccaatagaaattgctcgacaactcactttacttgaatcagatctataccgagctgtacagccatcagaattagttggaagtgtgtggacaaaagaagacaaagaaattaactctcctaatcttctgaaaatgattcgacataccaccaacctcactctgtggtttgagaaatgtattgtagaaactgaaaatttagaagaaagagtagctgtggtgagtcgaattattgagattctacaagtctttcaagagttgaacaactttaatggtgtccttgaggttgtcagtgctatgaattcatcacctgtttacagactagaccacacatttgagcaaataccaagtcgccagaagaaaattttagaagaagctcatgaattgagtgaagatcactataagaaatatttggcaaaactcaggtctattaatccaccatgtgtgcctttctttggaatttatctcactaatatcttgaaaacagaagaaggcaaccctgaggtcctaaaaagacatggaaaagagcttataaactttagcaaaaggaggaaagtagcagaaataacaggagagatccagcagtaccaaaatcagccttactgtttacgagtagaatcagatatcaaaaggttctttgaaaacttgaatccgatgggaaatagcatggagaaggaatttacagattatcttttcaacaaatccctagaaatagaaccacgaaaccctaagcctctcccaagatttccaaaaaaatatagctatcccctaaaatctcctggtgttcgtccatcaaacccaagaccaggtaccatgaggcatcccacacctctgcagcaggagccaaggaaaattagttatagtaggatccctgaaagtgaaacagaaagtacagcatctgcaccaaattctccaagaacaccgttaacacctccgcctgcttctggtgcttccagtaccacagatgtttgcagtgtatttgattccgatcattcgagcccttttcactcaagatctgcttctgtatcatctataagtttaaccaaaggcactgatgaagtgcctgtccctcctcctgttcctccacgaagacgaccagaatctgccccagcagaatcttcaccatctaagattatgtctaagcatttggacagtcccccagccattcctcctaggcaacccacatcaaaagcctattcaccacgatattcaatatcagaccggacctctatctcagaccctcctgaaagccctcccttattaccaccacgagaacctgtgaggacacctgatgttttctcaagctcaccactacatctccaacctccccctttgggcaaaaaaagtgaccatggcaatgccttcttcccaaacagcccttccccctttacaccacctcctcctcaaacaccttctcctcacggcacaagaaggcatctgccatcaccaccattgacacaagaagtggaccttcattccattgctgggccgcctgttcctccacgacaaagcacttctcaacatatccctaaactccctccaaaaacttacaaaagggagcacacacacccatccatgcacagagatggaccaccactgttggagaatgcccattcttcctgagttcctctgtactgggatgtatattttcctagccccaaatccattgctggcaatggatgcactgaatgtgccagcactgaggagttaaaatgagaactccaaacactaacgactcttcttcaagatgcagtataagac

SEQ ID NO: 837 - DNA, 8314 bp, Homo sapiens
ccgccgcccctctccccgcccagaggcgccccgggggcaccatgcaggcgcagcagctgccctacgagtttttcagcgaagagaacgcgcccaagtggcggggactactggtgcctgcgctgaaaaaggtccaggggcaagttcatcctactctcgagtctaatgatgatgctcttcagtatgttgaagaattaattttgcaattattaaatatgctatgccaagctcagccccgaagtgcttcagatgtagaggaacgtgttcaaaaaagtttccctcatccaattgataaatgggcaatagctgatgcccaatcagctattgaaaagaggaagcgaagaaaccctttatctctcccagtagaaaaaattcatcctttattaaaggaggtcctaggttataaaattgaccaccaggtttctgtttacatagtagcagtcttagaatacatttctgcagacattttaaagctggttgggaattatgtaagaaatatacggcattatgaaattacaaaacaagatattaaagtggcaatgtgtgctgacaaggtattgatggatatgtttcatcaagatgtagaagatattaatatattatctttaactgacgaagagccttccacctcaggagaacaaacttactatgatttggtaaaagcatttatggcagaaattcgacaatatataagggaactaaatctaattataaaagtttttagagagccctttgtctccaattcaaaattgttttcagctaatgatgtagaaaatatatttagtcgcatagtagatatacatgaacttagtgtaaagttactgggccatatagaagatacagtagaaatgacagatgaaggcagtccccatccactagtaggaagctgctttgaagacttagcagaggaactggcatttgatccatatgaatcgtatgctcgagatattttgcgacctggttttcatgatcgtttccttagtcagttatcaaagcctggggcagcactttatttgcagtcaataggcgaaggtttcaaagaagctgttcaatatgttttacccaggctgcttctggcccctgtttaccactgtctccattactttgaacttttgaagcagttagaagaaaaaagtgaagatcaagaagacaaggaatgtttaaaacaagcaataacagctttgcttaatgttcagagtggtatggaaaaaatatgttctaaaagtcttgcaaaacgaagactgagtgaatctgcatgtcggttttatagtcagcaaatgaaggggaaacaactagcaatcaagaagatgaacgagattcagaagaatattgatggttgggagggaaaagacattggacagtgttgtaatgaatttataatggaaggaactcttacacgtgtaggagccaaacatgagagacacatatttctctttgatggcttaatgatttgctgtaaatcaaatcatgggcagccaagacttcctggtgctagcaatgcagaatatcgtcttaaagaaaagttttttatgcgaaaggtacaaattaatgataaagatgacaccaatgaatacaagcatgcttttgaaataattttaaaagatgaaaatagtgttatattttctgccaagtcagctgaagagaaaaacaattggatggcagcattgatatctttacagtaccggagtacactggaaaggatgcttgatgtaacaatgctacaggaagagaaagaggagcagatgaggctgcctagtgctgatgtttatagatttgcagagcctgactctgaagagaatattatatttgaagagaacatgcagcccaaggctggaattccaattatcaaagcaggaactgttattaaacttatagagaggcttacgtaccatatgtacgcagatcccaattttgttcggacatttcttacaacatacagatccttttgcaaacctcaagaactactgagtcttataatagaaaggtttgaaattccagagcctgagccaacagaagctgatcgcatagctatagagaatggagatcaacccttgagtgcagaactgaaaagatttagaaaagaatatatacagcctgtgcaactgcgagtattaaatgtatgtcggcactgggtagagcaccacttctatgattttgaaagagatgcatatcttttgcaacgaatggaagaatttattggaacagtaagaggtaaagcaatgaaaaaatgggttgaatccatcactaaaataatccaaaggaaaaaaattgcaagagacaatggaccaggtcataatattacatttcagagttcacctcccacagttgagtggcatataagcagacctgggcacatagagacttttgacctgctcaccttacacccaatagaaattgctcgacaactcactttacttgaatcagatctataccgagctgtacagccatcagaattagttggaagtgtgtggacaaaagaagacaaagaaattaactctcctaatcttctgaaaatgattcgacataccaccaacctcactctgtggtttgagaaatgtattgtagaaactgaaaatttagaagaaagagtagctgtggtgagtcgaattattgagattctacaagtctttcaagagttgaacaactttaatggtgtccttgaggttgtcagtgctatgaattcatcacctgtttacagactagaccacacatttgagcaaataccaagtcgccagaagaaaattttagaagaagctcatgaattgagtgaagatcactataagaaatatttggcaaaactcaggtctattaatccaccatgtgtgcctttctttggaatttatctcactaatatcttgaaaacagaagaaggcaaccctgaggtcctaaaaagacatggaaaagagcttataaactttagcaaaaggaggaaagtagcagaaataacaggagagatccagcagtaccaaaatcagccttactgtttacgagtagaatcagatatcaaaaggttctttgaaaacttgaatccgatgggaaatagcatggagaaggaatttacagattatcttttcaacaaatccctagaaatagaaccacgaaaccctaagcctctcccaagatttccaaaaaaatatagctatcccctaaaatctcctggtgttcgtccatcaaacccaagaccaggtaccatgaggcatcccacacctctgcagcaggagccaaggaaaattagttatagtaggatccctgaaagtgaaacagaaagtacagcatctgcaccaaattctccaagaacaccgttaacacctccgcctgcttctggtgcttccagtaccacagatgtttgcagtgtatttgattccgatcattcgagcccttttcactcaagcaatgataccgtctttatccaagttactctgccccatggcccaagatctgcttctgtatcatctataagtttaaccaaaggcactgatgaagtgcctgtccctcctcctgttcctccacgaagacgaccagaatctgccccagcagaatcttcaccatctaagattatgtctaagcatttggacagtcccccagccattcctcctaggcaacccacatcaaaagcctattcaccacgatattcaatatcagaccggacctctatctcagaccctcctgaaagccctcccttattaccaccacgagaacctgtgaggacacctgatgttttctcaagctcaccactacatctccaacctccccctttgggcaaaaaaagtgaccatggcaatgccttcttcccaaacagcccttccccctttacaccacctcctcctcaaacaccttctcctcacggcacaagaaggcatctgccatcaccaccattgacacaagaagtggaccttcattccattgctgggccgcctgttcctccacgacaaagcacttctcaacatatccctaaactccctccaaaaacttacaaaagggagcacacacacccatccatgcacagagatggaccaccactgttggagaatgcccattcttcctgagttcctctgtactgggatgtatattttcctagccccaaatccattgctggcaatggatgcactgaatgtgccagcactgaggagttaaaatgagaactccaaacactaacgactcttcttcaagatgcagtataagacaatgaattttaacctagatgtaattatacaatggaaatggtattccagtttagaatatggaaagaccgacctagaggaattggacaactgattgcacctgaaaatcataaagggactttttctggccaataggcaggagtcctctttttgtgaagtgatcttttgtgaagtgatcattaaagggatggaaaacacagtctagtgtccagcaggcccacatgacagtttttgtaattcaaattatgcacttttaaaaaaaaaaacttaaacagggatcttaatatcttcctttgttttcctttgctttactcttctactttagaatattttcttaaaaatcactcaaaggactgtgaggaaaggctgtggtacctgaccttgttgaaatcaaggcccggcactgtactacaggcctgtttacagattattacggtgaactgaatgggtaccgaggcttcaccaaagaggtacttttttgttgttgttgttgttttaggaataattgtaccaattttaagagcattccccccacctgtccccacacacccaaacaaaatgtggtggtgttgccttcaaaaaagagaagttttgtgtcattaacatgacagaagaactttttaaaaaaaaataactgtcaactattctatttgcatttaggagactgttcatctatgctagattgtcattttccctccttctcccacagaagtttactggtagtccatgtcatggctcgtagctatccctctaaccataccatggaaatgcaggcacccaatgtgaaaaggagcacttgctgggcatcactgacaccgctcatgttttacacatagttgagtaatcagcatatctagaattatcttgcattgcctaaatcatatgtatatagtgaatgttatataatatacctggcaggtctgttttaatttaattgaataaagatacaaatactttgtttggctggcatatattaaattattatatgaagaaaatggttgattcttatttcttttagttgaaaaacacacaaaaacactaaacataaaagcacgttttgtggtacgccttggtttctagttctggatatatgtattaatcttaaagaatgatctaaagtcacagcttggcatataggaagatacttggttagaataggatgggtatcttttaagcagaactttgtaagtaagttttaagttcctaagcaacaagtatacagtttgttaaggtttatattgaacattctaccttgcttgaggttttctgctttatcaaaactattcataatagaacatctacctgcatcattactatcataatatggattattcataaagcgtatgtactgttcttctgagtctaacaaatactgtgactgaaatgcatgcaccttgttgaagagaaaacattttattaatctccactataatgtctgtgaaatgtgcagtattccatccttagagagtttatctggttcatcagcatctgcatgtatcctctgaataatgaagcaacatttcagcaattctgttaaccacaccattagagacatttttagaagtgctgcaacatggtgggaacctagtactttaataatttcctatgatatttattagagcataaaatgtacatcacgatagtacagtatgtagtcctttaagaccagaaggtatgttaactgcaccatcattaagcagtctatcctattttcttatttatttgttagaattgaatcctttctcaatatctgtaccattcctatgatggtagccattcttctctttataaaatatttcctctttgaaaagcgtcctaaaacattaatttcaaatcccctcttggatgcaaagtgtccctaagaccatccattcaacagtatttatgtgagccaacttactagagccgctacaactaatcatgatagacagtccagaatctccctggactttatactgggccagcctcattgtccctaagatttctctttttatgtctcatggattacttctctttttaattgccccaggcacattccaaatgagaacctggtaaaagtcacattggacccccttcagtatgtcttcggctaatgtgttagccttcaataaggtgataaccccttttcaacctatctagtctataaagaggaaaaattcagatttggagttctaatcctatttctcccaaagggaactattcttctaccccatggttctaggagaccacttcactgtgcaacagttttacatgcattgtggatggaggatatttttattctgaactgttacatttaggtaaaaatattttctgcagtggtaactgattagaaaaatgccaattggatgcccttaggtggaggtgagaaaatggcatccttgccttcttctcaatatgaaacattaactagttgacaaatttatccttgtagtaatgaaaatctatttaatcagggaccagaaatggctgaggagataaatgcatcattacaaaattctgcttttgaatcctggacattacaagggggtaaatgcagcatgactttttgttaaccacattccaaaatgtggaacatttcttttagaaatgaaaatatttcaaggctgatgtattttaagactacacattatcaggaaacatacattgagagttcgcttaattaaaggttgttgggcatcaaattatgtttagtaggttactattctctaacaactcaaggatgctttaatggatctgaatttgacaaagagcatgccacactaatactacagtcaacaacagcccagagaacaattactatgtcagctggaggctatattatgattctaaattcttaaaggtttttttccctccataaatcaaaaattaccttatgtaaaccaaaaattagttggtatttatggtcatgatcttaattctcaagtttagcttaatcttgtatttcattgtttgtcttctaatatgacagcttaaattcagatttttaagtgactcagcaaaataggaggagtgtcccaatttattagtgttgtacatattgaagaaaacctttttgttccttcagatttagaaagaaacagtttaaccatttatttcttggtattctgctgctgtgaataggtttacttattcttttaacatatattgtgtgactacgcaagtataggtcctgttgtattgcattaatctttaccagtaactaaacatcacaaggttaatattggtttggctgaaagaattatgcagtaaagttatttataagggaacatgatgactttattcaatatttttcttctttgaaacatctcattactaacttttaagattatttcataatcccttatacatgagccaatgaaatattttgagctctacttaagaagcatgaagtctatattataaatctaaacaacaaaagcacttgtaacttgtttagtaaattccatgccttattttccatttttgacaccgtaaagtgcattttctgtcgactgtgagcaaatttcccttttgcctttaatgaaaatagtgcattaagtagccaattgctgcagaattataaagcaaattagctaacagtgggtcacattggactaccactcaaagaaacaagatgcataacagatgatggaaggtacatgtggtgtggcttagggagagcgcacctgtgccagatgcatgccactttcagtagctgccaaatgtgcctttaattaagaacatctctaatttttttcttcagatcaagtcagcatttggggtcgggatttgggcagggaactttggggtgcaaatatctggtgaaaccaccagagaatttgtttgtcaaagtgacatgtataattttagttgagacgtgtttgtgtatatatgtgtatttgcctttgtttagtagcacggttatttgctaaaataattgtcaaaaaattgctctgtcggtcggtctttgatgtaagaacaaagtgtggtctatacatctaatatggcctttgtacctaaccatgttcataggtaatctttgtactctgtgtgcagcagtatttggtttgcatttaaagtgaaaataacggctgttatttttctggcattactaagataaactgaaaaataataaagaaaaatgccttacatagccc

SEQ ID NO: 838 - DNA, 8517 bp, Homo sapiens
agtagcgagcaggttcagttcgctagtaggaagctccagcgctacaccgccgcccctctccccgcccagaggcgccccgggggcaccatgcaggcgcagcagctgccctacgagtttttcagcgaagagaacgcgcccaagtggcggggactactggtgcctgcgctgaaaaaggtccaggggcaagttcatcctactctcgagtctaatgatgatgctcttcagtatgttgaagaattaattttgcaattattaaatatgctatgccaagctcagccccgaagtgcttcagatgtagaggaacgtgttcaaaaaagtttccctcatccaattgataaatgggcaatagctgatgcccaatcagctattgaaaagaggaagcgaagaaaccctttatctctcccagtagaaaaaattcatcctttattaaaggaggtcctaggttataaaattgaccaccaggtttctgtttacatagtagcagtcttagaatacatttctgcagacattttaaagctggttgggaattatgtaagaaatatacggcattatgaaattacaaaacaagatattaaagtggcaatgtgtgctgacaaggtattgatggatatgtttcatcaagatgtagaagatattaatatattatctttaactgacgaagagccttccacctcaggagaacaaacttactatgatttggtaaaagcatttatggcagaaattcgacaatatataagggaactaaatctaattataaaagtttttagagagccctttgtctccaattcaaaattgttttcagctaatgatgtagaaaatatatttagtcgcatagtagatatacatgaacttagtgtaaagttactgggccatatagaagatacagtagaaatgacagatgaaggcagtccccatccactagtaggaagctgctttgaagacttagcagaggaactggcatttgatccatatgaatcgtatgctcgagatattttgcgacctggttttcatgatcgtttccttagtcagttatcaaagcctggggcagcactttatttgcagtcaataggcgaaggtttcaaagaagctgttcaatatgttttacccaggctgcttctggcccctgtttaccactgtctccattactttgaacttttgaagcagttagaagaaaaaagtgaagatcaagaagacaaggaatgtttaaaacaagcaataacagctttgcttaatgttcagagtggtatggaaaaaatatgttctaaaagtcttgcaaaacgaagactgagtgaatctgcatgtcggttttatagtcagcaaatgaaggggaaacaactagcaatcaagaagatgaacgagattcagaagaatattgatggttgggagggaaaagacattggacagtgttgtaatgaatttataatggaaggaactcttacacgtgtaggagccaaacatgagagacacatatttctctttgatggcttaatgatttgctgtaaatcaaatcatgggcagccaagacttcctggtgctagcaatgcagaatatcgtcttaaagaaaagttttttatgcgaaaggtacaaattaatgataaagatgacaccaatgaatacaagcatgcttttgaaataattttaaaagatgaaaatagtgttatattttctgccaagtcagctgaagagaaaaacaattggatggcagcattgatatctttacagtaccggagtacactggaaaggatgcttgatgtaacaatgctacaggaagagaaagaggagcagatgaggctgcctagtgctgatgtttatagatttgcagagcctgactctgaagagaatattatatttgaagagaacatgcagcccaaggctggaattccaattatcaaagcaggaactgttattaaacttatagagaggcttacgtaccatatgtacgcagatcccaattttgttcggacatttcttacaacatacagatccttttgcaaacctcaagaactactgagtcttataatagaaaggtttgaaattccagagcctgagccaacagaagctgatcgcatagctatagagaatggagatcaacccttgagtgcagaactgaaaagatttagaaaagaatatatacagcctgtgcaactgcgagtattaaatgtatgtcggcactgggtagagcaccacttctatgattttgaaagagatgcatatcttttgcaacgaatggaagaatttattggaacagtaagaggtaaagcaatgaaaaaatgggttgaatccatcactaaaataatccaaaggaaaaaaattgcaagagacaatggaccaggtcataatattacatttcagagttcacctcccacagttgagtggcatataagcagacctgggcacatagagacttttgacctgctcaccttacacccaatagaaattgctcgacaactcactttacttgaatcagatctataccgagctgtacagccatcagaattagttggaagtgtgtggacaaaagaagacaaagaaattaactctcctaatcttctgaaaatgattcgacataccaccaacctcactctgtggtttgagaaatgtattgtagaaactgaaaatttagaagaaagagtagctgtggtgagtcgaattattgagattctacaagtctttcaagagttgaacaactttaatggtgtccttgaggttgtcagtgctatgaattcatcacctgtttacagactagaccacacatttgagcaaataccaagtcgccagaagaaaattttagaagaagctcatgaattgagtgaagatcactataagaaatatttggcaaaactcaggtctattaatccaccatgtgtgcctttctttggaatttatctcactaatatcttgaaaacagaagaaggcaaccctgaggtcctaaaaagacatggaaaagagcttataaactttagcaaaaggaggaaagtagcagaaataacaggagagatccagcagtaccaaaatcagccttactgtttacgagtagaatcagatatcaaaaggttctttgaaaacttgaatccgatgggaaatagcatggagaaggaatttacagattatcttttcaacaaatccctagaaatagaaccacgaaaccctaagcctctcccaagatttccaaaaaaatatagctatcccctaaaatctcctggtgttcgtccatcaaacccaagaccaggtaccatgaggcatcccacacctctgcagcaggagccaaggaaaattagttatagtaggatccctgaaagtgaaacagaaagtacagcatctgcaccaaattctccaagaacaccgttaacacctccgcctgcttctggtgcttccagtaccacagatgtttgcagtgtatttgattccgatcattcgagcccttttcactcaagcaatgataccgtctttatccaagttactctgccccatggcccaagatctgcttctgtatcatctataagtttaaccaaaggcactgatgaagtgcctgtccctcctcctgttcctccacgaagacgaccagaatctgccccagcagaatcttcaccatctaagattatgtctaagcatttggacagtcccccagccattcctcctaggcaacccacatcaaaagcctattcaccacgatattcaatatcagaccggacctctatctcagaccctcctgaaagccctcccttattaccaccacgagaacctgtgaggacacctgatgttttctcaagctcaccactacatctccaacctccccctttgggcaaaaaaagtgaccatggcaatgccttcttcccaaacagcccttccccctttacaccacctcctcctcaaacaccttctcctcacggcacaagaaggcatctgccatcaccaccattgacacaagaagtggaccttcattccattgctgggccgcctgttcctccacgacaaagcacttctcaacatatccctaaactccctccaaaaacttacaaaagggagcacacacacccatccatgcacagagatggaccaccactgttggagaatgcccattcttcctgagttcctctgtactgggatgtatattttcctagccccaaatccattgctggcaatggatgcactgaatgtgccagcactgaggagttaaaatgagaactccaaacactaacgactcttcttcaagatgcagtataagacaatgaattttaacctagatgtaattatacaatggaaatggtattccagtttagaatatggaaagaccgacctagaggaattggacaactgattgcacctgaaaatcataaagggactttttctggccaataggcaggagtcctctttttgtgaagtgatcttttgtgaagtgatcattaaagggatggaaaacacagtctagtgtccagcaggcccacatgacagtttttgtaattcaaattatgcacttttaaaaaaaaaaacttaaacagggatcttaatatcttcctttgttttcctttgctttactcttctactttagaatattttcttaaaaatcactcaaaggactgtgaggaaaggctgtggtacctgaccttgttgaaatcaaggcccggcactgtactacaggcctgtttacagattattacggtgaactgaatgggtaccgaggcttcaccaaagaggtacttttttgttgttgttgttgttttaggaataattgtaccaattttaagagcattccccccacctgtccccacacacccaaacaaaatgtggtggtgttgccttcaaaaaagagaagttttgtgtcattaacatgacagaagaactttttaaaaaaaaataactgtcaactattctatttgcatttaggagactgttcatctatgctagattgtcattttccctccttctcccacagaagtttactggtagtccatgtcatggctcgtagctatccctctaaccataccatggaaatgcaggcacccaatgtgaaaaggagcacttgctgggcatcactgacaccgctcatgttttacacatagttgagtaatcagcatatctagaattatcttgcattgcctaaatcatatgtatatagtgaatgttatataatatacctggcaggtctgttttaatttaattgaataaagatacaaatactttgtttggctggcatatattaaattattatatgaagaaaatggttgattcttatttcttttagttgaaaaacacacaaaaacactaaacataaaagcacgttttgtggtacgccttggtttctagttctggatatatgtattaatcttaaagaatgatctaaagtcacagcttggcatataggaagatacttggttagaataggatgggtatcttttaagcagaactttgtaagtaagttttaagttcctaagcaacaagtatacagtttgttaaggtttatattgaacattctaccttgcttgaggttttctgctttatcaaaactattcataatagaacatctacctgcatcattactatcataatatggattattcataaagcgtatgtactgttcttctgagtctaacaaatactgtgactgaaatgcatgcaccttgttgaagagaaaacattttattaatctccactataatgtctgtgaaatgtgcagtattccatccttagagagtttatctggttcatcagcatctgcatgtatcctctgaataatgaagcaacatttcagcaattctgttaaccacaccattagagacatttttagaagtgctgcaacatggtgggaacctagtactttaataatttcctatgatatttattagagcataaaatgtacatcacgatagtacagtatgtagtcctttaagaccagaaggtatgttaactgcaccatcattaagcagtctatcctattttcttatttatttgttagaattgaatcctttctcaatatctgtaccattcctatgatggtagccattcttctctttataaaatatttcctctttgaaaagcgtcctaaaacattaatttcaaatcccctcttggatgcaaagtgtccctaagaccatccattcaacagtatttatgtgagccaacttactagagccgctacaactaatcatgatagacagtccagaatctccctggactttatactgggccagcctcattgtccctaagatttctctttttatgtctcatggattacttctctttttaattgccccaggcacattccaaatgagaacctggtaaaagtcacattggacccccttcagtatgtcttcggctaatgtgttagccttcaataaggtgataaccccttttcaacctatctagtctataaagaggaaaaattcagatttggagttctaatcctatttctcccaaagggaactattcttctaccccatggttctaggagaccacttcactgtgcaacagttttacatgcattgtggatggaggatatttttattctgaactgttacatttaggtaaaaatattttctgcagtggtaactgattagaaaaatgccaattggatgcccttaggtggaggtgagaaaatggcatccttgccttcttctcaatatgaaacattaactagttgacaaatttatccttgtagtaatgaaaatctatttaatcagggaccagaaatggctgaggagataaatgcatcattacaaaattctgcttttgaatcctggacattacaagggggtaaatgcagcatgactttttgttaaccacattccaaaatgtggaacatttcttttagaaatgaaaatatttcaaggctgatgtattttaagactacacattatcaggaaacatacattgagagttcgcttaattaaaggttgttgggcatcaaattatgtttagtaggttactattctctaacaactcaaggatgctttaatggatctgaatttgacaaagagcatgccacactaatactacagtcaacaacagcccagagaacaattactatgtcagctggaggctatattatgattctaaattcttaaaggtttttttccctccataaatcaaaaattaccttatgtaaaccaaaaattagttggtatttatggtcatgatcttaattctcaagtttagcttaatcttgtatttcattgtttgtcttctaatatgacagcttaaattcagatttttaagtgactcagcaaaataggaggagtgtcccaatttattagtgttgtacatattgaagaaaacctttttgttccttcagatttagaaagaaacagtttaaccatttatttcttggtattctgctgctgtgaataggtttacttattcttttaacatatattgtgtgactacgcaagtataggtcctgttgtattgcattaatctttaccagtaactaaacatcacaaggttaatattggtttggctgaaagaattatgcagtaaagttatttataagggaacatgatgactttattcaatatttttcttctttgaaacatctcattactaacttttaagattatttcataatcccttatacatgagccaatgaaatattttgagctctacttaagaagcatgaagtctatattataaatctaaacaacaaaagcacttgtaacttgtttagtaaattccatgccttattttccatttttgacaccgtaaagtgcattttctgtcgactgtgagcaaatttcccttttgcctttaatgaaaatagtgcattaagtagccaattgctgcagaattataaagcaaattagctaacagtgggtcacattggactaccactcaaagaaacaagatgcataacagatgatggaaggtacatgtggtgtggcttagggagagcgcacctgtgccagatgcatgccactttcagtagctgccaaatgtgcctttaattaagaacatctctaatttttttcttcagatcaagtcagcatttggggtcgggatttgggcagggaactttggggtgcaaatatctggtgaaaccaccagagaatttgtttgtcaaagtgacatgtataattttagttgagacgtgtttgtgtatatatgtgtatttgcctttgtttagtagcacggttatttgctaaaataattgtcaaaaaattgctctgtcggtcggtctttgatgtaagaacaaagtgtggtctatacatctaatatggcctttgtacctaaccatgttcataggtaatctttgtactctgtgtgcagcagtatttggtttgcatttaaagtgaaaataacggctgttatttttctggcattactaagataaactgaaaaataataaagaaaaatgccttacatagcccacaagtgtattatttttgcatgtatttattttagagggcagtatttttgaaatcattagtgattctcatttagctcatatatgccatatagaaatattttgcatttttattgtggtctttctttggaggcacttttttcctgtatcaagttataaaa

SEQ ID NO: 839 - DNA, 1469 bp, Homo sapiens
aagaagcctctgcgcctgcgccagggcgcacccgtcggcggtaaaagctgaggggctggcgcgggggattggtgggcgacacttttacgtctacacgtgcctacccgtctgcacgtttctgagtccgcacggttgtcttctcttgctgaatggacataggtgttttgttttgtcccaagagatacaggtccaggggcaagttcatcctactctcgagtctaatgatgatgctcttcagtatgttgaagaattaattttgcaattattaaatatgctatgccaagctcagccccgaagtgcttcagatgtagaggaacgtgttcaaaaaagtttccctcatccaattgataaatgggcaatagctgatgcccaatcagctattgaaaagaggaagcgaagaaaccctttatctctcccagtagaaaaaattcatcctttattaaaggaggtcctaggttataaaattgaccaccaggtttctgtttacatagtagcagtcttagaatacatttctgcagacattttaaagctggttgggaattatgtaagaaatatacggcattatgaaattacaaaacaagatattaaagtggcaatgtgtgctgacaaggtattgatggatatgtttcatcaagatgtagaagatattaatatattatctttaactgacgaagagccttccacctcaggagaacaaacttactatgatttggtaaaagcatttatggcagaaattcgacaatatataagggaactaaatctaattataaaagtttttagagagccctttgtctccaattcaaaattgttttcagctaatgatgtagaaaatatatttagtcgcatagtagatatacatgaacttagtgtaaagttactgggccatatagaagatacagtagaaatgacagatgaaggcagtccccatccactagtaggaagctgctttgaagacttagcagaggaactggcatttgatccatatgaatcgtatgctcgagatattttgcgacctggttttcatgatcgtttccttagtcagttatcaaagcctggggcagcactttatttgcagtcaataggcgaaggtttcaaagaagctgttcaatatgttttacccaggctgcttctggcccctgtttaccactgtctccattactttgaacttttgaagtttccatttggggacctcagcagactcagggactcagtgtgaggataagggagccagtgtgaggataaggccaaagtaatggggaagcagttagaagaaaaaagtgaagatcaagaagacaaggaatgtttaaaacaagcaataacagctttgcttaatgttcagagtggtatggaaaaaatatgttctaaaagtcttgcaaaacgaagactgagtgaatctgcatgtcggttttatagtcagcaaatgaaggggaaacaactagcaatcaagaagatgaacgagattcagaaga

SEQ ID NO: 840 - DNA, 3960 bp, Homo sapiens
gatgcggaggcgctgtcgccggggccatgcagcaggcgccgcagccttacgagttcttcagcgaggagaacagtccgaaatggcggggactgttggtctcggccctgcggaaggttcaggaacaagtgcatcccactctctcagctaatgaagagtctctctattatattgaagagctgatttttcagctgcttaataaattatgcatggcccagccaaggactgttcaagatgtagaggagcgagttcagaagacctttcctcacccaattgataaatgggccattgctgatgcacaatctgctatagaaaaacgaaaacgaagaaatcctcttttactgcctgtggacaaaatccatccttcgttgaaggaagtattagggtacaaagtggactaccatgtatccctatatattgtggctgtactagagtatatctcagctgatattttaaaattggctggtaattatgtttttaatatccggcattatgaaatatctcagcaggacattaaagtgtcaatgtgtgcggataaggttttgatggacatgtttgatcaggatgacataggtttggtttctctctgtgaagatgaacctagttcttctggtgaattaaactactatgatcttgtcagaactgaaatcgcagaagaaagacagtatctacgggaattaaatatgatcataaaagtgtttcgagaagcctttctttctgatagaaagctgtttaaaccttctgatatcgaaaagatttttagtaacatttcagatatacatgaattgactgtgaaacttttaggtttgattgaagacacagttgaaatgactgatgaaagcagtcctcatcccttagctggcagctgttttgaagatttggcagaagagcaagcatttgatccttatgaaacattatcacaggacattctttcaccagagtttcatgaacatttcaataaattgatggccagacctgcagttgctctacactttcagcaattgaaagcatgtagtgaagaacaagaagacagagaatgtttgaaccaagctattactgctctcatgaatctccaaggtagcatggaccgaatttacaagcagtattcacctagacgtcgacctggagatcctgtttgccctttttatagtcaccaattaagaagcaaacacctggctatcaaaaaaatgaatgaaattcagaaaaatatcgatggatgggaaggcaaagatattggacagtgttgtaatgaattcattatggagggaccattgacaagaatcggtgccaaacatgaacggcatatttttctgtttgatggcttaatgatcagttgtaaacctaatcatggccagactcggcttccaggttacagtagtgcagaatacaggttaaaagaaaaatttgtcatgaggaaaatacaaatttgtgataaagaagatacttgtgagcacaagcatgcatttgaattagtatccaaagatgagaacagcataatatttgctgctaagtctgctgaagaaaaaaacaactggatggcagcccttatttctcttcattatcgtagtactctagatcgaatgttagattcagtattattgaaagaagaaaatgagcaaccactgagattaccaagtcctgaagtatatcgttttgtagtaaaagactctgaggaaaacattgtttttgaagacaacttgcaaagtagaagtggcatccccattattaaaggaggaactgtagtgaaattaattgaaaggttaacatatcatatgtatgcagatcccaattttgttcgtacttttcttaccacatatcgttcattttgtaaaccacaggaattgctgagcttactgattgaacggtttgaaattccagagccagaacctactgacgcagacaaattggcaatagagaaaggcgagcagccaatcagtgcagaccttaaaagatttcgcaaggaatatgtccaaccagtacaacttaggatcttaaatgtatttcggcattgggttgaacatcatttttatgactttgaaagagacttggaattgcttgaaagactagaatccttcatttcaagtgtaagagggaaagctatgaaaaaatgggtagagtcaattgctaagatcatcaggaggaagaagcaagctcaggcaaacggagtaagccataatattacctttgaaagtccacctccaccaattgaatggcatatcagcaaaccaggacagtttgaaacatttgatctcatgacacttcatccaatagaaattgcacgtcagctgacacttttggagtctgatctttacaggaaagttcaaccgtctgaacttgtagggagtgtgtggaccaaagaagataaagaaataaattctccaaatttattaaaaatgattcgccataccacaaatctcaccctctggtttgaaaaatgcattgtggaagcagaaaattttgaagaacgggtggcagtactaagtagaattatagaaattctgcaagtttttcaagatttgaataatttcaatggcgtattggagatagtcagtgcagtaaattcagtgtcagtatacagactagaccatacctttgaggcactgcaggaaaggaaaaggaaaattttggacgaagctgtggaattaagtcaagatcactttaaaaaatacctagtaaaacttaagtcaatcaatccaccttgtgtgcctttttttggaatatatttaacaaatattctgaagaccgaagaagggaataatgattttttaaaaaagaaagggaaagatttaatcaatttcagtaagaggaggaaagtagctgaaattactggagaaattcagcagtatcagaatcagccttactgtttacggatagaaccagatatgaggagattctttgaaaaccttaaccccatgggaagtgcatctgaaaaagagtttacagattatttgttcaacaagtcactagaaattgaacctcgaaactgcaaacagccacctcgatttcctaggaaatcaactttttccttaaaatctcctggaataaggcctaacacaggccgacatggctctacctcaggtactttacgaggtcacccaacaccattagaaagagaaccatgtaaaataagctttagtcggattgctgaaactgagctggaatcaacagtgtcagcaccaacctctccaaatacaccatctactccaccagtatctgcttcttcagaccttagtgtatttttagatgtggatctcaacagctcctgtggcagcaatagcatctttgctccagtgcttttgccacattcaaagtctttctttagttcatgtggtagtttacataaactaagtgaagagcccctgattcctcctcctcttcctcctcgaaaaaagtttgatcatgatgcttcaaattccaagggaaatatgaaatctgatgatgatcctcctgctattccaccgagacagcctcctcctccaaaggtaaaacccagagttcctgttcctactggtgcatttgatgggcctctgcatagtccacctccgccaccaccaagagatcctcttcctgatacccctccaccagttccccttcggcctccagaacactttataaactgtccatttaatcttcagccacctccactggggcatcttcacagagattcagactggctcagagacattagtacgtgtccaaattcgccaagcactcctcctagcacaccctctccaagggtaccgcgtcgatgctatgtgctcagttctagtcagaataatcttgctcatcctccagctccccctgttccaccaaggcagaattcaagccctcatctgccaaaactgccaccaaagacttacaaacgggagctttcgcaccccccattgtacagactgcctttgctagaaaatgcagaaactccccaatgaccttagccatatgtagtcattgacactggaatgg

SEQ ID NO: 841 - DNA, 8269 bp, Homo sapiens
ccgccgcccctctccccgcccagaggcgccccgggggcaccatgcaggcgcagcagctgccctacgagtttttcagcgaagagaacgcgcccaagtggcggggactactggtgcctgcgctgaaaaaggtccaggggcaagttcatcctactctcgagtctaatgatgatgctcttcagtatgttgaagaattaattttgcaattattaaatatgctatgccaagctcagccccgaagtgcttcagatgtagaggaacgtgttcaaaaaagtttccctcatccaattgataaatgggcaatagctgatgcccaatcagctattgaaaagaggaagcgaagaaaccctttatctctcccagtagaaaaaattcatcctttattaaaggaggtcctaggttataaaattgaccaccaggtttctgtttacatagtagcagtcttagaatacatttctgcagacattttaaagctggttgggaattatgtaagaaatatacggcattatgaaattacaaaacaagatattaaagtggcaatgtgtgctgacaaggtattgatggatatgtttcatcaagatgtagaagatattaatatattatctttaactgacgaagagccttccacctcaggagaacaaacttactatgatttggtaaaagcatttatggcagaaattcgacaatatataagggaactaaatctaattataaaagtttttagagagccctttgtctccaattcaaaattgttttcagctaatgatgtagaaaatatatttagtcgcatagtagatatacatgaacttagtgtaaagttactgggccatatagaagatacagtagaaatgacagatgaaggcagtccccatccactagtaggaagctgctttgaagacttagcagaggaactggcatttgatccatatgaatcgtatgctcgagatattttgcgacctggttttcatgatcgtttccttagtcagttatcaaagcctggggcagcactttatttgcagtcaataggcgaaggtttcaaagaagctgttcaatatgttttacccaggctgcttctggcccctgtttaccactgtctccattactttgaacttttgaagcagttagaagaaaaaagtgaagatcaagaagacaaggaatgtttaaaacaagcaataacagctttgcttaatgttcagagtggtatggaaaaaatatgttctaaaagtcttgcaaaacgaagactgagtgaatctgcatgtcggttttatagtcagcaaatgaaggggaaacaactagcaatcaagaagatgaacgagattcagaagaatattgatggttgggagggaaaagacattggacagtgttgtaatgaatttataatggaaggaactcttacacgtgtaggagccaaacatgagagacacatatttctctttgatggcttaatgatttgctgtaaatcaaatcatgggcagccaagacttcctggtgctagcaatgcagaatatcgtcttaaagaaaagttttttatgcgaaaggtacaaattaatgataaagatgacaccaatgaatacaagcatgcttttgaaataattttaaaagatgaaaatagtgttatattttctgccaagtcagctgaagagaaaaacaattggatggcagcattgatatctttacagtaccggagtacactggaaaggatgcttgatgtaacaatgctacaggaagagaaagaggagcagatgaggctgcctagtgctgatgtttatagatttgcagagcctgactctgaagagaatattatatttgaagagaacatgcagcccaaggctggaattccaattatcaaagcaggaactgttattaaacttatagagaggcttacgtaccatatgtacgcagatcccaattttgttcggacatttcttacaacatacagatccttttgcaaacctcaagaactactgagtcttataatagaaaggtttgaaattccagagcctgagccaacagaagctgatcgcatagctatagagaatggagatcaacccttgagtgcagaactgaaaagatttagaaaagaatatatacagcctgtgcaactgcgagtattaaatgtatgtcggcactgggtagagcaccacttctatgattttgaaagagatgcatatcttttgcaacgaatggaagaatttattggaacagtaagaggtaaagcaatgaaaaaatgggttgaatccatcactaaaataatccaaaggaaaaaaattgcaagagacaatggaccaggtcataatattacatttcagagttcacctcccacagttgagtggcatataagcagacctgggcacatagagacttttgacctgctcaccttacacccaatagaaattgctcgacaactcactttacttgaatcagatctataccgagctgtacagccatcagaattagttggaagtgtgtggacaaaagaagacaaagaaattaactctcctaatcttctgaaaatgattcgacataccaccaacctcactctgtggtttgagaaatgtattgtagaaactgaaaatttagaagaaagagtagctgtggtgagtcgaattattgagattctacaagtctttcaagagttgaacaactttaatggtgtccttgaggttgtcagtgctatgaattcatcacctgtttacagactagaccacacatttgagcaaataccaagtcgccagaagaaaattttagaagaagctcatgaattgagtgaagatcactataagaaatatttggcaaaactcaggtctattaatccaccatgtgtgcctttctttggaatttatctcactaatatcttgaaaacagaagaaggcaaccctgaggtcctaaaaagacatggaaaagagcttataaactttagcaaaaggaggaaagtagcagaaataacaggagagatccagcagtaccaaaatcagccttactgtttacgagtagaatcagatatcaaaaggttctttgaaaacttgaatccgatgggaaatagcatggagaaggaatttacagattatcttttcaacaaatccctagaaatagaaccacgaaaccctaagcctctcccaagatttccaaaaaaatatagctatcccctaaaatctcctggtgttcgtccatcaaacccaagaccaggtaccatgaggcatcccacacctctgcagcaggagccaaggaaaattagttatagtaggatccctgaaagtgaaacagaaagtacagcatctgcaccaaattctccaagaacaccgttaacacctccgcctgcttctggtgcttccagtaccacagatgtttgcagtgtatttgattccgatcattcgagcccttttcactcaagatctgcttctgtatcatctataagtttaaccaaaggcactgatgaagtgcctgtccctcctcctgttcctccacgaagacgaccagaatctgccccagcagaatcttcaccatctaagattatgtctaagcatttggacagtcccccagccattcctcctaggcaacccacatcaaaagcctattcaccacgatattcaatatcagaccggacctctatctcagaccctcctgaaagccctcccttattaccaccacgagaacctgtgaggacacctgatgttttctcaagctcaccactacatctccaacctccccctttgggcaaaaaaagtgaccatggcaatgccttcttcccaaacagcccttccccctttacaccacctcctcctcaaacaccttctcctcacggcacaagaaggcatctgccatcaccaccattgacacaagaagtggaccttcattccattgctgggccgcctgttcctccacgacaaagcacttctcaacatatccctaaactccctccaaaaacttacaaaagggagcacacacacccatccatgcacagagatggaccaccactgttggagaatgcccattcttcctgagttcctctgtactgggatgtatattttcctagccccaaatccattgctggcaatggatgcactgaatgtgccagcactgaggagttaaaatgagaactccaaacactaacgactcttcttcaagatgcagtataagacaatgaattttaacctagatgtaattatacaatggaaatggtattccagtttagaatatggaaagaccgacctagaggaattggacaactgattgcacctgaaaatcataaagggactttttctggccaataggcaggagtcctctttttgtgaagtgatcttttgtgaagtgatcattaaagggatggaaaacacagtctagtgtccagcaggcccacatgacagtttttgtaattcaaattatgcacttttaaaaaaaaaaacttaaacagggatcttaatatcttcctttgttttcctttgctttactcttctactttagaatattttcttaaaaatcactcaaaggactgtgaggaaaggctgtggtacctgaccttgttgaaatcaaggcccggcactgtactacaggcctgtttacagattattacggtgaactgaatgggtaccgaggcttcaccaaagaggtacttttttgttgttgttgttgttttaggaataattgtaccaattttaagagcattccccccacctgtccccacacacccaaacaaaatgtggtggtgttgccttcaaaaaagagaagttttgtgtcattaacatgacagaagaactttttaaaaaaaaataactgtcaactattctatttgcatttaggagactgttcatctatgctagattgtcattttccctccttctcccacagaagtttactggtagtccatgtcatggctcgtagctatccctctaaccataccatggaaatgcaggcacccaatgtgaaaaggagcacttgctgggcatcactgacaccgctcatgttttacacatagttgagtaatcagcatatctagaattatcttgcattgcctaaatcatatgtatatagtgaatgttatataatatacctggcaggtctgttttaatttaattgaataaagatacaaatactttgtttggctggcatatattaaattattatatgaagaaaatggttgattcttatttcttttagttgaaaaacacacaaaaacactaaacataaaagcacgttttgtggtacgccttggtttctagttctggatatatgtattaatcttaaagaatgatctaaagtcacagcttggcatataggaagatacttggttagaataggatgggtatcttttaagcagaactttgtaagtaagttttaagttcctaagcaacaagtatacagtttgttaaggtttatattgaacattctaccttgcttgaggttttctgctttatcaaaactattcataatagaacatctacctgcatcattactatcataatatggattattcataaagcgtatgtactgttcttctgagtctaacaaatactgtgactgaaatgcatgcaccttgttgaagagaaaacattttattaatctccactataatgtctgtgaaatgtgcagtattccatccttagagagtttatctggttcatcagcatctgcatgtatcctctgaataatgaagcaacatttcagcaattctgttaaccacaccattagagacatttttagaagtgctgcaacatggtgggaacctagtactttaataatttcctatgatatttattagagcataaaatgtacatcacgatagtacagtatgtagtcctttaagaccagaaggtatgttaactgcaccatcattaagcagtctatcctattttcttatttatttgttagaattgaatcctttctcaatatctgtaccattcctatgatggtagccattcttctctttataaaatatttcctctttgaaaagcgtcctaaaacattaatttcaaatcccctcttggatgcaaagtgtccctaagaccatccattcaacagtatttatgtgagccaacttactagagccgctacaactaatcatgatagacagtccagaatctccctggactttatactgggccagcctcattgtccctaagatttctctttttatgtctcatggattacttctctttttaattgccccaggcacattccaaatgagaacctggtaaaagtcacattggacccccttcagtatgtcttcggctaatgtgttagccttcaataaggtgataaccccttttcaacctatctagtctataaagaggaaaaattcagatttggagttctaatcctatttctcccaaagggaactattcttctaccccatggttctaggagaccacttcactgtgcaacagttttacatgcattgtggatggaggatatttttattctgaactgttacatttaggtaaaaatattttctgcagtggtaactgattagaaaaatgccaattggatgcccttaggtggaggtgagaaaatggcatccttgccttcttctcaatatgaaacattaactagttgacaaatttatccttgtagtaatgaaaatctatttaatcagggaccagaaatggctgaggagataaatgcatcattacaaaattctgcttttgaatcctggacattacaagggggtaaatgcagcatgactttttgttaaccacattccaaaatgtggaacatttcttttagaaatgaaaatatttcaaggctgatgtattttaagactacacattatcaggaaacatacattgagagttcgcttaattaaaggttgttgggcatcaaattatgtttagtaggttactattctctaacaactcaaggatgctttaatggatctgaatttgacaaagagcatgccacactaatactacagtcaacaacagcccagagaacaattactatgtcagctggaggctatattatgattctaaattcttaaaggtttttttccctccataaatcaaaaattaccttatgtaaaccaaaaattagttggtatttatggtcatgatcttaattctcaagtttagcttaatcttgtatttcattgtttgtcttctaatatgacagcttaaattcagatttttaagtgactcagcaaaataggaggagtgtcccaatttattagtgttgtacatattgaagaaaacctttttgttccttcagatttagaaagaaacagtttaaccatttatttcttggtattctgctgctgtgaataggtttacttattcttttaacatatattgtgtgactacgcaagtataggtcctgttgtattgcattaatctttaccagtaactaaacatcacaaggttaatattggtttggctgaaagaattatgcagtaaagttatttataagggaacatgatgactttattcaatatttttcttctttgaaacatctcattactaacttttaagattatttcataatcccttatacatgagccaatgaaatattttgagctctacttaagaagcatgaagtctatattataaatctaaacaacaaaagcacttgtaacttgtttagtaaattccatgccttattttccatttttgacaccgtaaagtgcattttctgtcgactgtgagcaaatttcccttttgcctttaatgaaaatagtgcattaagtagccaattgctgcagaattataaagcaaattagctaacagtgggtcacattggactaccactcaaagaaacaagatgcataacagatgatggaaggtacatgtggtgtggcttagggagagcgcacctgtgccagatgcatgccactttcagtagctgccaaatgtgcctttaattaagaacatctctaatttttttcttcagatcaagtcagcatttggggtcgggatttgggcagggaactttggggtgcaaatatctggtgaaaccaccagagaatttgtttgtcaaagtgacatgtataattttagttgagacgtgtttgtgtatatatgtgtatttgcctttgtttagtagcacggttatttgctaaaataattgtcaaaaaattgctctgtcggtcggtctttgatgtaagaacaaagtgtggtctatacatctaatatggcctttgtacctaaccatgttcataggtaatctttgtactctgtgtgcagcagtatttggtttgcatttaaagtgaaaataacggctgttatttttctggcattactaagataaactgaaaaataataaagaaaaatgccttacatagccc

SEQ ID NO: 842 - DNA, 831 bp, Homo sapiens
gcagccgcggtgttgtgctgtggggaagggagaaggatttgtaaaccccggagcgaggttctgcttacccgaggccgctgctgtgcggagacccccgggtgaagccaccgtcatcatgtctgaccaggatagcagtgagattcacttcaaagtgaaaatgacaacacatctcaagaaactcaaagaatcatactgtcaaagacagggtgttccaatgaattcactcaggtttctctttgagggtcagagaattgctgataatcatactccaaaagaactgggaatggaggaagaagatgtgattgaagtttatcaggaacaaacggggggtcattcaacagtttagatattctttttattttttttcttttccctcaatccttttttatttttaaaaatagttcttttgtaatgtggtgttcaaaacggaattgaaaactggcaccccatctctttgaaacatctggtaatttgaattctagtgctcattattcattattgtttgttttcattgtgctgatttttggtgatcaagcctcagtccccttcatattaccctctcctttttaaaaattacgtgtgcacagagaggtcacctttttcaggacattgcattttcaggcttgtggtgataaataagatcgaccaatgcaagtgttcataatgactttccaattggccctgatgttctagcatgtgattacttcactcctggactgtgactttcagtgggagatggaagtttttcagagaactgaactgtggaaaaatgacctttccttaacttgaagctacttttaaaatttgagggtctggaccaaaagaagagga

SEQ ID NO: 843 - DNA, 1071 bp, Homo sapiens
gcggaagtgacgcgaggcgtagcggaagttactgcagccgcggtgttgtgctgtggggaagggagaaggatttgtaaaccccggagcgaggttctgcttacccgaggccgctgctgtgcggagacccccgggtgaagccaccgtcatcatgtctgaccaggaggcaaaaccttcaactgaggacttgggggataagaaggaaggtgaatatattaaactcaaagtcattggacaggatagcagtgagattcacttcaaagtgaaaatgacaacacatctcaagaaactcaaagaatcatactgtcaaagacagggtgttccaatgaattcactcaggtttctctttgagggtcagagaattgctgataatcatactccaaaagaactgggaatggaggaagaagatgtgattgaagtttatcaggaacaaacggggggtcattcaacagtttagttttaaaatttgagggtctggaccaaaagaagaggaatatcaggttgaagtcaagatgacagataaggtgagagtaatgactaactccaaagatggcttcactgaagaaaaggcattttaagattttttaaaaatcttgtcagaagatcccagaaaagttctaattttcattagcaattaataaagctatacatgcagaaatgaatacaacagaacactgctctttttgattttatttgtactttttggcctgggatatgggttttaaatggacattgtctgtaccagcttcattaaaataaacaatatttgtaaaaatcatactaatgcttattttattttaattgtatagaaagaaaaaaatgcctaaaataaggttttcttgcataaatactggaaattgcacatggtacaaattttttcttcattactgtacagtgatgatgttaatgactttgaagcactgaaagttactgaagtgccttctgaatcaaggatttaattaaggccacaatacctttttaatactcagtgttctgtttttttaaaaacttgatattcctgtatggtgcatatatgatacagttacctaatcatgttgaataaatgggcatgcc

SEQ ID NO: 844 - DNA, 1536 bp, Homo sapiens
ctgcgcgaagcggaagtgacgcgaggcgtagcggaagttactgcagccgcggtgttgtgctgtggggaagggagaaggatttgtaaaccccggagcgaggttctgcttacccgaggccgctgctgtgcggagacccccgggtgaagccaccgtcatcatgtctgaccaggaggcaaaaccttcaactgaggacttgggggataagaaggaaggtgaatatattaaactcaaagtcattggacaggatagcagtgagattcacttcaaagtgaaaatgacaacacatctcaagaaactcaaagaatcatactgtcaaagacagggtgttccaatgaattcactcaggtttctctttgagggtcagagaattgctgataatcatactccaaaagaactgggaatggaggaagaagatgtgattgaagtttatcaggaacaaacggggggtcattcaacagtttagatattctttttattttttttcttttccctcaatccttttttatttttaaaaatagttcttttgtaatgtggtgttcaaaacggaattgaaaactggcaccccatctctttgaaacatctggtaatttgaattctagtgctcattattcattattgtttgttttcattgtgctgatttttggtgatcaagcctcagtccccttcatattaccctctcctttttaaaaattacgtgtgcacagagaggtcacctttttcaggacattgcattttcaggcttgtggtgataaataagatcgaccaatgcaagtgttcataatgactttccaattggccctgatgttctagcatgtgattacttcactcctggactgtgactttcagtgggagatggaagtttttcagagaactgaactgtggaaaaatgacctttccttaacttgaagctacttttaaaatttgagggtctggaccaaaagaagaggaatatcaggttgaagtcaagatgacagataaggtgagagtaatgactaactccaaagatggcttcactgaagaaaaggcattttaagattttttaaaaatcttgtcagaagatcccagaaaagttctaattttcattagcaattaataaagctatacatgcagaaatgaatacaacagaacactgctctttttgattttatttgtactttttggcctgggatatgggttttaaatggacattgtctgtaccagcttcattaaaataaacaatatttgtaaaaatcatactaatgcttattttattttaattgtatagaaagaaaaaaatgcctaaaataaggttttcttgcataaatactggaaattgcacatggtacaaattttttcttcattactgtacagtgatgatgttaatgactttgaagcactgaaagttactgaagtgccttctgaatcaaggatttaattaaggccacaatacctttttaatactcagtgttctgtttttttaaaaacttgatattcctgtatggtgcatatatgatacagttacctaatcatgttgaataaatgggcatgccaaaaatt

SEQ ID NO: 845 - DNA, 534 bp, Homo sapiens
ccaccgtcatcatgtctgaccaggaggcaaaaccttcaactgaggacttgggggataagaaggaaggtgaatatattaaactcaaagtcattggacagcagtgagattcacttcaaagtgaaaatgacaacacatctcaagaaactcaaagaatcatactgtcaaagacagggtgttccaatgaattcactcaggtttctctttgagggtcagagaattgctgataatcatactccaaaagaactgggaatggaggaagaagatgtgattgaagtttatcaggaacaaacggggggtcattcaacagtttagatattctttttattttttttcttttccctcaatccttttttatttttaaaaatagttcttttgtaatgtggtgttcaaaacggaattgaaaactggcaccccatctctttgaaacatctggtaatttgaattctagtgctcattattcattattgtttgttttcattgtgctgatttttggtgatcaagcctcagtccccttcatattaccctctccttttt

SEQ ID NO: 846 - DNA, 779 bp, Homo sapiens
gaggcgtagcggaagttactgcagccgcggtgttgtgctgtggggaagggagaaggatttgtaaaccccggagcgaggttctgcttacccgaggccgctgctgtgcggagacccccgggtgaagccaccgtcatcatgtctgaccaggctctgtggattagactcacctctgcttcttggtgtgtggggcctcagctgagatgactcaagtggctgggggctggaacagctagttgtcaggaggcaaaaccttcaactgaggacttgggggataagaaggaaggtgaatatattaaactcaaagtcattggacaggatagcagtgagattcacttcaaagtgaaaatgacaacacatctcaagaaactcaaagaatcatactgtcaaagacagggtgttccaatgaattcactcaggtttctctttgagggtcagagaattgctgataatcatactccaaaagaactgggaatggaggaagaagatgtgattgaagtttatcaggaacaaacggggggtcattcaacagtttagatattctttttattttttttcttttccctcaatccttttttatttttaaaaatagttcttttgtaatgtggtgttcaaaacggaattgaaaactggcaccccatctctttgaaacatctggtaatttgaattctagtgctcattattcattattgtttgttttcattgtgctgatttttggtgatcaagcctcagtccccttcatattaccctctcctttttaaaaattacgtgtgcacagagag

SEQ ID NO: 847 - DNA, 2699 bp, Homo sapiens
cccagaaggccgcggggggtggaccgcctaagagggcgtgcgctcccgacatgccccgcggcgcgccattaaccgccagatttgaatcgcgggacccgttggcagaggtggcggcggcggcatgggtgccccgacgttgccccctgcctggcagccctttctcaaggaccaccgcatctctacattcaagaactggcccttcttggagggctgcgcctgcaccccggagcggatggccgaggctggcttcatccactgccccactgagaacgagccagacttggcccagtgtttcttctgcttcaaggagctggaaggctgggagccagatgacgaccccattgggccgggcacggtggcttacgcctgtaataccagcactttgggaggccgaggcgggcggatcacgagagaggaacataaaaagcattcgtccggttgcgctttcctttctgtcaagaagcagtttgaagaattaacccttggtgaatttttgaaactggacagagaaagagccaagaacaaaattgcaaaggaaaccaacaataagaagaaagaatttgaggaaactgcggagaaagtgcgccgtgccatcgagcagctggctgccatggattgaggcctctggccggagctgcctggtcccagagtggctgcaccacttccagggtttattccctggtgccaccagccttcctgtgggccccttagcaatgtcttaggaaaggagatcaacattttcaaattagatgtttcaactgtgctcttgttttgtcttgaaagtggcaccagaggtgcttctgcctgtgcagcgggtgctgctggtaacagtggctgcttctctctctctctctcttttttgggggctcatttttgctgttttgattcccgggcttaccaggtgagaagtgagggaggaagaaggcagtgtcccttttgctagagctgacagctttgttcgcgtgggcagagccttccacagtgaatgtgtctggacctcatgttgttgaggctgtcacagtcctgagtgtggacttggcaggtgcctgttgaatctgagctgcaggttccttatctgtcacacctgtgcctcctcagaggacagtttttttgttgttgtgtttttttgtttttttttttttggtagatgcatgacttgtgtgtgatgagagaatggagacagagtccctggctcctctactgtttaacaacatggctttcttattttgtttgaattgttaattcacagaatagcacaaactacaattaaaactaagcacaaagccattctaagtcattggggaaacggggtgaacttcaggtggatgaggagacagaatagagtgataggaagcgtctggcagatactccttttgccactgctgtgtgattagacaggcccagtgagccgcggggcacatgctggccgctcctccctcagaaaaaggcagtggcctaaatcctttttaaatgacttggctcgatgctgtgggggactggctgggctgctgcaggccgtgtgtctgtcagcccaaccttcacatctgtcacgttctccacacgggggagagacgcagtccgcccaggtccccgctttctttggaggcagcagctcccgcagggctgaagtctggcgtaagatgatggatttgattcgccctcctccctgtcatagagctgcagggtggattgttacagcttcgctggaaacctctggaggtcatctcggctgttcctgagaaataaaaagcctgtcatttcaaacactgctgtggaccctactgggtttttaaaatattgtcagtttttcatcgtcgtccctagcctgccaacagccatctgcccagacagccgcagtgaggatgagcgtcctggcagagacgcagttgtctctgggcgcttgccagagccacgaaccccagacctgtttgtatcatccgggctccttccgggcagaaacaactgaaaatgcacttcagacccacttatttctgccacatctgagtcggcctgagatagacttttccctctaaactgggagaatatcacagtggtttttgttagcagaaaatgcactccagcctctgtactcatctaagctgcttatttttgatatttgtgtcagtctgtaaatggatacttcactttaataactgttgcttagtaattggctttgtagagaagctggaaaaaaatggttttgtcttcaactcctttgcatgccaggcggtgatgtggatctcggcttctgtgagcctgtgctgtgggcagggctgagctggagccgcccctctcagcccgcctgccacggcctttccttaaaggccatccttaaaaccagaccctcatggctaccagcacctgaaagcttcctcgacatctgttaataaagccgtaggcccttgtctaagtgcaaccgcctagactttctttcagatacatgtccacatgtccatttttcaggttctctaagttggagtggagtctgggaagggttgtgaatgaggcttctgggctatgggtgaggttccaatggcaggttagagcccctcgggccaactgccatcctggaaagtagagacagcagtgcccgctgcccagaagagaccagcaagccaaactggagcccccattgcaggctgtcgccatgtggaaagagtaactcacaattgccaataaagtctcatgtggttttatct

SEQ ID NO: 848 - DNA, 2630 bp, Homo sapiens
cccagaaggccgcggggggtggaccgcctaagagggcgtgcgctcccgacatgccccgcggcgcgccattaaccgccagatttgaatcgcgggacccgttggcagaggtggcggcggcggcatgggtgccccgacgttgccccctgcctggcagccctttctcaaggaccaccgcatctctacattcaagaactggcccttcttggagggctgcgcctgcaccccggagcggatggccgaggctggcttcatccactgccccactgagaacgagccagacttggcccagtgtttcttctgcttcaaggagctggaaggctgggagccagatgacgaccccatagaggaacataaaaagcattcgtccggttgcgctttcctttctgtcaagaagcagtttgaagaattaacccttggtgaatttttgaaactggacagagaaagagccaagaacaaaattgcaaaggaaaccaacaataagaagaaagaatttgaggaaactgcggagaaagtgcgccgtgccatcgagcagctggctgccatggattgaggcctctggccggagctgcctggtcccagagtggctgcaccacttccagggtttattccctggtgccaccagccttcctgtgggccccttagcaatgtcttaggaaaggagatcaacattttcaaattagatgtttcaactgtgctcttgttttgtcttgaaagtggcaccagaggtgcttctgcctgtgcagcgggtgctgctggtaacagtggctgcttctctctctctctctcttttttgggggctcatttttgctgttttgattcccgggcttaccaggtgagaagtgagggaggaagaaggcagtgtcccttttgctagagctgacagctttgttcgcgtgggcagagccttccacagtgaatgtgtctggacctcatgttgttgaggctgtcacagtcctgagtgtggacttggcaggtgcctgttgaatctgagctgcaggttccttatctgtcacacctgtgcctcctcagaggacagtttttttgttgttgtgtttttttgtttttttttttttggtagatgcatgacttgtgtgtgatgagagaatggagacagagtccctggctcctctactgtttaacaacatggctttcttattttgtttgaattgttaattcacagaatagcacaaactacaattaaaactaagcacaaagccattctaagtcattggggaaacggggtgaacttcaggtggatgaggagacagaatagagtgataggaagcgtctggcagatactccttttgccactgctgtgtgattagacaggcccagtgagccgcggggcacatgctggccgctcctccctcagaaaaaggcagtggcctaaatcctttttaaatgacttggctcgatgctgtgggggactggctgggctgctgcaggccgtgtgtctgtcagcccaaccttcacatctgtcacgttctccacacgggggagagacgcagtccgcccaggtccccgctttctttggaggcagcagctcccgcagggctgaagtctggcgtaagatgatggatttgattcgccctcctccctgtcatagagctgcagggtggattgttacagcttcgctggaaacctctggaggtcatctcggctgttcctgagaaataaaaagcctgtcatttcaaacactgctgtggaccctactgggtttttaaaatattgtcagtttttcatcgtcgtccctagcctgccaacagccatctgcccagacagccgcagtgaggatgagcgtcctggcagagacgcagttgtctctgggcgcttgccagagccacgaaccccagacctgtttgtatcatccgggctccttccgggcagaaacaactgaaaatgcacttcagacccacttatttctgccacatctgagtcggcctgagatagacttttccctctaaactgggagaatatcacagtggtttttgttagcagaaaatgcactccagcctctgtactcatctaagctgcttatttttgatatttgtgtcagtctgtaaatggatacttcactttaataactgttgcttagtaattggctttgtagagaagctggaaaaaaatggttttgtcttcaactcctttgcatgccaggcggtgatgtggatctcggcttctgtgagcctgtgctgtgggcagggctgagctggagccgcccctctcagcccgcctgccacggcctttccttaaaggccatccttaaaaccagaccctcatggctaccagcacctgaaagcttcctcgacatctgttaataaagccgtaggcccttgtctaagtgcaaccgcctagactttctttcagatacatgtccacatgtccatttttcaggttctctaagttggagtggagtctgggaagggttgtgaatgaggcttctgggctatgggtgaggttccaatggcaggttagagcccctcgggccaactgccatcctggaaagtagagacagcagtgcccgctgcccagaagagaccagcaagccaaactggagcccccattgcaggctgtcgccatgtggaaagagtaactcacaattgccaataaagtctcatgtggttttatct

SEQ ID NO: 849 - DNA, 2512 bp, Homo sapiens
cccagaaggccgcggggggtggaccgcctaagagggcgtgcgctcccgacatgccccgcggcgcgccattaaccgccagatttgaatcgcgggacccgttggcagaggtggcggcggcggcatgggtgccccgacgttgccccctgcctggcagccctttctcaaggaccaccgcatctctacattcaagaactggcccttcttggagggctgcgcctgcaccccggagcggatggccgaggctggcttcatccactgccccactgagaacgagccagacttggcccagtgtttcttctgcttcaaggagctggaaggctgggagccagatgacgaccccatgcaaaggaaaccaacaataagaagaaagaatttgaggaaactgcggagaaagtgcgccgtgccatcgagcagctggctgccatggattgaggcctctggccggagctgcctggtcccagagtggctgcaccacttccagggtttattccctggtgccaccagccttcctgtgggccccttagcaatgtcttaggaaaggagatcaacattttcaaattagatgtttcaactgtgctcttgttttgtcttgaaagtggcaccagaggtgcttctgcctgtgcagcgggtgctgctggtaacagtggctgcttctctctctctctctcttttttgggggctcatttttgctgttttgattcccgggcttaccaggtgagaagtgagggaggaagaaggcagtgtcccttttgctagagctgacagctttgttcgcgtgggcagagccttccacagtgaatgtgtctggacctcatgttgttgaggctgtcacagtcctgagtgtggacttggcaggtgcctgttgaatctgagctgcaggttccttatctgtcacacctgtgcctcctcagaggacagtttttttgttgttgtgtttttttgtttttttttttttggtagatgcatgacttgtgtgtgatgagagaatggagacagagtccctggctcctctactgtttaacaacatggctttcttattttgtttgaattgttaattcacagaatagcacaaactacaattaaaactaagcacaaagccattctaagtcattggggaaacggggtgaacttcaggtggatgaggagacagaatagagtgataggaagcgtctggcagatactccttttgccactgctgtgtgattagacaggcccagtgagccgcggggcacatgctggccgctcctccctcagaaaaaggcagtggcctaaatcctttttaaatgacttggctcgatgctgtgggggactggctgggctgctgcaggccgtgtgtctgtcagcccaaccttcacatctgtcacgttctccacacgggggagagacgcagtccgcccaggtccccgctttctttggaggcagcagctcccgcagggctgaagtctggcgtaagatgatggatttgattcgccctcctccctgtcatagagctgcagggtggattgttacagcttcgctggaaacctctggaggtcatctcggctgttcctgagaaataaaaagcctgtcatttcaaacactgctgtggaccctactgggtttttaaaatattgtcagtttttcatcgtcgtccctagcctgccaacagccatctgcccagacagccgcagtgaggatgagcgtcctggcagagacgcagttgtctctgggcgcttgccagagccacgaaccccagacctgtttgtatcatccgggctccttccgggcagaaacaactgaaaatgcacttcagacccacttatttctgccacatctgagtcggcctgagatagacttttccctctaaactgggagaatatcacagtggtttttgttagcagaaaatgcactccagcctctgtactcatctaagctgcttatttttgatatttgtgtcagtctgtaaatggatacttcactttaataactgttgcttagtaattggctttgtagagaagctggaaaaaaatggttttgtcttcaactcctttgcatgccaggcggtgatgtggatctcggcttctgtgagcctgtgctgtgggcagggctgagctggagccgcccctctcagcccgcctgccacggcctttccttaaaggccatccttaaaaccagaccctcatggctaccagcacctgaaagcttcctcgacatctgttaataaagccgtaggcccttgtctaagtgcaaccgcctagactttctttcagatacatgtccacatgtccatttttcaggttctctaagttggagtggagtctgggaagggttgtgaatgaggcttctgggctatgggtgaggttccaatggcaggttagagcccctcgggccaactgccatcctggaaagtagagacagcagtgcccgctgcccagaagagaccagcaagccaaactggagcccccattgcaggctgtcgccatgtggaaagagtaactcacaattgccaataaagtctcatgtggttttatct

SEQ ID NO: 850 - DNA, 476 bp, Homo sapiens
agatttgaatcgcgggacccgttggcagaggtggcggcggcggcatgggtgccccgacgttgccccctgcctggcagccctttctcaaggaccaccgcatctctacattcaagaactggcccttcttggagggctgcgcctgcaccccggagcggatggccgaggctggcttcatccactgccccactgagaacgagccagacttggcccagtgtttcttctgcttcaaggagctggaaggctgggagccagatgacgaccccattgggccgggcacggtggcttacgcctgtaataccagcactttgggaggccgaggcgggcggatcacgagagaggaacataaaaagcattcgtccggttgcgctttcctttctgtcaagaagcagtttgaagaattaacccttggtgaatttttgaaactggacagagaaagagccaagaacaaaattgagagagctctgttagcagaatga

SEQ ID NO: 851 - DNA, 1357 bp, Homo sapiens
agcatcctgagtaatgagtggcctgggccggagcaggcgaggtggccggagccgtgtggaccaggaggagcgctttccacagggcctgtggacgggggtggctatgagatcctgccccgaagagcagtactgggatcctctgctgggtacctgcatgtcctgcaaaaccatttgcaaccatcagagccagcgcacctgtgcagccttctgcaggtcactcagctgccgcaaggagcaaggcaagttctatgaccatctcctgagggactgcatcagctgtgcctccatctgtggacagcaccctaagcaatgtgcatacttctgtgagaacaagctcaggagcccagtgaaccttccaccagagctcaggagacagcggagtggagaagttgaaaacaattcagacaactcgggaaggtaccaaggattggagcacagaggctcagaagcaagtccagctctcccggggctgaagctgagtgcagatcaggtggccctggtctacagcacgctggggctctgcctgtgtgccgtcctctgctgcttcctggtggcggtggcctgcttcctcaagaagaggggggatccctgctcctgccagccccgctcaaggccccgtcaaagtccggccaagtcttcccaggatcacgcgatggaagccggcagccctgtgagcacatcccccgagccagtggagacctgcagcttctgcttccctgagtgcagggcgcccacgcaggagagcgcagtcacgcctgggacccccgaccccacttgtgctggaaggtgggggtgccacaccaggaccacagtcctgcagccttgcccacacatcccagacagtggccttggcattgtgtgtgtgcctgcccaggaggggggcccaggtgcataaatgggggtcagggagggaaaggaggagggagagagatggagaggaggggagagagaaagagaggtggggagaggggagagagatatgaggagagagagacagaggaggcagagagggagagaaacagaggagacagagagggagagagagacagagggagagagagacagaggggaagagaggcagagagggaaagaggcagagaaggaaagagacaggcagagaaggagagaggcagagagggagagaggcagagagggagagaggcagagagacagagagggagagagggacagagagagatagagcaggaggtcggggcactctgagtcccagttcccagtgcagctgtaggtcgtcatcacctaaccacacgtgcaataaagtcctcgtgcctgctgctcacagcccccgagagcccctcctcctggagaataaaacctttggcagctgcccttcctc

SEQ ID NO: 852 - DNA, 1397 bp, Homo sapiens
tcctgagtaatgagtggcctgggccggagcaggcgaggtggccggagccgtgtggaccaggaggagcgctggtcactcagctgccgcaaggagcaaggcaagttctatgaccatctcctgagggactgcatcagctgtgcctccatctgtggacagcaccctaagcaatgtgcatacttctgtgagaacaagctcaggagcccagtgaaccttccaccagagctcaggagacagcggagtggagaagttgaaaacaattcagacaactcgggaaggtaccaaggattggagcacagaggctcagaagcaagtccagctctcccggggctgaagctgagtgcagatcaggtggccctggtctacagcacgctggggctctgcctgtgtgccgtcctctgctgcttcctggtggcggtggcctgcttcctcaagaagaggggggatccctgctcctgccagccccgctcaaggccccgtcaaagtccggccaagtcttcccaggatcacgcgatggaagccggcagccctgtgagcacatcccccgagccagtggagacctgcagcttctgcttccctgagtgcagggcgcccacgcaggagagcgcagtcacgcctgggacccccgaccccacttgtgctggaaggaaaacgaagccccctcctgtattgacagctgggaattgtggagtccaccgtcctccacctgagacgagcacagggtctccacgaggacagaggctgctttggactcaatagaaaactgggcatcttcatggtcctagaaggatcccaggaggctgatcctatagagacgtctggttcctgaccccaactgcctccaggtgcctggaacagcccatcgtgggccctttaccctcagcaggtggacgccgttggtcctgccagggcaagatggagatggatgagcacccggatatcctgcccacccaggggcaaggcaacatcatcattactaagtatgagcagggacgctgagctggggcagcagtggacacagagcatgagcgtgttgacatctggaaattcaccagtcgtctctgggttgtgtgtgagacagagctgcccgtgtcagtgccctggaggtgaagggaagagcctgtgcctgctgcgtgggagactggtccagggacagggaatcaggagtggttgcaaaggtgtcaggaaataaaatgtactgacaagtggctgaagatgcttggagactggccaaaatataagaacagcaagaagctgggcacggtggcgggcacctgtaatcccagctactcaggaggctgaggcacgagaattgcttgaacccaggcagtggaggttgcagtgagccaagatcgcaccactgaactccagcctgggcgacaagagggagacttcatctc

SEQ ID NO: 853 - DNA, 2789 bp, Homo sapiens
agtgcaggtatctcatggagggttttttggatgtcttcttccctgtgggggggttccaaaggcccatgtctcttgggcattttctttcagattctatcagccctctctctttctctcctgtctctctctttcattcatacactgagtcattcagaaatggcttctctccaactcggagctgcaagtaattctggatctggtcacaaacaaaaagtccccagagttgccaatttatctagttcatctgtgccctgttcaagatgatgtaactaaacatttaccttcagggaggtgtttccaaagaattttcatcgatatatagaaatcaagagaaattccatactatcaccaaatcaagagaaattccatactatcaccagttggccaactttccaagtctagtgcagaaatccaaggcacctcacacctagagttcctatacctctgagactccagaggaaagaacaagacagtgcagaaggatatgttagaacccactgaaaacctagaaggttaaaaaggaagcataccctcctgacctataagaaaattttcagtctgcagggggatatccttgtggcccaagacattggtgttatcatttgactaagaggaaattatttgtggtgagctctgagtgaggattaggaccagggagatgccaagtttctatcacttacctcatgcctgtaagacaagtgttttgttccaattgatgaatggggataaaacagttcagccaatcacttatggggcaaagaatgggaatttgaagggtctggtgcctggccttgtcatacgtaaacaagagaggcatcgatgagttttatctgagtcatttgggaaaggataattcttgcagcaagccattttcctaaacacagaagaatagggggattccttaaccttcattgttctccaggatcataggtctcaggtaaaattaaaaattttcaggtcagaccactcagtctcagaaaggcaaagtaatttgccccaggtcactagtccaagatgttattctctttgaacaaatgtgtatgtccagtcacatattcttcattcattcctccccaaagcagtttttagctgttaggtatattcgatcactttagtctattttgaaaatgatatgagacactttttaagcaaagtctacagtttcccaatgagaaaattaatcctctttcttgtctttccagttgtgagacaaactcccacacagcactttaaaaatcagttcccagctctgcactgggaacatgaactaggcctggccttcaccaagaaccgaatgaactataccaacaaattcctgctgatcccagagtcgggagactacttcatttactcccaggtcacattccgtgggatgacctctgagtgcagtgaaatcagacaagcaggccgaccaaacaagccagactccatcactgtggtcatcaccaaggtaacagacagctaccctgagccaacccagctcctcatggggaccaagtctgtatgcgaagtaggtagcaactggttccagcccatctacctcggagccatgttctccttgcaagaaggggacaagctaatggtgaacgtcagtgacatctctttggtggattacacaaaagaagataaaaccttctttggagccttcttactataggaggagagcaaatatcattatatgaaagtcctctgccaccgagttcctaattttctttgttcaaatgtaattataaccaggggttttcttggggccgggagtagggggcattccacagggacaacggtttagctatgaaatttggggcccaaaatttcacacttcatgtgccttactgatgagagtactaactggaaaaaggctgaagagagcaaatatattattaagatgggttggaggattggcgagtttctaaatattaagacactgatcactaaatgaatggatgatctactcgggtcaggattgaaagagaaatatttcaacaccttcctgctatacaatggtcaccagtggtccagttattgttcaatttgatcataaatttgcttcaattcaggagctttgaaggaagtccaaggaaagctctagaaaacagtataaactttcagaggcaaaatccttcaccaatttttccacatactttcatgccttgcctaaaaaaaatgaaaagagagttggtatgtctcatgaatgttcacacagaaggagttggttttcatgtcatctacagcatatgagaaaagctacctttcttttgattatgtacacagatatctaaataaggaagtatgagtttcacatgtatatcaaaaatacaacagttgcttgtattcagtagagttttcttgcccacctattttgtgctgggttctaccttaacccagaagacactatgaaaaacaagacagactccactcaaaatttatatgaacaccactagatacttcctgatcaaacatcagtcaacatactctaaagaataactccaagtcttggccaggcgcagtggctcacacctgtaatcccaacactttgggaggccaaggtgggtggatcatctaaggccgggagttcaagaccagcctgaccaacgtggagaaaccccatctctactaaaaatacaaaattagccgggcgtggtagcgcatggctgtaatcctggctactcaggaggccgaggcagaagaattgcttgaactggggaggcagaggttgcggtgagcccagatcgcgccattgcactccagcctgggtaacaagagcaaaactctgtccaaaaaaaaaaaaa

SEQ ID NO: 854 - DNA, 2002 bp, Homo sapiens
aaaagggaaggaggagactgagtgattaagtcacccactgtgagagctggtcttctatttaatgggggctctctctgcccaggagtcagaggtgcctccaggagcagcaggagcatggccgaggatctgggactgagctttggggaaacagccagtgtggaaatgctgccagagcacggcagctgcaggcccaaggccaggagcagcagcgcacgctgggctctcacctgctgcctggtgttgctccccttccttgcaggactcaccacatacctgcttgtcagccagctccgggcccagggagaggcctgtgtgcagttccaggctctaaaaggacaggagtttgcaccttcacatcagcaagtttatgcacctcttagagcagacggagataagccaagggcacacctgacagttgtgagacaaactcccacacagcactttaaaaatcagttcccagctctgcactgggaacatgaactaggcctggccttcaccaagaaccgaatgaactataccaacaaattcctgctgatcccagagtcgggagactacttcatttactcccaggtcacattccgtgggatgacctctgagtgcagtgaaatcagacaagcaggccgaccaaacaagccagactccatcactgtggtcatcaccaaggtaacagacagctaccctgagccaacccagctcctcatggggaccaagtctgtatgcgaagtaggtagcaactggttccagcccatctacctcggagccatgttctccttgcaagaaggggacaagctaatggtgaacgtcagtgacatctctttggtggattacacaaaagaagataaaaccttctttggagccttcttactataggaggagagcaaatatcattatatgaaagtcctctgccaccgagttcctaattttctttgttcaaatgtaattataaccaggggttttcttggggccgggagtagggggcattccacagggacaacggtttagctatgaaatttggggcccaaaatttcacacttcatgtgccttactgatgagagtactaactggaaaaaggctgaagagagcaaatatattattaagatgggttggaggattggcgagtttctaaatattaagacactgatcactaaatgaatggatgatctactcgggtcaggattgaaagagaaatatttcaacaccttcctgctatacaatggtcaccagtggtccagttattgttcaatttgatcataaatttgcttcaattcaggagctttgaaggaagtccaaggaaagctctagaaaacagtataaactttcagaggcaaaatccttcaccaatttttccacatactttcatgccttgcctaaaaaaaatgaaaagagagttggtatgtctcatgaatgttcacacagaaggagttggttttcatgtcatctacagcatatgagaaaagctacctttcttttgattatgtacacagatatctaaataaggaagtatgagtttcacatgtatatcaaaaatacaacagttgcttgtattcagtagagttttcttgcccacctattttgtgctgggttctaccttaacccagaagacactatgaaaaacaagacagactccactcaaaatttatatgaacaccactagatacttcctgatcaaacatcagtcaacatactctaaagaataactccaagtcttggccaggcgcagtggctcacacctgtaatcccaacactttgggaggccaaggtgggtggatcatctaaggccgggagttcaagaccagcctgaccaacgtggagaaaccccatctctactaaaaatacaaaattagccgggcgtggtagcgcatggctgtaatcctggctactcaggaggccgaggcagaagaattgcttgaactggggaggcagaggttgcggtgagcccagatcgcgccattgcactccagcctgggtaacaagagcaaaactctgtccaaaaaaaaaaaaa

SEQ ID NO: 855 - DNA, 1676 bp, Homo sapiens
cagacgctccctcagcaaggacagcagaggaccagctaagagggagagaagcaactacagaccccccctgaaaacaaccctcagacgccacatcccctgacaagctgccaggcaggttctcttcctctcacatactgacccacggctccaccctctctcccctggaaaggacaccatgagcactgaaagcatgatccgggacgtggagctggccgaggaggcgctccccaagaagacaggggggccccagggctccaggcggtgcttgttcctcagcctcttctccttcctgatcgtggcaggcgccaccacgctcttctgcctgctgcactttggagtgatcggcccccagagggaagagttccccagggacctctctctaatcagccctctggcccaggcagtcagatcatcttctcgaaccccgagtgacaagcctgtagcccatgttgtagcaaaccctcaagctgaggggcagctccagtggctgaaccgccgggccaatgccctcctggccaatggcgtggagctgagagataaccagctggtggtgccatcagagggcctgtacctcatctactcccaggtcctcttcaagggccaaggctgcccctccacccatgtgctcctcacccacaccatcagccgcatcgccgtctcctaccagaccaaggtcaacctcctctctgccatcaagagcccctgccagagggagaccccagagggggctgaggccaagccctggtatgagcccatctatctgggaggggtcttccagctggagaagggtgaccgactcagcgctgagatcaatcggcccgactatctcgactttgccgagtctgggcaggtctactttgggatcattgccctgtgaggaggacgaacatccaaccttcccaaacgcctcccctgccccaatccctttattaccccctccttcagacaccctcaacctcttctggctcaaaaagagaattgggggcttagggtcggaacccaagcttagaactttaagcaacaagaccaccacttcgaaacctgggattcaggaatgtgtggcctgcacagtgaagtgctggcaaccactaagaattcaaactggggcctccagaactcactggggcctacagctttgatccctgacatctggaatctggagaccagggagcctttggttctggccagaatgctgcaggacttgagaagacctcacctagaaattgacacaagtggaccttaggccttcctctctccagatgtttccagacttccttgagacacggagcccagccctccccatggagccagctccctctatttatgtttgcacttgtgattatttattatttatttattatttatttatttacagatgaatgtatttatttgggagaccggggtatcctgggggacccaatgtaggagctgccttggctcagacatgttttccgtgaaaacggagctgaacaataggctgttcccatgtagccccctggcctctgtgccttcttttgattatgttttttaaaatatttatctgattaagttgtctaaacaatgctgatttggtgaccaactgtcactcattgctgagcctctgctccccaggggagttgtgtctgtaatcgccctactattcagtggcgagaaataaagtttgcttagaaaagaaa

SEQ ID NO: 856 - DNA, 1676 bp, Homo sapiens; identical to SEQ ID NO: 855

SEQ ID NO: 857 - DNA, 1676 bp, Homo sapiens; identical to SEQ ID NO: 855

SEQ ID NO: 858 - DNA, 1676 bp, Homo sapiens; identical to SEQ ID NO: 855

SEQ ID NO: 859 - DNA, 1676 bp, Homo sapiens; identical to SEQ ID NO: 855

SEQ ID NO: 860 - DNA, 1315 bp, Homo sapiens
ttccccagggacctctctctaatcagccctctggcccaggcagtcagatcatcttctcgaaccccgagtgacaagcctgtagcccatgttgtagcaaaccctcaagctgaggggcagctccagtggctgaaccgccgggccaatgccctcctggccaatggcgtggagctgagagataaccagctggtggtgccatcagagggcctgtacctcatctactcccaggtcctcttcaagggccaaggctgcccctccacccatgtgctcctcacccacaccatcagccgcatcgccgtctcctaccagaccaaggtcaacctcctctctgccatcaagagcccctgccagagggagaccccagagggggctgaggccaagccctggtatgagcccatctatctgggaggggtcttccagctggagaagggtgaccgactcagcgctgagatcaatcggcccgactatctcgactttgccgagtctgggcaggtctactttgggatcattgccctgtgaggaggacgaacatccaaccttcccaaacgcctcccctgccccaatccctttattaccccctccttcagacaccctcaacctcttctggctcaaaaagagaattgggggcttagggtcggaacccaagcttagaactttaagcaacaagaccaccacttcgaaacctgggattcaggaatgtgtggcctgcacagtgaagtgctggcaaccactaagaattcaaactggggcctccagaactcactggggcctacagctttgatccctgacatctggaatctggagaccagggagcctttggttctggccagaatgctgcaggacttgagaagacctcacctagaaattgacacaagtggaccttaggccttcctctctccagatgtttccagacttccttgagacacggagcccagccctccccatggagccagctccctctatttatgtttgcacttgtgattatttattatttatttattatttatttatttacagatgaatgtatttatttgggagaccggggtatcctgggggacccaatgtaggagctgccttggctcagacatgttttccgtgaaaacggagctgaacaataggctgttcccatgtagccccctggcctctgtgccttcttttgattatgttttttaaaatatttatctgattaagttgtctaaacaatgctgatttggtgaccaactgtcactcattgctgagcctctgctccccaggggagttgtgtctgtaatcgccctactattcagtggcgagaaataaagtttgcttagaaaagaaa

SEQ ID NO: 861 - DNA, 1676 bp, Homo sapiens; identical to SEQ ID NO: 855

SEQ ID NO: 862 - DNA, 1676 bp, Homo sapiens; identical to SEQ ID NO: 855

SEQ ID NO: 863 - DNA, 2223 bp, Homo sapiens
ctccagctcttcctgtcccgctgttgcaacactgcctcactcttcccctcccaccttctctcccctcctctctgctttaattttctcagaattctctggactgaggctccagttctggcctttggggttcaagatcactgggaccaggccgtgatctctatgcccgagtctcaaccctcaactgtcaccccaaggcacttgggacgtcctggacagaccgagtcccgggaagccccagcactgccgctgccacactgccctgagcccaaatgggggagtgagaggccatagctgtctggcatgggcctctccaccgtgcctgacctgctgctgccactggtgctcctggagctgttggtgggaatatacccctcaggggttattggactggtccctcacctaggggacagggagaagagagatagtgtgtgtccccaaggaaaatatatccaccctcaaaataattcgatttgctgtaccaagtgccacaaaggaacctacttgtacaatgactgtccaggcccggggcaggatacggactgcagggagtgtgagagcggctccttcaccgcttcagaaaaccacctcagacactgcctcagctgctccaaatgccgaaaggaaatgggtcaggtggagatctcttcttgcacagtggaccgggacaccgtgtgtggctgcaggaagaaccagtaccggcattattggagtgaaaaccttttccagtgcttcaattgcagcctctgcctcaatgggaccgtgcacctctcctgccaggagaaacagaacaccgtgtgcacctgccatgcaggtttctttctaagagaaaacgagtgtgtctcctgtagtaactgtaagaaaagcctggagtgcacgaagttgtgcctaccccagattgagaatgttaagggcactgaggactcaggcaccacagtgctgttgcccctggtcattttctttggtctttgccttttatccctcctcttcattggtttaatgtatcgctaccaacggtggaagtccaagctctactccattgtttgtgggaaatcgacacctgaaaaagagggggagcttgaaggaactactactaagcccctggccccaaacccaagcttcagtcccactccaggcttcacccccaccctgggcttcagtcccgtgcccagttccaccttcacctccagctccacctatacccccggtgactgtcccaactttgcggctccccgcagagaggtggcaccaccctatcagggggctgaccccatccttgcgacagccctcgcctccgaccccatccccaacccccttcagaagtgggaggacagcgcccacaagccacagagcctagacactgatgaccccgcgacgctgtacgccgtggtggagaacgtgcccccgttgcgctggaaggaattcgtgcggcgcctagggctgagcgaccacgagatcgatcggctggagctgcagaacgggcgctgcctgcgcgaggcgcaatacagcatgctggcgacctggaggcggcgcacgccgcggcgcgaggccacgctggagctgctgggacgcgtgctccgcgacatggacctgctgggctgcctggaggacatcgaggaggcgctttgcggccccgccgccctcccgcccgcgcccagtcttctcagatgaggctgcgcccctgcgggcagctctaaggaccgtcctgcgagatcgccttccaaccccacttttttctggaaaggaggggtcctgcaggggcaagcaggagctagcagccgcctacttggtgctaacccctcgatgtacatagcttttctcagctgcctgcgcgccgccgacagtcagcgctgtgcgcgcggagagaggtgcgccgtgggctcaagagcctgagtgggtggtttgcgaggatgagggacgctatgcctcatgcccgttttgggtgtcctcaccagcaaggctgctcgggggcccctggttcgtccctgagcctttttcacagtgcataagcagttttttttgtttttgttttgttttgttttgtttttaaatcaatcatgttacactaatagaaacttggcactcctgtgccctctgcctggacaagcacatagcaagctgaactgtcctaaggcaggggcgagcacggaacaatggggccttcagctggagctgtggacttttgtacatacactaaaattctgaagttaaagctctgctcttgga

SEQ ID NO: 864 - DNA, 1339 bp, Homo sapiens
caaatgggggagtgagaggccatagctgtctggcatgggcctctccaccgtgcctgacctgctgctgccactggtgctcctggagctgttggtgggaatatacccctcaggggttattggactggtccctcacctaggggacagggagaagagagatagtgtgtgtccccaaggaaaatatatccaccctcaaaataattcgatttgctgtaccaagtgccacaaaggaacctacttgtacaatgactgtccaggcccggggcaggatacggactgcagggagtgtgagagcggctccttcaccgcttcagaaaaccacctcagacactgcctcagctgctccaaatgccgaaaggaaatgggtcaggtggagatctcttcttgcacagtggaccgggacaccgtgtgtggctgcaggaagaaccagtaccggcattattggagtgaaaaccttttccagtgcttcaattgcagcctctgcctcaatgggaccgtgcacctctcctgccaggagaaacagaacaccgtgtgcacctgccatgcaggtttctttctaagagaaaacgagtgtgtctcctgtagtaaagtcctgctctgtcgcccaggctggaatgcagtggcgcgatctcggctcactgcaacctctgcctcccagattcaagcaattctcctgcttcagcctcccaagtagctgggattacaggcacgtgccaccatgcctggctaatttttgtatttttagtagagatggggtttcaccatcttggtcaggctggtctcaaactcctggtgatccacctgcctctgcctcccaaagtgctgggattacagccgtgagccactgcacccagccggcttcatctcttcttgaaatcacttttataccattctatgtggttctcaccatgagcttgagtggtgggctaaagtgcctctccctgctttcagcttcctgctgggaactcactctctcaagttccttccagcaccaccccatagagttcccatcactccacactgtccagtgacaactcccaacatggaagatctgctagttctacagggtgctctctggctgccccagtaacatgtgtttttaaatttttcacatgcatgtttgaccccgactccccgaagtcaggtactgtaactagcagtgtcatttaagaaaaagccctttaacctctctttgccaaaggattcttatcagcaaaacagtgatgaaacaacaatcccataacagctagctggctaccttctcaagcacttattaaatgaggcataatgattttgcttaatcctcaatcctgagaggtgggcgatccctgtggtgatgagg

SEQ ID NO: 865 - DNA, 3683 bp, Homo sapiens
gcgagcgcagcggagcctggagagaaggcgctgggctgcgagggcgcgagggcgcgagggcagggggcaaccggaccccgcccgcacccatggcgcccgtcgccgtctgggccgcgctggccgtcggactggagctctgggctgcggcgcacgccttgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacttcgctcttccagttggactgattgtgggtgtgacagccttgggtctactaataataggagtggtgaactgtgtcatcatgacccaggtgaaaaagaagcccttgtgcctgcagagagaagccaaggtgcctcacttgcctgccgataaggcccggggtacacagggccccgagcagcagcacctgctgatcacagcgccgagctccagcagcagctccctggagagctcggccagtgcgttggacagaagggcgcccactcggaaccagccacaggcaccaggcgtggaggccagtggggccggggaggcccgggccagcaccgggagctcagattcttcccctggtggccatgggacccaggtcaatgtcacctgcatcgtgaacgtctgtagcagctctgaccacagctcacagtgctcctcccaagccagctccacaatgggagacacagattccagcccctcggagtccccgaaggacgagcaggtccccttctccaaggaggaatgtgcctttcggtcacagctggagacgccagagaccctgctggggagcaccgaagagaagcccctgccccttggagtgcctgatgctgggatgaagcccagttaaccaggccggtgtgggctgtgtcgtagccaaggtgggctgagccctggcaggatgaccctgcgaaggggccctggtccttccaggcccccaccactaggactctgaggctctttctgggccaagttcctctagtgccctccacagccgcagcctccctctgacctgcaggccaagagcagaggcagcgagttgtggaaagcctctgctgccatggcgtgtccctctcggaaggctggctgggcatggacgttcggggcatgctggggcaagtccctgactctctgtgacctgccccgcccagctgcacctgccagcctggcttctggagcccttgggttttttgtttgtttgtttgtttgtttgtttgtttctccccctgggctctgccccagctctggcttccagaaaaccccagcatccttttctgcagaggggctttctggagaggagggatgctgcctgagtcacccatgaagacaggacagtgcttcagcctgaggctgagactgcgggatggtcctggggctctgtgcagggaggaggtggcagccctgtagggaacggggtccttcaagttagctcaggaggcttggaaagcatcacctcaggccaggtgcagtggctcacgcctatgatcccagcactttgggaggctgaggcgggtggatcacctgaggttaggagttcgagaccagcctggccaacatggtaaaaccccatctctactaaaaatacagaaattagccgggcgtggtggcgggcacctatagtcccagctactcagaagcctgaggctgggaaatcgtttgaacccgggaagcggaggttgcagggagccgagatcacgccactgcactccagcctgggcgacagagcgagagtctgtctcaaaagaaaaaaaaaagcaccgcctccaaatgccaacttgtccttttgtaccatggtgtgaaagtcagatgcccagagggcccaggcaggccaccatattcagtgctgtggcctgggcaagataacgcacttctaactagaaatctgccaattttttaaaaaagtaagtaccactcaggccaacaagccaacgacaaagccaaactctgccagccacatccaaccccccacctgccatttgcaccctccgccttcactccggtgtgcctgcagccccgcgcctccttccttgctgtcctaggccacaccatctcctttcagggaatttcaggaactagagatgactgagtcctcgtagccatctctctactcctacctcagcctagaccctcctcctcccccagaggggtgggttcctcttccccactccccaccttcaattcctgggccccaaacgggctgccctgccactttggtacatggccagtgtgatcccaagtgccagtcttgtgtctgcgtctgtgttgcgtgtcgtgggtgtgtgtagccaaggtcggtaagttgaatggcctgccttgaagccactgaagctgggattcctccccattagagtcagccttccccctcccagggccagggccctgcagaggggaaaccagtgtagccttgcccggattctgggaggaagcaggttgaggggctcctggaaaggctcagtctcaggagcatggggataaaggagaaggcatgaaattgtctagcagagcaggggcagggtgataaattgttgataaattccactggacttgagcttggcagctgaactattggagggtgggagagcccagccattaccatggagacaagaagggttttccaccctggaatcaagatgtcagactggctggctgcagtgacgtgcacctgtactcaggaggctgaggggaggatcactggagcccaggagtttgaggctgcagcgagctatgatcgcgccactacactccagcctgagcaacagagtgagaccctgtctcttaaagaaaaaaaaagtcagactgctgggactggccaggtttctgcccacattggacccacatgaggacatgatggagcgcacctgccccctggtggacagtcctgggagaacctcaggcttccttggcatcacagggcagagccgggaagcgatgaatttggagactctgtggggccttggttcccttgtgtgtgtgtgttgatcccaagacaatgaaagtttgcactgtatgctggacggcattcctgcttatcaataaacctgtttgttttacacgtcga

SEQ ID NO: 866 - DNA, 3683 bp, Homo sapiens; identical to SEQ ID NO: 865

SEQ ID NO: 867 - DNA, 893 bp, Homo sapiens
gcgagcgcagcggagcctggagagaaggcgctgggctgcgagggcgcgagggcgcgagggcagggggcaaccggaccccgcccgcacccatggcgcccgtcgccgtctgggccgcgctggccgtcggactggagctctgggctgcggcgcacgccttgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacttcgctcttccagttgtctctctttcttcctct

SEQ ID NO: 868 - DNA, 557 bp, Homo sapiens
gcgagcgcagcggagcctggagagaaggcgctgggctgcgagggcgcgagggcgcgagggcagggggcaaccggaccccgcccgcacccatggcgcccgtcgccgtctgggccgcgctggccgtcggactggagctctgggctgcggcgcacgccttgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccagacctctcctag

SEQ ID NO: 869 - DNA, 1465 bp, Homo sapiens
gagcggagcctggcgggcgtgggaacccaggccccgccgaggcggccaggaggtgagatggcagctgggcaaaatgggcacgaagagtgggtgggcagcgcatacctgtttgtggagtcctcgctggacaaggtggtcctgtcggatgcctacgcgcacccccagcagaaggtggcagtgtacagggctctgcaggctgccttggcagagagcggcgggagcccggacgtgctgcagatgctgaagatccaccgcagcgacccgcagctgatcgtgcagctgcgattctgcgggcggcagccctgtggccgcttcctccgcgcctaccgcgagggggcgctgcgcgccgcgctgcagaggagcctggcggccgcgctcgcccagcactcggtgccgctgcaactggagctgcgcgccggcgccgagcggctggacgctttgctggcggacgaggagcgctgtttgagttgcatcctagcccagcagcccgaccggctccgggatgaagaactggctgagctggaggatgcgctgcgaaatctgaagtgcggctcgggggcccggggtggcgacggggaggtcgcttcggcccccttgcagcccccggtgccctctctgtcggaggtgaagccgccgccgccgccgccacctgcccagacttttctgttccagggtcagcctgtagtgaatcggccgctgagcctgaaggaccaacagacgttcgcgcgctctgtgggtctcaaatggcgcaaggtggggcgctcactgcagcgaggctgccgggcgctgcgggacccggcgctggactcgctggcctacgagtacgagcgcgagggactgtacgagcaggccttccagctgctgcggcgcttcgtgcaggccgagggccgccgcgccacgctgcagcgcctggtggaggcactcgaggagaacgagctcaccagcctggcagaggacttgctgggcctgaccgatcccaatggcggcctggcctagaccaggggtgcagccagcttttggagaacctggatggccttagggttccttctgcggctattgctgaacccctgtccatccacgggaccctgaaactccacttggcctatctgctggacctgctggggcagagttgattgccttccccaggagccagaccactgggggtgcatcattggggattctgcctcaggtactttgatagagtgtggggtgggggggacctgctttggagatcagcctcaccttctcccatcccagaagcggggcttacagccagcccttacagtttcactcatgaagcaccttgatctttggtgtcctggacttcatcctgggtgctgcagatactgcagtgaagtaaaacaggaatcaatcttgcctgcccccagctcacactcagcgtgggaccccgaatgttaagcaatgataataaagtataacacggattttgatgtgagaaatacaa

SEQ ID NO: 870 - DNA, 2264 bp, Homo sapiens
ttccgggcgcgctgcgaccgttggggctttgttcgcgggggtcacagctctcatggctgcagctagcgtgaccccccctggctccctggagttgctacagcccggcttctccaagaccctcctggggaccaagctggaagccaagtacctgtgctccgcctgcagaaacgtcctccgcaggcccttccaggcgcagtgtggccaccggtactgctccttctgcctggccagcatcctcagctctgggcctcagaactgtgctgcctgtgttcacgagggcatatatgaagaaggcatttctattttagaaagcagttcggccttcccagataatgctgcccgcagggaggtggagagcctgccggccgtctgtcccagtgatggatgcacctggaaggggaccctgaaagaatacgagagctgccacgaaggccgctgcccgctcatgctgaccgaatgtcccgcgtgcaaaggcctggtccgccttggtgaaaaggagcgccacctggagcacgagtgcccggagagaagcctgagctgccggcattgccgggcaccctgctgcggagcagacgtgaaggcgcaccacgaggtctgccccaagttccccttaacttgtgacggctgcggcaagaagaagatcccccgggagaagtttcaggaccacgtcaagacttgtggcaagtgtcgagtcccttgcagattccacgccatcggctgcctcgagacggtagagggtgagaaacagcaggagcacgaggtgcagtggctgcgggagcacctggccatgctactgagctcggtgctggaggcaaagcccctcttgggagaccagagccacgcggggtcagagctcctgcagaggtgcgagagcctggagaagaagacggccacttttgagaacattgtctgcgtcctgaaccgggaggtggagagggtggccatgactgccgaggcctgcagccggcagcaccggctggaccaagacaagattgaagccctgagtagcaaggtgcagcagctggagaggagcattggcctcaaggacctggcgatggctgacttggagcagaaggtcttggagatggaggcatccacctacgatggggtcttcatctggaagatctcagacttcgccaggaagcgccaggaagctgtggctggccgcatacccgccatcttctccccagccttctacaccagcaggtacggctacaagatgtgtctgcgtatctacctgaacggcgacggcaccgggcgaggaacacacctgtccctcttctttgtggtgatgaagggcccgaatgacgccctgctgcggtggcccttcaaccagaaggtgaccttaatgctgctcgaccagaataaccgggagcacgtgattgacgccttcaggcccgacgtgacttcatcctcttttcagaggccagtcaacgacatgaacatcgcaagcggctgccccctcttctgccccgtctccaagatggaggcaaagaattcctacgtgcgggacgatgccatcttcatcaaggccattgtggacctgacagggctctaactgccccctactggtgtctgggggttgggggcagccaggcacagccggctcacggaggggccaccacgctgggccagggtctcactgtacaagtgggcaggggccgcgcttgggcgcttgggagggtgtcggcctgcagccaagttcactgtcacgggggaaggagccaccagccagtcctcagatttcagagactgcggaggggcttggcagacggtcttagccaagggctgtggtggcattggccgagggtcttcgggtgcttcccagcacaagctgcccttgctgtcctgtgcagtgaagggagaggccctgggtgggggacactcagagtgggagcacatcccagcagtgcccatgtagcaggagcacagtggatggccttgtgtccctcgggcatgacaggcagaaacgagggctgctccaggagaagggcctcctgctggccagagcaaggaaggctgagcagcttggttctcccctctggcccctggagagaagggagcattcctagacccctgggtgcttgtctgcacagagctctggtctgtgccaccttggccaggctggctgtgggagagggtctggtcccacgccgcctctgctcagaccactgtgtgggaggtgcacagcacagcctgcgggtaaagtgtgagagcttgccatccagctcacgaagacagagttattaaaccattcaaatctc

SEQ ID NO: 871 - DNA, 2413 bp, Homo sapiens
cgcgctgcgaccgttggggctttgttcgcgggggtcacagctctcatggctgcagctagcgtgaccccccctggctccctggagttgctacagcccggcttctccaagaccctcctggggaccaagctggaagccaagtacctgtgctccgcctgcagaaacgtcctccgcaggcccttccaggcgcagtgtggccaccggtactgctccttctgcctggccagcatcctcagctctgggcctcagaactgtgctgcctgtgttcacgagggcatatatgaagaaggcatttctattttagaaagcagttcggccttcccagataatgctgcccgcagggaggtggagagcctgccggccgtctgtcccagtgatggatgcacctggaaggggaccctgaaagaatacgaggtaaagatgcctgcgtgtggcatggtgacagaagctccagcagtcgggagtcgtccacgctccccaagcagttatgaccttgtcctgcacgttcctctcactggggctgaagcctgtctgatgtctgtggaggaagagacggagctgctccttagaagctgccacgaaggccgctgcccgctcatgctgaccgaatgtcccgcgtgcaaaggcctggtccgccttggtgaaaaggagcgccacctggagcacgagtgcccggagagaagcctgagctgccggcattgccgggcaccctgctgcggagcagacgtgaaggcgcaccacgaggtctgccccaagttccccttaacttgtgacggctgcggcaagaagaagatcccccgggagaagtttcaggaccacgtcaagacttgtggcaagtgtcgagtcccttgcagattccacgccatcggctgcctcgagacggtagagggtgagaaacagcaggagcacgaggtgcagtggctgcgggagcacctggccatgctactgagctcggtgctggaggcaaagcccctcttgggagaccagagccacgcggggtcagagctcctgcagaggtgcgagagcctggagaagaagacggccacttttgagaacattgtctgcgtcctgaaccgggaggtggagagggtggccatgactgccgaggcctgcagccggcagcaccggctggaccaagacaagattgaagccctgagtagcaaggtgcagcagctggagaggagcattggcctcaaggacctggcgatggctgacttggagcagaaggtcttggagatggaggcatccacctacgatggggtcttcatctggaagatctcagacttcgccaggaagcgccaggaagctgtggctggccgcatacccgccatcttctccccagccttctacaccagcaggtacggctacaagatgtgtctgcgtatctacctgaacggcgacggcaccgggcgaggaacacacctgtccctcttctttgtggtgatgaagggcccgaatgacgccctgctgcggtggcccttcaaccagaaggtgaccttaatgctgctcgaccagaataaccgggagcacgtgattgacgccttcaggcccgacgtgacttcatcctcttttcagaggccagtcaacgacatgaacatcgcaagcggctgccccctcttctgccccgtctccaagatggaggcaaagaattcctacgtgcgggacgatgccatcttcatcaaggccattgtggacctgacagggctctaactgccccctactggtgtctgggggttgggggcagccaggcacagccggctcacggaggggccaccacgctgggccagggtctcactgtacaagtgggcaggggccgcgcttgggcgcttgggagggtgtcggcctgcagccaagttcactgtcacgggggaaggagccaccagccagtcctcagatttcagagactgcggaggggcttggcagacggtcttagccaagggctgtggtggcattggccgagggtcttcgggtgcttcccagcacaagctgcccttgctgtcctgtgcagtgaagggagaggccctgggtgggggacactcagagtgggagcacatcccagcagtgcccatgtagcaggagcacagtggatggccttgtgtccctcgggcatgacaggcagaaacgagggctgctccaggagaagggcctcctgctggccagagcaaggaaggctgagcagcttggttctcccctctggcccctggagagaagggagcattcctagacccctgggtgcttgtctgcacagagctctggtctgtgccaccttggccaggctggctgtgggagagggtctggtcccacgccgcctctgctcagaccactgtgtgggaggtgcacagcacagcctgcgggtaaagtgtgagagcttgccatccagctcacgaagacagagttattaaaccattcaaatctc

SEQ ID NO: 872 - DNA, 2019 bp, Homo sapiens
gcgctgcgaccgttggggctttgttcgcgggggtcacagctctcatggctgcagctagcgtgaccccccctggctccctggagttgctacagcccggcttctccaagaccctcctggggaccaagctggaagccaagtacctgtgctccgcctgcagaaacgtcctccgcaggcccttccaggcgcagtgtggccaccggtactgctccttctgcctggccagcatcctcagctctgggcctcagaactgtgctgcctgtgttcacgagggcatatatgaagaaggcatttctattttagaaagcagttcggccttcccagataatgctgcccgcagggaggtggagagcctgccggccgtctgtcccagtgatggatgcacctggaaggggaccctgaaagaatacgaggtaaagatgcctgcgtgtggcatggtgacagaagctccagcagtcgggagtcgtccacgctccccaagcagttatgaccttgtcctgcacgttcctctcactggggctgaagcctgtctgatgtctgtggaggaagagacggagctgctccttagaagctgccacgaaggccgctgcccgctcatgctgaccgaatgtcccgcgtgcaaaggcctggtccgccttggtgaaaaggagcgccacctggagcacgagtgcccggagagaagcctgagctgccggcattgccgggcaccctgctgcggagcagacgtgaagcggctggaccaagacaagattgaagccctgagtagcaaggtgcagcagctggagaggagcattggcctcaaggacctggcgatggctgacttggagcagaaggtcttggagatggaggcatccacctacgatggggtcttcatctggaagatctcagacttcgccaggaagcgccaggaagctgtggctggccgcatacccgccatcttctccccagccttctacaccagcaggtacggctacaagatgtgtctgcgtatctacctgaacggcgacggcaccgggcgaggaacacacctgtccctcttctttgtggtgatgaagggcccgaatgacgccctgctgcggtggcccttcaaccagaaggtgaccttaatgctgctcgaccagaataaccgggagcacgtgattgacgccttcaggcccgacgtgacttcatcctcttttcagaggccagtcaacgacatgaacatcgcaagcggctgccccctcttctgccccgtctccaagatggaggcaaagaattcctacgtgcgggacgatgccatcttcatcaaggccattgtggacctgacagggctctaactgccccctactggtgtctgggggttgggggcagccaggcacagccggctcacggaggggccaccacgctgggccagggtctcactgtacaagtgggcaggggccgcgcttgggcgcttgggagggtgtcggcctgcagccaagttcactgtcacgggggaaggagccaccagccagtcctcagatttcagagactgcggaggggcttggcagacggtcttagccaagggctgtggtggcattggccgagggtcttcgggtgcttcccagcacaagctgcccttgctgtcctgtgcagtgaagggagaggccctgggtgggggacactcagagtgggagcacatcccagcagtgcccatgtagcaggagcacagtggatggccttgtgtccctcgggcatgacaggcagaaacgagggctgctccaggagaagggcctcctgctggccagagcaaggaaggctgagcagcttggttctcccctctggcccctggagagaagggagcattcctagacccctgggtgcttgtctgcacagagctctggtctgtgccaccttggccaggctggctgtgggagagggtctggtcccacgccgcctctgctcagaccactgtgtgggaggtgcacagcacagcctgcgggtaaagtgtgagagcttgccatccagctcacgaagacagagttattaaaccattcaaatctc

SEQ ID NO: 873 - DNA, 680 bp, Homo sapiens
tggcactcccaaagtgctgggattacaggctggtctcgaactcctggcctgaagtgatcctccaacctcagcctcccaagtagctgggattacaggttgaatcgctcctagctgacccctcacgtctcttatgatacgtacagaaagcaagagcagcccatgccgtccggccgcgcaccaggtctcagtctgtgtgtctggttcaggtgaccatggtgttcagttcagttcctcctgcctcgtgtgtaggccactgagagctccctagtctaagccggaggaggttctgggctttgttcgcgggggtcacagctctcatggctgcagctagcgtgaccccccctggctccctggagttgctacagcccggcttctccaagaccctcctggggaccaagctggaagccaagtacctgtgctccgcctgcagaaacgtcctccgcaggcccttccaggcgcagtgtggccaccggtactgctccttctgcctggccagcatcctcagctctgggcctcagaactgtgctgcctgtgttcacgagggcatatatgaagaaggcatttctattttagaaagcagttcggccttcccagataatgctgcccgcagggaggtggagagcctgccggccgtctgtcccagtgatggatgcacctggaaggggaccctgaaagaatac

SEQ ID NO: 874 - DNA, 709 bp, Homo sapiens
agatgactgcagagtgagagtgaaaccagcttccctcggaggctgcagcacagggctgacatgcaaacgtctgaaaaagaggcaagctctcggtgtgagcaagtggactgcggctatttgaggaaggagcccacgtgggaatcccctgagctgcgccatggccagaggctttgttcgcgggggtcacagctctcatggctgcagctagcgtgaccccccctggctccctggagttgctacagcccggcttctccaagaccctcctggggaccaagctggaagccaagtacctgtgctccgcctgcagaaacgtcctccgcaggcccttccaggcgcagtgtggccaccggtactgctccttctgcctggccagcatcctcagctctgggcctcagaactgtgctgcctgtgttcacgagggcatatatgaagaaggcatttctattttagaaagcagttcggccttcccagataatgctgcccgcagggaggtggagagcctgccggccgtctgtcccagtgatggatgcacctggaaggggaccctgaaagaatacgagagctgccacgaaggccgctgcccgctcatgctgaccgaatgtcccgcgtgcaaaggcctggtccgccttggtgaaaaggagcgccacctggagcacgagtgcccggagagaagcctgagctgccggcattgccgggcaccctgctgcgg

SEQ ID NO: 875 - DNA, 823 bp, Homo sapiens
accggtgtcgcccggcttgggctcccggctcacctctcgggtgtgcggcaggggtctccgccccggggccacgggaggggaagcaagggcctcgctgtctcgccgcacctggggaagggacccaattagcgcggaccccacagcgcagcacctcaccagctccccgcaccaacgccccggcgcgctctttgaggaaaaagcagagggcgacttagggctttgttcgcgggggtcacagctctcatggctgcagctagcgtgaccccccctggctccctggagttgctacagcccggcttctccaagaccctcctggggaccaagctggaagccaagtacctgtgctccgcctgcagaaacgtcctccgcaggcccttccaggcgcagtgtggccaccggtactgctccttctgcctggccagcatcctcagctctgggcctcagaactgtgctgcctgtgttcacgagggcatatatgaagaaggcatttctattttagaaagcagttcggccttcccagataatgctgcccgcagggaggtggagagcctgccggccgtctgtcccagtgatggatgcacctggaaggggaccctgaaagaatacgagagctgccacgaaggccgctgcccgctcatgctgaccgaatgtcccgcgtgcaaaggcctggtccgccttggtgaaaaggagcgccacctggagcacgagtgcccggagagaagcctgagctgccggcattgccgggcaccctgctgcggagcagacgtgaaggcgcaccacgaggtctgccccaagttccccttaacttgtgacggctgcggca

SEQ ID NO: 876 - DNA, 2209 bp, Homo sapiens
gtagctgggcgggcccttagttccgggcgcgctgcgaccgttggggctttgttcgcgggggtcacagctctcatggctgcagctagcgtgaccccccctggctccctggagttgctacagcccggcttctccaagaccctcctggggaccaagctggaagccaagtacctgtgctccgcctgcagaaacgtcctccgcaggcccttccaggcgcagtgtggccaccggtactgctccttctgcctggccagcatcctcagctctgggcctcagaactgtgctgcctgtgttcacgagggcatatatgaagaaggcatttctattttagaaagcagttcggccttcccagataatgctgcccgcagggaggtggagagcctgccggccgtctgtcccagtgatggatgcacctggaaggggaccctgaaagaatacgagagctgccacgaaggccgctgcccgctcatgctgaccgaatgtcccgcgtgcaaaggcctggtccgccttggtgaaaaggagcgccacctggagcacgagtgcccggagagaagcctgagctgccggcattgccgggcaccctgctgcggagcagacgtgaagtttcaggaccacgtcaagacttgtggcaagtgtcgagtcccttgcagattccacgccatcggctgcctcgagacggtagagggtgagaaacagcaggagcacgaggtgcagtggctgcgggagcacctggccatgctactgagctcggtgctggaggcaaagcccctcttgggagaccagagccacgcggggtcagagctcctgcagaggtgcgagagcctggagaagaagacggccacttttgagaacattgtctgcgtcctgaaccgggaggtggagagggtggccatgactgccgaggcctgcagccggcagcaccggctggaccaagacaagattgaagccctgagtagcaaggtgcagcagctggagaggagcattggcctcaaggacctggcgatggctgacttggagcagaaggtcttggagatggaggcatccacctacgatggggtcttcatctggaagatctcagacttcgccaggaagcgccaggaagctgtggctggccgcatacccgccatcttctccccagccttctacaccagcaggtacggctacaagatgtgtctgcgtatctacctgaacggcgacggcaccgggcgaggaacacacctgtccctcttctttgtggtgatgaagggcccgaatgacgccctgctgcggtggcccttcaaccagaaggtgaccttaatgctgctcgaccagaataaccgggagcacgtgattgacgccttcaggcccgacgtgacttcatcctcttttcagaggccagtcaacgacatgaacatcgcaagcggctgccccctcttctgccccgtctccaagatggaggcaaagaattcctacgtgcgggacgatgccatcttcatcaaggccattgtggacctgacagggctctaactgccccctactggtgtctgggggttgggggcagccaggcacagccggctcacggaggggccaccacgctgggccagggtctcactgtacaagtgggcaggggccgcgcttgggcgcttgggagggtgtcggcctgcagccaagttcactgtcacgggggaaggagccaccagccagtcctcagatttcagagactgcggaggggcttggcagacggtcttagccaagggctgtggtggcattggccgagggtcttcgggtgcttcccagcacaagctgcccttgctgtcctgtgcagtgaagggagaggccctgggtgggggacactcagagtgggagcacatcccagcagtgcccatgtagcaggagcacagtggatggccttgtgtccctcgggcatgacaggcagaaacgagggctgctccaggagaagggcctcctgctggccagagcaaggaaggctgagcagcttggttctcccctctggcccctggagagaagggagcattcctagacccctgggtgcttgtctgcacagagctctggtctgtgccaccttggccaggctggctgtgggagagggtctggtcccacgccgcctctgctcagaccactgtgtgggaggtgcacagcacagcctgcgggtaaagtgtgagagcttgccatccagctcacgaagacagagttattaaaccattcaaatctc

SEQ ID NO: 877 - DNA, 1789 bp, Homo sapiens
gaaaccagcttccctcggaggctgcagcacagggctgacatgcaaacgtctgaaaaagaggcaagctctcggtgtgagcaagtggactgcggctatttgaggaaggagcccacgtgggaatcccctgagctgcgccatggccagaggctttgttcgcgggggtcacagctctcatggctgcagctagcgtgaccccccctggctccctggagttgctacagcccggcttctccaagaccctcctggggaccaagctggaagccaagtacctgtgctccgcctgcagaaacgtcctccgcaggcccttccaggcgcagtgtggccaccggtactgctccttctgcctggccagcatcctcagctctgggcctcagaactgtgctgcctgtgttcacgagggcatatatgaagaaggcatttctattttagaaagcagttcggccttcccagataatgctgcccgcagggaggtggagagcctgccggccgtctgtcccagtgatggatgcacctggaaggggaccctgaaagaatacgagagctgccacgaaggccgctgcccgctcatgctgaccgaatgtcccgcgtgcaaaggcctggtccgccttggtgaaaaggagcgccacctggagcacgagtgcccggagagaagcctgagctgccggcattgccgggcaccctgctgcggagcagacgtgaaggcgcaccacgaggtctgccccaagttccccttaacttgtgacggctgcggcaagaagaagatcccccgggagaagtttcaggaccacgtcaagacttgtggcaagtgtcgagtcccttgcagattccacgccatcggctgcctcgagacggtagagggtgagaaacagcaggagcacgaggtgcagtggctgcgggagcacctggccatgctactgagctcggtgctggaggcaaagcccctcttgggagaccagagccacgcggggtcagagctcctgcagaggtgcgagagcctggagaagaagacggccacttttgagaacattgtctgcgtcctgaaccgggaggtggagagggtggccatgactgccgaggcctgcagccggcagcaccggctggaccaagacaagattgaagccctgagtagcaaggtgcagcagctggagaggagcattggcctcaaggacctggcgatggctgacttggagcagaaggtcttggagatggaggcatccacctacgatggggtcttcatctggaagatctcagacttcgccaggaagcgccaggaagctgtggctggccgcatacccgccatcttctccccagccttctacaccagcaggtacggctacaagatgtgtctgcgtatctacctgaacggcgacggcaccgggcgaggaacacacctgtccctcttctttgtggtgatgaagggcccgaatgacgccctgctgcggtggcccttcaaccagaaggtgaccttaatgctgctcgaccagaataaccgggagcacgtgattgacgccttcaggcccgacgtgacttcatcctcttttcagaggccagtcaacgacatgaacatcgcaagcggctgccccctcttctgccccgtctccaagatggaggcaaagaattcctacgtgcgggacgatgccatcttcatcaaggccattgtggacctgacagggctctaactgccccctactggtgtctgggggttgggggcagccaggcacagccggctcacggaggggccaccacgctgggccagggtctcactgtacaagtgggcaggggccgcgct

SEQ ID NO: 878 - DNA, 2492 bp, Homo sapiens
gggagcgcggcgcggccgccgcgtgcgcgagccggggttgcagcccagccgggactttccagccggcggcagccgcggcggccgccggctcttccccgccccccgccatggggcagcccggggagcagaacgctgcggaccgcggcggaggacgcgcccggcgcccctgagccggccgagcggcgacggaccgcgagatgaggaaaatgaggcccaaagaagtgatgccacttggttaaggtcccagagcaggtcagaatcagacctaggatcagaaacctggctcctggctcctggctccctactcttctaaggatcgctgtcctgacagaagagaactcctctttcctaaaatggagtcgagtaaaaagatggactctcctggcgcgctgcagactaacccgccgctaaagctgcacactgaccgcagtgctgggacgccagtttttgtccctgaacaaggaggttacaaggaaaagtttgtgaagaccgtggaggacaagtacaagtgtgagaagtgccacctggtgctgtgcagcccgaagcagaccgagtgtgggcaccgcttctgcgagagctgcatggcggccctgctgagctcttcaagtccaaaatgtacagcgtgtcaagagagcatcgttaaagataaggtgtttaaggataattgctgcaagagagaaattctggctcttcagatctattgtcggaatgaaagcagaggttgtgcagagcagttaatgctgggacatctgctggtgcatttaaaaaatgattgccattttgaagaacttccatgtgtgcgtcctgactgcaaagaaaaggtcttgaggaaagacctgcgagaccacgtggagaaggcgtgtaaataccgggaagccacatgcagccactgcaagagtcaggttccgatgatcgcgctgcagaaacacgaagacaccgactgtccctgcgtggtggtgtcctgccctcacaagtgcagcgtccagactctcctgaggagcgaggggacaaaccagcagatcaaggcccacgaggccagctccgccgtgcagcacgtcaacctgctgaaggagtggagcaactcgctcgaaaagaaggtttccttgttgcagaatgaaagtgtagaaaaaaacaagagcatacaaagtttgcacaatcagatatgtagctttgaaattgaaattgagagacaaaaggaaatgcttcgaaataatgaatccaaaatccttcatttacagcgagtgatagacagccaagcagagaaactgaaggagcttgacaaggagatccggcccttccggcagaactgggaggaagcagacagcatgaagagcagcgtggagtccctccagaaccgcgtgaccgagctggagagcgtggacaagagcgcggggcaagtggctcggaacacaggcctgctggagtcccagctgagccggcatgaccagatgctgagtgtgcacgacatccgcctagccgacatggacctgcgcttccaggtcctggagaccgccagctacaatggagtgctcatctggaagattcgcgactacaagcggcggaagcaggaggccgtcatggggaagaccctgtccctttacagccagcctttctacactggttactttggctataagatgtgtgccagggtctacctgaacggggacgggatggggaaggggacgcacttgtcgctgttttttgtcatcatgcgtggagaatatgatgccctgcttccttggccgtttaagcagaaagtgacactcatgctgatggatcaggggtcctctcgacgtcatttgggagatgcattcaagcccgaccccaacagcagcagcttcaagaagcccactggagagatgaatatcgcctctggctgcccagtctttgtggcccaaactgttctagaaaatgggacatatattaaagatgatacaatttttattaaagtcatagtggatacttcggatctgcccgatccctgataagtagctggggaggtggatttagcagaaggcaactcctctgggggatttgaaccggtctgtcttcactgaggtcctcgcgctcagaaaaggaccttgtgagacggaggaagcggcagaaggcggacgcgtgccggcgggaggagccacgcgtgagcacacctgacacgttttataatagactagccacacttcactctgaagaattatttatccttcaacaagataaatattgctgtcagagaaggttttcattttcatttttaaagatctagttaattaaggtggaaaacatatatgctaaacaaaagaaacatgatttttcttccttaaacttgaacaccaaaaaaacacacacacacacacacgtggggatagctggacatgtcagcatgttaagtaaaaggagaatttatgaaatagtaatgcaattctgatatcttctttctaaaattcaagagtgcaattttgtttcaaatacagtatattgtctatttttaaggcctc

SEQ ID NO: 879 - DNA, 2239 bp, Homo sapiens
agaagtgatgccacttggttaaggtcccagagcaggtcagaatcagacctaggatcagaaacctggctcctggctcctggctccctactcttctaaggatcgctgtcctgacagaagagaactcctctttcctaaaatggagtcgagtaaaaagatggactctcctggcgcgctgcagactaacccgccgctaaagctgcacactgaccgcagtgctgggacgccagtttttgtccctgaacaaggaggttacaaggaaaagtttgtgaagaccgtggaggacaagtacaagtgtgagaagtgccacctggtgctgtgcagcccgaagcagaccgagtgtgggcaccgcttctgcgagagctgcatggcggccctgctgagctcttcaagtccaaaatgtacagcgtgtcaagagagcatcgttaaagataaggtgtttaaggataattgctgcaagagagaaattctggctcttcagatctattgtcggaatgaaagcagaggttgtgcagagcagttaatgctgggacatctgctggtgcatttaaaaaatgattgccattttgaagaacttccatgtgtgcgtcctgactgcaaagaaaaggtcttgaggaaagacctgcgagaccacgtggagaaggcgtgtaaataccgggaagccacatgcagccactgcaagagtcaggttccgatgatcgcgctgcagaaacacgaagacaccgactgtccctgcgtggtggtgtcctgccctcacaagtgcagcgtccagactctcctgaggagcgaggggacaaaccagcagatcaaggcccacgaggccagctccgccgtgcagcacgtcaacctgctgaaggagtggagcaactcgctcgaaaagaaggtttccttgttgcagaatgaaagtgtagaaaaaaacaagagcatacaaagtttgcacaatcagatatgtagctttgaaattgaaattgagagacaaaaggaaatgcttcgaaataatgaatccaaaatccttcatttacagcgagtgatagacagccaagcagagaaactgaaggagcttgacaaggagatccggcccttccggcagaactgggaggaagcagacagcatgaagagcagcgtggagtccctccagaaccgcgtgaccgagctggagagcgtggacaagagcgcggggcaagtggctcggaacacaggcctgctggagtcccagctgagccggcatgaccagatgctgagtgtgcacgacatccgcctagccgacatggacctgcgcttccaggtcctggagaccgccagctacaatggagtgctcatctggaagattcgcgactacaagcggcggaagcaggaggccgtcatggggaagaccctgtccctttacagccagcctttctacactggttactttggctataagatgtgtgccagggtctacctgaacggggacgggatggggaaggggacgcacttgtcgctgttttttgtcatcatgcgtggagaatatgatgccctgcttccttggccgtttaagcagaaagtgacactcatgctgatggatcaggggtcctctcgacgtcatttgggagatgcattcaagcccgaccccaacagcagcagcttcaagaagcccactggagagatgaatatcgcctctggctgcccagtctttgtggcccaaactgttctagaaaatgggacatatattaaagatgatacaatttttattaaagtcatagtggatacttcggatctgcccgatccctgataagtagctggggaggtggatttagcagaaggcaactcctctgggggatttgaaccggtctgtcttcactgaggtcctcgcgctcagaaaaggaccttgtgagacggaggaagcggcagaaggcggacgcgtgccggcgggaggagccacgcgtgagcacacctgacacgttttataatagactagccacacttcactctgaagaattatttatccttcaacaagataaatattgctgtcagagaaggttttcattttcatttttaaagatctagttaattaaggtggaaaacatatatgctaaacaaaagaaacatgatttttcttccttaaacttgaacaccaaaaaaacacacacacacacacacgtggggatagctggacatgtcagcatgttaagtaaaaggagaatttatgaaatagtaatgcaattctgatatcttctttctaaaattcaagagtgcaattttg

SEQ ID NO: 880 - DNA, 2459 bp, Homo sapiens
cggccgccggctcttccccgccccccgccatggggcagcccggggagcagaacgctgcggaccgcggcggaggacgcgcccggcgcccctgagccggccgagcggcgacggaccgcgagatgaggaaaatgaggcccaaagaagtgatgccacttggttaaggtcccagagcaggtcagaatcagacctaggatcagaaacctggctcctggctcctggctccctactcttctaaggatcgctgtcctgacagaagagaactcctctttcctaaaatggagtcgagtaaaaagatggactctcctggcgcgctgcagactaacccgccgctaaagctgcacactgaccgcagtgctgggacgccagtttttgtccctgaacaaggaggttacaaggaaaagtttgtgaagaccgtggaggacaagtacaagtgtgagaagtgccacctggtgctgtgcagcccgaagcagaccgagtgtgggcaccgcttctgcgagagctgcatggcggccctgctgagctcttcaagtccaaaatgtacagcgtgtcaagagagcatcgttaaagataaggtgtttaaggataattgctgcaagagagaaattctggctcttcagatctattgtcggaatgaaagcagaggttgtgcagagcagttaatgctgggacatctgctggtgcatttaaaaaatgattgccattttgaagaacttccatgtgtgcgtcctgactgcaaagaaaaggtcttgaggaaagacctgcgagaccacgtggagaaggcgtgtaaataccgggaagccacatgcagccactgcaagagtcaggttccgatgatcgcgctgcagaaacacgaagacaccgactgtccctgcgtggtggtgtcctgccctcacaagtgcagcgtccagactctcctgaggagcgagttgagtgcacacttgtcagagtgtgtcaatgcccccagcacctgtagttttaagcgctatggctgcgtttttcaggggacaaaccagcagatcaaggcccacgaggccagctccgccgtgcagcacgtcaacctgctgaaggagtggagcaactcgctcgaaaagaaggtttccttgttgcagaatgaaagtgtagaaaaaaacaagagcatacaaagtttgcacaatcagatatgtagctttgaaattgaaattgagagacaaaaggaaatgcttcgaaataatgaatccaaaatccttcatttacagcgagtgatagacagccaagcagagaaactgaaggagcttgacaaggagatccggcccttccggcagaactgggaggaagcagacagcatgaagagcagcgtggagtccctccagaaccgcgtgaccgagctggagagcgtggacaagagcgcggggcaagtggctcggaacacaggcctgctggagtcccagctgagccggcatgaccagatgctgagtgtgcacgacatccgcctagccgacatggacctgcgcttccaggtcctggagaccgccagctacaatggagtgctcatctggaagattcgcgactacaagcggcggaagcaggaggccgtcatggggaagaccctgtccctttacagccagcctttctacactggttactttggctataagatgtgtgccagggtctacctgaacggggacgggatggggaaggggacgcacttgtcgctgttttttgtcatcatgcgtggagaatatgatgccctgcttccttggccgtttaagcagaaagtgacactcatgctgatggatcaggggtcctctcgacgtcatttgggagatgcattcaagcccgaccccaacagcagcagcttcaagaagcccactggagagatgaatatcgcctctggctgcccagtctttgtggcccaaactgttctagaaaatgggacatatattaaagatgatacaatttttattaaagtcatagtggatacttcggatctgcccgatccctgataagtagctggggaggtggatttagcagaaggcaactcctctgggggatttgaaccggtctgtcttcactgaggtcctcgcgctcagaaaaggaccttgtgagacggaggaagcggcagaaggcggacgcgtgccggcgggaggagccacgcgtgagcacacctgacacgttttataatagactagccacacttcactctgaagaattatttatccttcaacaagataaatattgctgtcagagaaggttttcattttcatttttaaagatctagttaattaaggtggaaaacatatatgctaaacaaaagaaacatgatttttcttccttaaacttgaacaccaaaaaaacacacacacacacacacgtggggatagctggacatgtcagcatgttaagtaaaaggagaatttatgaaatagtaatgcaattctgatatcttctttctaaaattcaagagtgcaattttgtttcaa

SEQ ID NO: 881 - DNA, 1786 bp, Homo sapiens
agcagaacgctgcggaccgcggcggaggacgcgcccggcgcccctgagccggccgagcggcgacggaccgcgagaactcctctttcctaaaatggagtcgagtaaaaagatggactctcctggcgcgctgcagactaacccgccgctaaagctgcacactgaccgcagtgctgggacgccagtttttgtccctgaacaaggaggttacaaggaaaagtttgtgaagaccgtggaggacaagtacaagtgtgagaagtgccacctggtgctgtgcagcccgaagcagaccgagtgtgggcaccgcttctgcgagagctgcatggcggccctgctgagctcttcaagtccaaaatgtacagcgtgtcaagagagcatcgttaaagataaggtgtttaaggataattgctgcaagagagaaattctggctcttcagatctattgtcggaatgaaagcagaggttgtgcagagcagttaatgctgggacatctgctggtgcatttaaaaaatgattgccattttgaagaacttccatgtgtgcgtcctgactgcaaagaaaaggtcttgaggaaagacctgcgagaccacgtggagaaggcgtgtaaataccgggaagccacatgcagccactgcaagagtcaggttccgatgatcgcgctgcaggtttccttgttgcagaatgaaagtgtagaaaaaaacaagagcatacaaagtttgcacaatcagatatgtagctttgaaattgaaattgagagacaaaaggaaatgcttcgaaataatgaatccaaaatccttcatttacagcgagtgatagacagccaagcagagaaactgaaggagcttgacaaggagatccggcccttccggcagaactgggaggaagcagacagcatgaagagcagcgtggagtccctccagaaccgcgtgaccgagctggagagcgtggacaagagcgcggggcaagtggctcggaacacaggcctgctggagtcccagctgagccggcatgaccagatgctgagtgtgcacgacatccgcctagccgacatggacctgcgcttccaggtcctggagaccgccagctacaatggagtgctcatctggaagattcgcgactacaagcggcggaagcaggaggccgtcatggggaagaccctgtccctttacagccagcctttctacactggttactttggctataagatgtgtgccagggtctacctgaacggggacgggatggggaaggggacgcacttgtcgctgttttttgtcatcatgcgtggagaatatgatgccctgcttccttggccgtttaagcagaaagtgacactcatgctgatggatcaggggtcctctcgacgtcatttgggagatgcattcaagcccgaccccaacagcagcagcttcaagaagcccactggagagatgaatatcgcctctggctgcccagtctttgtggcccaaactgttctagaaaatgggacatatattaaagatgatacaatttttattaaagtcatagtggatacttcggatctgcccgatccctgataagtagctggggaggtggatttagcagaaggcaactcctctgggggatttgaaccggtctgtcttcactgaggtcctcgcgctcagaaaaggaccttgtgagacggaggaagcggcagaaggcggacgcgtgccggcgggaggagccacgcgtgagcacacctgacacgttttataatagactagccacacttcactctgaagaattatttatccttcaacaagataaatattgct

SEQ ID NO: 882 - DNA, 7640 bp, Homo sapiens
cgagggagcgcggcgcggccgccgcgtgcgcgagccggggttgcagcccagccgggactttccagccggcggcagccgcggcggccgccggctcttccccgccccccgccatggggcagcccggggagcagaacgctgcggaccgcggcggaggacgcgcccggcgcccctgagccggccgagcggcgacggaccgcgagaactcctctttcctaaaatggagtcgagtaaaaagatggactctcctggcgcgctgcagactaacccgccgctaaagctgcacactgaccgcagtgctgggacgccagtttttgtccctgaacaaggaggttacaaggaaaagtttgtgaagaccgtggaggacaagtacaagtgtgagaagtgccacctggtgctgtgcagcccgaagcagaccgagtgtgggcaccgcttctgcgagagctgcatggcggccctgctgagctcttcaagtccaaaatgtacagcgtgtcaagagagcatcgttaaagataaggtgtttaaggataattgctgcaagagagaaattctggctcttcagatctattgtcggaatgaaagcagaggttgtgcagagcagttaatgctgggacatctgctggtgcatttaaaaaatgattgccattttgaagaacttccatgtgtgcgtcctgactgcaaagaaaaggtcttgaggaaagacctgcgagaccacgtggagaaggcgtgtaaataccgggaagccacatgcagccactgcaagagtcaggttccgatgatcgcgctgcagaaacacgaagacaccgactgtccctgcgtggtggtgtcctgccctcacaagtgcagcgtccagactctcctgaggagcgagttgagtgcacacttgtcagagtgtgtcaatgcccccagcacctgtagttttaagcgctatggctgcgtttttcaggggacaaaccagcagatcaaggcccacgaggccagctccgccgtgcagcacgtcaacctgctgaaggagtggagcaactcgctcgaaaagaaggtttccttgttgcagaatgaaagtgtagaaaaaaacaagagcatacaaagtttgcacaatcagatatgtagctttgaaattgaaattgagagacaaaaggaaatgcttcgaaataatgaatccaaaatccttcatttacagcgagtgatagacagccaagcagagaaactgaaggagcttgacaaggagatccggcccttccggcagaactgggaggaagcagacagcatgaagagcagcgtggagtccctccagaaccgcgtgaccgagctggagagcgtggacaagagcgcggggcaagtggctcggaacacaggcctgctggagtcccagctgagccggcatgaccagatgctgagtgtgcacgacatccgcctagccgacatggacctgcgcttccaggtcctggagaccgccagctacaatggagtgctcatctggaagattcgcgactacaagcggcggaagcaggaggccgtcatggggaagaccctgtccctttacagccagcctttctacactggttactttggctataagatgtgtgccagggtctacctgaacggggacgggatggggaaggggacgcacttgtcgctgttttttgtcatcatgcgtggagaatatgatgccctgcttccttggccgtttaagcagaaagtgacactcatgctgatggatcaggggtcctctcgacgtcatttgggagatgcattcaagcccgaccccaacagcagcagcttcaagaagcccactggagagatgaatatcgcctctggctgcccagtctttgtggcccaaactgttctagaaaatgggacatatattaaagatgatacaatttttattaaagtcatagtggatacttcggatctgcccgatccctgataagtagctggggaggtggatttagcagaaggcaactcctctgggggatttgaaccggtctgtcttcactgaggtcctcgcgctcagaaaaggaccttgtgagacggaggaagcggcagaaggcggacgcgtgccggcgggaggagccacgcgtgagcacacctgacacgttttataatagactagccacacttcactctgaagaattatttatccttcaacaagataaatattgctgtcagagaaggttttcattttcatttttaaagatctagttaattaaggtggaaaacatatatgctaaacaaaagaaacatgatttttcttccttaaacttgaacaccaaaaaaacacacacacacacacacgtggggatagctggacatgtcagcatgttaagtaaaaggagaatttatgaaatagtaatgcaattctgatatcttctttctaaaattcaagagtgcaattttgtttcaaatacagtatattgtctatttttaaggcctcatctggtctctgttttaataatttgtttgtcagaagaccctgaagtatatacctaggtcttttttttgaaagtctctaaattcagaatcattttttaatttaaagttctacaaataattgttactgcaaacattttattttaaaacgttgatagactgatatttcttggaagaaaatataaaatatcaaacactggttatcacttgtgataggaaagagaatattcaacctgttgttatttctcgttagaaatgtaaaccttcaaatatctgtcgtagttaatgacacgacttcacaattctgaacggagcctcgctcatggatgctgtgcatcattttcagatttataattgttttcaccctaaaatagggcatccgttgaactttggagttctaaacaaaatcctgtaggtgtttggattctgccccatgtgttcggacgagctctctgttgctgacagcaccggccttcggtctccatgtcaggggtgggcgggtgactgctgagggaggcccgcaggtgtgtttctccatcccgtcatcttgctgcatgccgtcaacggtctccgaaagcaacgttgtgcgtagagctggtggcatacggcccacgtgccttagatgggacatgctgcttctccaccctgggtttgcattgagcatcattctagaaagtgctagtttaaccagacttttctctccaccactagatctttgtctctacaagggccctcagacacctctgcacctgctgaggggaagccaggctccaccgtcggcttctggagcctccgctgcttaattaccacagattccaaatctctaggccccacgagtgagccgcctggtccaagtacggcctggtcccaccctgagggaggcaggtgtggaacagaagccgagcctctccgtgtccccaccggggccgtgggcacccccacagcccgaagcagaaccctctgagcattccagagaccgctgctcgggggcctgcccaggctgaccaacgggcgctcctgaccaccaccctggcgggaagggtggccacggggcccgtcgtcccagcctgtgcctgcccagatggcattttctcaactcactgtttactgtctctcagtgtccaactgtgattagaagcctggagcctgccccctgcaccccttttgctatgcaccacgcttcatggtgctcttaccactgatgggtgctacacgcgacgggtgcttcttaggcaaaaccaatgtgtgcgaactgtcacacctgtgccactcgcccacaagccgcgcccacaattggccagctgggccgtgcacgtcagactgcctgcctcggctctccccgtggccgcgcggggacagcttggtgggtgcccggtggcccacctgtctctggtgctgccatctgtcctgggtgtgccttcgccccagtgcctgctggaagtgccctccgtcgcacccctgtgccctgagctcccgtgaggggcccgccgcgccctttcgcggtcgaagcgttccgttgttcttatctgcctttcctttccccgctctcctgggattactttgggggaatgagtatccttggttctgccctgtgagggagtcgtgtgtccctgctcataaaggaaggacttcctgcagaagctgcggaaaactactgttccctcgaaggtgtcccccacctgaggcctgtcccctacctgccctcaggtagttttcctgaggccaggggttaacaacagggacatccctgcaacttccccttcacaaaatgtataatattagatgaaggatatgcaacatcttggtctagtaagaaccgtttcctcccctctgggttgaagtcctggtgtggcccccagaagcagcagtgcgtgtcactgggacgtctccagtagcccttcccaggcagacgctcctggcgggacgccatggggcccacctgagggtcccacagacgtaacctgagtgacaggagtccttgaggatgggatggcctatgtcacacactttgtccttgaacctgagtgatgggggtccttgaggatgggatggcctgtgtcacgcgctttgtctttgtgtttggttgtatcggggtctctgttctgagtgtgtcttcctctcatgtactcaacacagtgggcagcagcctgggacggcgtcccctctcccggcggcgggcaagccttgcgctgctccaccctcggcctgggcaccctcacttggcgctggccacctgggccagcctggggccatggtctctctgcagctgaggcccagtggccccttgggcagtgatcggccctccccgcatcacagggccctggcagcaagcgggaaatgggggcgcacactgtgtgcttgggggtgctgcttgtttaccacacatgaccagactcccagcaggacagagctgctcagtactttacagaaaccaactgagtcgtttgtgcatgaattaagccggtctgcttccccgtcaccttcgtaacaaaacaacgtcccctctcccctcgcctcgagcagtttcttcaggacaccgtggctcgggctgctccctgctgccaggcacgctggttggctggcctgggcccggctcacgtgaagggcactggctcttgtgaccacactgagccacgtgcaagccgcagccgggcctggaagcctgaccctctggttctagggcttgtcccgcggagcctgcagagctagacgttggggtgtgtccgtgatgatatgggggccaggctgggagtagggcctttctagcagggttgggtggctcagtgagggtgtggaagtgggggacccacggggcctggctttgggactagacatgccagccccagctgggctggagggagcctgagtgagccccgacatacgctgggcctttcagctcgccgtgctctggtgacacacaggcggccaggttgggatttgtgtcaattctaggagccatcaagcatgaatgtggttctgtctcctgagcgcaagcctcgccggacccctgggcgaaggcctggacttgcagatgtgtgttccctgtgcgggtggacagagggggcccttatgacccacattgcagccccattccaccaccccttcctccccagagcagtctctgccgagggacagcacctgtgtcccttcgatgccacaacagccagttgaacaggggagccctttgctcaggcagcttctcctgcctctccctcctttctccttccctgccccatccccgtgcccttcttggcctgtggcgctggggagccatggtgtggcatactggggctcctgctccttgggccacttcctcagcccgggccccacaggcccaccacctgccagggctcccactgcactggctgtggcaggaggcttccccatgaccccgtgtggcccagctcggtgaggatgcagttctaggcacagcccctgggacagccagctgcctcccagaccacgtcagcctgctccagggtcctcagtcaccctgggccaggggccacgtgtcccatggatgtcgaccatgccaacgtcacattccagcaccccttttgcttgatggcgtctggtggtagtcagcatggtggacccacatcctacagccagaggtgatgttggacaaaggaaggggagtctggatgggtccttaaacgaccattctgtccgcagcggggtcattccttgtcagcccaagggagggccggggagtacactgatcccaacagctgggctgacacctcctttctcccctgcacggggaggattggcctgaggaccgtcaccctgtgcacagccccagtagggtggcagtgccactgtctccttgggccgttgcaggattgggcgggtgcagactccccttgcgggccccttgctcaatccccggccctcccagactcctccctctactgggggtaatttgtgtgtcagaagggctctggcagagctgtaaaatactgttttttaaaaattttagtccagatctttacttattagactgcagaaggagagctagggagagtgggggaagcccccttgcttttgtatctgtgaggtgaatgagggtctgtcacccaaatctacttctcagcccatgaccatagttctgttttccgtttgcaaatctcagtagctctgttttctccaaagtagaatgtgcgcaccggggtcctagccaggcgaggtcagtgtcggcaggctacctggtcattattgctgcctcgtccaggctgatgctgatggtcacaggcacggtggcatcagggagccgggccagcaggcggcgtgaggcggggccagcagctcactgcaagggcattttccacctgatcctggtgtgccccacatgcggtggcagggcagacgtgtgaagcctcggccgtctcggggctggcaggtgtgcgggtgaggaggccccggtggccaagcagagcctgcgtttcatttctcctgctgcactgtgtctagtctgtcttgtgaactctcaccgtgaaaagaggctagaagtccaggatcgctgtaccgctcctgtaattaggtgatgactggatttgacaacttagtcccctcagacaagtaagataccctccaacagcaaattcaatgacttaattggaaaacacacaagctggcatgatgtccggtgatttctgtaagaaatgcctgtaggagaaggtctgtgaagtgtggagggcagtgtcgacgctgcacagcatctgcagattcgcagcctcttctctgccggtgcctctgttcggttctgttacccaaaaacaaagaccaaagaaggccaatctctcatttgaccctgtctttttaatctgcctgttttaaaagttgcgtctgtagtagccgcttgctgtgaagacacatcttgacagtccaagtgattttgtgaccagtgatttgggtcctgttttccgctcttctaagaaaaaacaaaaagaccgtgagttattgcccagcaataatcatgttgttactgtgagttagcaacatgcctgacttcctgatagcattactgttttctagttttgtttattgtatattatgtgtggttttatttggtatttatttgtgttttgaggtcttgcaatgtttttgtgtttctgatgctaataactaaagtttgtaagactgtagaatgcaaaactcggagatgctaaactgtcttattagaggaaaataaatctgattatggagtctca

SEQ ID NO: 883 - DNA, 701 bp, Homo sapiens
ccgcggcggaggacgcgcccggcgcccctgagccggccgagcggcgacggaccgcgagatggcgtctcgctctgtcacccaggctggagtgcagtggcgcgatccctgcttactgcagcttctgcctcccaggttcgagagattctcctgcctcagcctcccaagtagctgggactacagcagctgacatctgtgaagcctcagtgatcctataaattgaggaacctgagagaatcaagagaaagacaacaattcttgctgatatgaggaaaatgaggcccaaagaagtgatgccacttggttaaggtcccagagcaggtcagaatcagacctaggatcagaaacctggctcctggctcctggctccctactcttctaaggatcgctgtcctgacagaagagaactcctctttcctaaaatggagtcgagtaaaaagatggactctcctggcgcgctgcagactaacccgccgctaaagctgcacactgaccgcagtgctgggacgccagtttttgtccctgaacaaggaggttacaaggaaaagtttgtgaagaccgtggaggacaagtacaagtgtgagaagtgccacctggtgctgtgcagcccgaagcagaccgagtgtgggcaccgcttctgcgagagctgcatggcggccctgctgagctcttcaagtccaaaatgtacagcgtgtcaagagagc

SEQ ID NO: 884 - DNA, 3972 bp, Homo sapiens
gcagcagccgcgcctgcagaccggcctcgcggagcccgcgcgccgagccccacaatggcttattcagaagagcataaaggtatgccctgtggtttcatccgccagaattccggcaactccatttccttggactttgagcccagtatagagtaccagtttgtggagcggttggaagagcgctacaaatgtgccttctgccactcggtgcttcacaacccccaccagacaggatgtgggcaccgcttctgccagcactgcatcctgtccctgagagaattaaacacagtgccaatctgccctgtagataaagaggtcatcaaatctcaggaggtttttaaagacaattgttgcaaaagagaagtcctcaacttatatgtatattgcagcaatgctcctggatgtaatgccaaggttattctgggccggtaccaggatcaccttcagcagtgcttatttcaacctgtgcagtgttctaatgagaagtgccgggagccagtcctacggaaagacctgaaagagcatttgagtgcatcctgtcagtttcgaaaggaaaaatgcctttattgcaaaaaggatgtggtagtcatcaatctacagaatcatgaggaaaacttgtgtcctgaatacccagtattttgtcccaacaattgtgcgaagattattctaaaaactgaggtagatgaacacctggctgtatgtcctgaagctgagcaagactgtccttttaagcactatggctgtgctgtaacggataaacggaggaacctgcagcaacatgagcattcagccttacgggagcacatgcgtttggttttagaaaagaatgtccaattagaagaacagatttctgacttacacaagagcctagaacagaaagaaagtaaaatccagcagctagcagaaactataaagaaacttgaaaaggagttcaagcagtttgcacagttgtttggcaaaaatggaagcttcctcccaaacatccaggtttttgccagtcacattgacaagtcagcttggctagaagctcaagtgcatcaattattacaaatggttaaccagcaacaaaataaatttgacctgagacctttgatggaagcagttgatacagtgaaacagaaaattaccctgctagaaaacaatgatcaaagattagccgttttagaagaggaaactaacaaacatgatacccacattaatattcataaagcacagctgagtaaaaatgaagagcgatttaaactgctggagggtacttgctataatggaaagctcatttggaaggtgacagattacaagatgaagaagagagaggcggtggatgggcacacagtgtccatcttcagccagtccttctacaccagccgctgtggctaccggctctgtgctagagcatacctgaatggggatgggtcagggagggggtcacacctgtccctatactttgtggtcatgcgaggagagtttgactcactgttgcagtggccattcaggcagagggtgaccctgatgcttctggaccagagtggcaaaaagaacattatggagaccttcaaacctgaccccaatagcagcagctttaaaagacctgatggggagatgaacattgcatctggctgtccccgctttgtggctcattctgttttggagaatgccaagaacgcctacattaaagatgacactctgttcttgaaagtggccgtggacttaactgacctggaggatctctagtcactgttatggggtgataagaggacttcttggggccagaactgtggaggagagcacatttgattatcatattgacctggatttagactcaaagcacatttgtatttgcctttttccttaacgtttgaagtcagtttaaaacttctgaagtgctgtctttttacattttactctgtcccagtttgaaacttaaaactcttagaatattctcttattatttatatttttatatttcttgaaagatggtaagtttcttgaagtttttggggcgtttctcttttactggtgcttagcgcagtgtctcgggcactctaaatattgagtgttatggaggacacagaggtagcagaatcccagttgaaaatgttttgatattttattgtttggcctattgattctagacctggccttaagtctgcaaaagccatctttataaggtaggctgttccagttaagtagtgggtgatgtagttacaaagataatatgctcagtttggacctttttttcagttaaatgctaaatatatgaaaattactatacctctaagtattttcatgaaattcaccagcagtttgcaagcacagttttgcaaggctgcataagaactggtgaatggggtaagcattttcattcttcctgctgaagtaaagcagaaagtactgcatagtatatgagatatagccagctagctaaagttcagattttgttaggttcaaccctatgaaaaaaactattttcataggtcaaaaatggtaaaaaattagcagtttcataagattcaaccaaataaatatatatatacacacacacatacatatacacctatatatgtgtgtatacaaacagttcgaatgtattttggtgacagtaataaatcaatgtgaggatggatagaatttagtatatgatagagaaaatgtcataaatggataaaaggaatttacaacttgaggagaaaacctttacaatttcctatgggtgtcagaagtactctcagcgaaaactgatggctaaaacagtatctactattctctgataactttttttttgagacagagtttcattgtcacccaggctggagtacagtggcatgatctcagctcactgcaaactctgcctcccgaattcaagtgattctcctgcctcagcctcctgagtagctgggattacaggcgcccgtcaccacacccaggtaatttttgtatttttagtagagacggagttttgccatgttggccaagctgatctcaaactcctgacctcaagtgatctgcccgcctcggcctcccaaagtgctgagattacaggcatgacccaccgcgtcaagcctctgacaactattgaatttgtaagctgctatgcaaatgggcatttatataaacttgtgatgtttcttgtcagaattctgagtactctgtgaagaacagaaatgatcatattcttatgcatctatctgtatgggtctgaaggtgtatatacaaactgagatgagtccttatgactcttgataagcctgagtttaacaacaacaaaaatgccaagttgtcctgagcccttctgcgttgttatgccacttccctactgctcatatgcacgctggctcccctgggcacgcaaggatgagtatgggccatgggcccctgtagagctgcttacctggtgatgaccatgcaccttacaatttctgaacagttaaccctatagaagcatgctttatatgagtgtcttctgggaagaggaaccttcttaatctcttctgtgggattttcaaaatgctaaagactcacactgcagcaatcatcccagatgattaaattcaaagaaataggttcacaacaggaatatactgaagaactagagtgtcactgctggtgaactgtggcacggttgctcaacacatcacctcggacaaattcaggaagcatttctttagcccacaagtccagacccaggtgctctgtatgtttgtttttaatattcatcatatccaagttcactctgtcttcctgagcagtggaagatcatattgctgtaacttcttttaagtagttgatgtggaaaacattttaaagtgaatttgtcaaaatgctggttttgtgttttatccaacttttgtgcatatatataaagtatgtcatggcatggtttgcttaggagttcagagttccttcatcatcgaaatagtgattaagtgatcccagaacaaggaatactagagtaaaaagcacctctttttcacaaaa

SEQ ID NO: 885 - DNA, 3972 bp, Homo sapiens
agacgcacgtgagggaaatcagatgactggacttgtagatactaacggttctgaagcggaatggcttattcagaagagcataaaggtatgccctgtggtttcatccgccagaattccggcaactccatttccttggactttgagcccagtatagagtaccagtttgtggagcggttggaagagcgctacaaatgtgccttctgccactcggtgcttcacaacccccaccagacaggatgtgggcaccgcttctgccagcactgcatcctgtccctgagagaattaaacacagtgccaatctgccctgtagataaagaggtcatcaaatctcaggaggtttttaaagacaattgttgcaaaagagaagtcctcaacttatatgtatattgcagcaatgctcctggatgtaatgccaaggttattctgggccggtaccaggatcaccttcagcagtgcttatttcaacctgtgcagtgttctaatgagaagtgccgggagccagtcctacggaaagacctgaaagagcatttgagtgcatcctgtcagtttcgaaaggaaaaatgcctttattgcaaaaaggatgtggtagtcatcaatctacagaatcatgaggaaaacttgtgtcctgaatacccagtattttgtcccaacaattgtgcgaagattattctaaaaactgaggtagatgaacacctggctgtatgtcctgaagctgagcaagactgtccttttaagcactatggctgtgctgtaacggataaacggaggaacctgcagcaacatgagcattcagccttacgggagcacatgcgtttggttttagaaaagaatgtccaattagaagaacagatttctgacttacacaagagcctagaacagaaagaaagtaaaatccagcagctagcagaaactataaagaaacttgaaaaggagttcaagcagtttgcacagttgtttggcaaaaatggaagcttcctcccaaacatccaggtttttgccagtcacattgacaagtcagcttggctagaagctcaagtgcatcaattattacaaatggttaaccagcaacaaaataaatttgacctgagacctttgatggaagcagttgatacagtgaaacagaaaattaccctgctagaaaacaatgatcaaagattagccgttttagaagaggaaactaacaaacatgatacccacattaatattcataaagcacagctgagtaaaaatgaagagcgatttaaactgctggagggtacttgctataatggaaagctcatttggaaggtgacagattacaagatgaagaagagagaggcggtggatgggcacacagtgtccatcttcagccagtccttctacaccagccgctgtggctaccggctctgtgctagagcatacctgaatggggatgggtcagggagggggtcacacctgtccctatactttgtggtcatgcgaggagagtttgactcactgttgcagtggccattcaggcagagggtgaccctgatgcttctggaccagagtggcaaaaagaacattatggagaccttcaaacctgaccccaatagcagcagctttaaaagacctgatggggagatgaacattgcatctggctgtccccgctttgtggctcattctgttttggagaatgccaagaacgcctacattaaagatgacactctgttcttgaaagtggccgtggacttaactgacctggaggatctctagtcactgttatggggtgataagaggacttcttggggccagaactgtggaggagagcacatttgattatcatattgacctggatttagactcaaagcacatttgtatttgcctttttccttaacgtttgaagtcagtttaaaacttctgaagtgctgtctttttacattttactctgtcccagtttgaaacttaaaactcttagaatattctcttattatttatatttttatatttcttgaaagatggtaagtttcttgaagtttttggggcgtttctcttttactggtgcttagcgcagtgtctcgggcactctaaatattgagtgttatggaggacacagaggtagcagaatcccagttgaaaatgttttgatattttattgtttggcctattgattctagacctggccttaagtctgcaaaagccatctttataaggtaggctgttccagttaagtagtgggtgatgtagttacaaagataatatgctcagtttggacctttttttcagttaaatgctaaatatatgaaaattactatacctctaagtattttcatgaaattcaccagcagtttgcaagcacagttttgcaaggctgcataagaactggtgaatggggtaagcattttcattcttcctgctgaagtaaagcagaaagtactgcatagtatatgagatatagccagctagctaaagttcagattttgttaggttcaaccctatgaaaaaaactattttcataggtcaaaaatggtaaaaaattagcagtttcataagattcaaccaaataaatatatatatacacacacacatacatatacacctatatatgtgtgtatacaaacagttcgaatgtattttggtgacagtaataaatcaatgtgaggatggatagaatttagtatatgatagagaaaatgtcataaatggataaaaggaatttacaacttgaggagaaaacctttacaatttcctatgggtgtcagaagtactctcagcgaaaactgatggctaaaacagtatctactattctctgataactttttttttgagacagagtttcattgtcacccaggctggagtacagtggcatgatctcagctcactgcaaactctgcctcccgaattcaagtgattctcctgcctcagcctcctgagtagctgggattacaggcgcccgtcaccacacccaggtaatttttgtatttttagtagagacggagttttgccatgttggccaagctgatctcaaactcctgacctcaagtgatctgcccgcctcggcctcccaaagtgctgagattacaggcatgacccaccgcgtcaagcctctgacaactattgaatttgtaagctgctatgcaaatgggcatttatataaacttgtgatgtttcttgtcagaattctgagtactctgtgaagaacagaaatgatcatattcttatgcatctatctgtatgggtctgaaggtgtatatacaaactgagatgagtccttatgactcttgataagcctgagtttaacaacaacaaaaatgccaagttgtcctgagcccttctgcgttgttatgccacttccctactgctcatatgcacgctggctcccctgggcacgcaaggatgagtatgggccatgggcccctgtagagctgcttacctggtgatgaccatgcaccttacaatttctgaacagttaaccctatagaagcatgctttatatgagtgtcttctgggaagaggaaccttcttaatctcttctgtgggattttcaaaatgctaaagactcacactgcagcaatcatcccagatgattaaattcaaagaaataggttcacaacaggaatatactgaagaactagagtgtcactgctggtgaactgtggcacggttgctcaacacatcacctcggacaaattcaggaagcatttctttagcccacaagtccagacccaggtgctctgtatgtttgtttttaatattcatcatatccaagttcactctgtcttcctgagcagtggaagatcatattgctgtaacttcttttaagtagttgatgtggaaaacattttaaagtgaatttgtcaaaatgctggttttgtgttttatccaacttttgtgcatatatataaagtatgtcatggcatggtttgcttaggagttcagagttccttcatcatcgaaatagtgattaagtgatcccagaacaaggaatactagagtaaaaagcacctctttttc

SEQ ID NO: 886 - DNA, 1827 bp, Homo sapiens
agtgcagggatgtgcagatgagtgggctgtggggtgtcctgctcacggtttcatggatgaatggcttattcagaagagcataaaggtatgccctgtggtttcatccgccagaattccggcaactccatttccttggactttgagcccagtatagagtaccagtttgtggagcggttggaagagcgctacaaatgtgccttctgccactcggtgcttcacaacccccaccagacaggatgtgggcaccgcttctgccagcactgcatcctgtccctgagagaattaaacacagtgccaatctgccctgtagataaagaggtcatcaaatctcaggaggtttttaaagacaattgttgcaaaagagaagtcctcaacttatatgtatattgcagcaatgctcctggatgtaatgccaaggttattctgggccggtaccaggatcaccttcagcagtgcttatttcaacctgtgcagtgttctaatgagaagtgccgggagccagtcctacggaaagacctgaaagagcatttgagtgcatcctgtcagtttcgaaaggaaaaatgcctttattgcaaaaaggatgtggtagtcatcaatctacagaatcatgaggaaaacttgtgtcctgaatacccagtattttgtcccaacaattgtgcgaagattattctaaaaactgaggtagatgaacacctggctgtatgtcctgaagctgagcaagactgtccttttaagcactatggctgtgctgtaacggataaacggaggaacctgcagcaacatgagcattcagccttacgggagcacatgcgtttggttttagaaaagaatgtccaattagaagaacagatttctgacttacacaagagcctagaacagaaagaaagtaaaatccagcagctagcagaaactataaagaaacttgaaaaggagttcaagcagtttgcacagttgtttggcaaaaatggaagcttcctcccaaacatccaggtttttgccagtcacattgacaagtcagcttggctagaagctcaagtgcatcaattattacaaatggttaaccagcaacaaaataaatttgacctgagacctttgatggaagcagttgatacagtgaaacagaaaattaccctgctagaaaacaatgatcaaagattagccgttttagaagaggaaactaacaaacatgatacccacattaatattcataaagcacagctgagtaaaaatgaagagcgatttaaactgctggagggtacttgctataatggaaagctcatttggaaggtgacagattacaagatgaagaagagagaggcggtggatgggcacacagtgtccatcttcagccagtccttctacaccagccgctgtggctaccggctctgtgctagagcatacctgaatggggatgggtcagggagggggtcacacctgtccctatactttgtggtcatgcgaggagagtttgactcactgttgcagtggccattcaggcagagggtgaccctgatgcttctggaccagagtggcaaaaagaacattatggagaccttcaaacctgaccccaatagcagcagctttaaaagacctgatggggagatgaacattgcatctggctgtccccgctttgtggctcattctgttttggagaatgccaagaacgcctacattaaagatgacactctgttcttgaaagtggccgtggacttaactgacctggaggatctctagtcactgttatggggtgataagaggacttcttggggccagaactgtggaggagagcacatttgattatcatattgacctggatttagactcaaa

SEQ ID NO: 887 - DNA, 1622 bp, Homo sapiens
gcagccaggagcagcagccgcgcctgcagaccggcctcgcggagcccgcgcgccgagccccacaatggcttattcagaagagcataaaggtatgccctgtggtttcatccgccagaattccggcaactccatttccttggactttgagcccagtatagagtaccagtttgtggagcggttggaagagcgctacaaatgtgccttctgccactcggtgcttcacaacccccaccagacaggatgtgggcaccgcttctgccagcactgcatcctgtccctgagagaattaaacacagtgccaatctgccctgtagataaagaggtcatcaaatctcaggaggtttttaaagacaattgttgcaaaagagaagtcctcaacttatatgtatattgcagcaatgctcctggatgtaatgccaaggttattctgggccggtaccaggataaacggaggaacctgcagcaacatgagcattcagccttacgggagcacatgcgtttggttttagaaaagaatgtccaattagaagaacagatttctgacttacacaagagcctagaacagaaagaaagtaaaatccagcagctagcagaaactataaagaaacttgaaaaggagttcaagcagtttgcacagttgtttggcaaaaatggaagcttcctcccaaacatccaggtttttgccagtcacattgacaagtcagcttggctagaagctcaagtgcatcaattattacaaatggttaaccagcaacaaaataaatttgacctgagacctttgatggaagcagttgatacagtgaaacagaaaattaccctgctagaaaacaatgatcaaagattagccgttttagaagaggaaactaacaaacatgatacccacattaatattcataaagcacagctgagtaaaaatgaagagcgatttaaactgctggagggtacttgctataatggaaagctcatttggaaggtgacagattacaagatgaagaagagagaggcggtggatgggcacacagtgtccatcttcagccagtccttctacaccagccgctgtggctaccggctctgtgctagagcatacctgaatggggatgggtcagggagggggtcacacctgtccctatactttgtggtcatgcgaggagagtttgactcactgttgcagtggccattcaggcagagggtgaccctgatgcttctggaccagagtggcaaaaagaacattatggagaccttcaaacctgaccccaatagcagcagctttaaaagacctgatggggagatgaacattgcatctggctgtccccgctttgtggctcattctgttttggagaatgccaagaacgcctacattaaagatgacactctgttcttgaaagtggccgtggacttaactgacctggaggatctctagtcactgttatggggtgataagaggacttcttggggccagaactgtggaggagagcacatttgattatcatattgacctggatttagactcaaagcacatttgtatttgcctttttccttaacgtttgaagtcagtttaaaacttctgaagtgctgtctttttacattttactctgtcccagtttgaaacttaaaactcttag

SEQ ID NO: 888 - DNA, 2558 bp, Homo sapiens
gcagtggcgtccgcagctggggcttggcctgcgggcggccagcgaaggtggcgaaggctcccactggatccagagtttgccgtccaagcagcctcgtctcggcgcgcagtgtctgtgtccgtcctctaccagcgccttggctgagcggagtcgtgcggttggtgggggagccctgccctcctggttcggcctccccgcgcactagaacgatcatgaacttctgaagggacccagctttctttgtgtgctccaagtgatttgcacaaataataatatatatatttattgaaggagagaatcagagcaagtgataatcaagttactatgagtctgctaaactgtgaaaacagctgtggatccagccagtctgaaagtgactgctgtgtggccatggccagctcctgtagcgctgtaacaaaagatgatagtgtgggtggaactgccagcacggggaacctctccagctcatttatggaggagatccagggatatgatgtagagtttgacccacccctggaaagcaagtatgaatgccccatctgcttgatggcattacgagaagcagtgcaaacgccatgcggccataggttctgcaaagcctgcatcataaaatcaataagggatgcaggtcacaaatgtccagttgacaatgaaatactgctggaaaatcaactatttccagacaattttgcaaaacgtgagattctttctctgatggtgaaatgtccaaatgaaggttgtttgcacaagatggaactgagacatcttgaggatcatcaagcacattgtgagtttgctcttatggattgtccccaatgccagcgtcccttccaaaaattccatattaatattcacattctgaaggattgtccaaggagacaggtttcttgtgacaactgtgctgcatcaatggcatttgaagataaagagatccatgaccagaactgtcctttggcaaatgtcatctgtgaatactgcaatactatactcatcagagaacagatgcctaatcattatgatctagactgccctacagccccaattccatgcacattcagtacttttggttgccatgaaaagatgcagaggaatcacttggcacgccacctacaagagaacacccagtcacacatgagaatgttggcccaggctgttcatagtttgagcgttatacccgactctgggtatatctcagaggtccggaatttccaggaaactattcaccagttagagggtcgccttgtaagacaagaccatcaaatccgggagctgactgctaaaatggaaactcagagtatgtatgtaagtgagctcaaacgaaccattcgaacccttgaggacaaagttgctgaaatcgaagcacagcagtgcaatggaatttatatttggaagattggcaactttggaatgcatttgaaatgtcaagaagaggagaaacctgttgtgattcatagccctggattctacactggcaaacccgggtacaaactgtgcatgcgcttgcaccttcagttaccgactgctcagcgctgtgcaaactatatatccctttttgtccacacaatgcaaggagaatatgacagccacctcccttggcccttccagggtacaatacgccttacaattcttgatcagtctgaagcacctgtaaggcaaaaccacgaagagataatggatgccaaaccagagctgcttgctttccagcgacccacaatcccacggaacccaaaaggttttggctatgtaacttttatgcatctggaagccctaagacaaagaactttcattaaggatgacacattattagtgcgctgtgaggtctccacccgctttgacatgggtagccttcggagggagggttttcagccacgaagtactgatgcaggggtatagcttgccctcacttgctcaaaaacaactacctggagaaaacagtgcctttccttgccctgttctcaataacatgcaaacaaacaagccacgggaaatatgtaatatctactagtgagtgttgttagagaggtcacttactatttcttcctgttacaaatgatctgaggcagttttttcctgggaatccacacgttccatgctttttcagaaatgttaggcctgaagtgcctgtggcatgttgcagcagctattttgccagttagtatacctctttgttgtactttcttgggcttttgctctggtgtattttattgtcagaaagtccagactcaagagtactaaacttttaataataatggattttccttaaaacttcagtctttttgtagtattatatgtaatatattaaaagtgaaaatcactaccgccttgtgctagtgccctcgagaagagttattgctctagaaagttgagttctcatttttttaacctgttatagatttcagaggatttgaaccataatccttggaaaacttaagttctcattcaccccagtttttcctccaggttgttactaaggatattcagggatgagtttaaaccctaaatataaccttaattatttagtgtaaacatgtctgttgaataatacttgtttaagtgtt

SEQ ID NO: 889 - DNA, 4627 bp, Homo sapiens
agcagagaaggcggaagcagtggcgtccgcagctggggcttggcctgcgggcggccagcgaaggtggcgaaggctcccactggatccagagtttgccgtccaagcagcctcgtctcggcgcgcagtgtctgtgtccgtcctctaccagcgccttggctgagcggagtcgtgcggttggtgggggagccctgccctcctggttcggcctccccgcgcactagaacgagcaagtgataatcaagttactatgagtctgctaaactgtgaaaacagctgtggatccagccagtctgaaagtgactgctgtgtggccatggccagctcctgtagcgctgtaacaaaagatgatagtgtgggtggaactgccagcacggggaacctctccagctcatttatggaggagatccagggatatgatgtagagtttgacccacccctggaaagcaagtatgaatgccccatctgcttgatggcattacgagaagcagtgcaaacgccatgcggccataggttctgcaaagcctgcatcataaaatcaataagggatgcaggtcacaaatgtccagttgacaatgaaatactgctggaaaatcaactatttccagacaattttgcaaaacgtgagattctttctctgatggtgaaatgtccaaatgaaggttgtttgcacaagatggaactgagacatcttgaggatcatcaagcacattgtgagtttgctcttatggattgtccccaatgccagcgtcccttccaaaaattccatattaatattcacattctgaaggattgtccaaggagacaggtttcttgtgacaactgtgctgcatcaatggcatttgaagataaagagatccatgaccagaactgtcctttggcaaatgtcatctgtgaatactgcaatactatactcatcagagaacagatgcctaatcattatgatctagactgccctacagccccaattccatgcacattcagtacttttggttgccatgaaaagatgcagaggaatcacttggcacgccacctacaagagaacacccagtcacacatgagaatgttggcccaggctgttcatagtttgagcgttatacccgactctgggtatatctcagaggtccggaatttccaggaaactattcaccagttagagggtcgccttgtaagacaagaccatcaaatccgggagctgactgctaaaatggaaactcagagtatgtatgtaagtgagctcaaacgaaccattcgaacccttgaggacaaagttgctgaaatcgaagcacagcagtgcaatggaatttatatttggaagattggcaactttggaatgcatttgaaatgtcaagaagaggagaaacctgttgtgattcatagccctggattctacactggcaaacccgggtacaaactgtgcatgcgcttgcaccttcagttaccgactgctcagcgctgtgcaaactatatatccctttttgtccacacaatgcaaggagaatatgacagccacctcccttggcccttccagggtacaatacgccttacaattcttgatcagtctgaagcacctgtaaggcaaaaccacgaagagataatggatgccaaaccagagctgcttgctttccagcgacccacaatcccacggaacccaaaaggttttggctatgtaacttttatgcatctggaagccctaagacaaagaactttcattaaggatgacacattattagtgcgctgtgaggtctccacccgctttgacatgggtagccttcggagggagggttttcagccacgaagtactgatgcaggggtatagcttgccctcacttgctcaaaaacaactacctggagaaaacagtgcctttccttgccctgttctcaataacatgcaaacaaacaagccacgggaaatatgtaatatctactagtgagtgttgttagagaggtcacttactatttcttcctgttacaaatgatctgaggcagttttttcctgggaatccacacgttccatgctttttcagaaatgttaggcctgaagtgcctgtggcatgttgcagcagctattttgccagttagtatacctctttgttgtactttcttgggcttttgctctggtgtattttattgtcagaaagtccagactcaagagtactaaacttttaataataatggattttccttaaaacttcagtctttttgtagtattatatgtaatatattaaaagtgaaaatcactaccgccttgtgctagtgccctcgagaagagttattgctctagaaagttgagttctcatttttttaacctgttatagatttcagaggatttgaaccataatccttggaaaacttaagttctcattcaccccagtttttcctccaggttgttactaaggatattcagggatgagtttaaaccctaaatataaccttaattatttagtgtaaacatgtctgttgaataatacttgtttaagtgttccttctgccttgcttacttatttccttgaggttacgaagtagcatcttccccagagtttataatgctgagaaccacgtggataccaactgctcattgttatgctatgtaaccctttttgtctattcagtgcagagtgaatttcacagctctgcatatgtcttcatttgtttaatgcttacaagacaggagatgcacacatacaatcagcaacataaaaattaaaagtgacccaagtagtcagcgcatgtggcatctcattggtggtgacagaagctatgtgagccagaagttttcagctcttttgaataccctctggtttatttcgattaaaaagaacaaaattgatttcctaaaatcagaattttttaaaacttgggagatgattggagatacctaggaggtcaccaaactaggattagaagtcacagtggttgtatcacaacttagcttgagtatgttgctgtagcctaacaactgcaggttctgagaaggatcctgtagaatcctggaagtaaccagattttcctaatagggagatgatttttttgtgtgccatcatgtatttgttaaaggcctatatatagatataaaatatcgtggaatctagttctcagggagacccgcaactagtataagcttataaaggatctaaagatccatccaccatttaaagttgtctggtaatgagagatgacattgtatcccccagagaggccaaatcagagtcgccagccagcgttctagatcagccttaatttcaagagaaagccaaggacctcatctgcaggggagtgtggttttcagccccagcgagtgtcactttgaactttccctttgcttttttctctcttctccctccccacccacccttaggctcctgatctggtgagtttgttatggagtgaaaataaaagtcaagcagagaccttgtttcccgtgccaccattagtaccacaagctcatggctagttaccacattacttcctggcagtttgtgtccctcagctgtgccttccaaccagcgcctgagaatcactgcataccaccctctaggtagggaaacctacactgctgctgttcctgtgattattttacaatgaataaataattgtcaagttccatttaaaaactgaacagtagtatttttgtatttgcgtagaaaaagcctgaaggaaatatactaaactttttgttggcttattttcctttgcgcttgcttatattttttacattttctacaataaatgtgtacttttatcggagaaaaaaattaaatgttgccacaaaacatttaatctccacgcccccagctcaaaaaaggaaatgatatttaaaagcttcctggtcagatttctattaaaagcactggctgtgcattagatacaaagaggagtcatttcctgccttggtgatactatttttttctactaactcaagagtctttattaaaaaaaaaagttgttttgcctaatttcagcttttagcaagcttcccatctgtaaaatgatttggaccagatatttctagagtcccctccagccataacattctgtctcaaattaagttccaaccagcagaacaatgacaatacttaggaaagtattttgccagtataaaatgtctttaacttactctttgctgacactgatactttcctctaatttagtgtctatcagctgggtcacatcttaagtaaaatgagcaattttaacccccaacatttggcattttgtcataaaccagccagttattttatgctggtcattcatcttgactacaaagtagaatagtcaagctgtcattccaaatagaaaactttttacttcaatcagaattaagccttaacctggaaagttggtttcttccttacattttcccaatctcctactctattcttaaacatgctagtttcactcagttgggtatacaagcctttgggctttatgttgtatgttactaaccaccttttaccatatttatcttttggcatcattctgggacattgctaaattaaaaaagaaattgtttccacttttttctggagatgttcaactaaaggttgttttgttttgttttttgttttgagacagtctcaccctgacgctcaggctggagtgcagtggtgcaacctcggctcactgcaac

SEQ ID NO: 890 - DNA, 2701 bp, Homo sapiens
gccctttcctggcggctgggtctttaacaccgcccagcgcacatgtcgggggaggcctggcagctgcagctgggagcgcacagacggctgccccgcctgagcgaggcgggcgccgccgcgatgctgcgaggcggacggcgcgggcagcttggctggcacagctgggctgcggggccgggcagcctgctggcttggctgatactggcatctgcgggcgccgcaccctgccccgatgcctgctgcccccacggctcctcgggactgcgatgcacccgggatggggccctggatagcctccaccacctgcccggcgcagagaacctgactgagctctacatcgagaaccagcagcatctgcagcatctggagctccgtgatctgaggggcctgggggagctgagaaacctcaccatcgtgaagagtggtctccgtttcgtggcgccagatgccttccatttcactcctcggctcagtcgcctgaatctctccttcaacgctctggagtctctctcctggaaaactgtgcagggcctctccttacaggaactggtcctgtcggggaaccctctgcactgttcttgtgccctgcgctggctacagcgctgggaggaggagggactgggcggagtgcctgaacagaagctgcagtgtcatgggcaagggcccctggcccacatgcccaatgccagctgtggtgtgcccacgctgaaggtccaggtgcccaatgcctcggtggatgtgggggacgacgtgctgctgcggtgccaggtggaggggcggggcctggagcaggccggctggatcctcacagagctggagcagtcagccacggtgatgaaatctgggggtctgccatccctggggctgaccctggccaatgtcaccagtgacctcaacaggaagaacgtgacgtgctgggcagagaacgatgtgggccgggcagaggtctctgttcaggtcaacgtctccttcccggccagtgtgcagctgcacacggcggtggagatgcaccactggtgcatccccttctctgtggatgggcagccggcaccgtctctgcgctggctcttcaatggctccgtgctcaatgagaccagcttcatcttcactgagttcctggagccggcagccaatgagaccgtgcggcacgggtgtctgcgcctcaaccagcccacccacgtcaacaacggcaactacacgctgctggctgccaaccccttcggccaggcctccgcctccatcatggctgccttcatggacaaccctttcgagttcaaccccgaggaccccatccctgacactaacagcacatctggagacccggtggagaagaaggacgaaacaccttttggggtctcggtggctgtgggcctggccgtctttgcctgcctcttcctttctacgctgctccttgtgctcaacaaatgtggacggagaaacaagtttgggatcaaccgcccggctgtgctggctccagaggatgggctggccatgtccctgcatttcatgacattgggtggcagctccctgtcccccaccgagggcaaaggctctgggctccaaggccacatcatcgagaacccacaatacttcagtgatgcctgtgttcaccacatcaagcgccgggacatcgtgctcaagtgggagctgggggagggcgcctttgggaaggtcttccttgctgagtgccacaacctcctgcctgagcaggacaagatgctggtggctgtcaaggcactgaaggaggcgtccgagagtgctcggcaggacttccagcgtgaggctgagctgctcaccatgctgcagcaccagcacatcgtgcgcttcttcggcgtctgcaccgagggccgccccctgctcatggtctttgagtatatgcggcacggggacctcaaccgcttcctccgatcccatggacctgatgccaagctgctggctggtggggaggatgtggctccaggccccctgggtctggggcagctgctggccgtggctagccaggtcgctgcggggatggtgtacctggcgggtctgcattttgtgcaccgggacctggccacacgcaactgtctagtgggccagggactggtggtcaagattggtgattttggcatgagcagggatatctacagcaccgactattaccgtgtgggaggccgcaccatgctgcccattcgctggatgccgcccgagagcatcctgtaccgtaagttcaccaccgagagcgacgtgtggagcttcggcgtggtgctctgggagatcttcacctacggcaagcagccctggtaccagctctccaacacggaggcaatcgactgcatcacgcagggacgtgagttggagcggccacgtgcctgcccaccagaggtctacgccatcatgcggggctgctggcagcgggagccccagcaacgccacagcatcaaggatgtgcacgcccggctgcaagccctggcccaggcacctcctgtctacctggatgtcctgggctagggggccggcccaggggctgggagtggttagccggaatactggggcctgccctcagcatcccccatagctcccagcagccccagggtgatctcaaagtatctaattcaccctcagcatgtgggaagggacaggtgggggctgggagtagaggatgttcctgcttctctaggcaaggtcccgtcatagcaattatatttattatcccttg

SEQ ID NO: 891 - DNA, 2609 bp, Homo sapiens
caggagagaaggactgagacgggaatgtggaatgcactgggcaaatggtcactgacacagagtgcagatgcctgcttctgggactcaatgcactgcaccctggtcatctgcggactcagcctgagcttccagagggcctaggagcagtaagggagtgagtgggcaactcggcgcatgaaggaggccgccctcatctgcctggcaccctctgtacccccgatcttgacggtgaagtcctgggacaccatgcagttgcgggctgctagatctcggtgcacaaacttgttggcagcaagctacatcgagaaccagcagcatctgcagcatctggagctccgtgatctgaggggcctgggggagctgagaaacctcaccatcgtgaagagtggtctccgtttcgtggcgccagatgccttccatttcactcctcggctcagtcgcctgaatctctccttcaacgctctggagtctctctcctggaaaactgtgcagggcctctccttacaggaactggtcctgtcggggaaccctctgcactgttcttgtgccctgcgctggctacagcgctgggaggaggagggactgggcggagtgcctgaacagaagctgcagtgtcatgggcaagggcccctggcccacatgcccaatgccagctgtggtgtgcccacgctgaaggtccaggtgcccaatgcctcggtggatgtgggggacgacgtgctgctgcggtgccaggtggaggggcggggcctggagcaggccggctggatcctcacagagctggagcagtcagccacggtgatgaaatctgggggtctgccatccctggggctgaccctggccaatgtcaccagtgacctcaacaggaagaacgtgacgtgctgggcagagaacgatgtgggccgggcagaggtctctgttcaggtcaacgtctccttcccggccagtgtgcagctgcacacggcggtggagatgcaccactggtgcatccccttctctgtggatgggcagccggcaccgtctctgcgctggctcttcaatggctccgtgctcaatgagaccagcttcatcttcactgagttcctggagccggcagccaatgagaccgtgcggcacgggtgtctgcgcctcaaccagcccacccacgtcaacaacggcaactacacgctgctggctgccaaccccttcggccaggcctccgcctccatcatggctgccttcatggacaaccctttcgagttcaaccccgaggaccccatccctgacactaacagcacatctggagacccggtggagaagaaggacgaaacaccttttggggtctcggtggctgtgggcctggccgtctttgcctgcctcttcctttctacgctgctccttgtgctcaacaaatgtggacggagaaacaagtttgggatcaaccgcccggctgtgctggctccagaggatgggctggccatgtccctgcatttcatgacattgggtggcagctccctgtcccccaccgagggcaaaggctctgggctccaaggccacatcatcgagaacccacaatacttcagtgatgcctgtgttcaccacatcaagcgccgggacatcgtgctcaagtgggagctgggggagggcgcctttgggaaggtcttccttgctgagtgccacaacctcctgcctgagcaggacaagatgctggtggctgtcaaggcactgaaggaggcgtccgagagtgctcggcaggacttccagcgtgaggctgagctgctcaccatgctgcagcaccagcacatcgtgcgcttcttcggcgtctgcaccgagggccgccccctgctcatggtctttgagtatatgcggcacggggacctcaaccgcttcctccgatcccatggacctgatgccaagctgctggctggtggggaggatgtggctccaggccccctgggtctggggcagctgctggccgtggctagccaggtcgctgcggggatggtgtacctggcgggtctgcattttgtgcaccgggacctggccacacgcaactgtctagtgggccagggactggtggtcaagattggtgattttggcatgagcagggatatctacagcaccgactattaccgtgtgggaggccgcaccatgctgcccattcgctggatgccgcccgagagcatcctgtaccgtaagttcaccaccgagagcgacgtgtggagcttcggcgtggtgctctgggagatcttcacctacggcaagcagccctggtaccagctctccaacacggaggcaatcgactgcatcacgcagggacgtgagttggagcggccacgtgcctgcccaccagaggtctacgccatcatgcggggctgctggcagcgggagccccagcaacgccacagcatcaaggatgtgcacgcccggctgcaagccctggcccaggcacctcctgtctacctggatgtcctgggctagggggccggcccaggggctgggagtggttagccggaatactggggcctgccctcagcatcccccatagctcccagcagccccagggtgatctcaaagtatctaattcaccctcagcatgtgggaagggacaggtgggggctgggagtagagga

SEQ ID NO: 892 - DNA, 2432 bp, Homo sapiens
acagacggctgccccgcctgagcgaggcgggcgccgccgcgatgctgcgaggcggacggcgcgggcagcttggctggcacagctgggctgcggggccgggcagcctgctggcttggctgatactggcatctgcgggcgccgcaccctgccccgatgcctgctgcccccacggctcctcgggactgcgatgcacccgggatggggccctggatagcctccaccacctgcccggcgcagagaacctgactgagctctacatcgagaaccagcagcatctgcagcatctggagctccgtgatctgaggggcctgggggagctgagaaacctcaccatcgtgaagagtggtctccgtttcgtggcgccagatgccttccatttcactcctcggctcagtcgcctgaatctctccttcaacgctctggagtctctctcctggaaaactgtgcagggcctctccttacaggaactggtcctgtcggggaaccctctgcactgttcttgtgccctgcgctggctacagcgctgggaggaggagggactgggcggagtgcctgaacagaagctgcagtgtcatgggcaagggcccctggcccacatgcccaatgccagctgtggtgtgcccacgctgaaggtccaggtgcccaatgcctcggtggatgtgggggacgacgtgctgctgcggtgccaggtggaggggcggggcctggagcaggccggctggatcctcacagagctggagcagtcagccacggtgatgaaatctgggggtctgccatccctggggctgaccctggccaatgtcaccagtgacctcaacaggaagaacgtgacgtgctgggcagagaacgatgtgggccgggcagaggtctctgttcaggtcaacgtctccttcccggccagtgtgcagctgcacacggcggtggagatgcaccactggtgcatccccttctctgtggatgggcagccggcaccgtctctgcgctggctcttcaatggctccgtgctcaatgagaccagcttcatcttcactgagttcctggagccggcagccaatgagaccgtgcggcacgggtgtctgcgcctcaaccagcccacccacgtcaacaacggcaactacacgctgctggctgccaaccccttcggccaggcctccgcctccatcatggctgccttcatggacaaccctttcgagttcaaccccgaggaccccatccctgtctccttctcgccggtggacactaacagcacatctggagacccggtggagaagaaggacgaaacaccttttggggtctcggtggctgtgggcctggccgtctttgcctgcctcttcctttctacgctgctccttgtgctcaacaaatgtggacggagaaacaagtttgggatcaaccgcccggctgtgctggctccagaggatgggctggccatgtccctgcatttcatgacattgggtggcagctccctgtcccccaccgagggcaaaggctctgggctccaaggccacatcatcgagaacccacaatacttcagtgatgcctgtgttcaccacatcaagcgccgggacatcgtgctcaagtgggagctgggggagggcgcctttgggaaggtcttccttgctgagtgccacaacctcctgcctgagcaggacaagatgctggtggctgtcaaggcactgaaggaggcgtccgagagtgctcggcaggacttccagcgtgaggctgagctgctcaccatgctgcagcaccagcacatcgtgcgcttcttcggcgtctgcaccgagggccgccccctgctcatggtctttgagtatatgcggcacggggacctcaaccgcttcctccgatcccatggacctgatgccaagctgctggctggtggggaggatgtggctccaggccccctgggtctggggcagctgctggccgtggctagccaggtcgctgcggggatggtgtacctggcgggtctgcattttgtgcaccgggacctggccacacgcaactgtctagtgggccagggactggtggtcaagattggtgattttggcatgagcagggatatctacagcaccgactattaccgtgtgggaggccgcaccatgctgcccattcgctggatgccgcccgagagcatcctgtaccgtaagttcaccaccgagagcgacgtgtggagcttcggcgtggtgctctgggagatcttcacctacggcaagcagccctggtaccagctctccaacacggaggcaatcgactgcatcacgcagggacgtgagttggagcggccacgtgcctgcccaccagaggtctacgccatcatgcggggctgctggcagcgggagccccagcaacgccacagcatcaaggatgtgcacgcccggctgcaagccctggcccaggcacctcctgtctacctggatgtcctgggctag

SEQ ID NO: 893 - DNA, 1553 bp, Homo sapiens
cctcgccctggtggtgcacgcccgggctgggcgctcagaggtcgggtgggcgcccactccgttcgctgcgcgcacagcgcccggcgagaggctcggagtttgatcacacacagcgtccggcttcctgtccccagcgccccctcccgccccgtttcccttgcccctccctctccccggcccgatccgcccgccggctccccctcccccgatccctcgggtcccgggatgggggggcggtgaggcaggcacagccccccgcccccatggccgcccgtcggagccagaggcggagggggcgccggggggagccgggcaccgccctgctggtcccgctcgcgctgggcctgggcctggcgctggcctgcctcggcctcctgctggccgtggtcagtttggggagccgggcatcgctgtccgcccaggagcctgcccaggaggagctggtggcagaggaggaccaggacccgtcggaactgaatccccagacagaagaaagccaggatcctgcgcctttcctgaaccgactagttcggcctcgcagaagtgcacctaaaggccggaaaacacgggctcgaagagcgatcgcagcccattatgaagttcatccacgacctggacaggacggagcgcaggcaggtgtggacgggacagtgagtggctgggaggaagccagaatcaacagctccagccctctgcgctacaaccgccagatcggggagtttatagtcacccgggctgggctctactacctgtactgtcaggtgcactttgatgaggggaaggctgtctacctgaagctggacttgctggtggatggtgtgctggccctgcgctgcctggaggaattctcagccactgcggcgagttccctcgggccccagctccgcctctgccaggtgtctggtctgttggccctgcggccagggtcctccctgcggatccgcaccctcccctgggcccatctcaaggctgcccccttcctcacctacttcggactcttccaggttcactgaggggccctggtctccccgcagtcgtcccaggctgccggctcccctcgacagctctctgggcacccggtcccctctgccccaccctcagccgctctttgctccagacctgcccctccctctagaggctgcctgggcctgttcacgtgttttccatcccacataaatacagtattcccactcttatcttacaactcccccaccgcccactctccacctcactagctccccaatccctgaccctttgaggcccccagtgatctcgactcccccctggccacagacccccagggcattgtgttcactgtactctgtgggcaaggatgggtccagaagaccccacttcaggcactaagaggggctggacctggcggcaggaagccaaagagactgggcctaggccaggagttcccaaatgtgaggggcgagaaacaagacaagctcctcccttgagaattccctgtggatttttaaaacagatattatttttattattattgtgacaaaatgttgataaatggatattaaatagaataagtcata

SEQ ID NO: 894 - DNA, 1768 bp, Homo sapiens
atggccgcccgtcggagccagaggcggagggggcgccggggggagccgggcaccgccctgctggtcccgctcgcgctgggcctgggcctggcgctggcctgcctcggcctcctgctggccgtggtcagtttggggagccgggcatcgctgtccgcccaggagcctgcccaggaggagctggtggcagaggaggaccaggacccgtcggaactgaatccccagacagaagaaagccaggatcctgcgcctttcctgaaccgactagttcggcctcgcagaagtgcacctaaaggccggaaaacacgggctcgaagagcgatcgcagcccattatgaagttcatccacgacctggacaggacggagcgcaggcaggtgtggacgggacagtgagtggctgggaggaagccagaatcaacagctccagccctctgcgctacaaccgccagatcggggagtttatagtcacccgggctgggctctactacctgtactgtcagagttccgatgccctggaagcctgggagaatggggagagatcccggaaaaggagagcagtgctcacccaaaaacagaagaagcagcactctgtcctgcacctggttcccattaacgccacctccaaggatgactccgatgtgacagaggtgatgtggcaaccagctcttaggcgtgggagaggcctacaggcccaaggatatggtgtccgaatccaggatgctggagtttatctgctgtatagccaggtcctgtttcaagacgtgactttcaccatgggtcaggtggtgtctcgagaaggccaaggaaggcaggagactctattccgatgtataagaagtatgccctcccacccggaccgggcctacaacagctgctatagcgcaggtgtcttccatttacaccaaggggatattctgagtgtcataattccccgggcaagggcgaaacttaacctctctccacatggaaccttcctggggtttgtgaaactgtgattgtgttataaaaagtggctcccagcttggaagaccagggtgggtacatactggagacagccaagagctgagtatataaaggagagggaatgtgcaggaacagaggcgtcttcctgggtttggctccccgttcctcacttttcccttttcattcccaccccctagactttgattttacggatatcttgcttctgttccccatggagctccgaattcttgcgtgtgtgtagatgaggggcgggggacgggcgccaggcattgtccagacctggtcggggcccactggaagcatccagaacagcaccaccatctagcggccgctcgagggaagcacccgccggttggccgaagtccacgaagccgccctctgctagggaaaacccctggttctccatgccacacctctctccaggtgccctctgcctcttcaccccacaagaagccttatcctacgtccttctctccatctatcggaccccagtttccatcactatctccagagatgtagctattatgcgcccgtctacagggggtgcccgacgatgacggtgccttcgcagtcaaattactcttcgggtcccaaggtttggctttcacgcgctccattgccccggcgtggcaggccattccaagcccttccgggctggaactggtgtcggaggagcctcgggtgtatcgtacgccctggtgttggtgttgcctcactcctctgagctcttctttctgatcaagccctgcttaaagttaaataaaatagaatgaatgataccccggc

SEQ ID NO: 895 - DNA, 1953 bp, Homo sapiens
attagcgcagggacctccgggccacagctcagagaatcggaaggcctcctcccccttcccgagcgctgccactggggccgaggtttccagcaagaacccgcgtgtccctgcgcacgcacacacggtgcacacgtcagtccggcgcctccccgtgccccgactcacgcaggtcctcccgcgcgcccgcaacacgcccgcaggctcctgtgtctgctgccggggcagcggggcccggaaggcagaagatggctgtgccacccacgtatgccgatcttggcaaatctgccagggatgtcttcaccaagggctatggatttggcttaataaagcttgatttgaaaacaaaatctgagaatggattggaatttacaagctcaggctcagccaacactgagaccaccaaagtgacgggcagtctggaaaccaagtacagatggactgagtacggcctgacgtttacagagaaatggaataccgacaatacactaggcaccgagattactgtggaagatcagcttgcacgtggactgaagctgaccttcgattcatccttctcacctaacactgggaaaaaaaatgctaaaatcaagacagggtacaagcgggagcacattaacctgggctgcgacatggatttcgacattgctgggccttccatccggggtgctctggtgctaggttacgagggctggctggccggctaccagatgaattttgagactgcaaaatcccgagtgacccagagcaactttgcagttggctacaagactgatgaattccagcttcacactaatgtgaatgacgggacagagtttggcggctccatttaccagaaagtgaacaagaagttggagaccgctgtcaatcttgcctggacagcaggaaacagtaacacgcgcttcggaatagcagccaagtatcagattgaccctgacgcctgcttctcggctaaagtgaacaactccagcctgataggtttaggatacactcagactctaaagccaggtattaaactgacactgtcagctcttctggatggcaagaacgtcaatgctggtggccacaagcttggtctaggactggaatttcaagcataaatgaatactgtacaattgtttaattttaaactattttgcagcatagctaccttcagaatttagtgtatcttttaatgttgtatgtctgggatgcaagtattgctaaatatgttagccctccaggttaaagttgattcagctttaagatgttacccttccagaggtacagaagaaacctatttccaaaaaaggtcctttcagtggtagactcggggagaacttggtggcccctttgagatgccaggtttcttttttatctagaaatggctgcaagtggaagcggataatatgtaggcactttgtaaattcatattgagtaaatgaatgaaattgtgatttcctgagaatcgaaccttggttccctaaccctaattgatgagaggctcgctgcttgatggtgtgtacaaactcacctgaatgggacttttttagacagatcttcatgacctgttcccaccccagttcatcatcatctcttttacaccaaaaggtctgcagggtgtggtaactgtttcttttgtgccattttggggtggagaaggtggatgtgatgaagccaataattcaggacttattccttcttgtgttgtgtttttttttggcccttgcaccagagtatgaaatagcttccaggagctccagctataagcttggaagtgtctgtgtgattgtaatcacatggtgacaacactcagaatctaaattggacttctgttgtattctcaccactcaatttgttttttagcagtttaatgggtacattttagagtcttccattttgttggaattagatcctccccttcaaatgctgtaattaacaacacttaaaaaacttgaataaaatattgaaacctca

SEQ ID NO: 896 - DNA, 1807 bp, Homo sapiens
gccgctcgctcggctccgctccctggctcggctccctgcctccgcgtcgcagcccccgccgtagccgcctccgagcccgccgccacatcctctgagaagatggctgtgccacccacgtatgccgatcttggcaaatctgccagggatgtcttcaccaagggctatggatttggcttaataaagcttgatttgaaaacaaaatctgagaatggattggaatttacaagctcaggctcagccaacactgagaccaccaaagtgacgggcagtctggaaaccaagtacagatggactgagtacggcctgacgtttacagagaaatggaataccgacaatacactaggcaccgagattactgtggaagatcagcttgcacgtggactgaagctgaccttcgattcatccttctcacctaacactgggaaaaaaaatgctaaaatcaagacagggtacaagcgggagcacattaacctgggctgcgacatggatttcgacattgctgggccttccatccggggtgctctggtgctaggttacgagggctggctggccggctaccagatgaattttgagactgcaaaatcccgagtgacccagagcaactttgcagttggctacaagactgatgaattccagcttcacactaatgtgaatgacgggacagagtttggcggctccatttaccagaaagtgaacaagaagttggagaccgctgtcaatcttgcctggacagcaggaaacagtaacacgcgcttcggaatagcagccaagtatcagattgaccctgacgcctgcttctcggctaaagtgaacaactccagcctgataggtttaggatacactcagactctaaagccaggtattaaactgacactgtcagctcttctggatggcaagaacgtcaatgctggtggccacaagcttggtctaggactggaatttcaagcataaatgaatactgtacaattgtttaattttaaactattttgcagcatagctaccttcagaatttagtgtatcttttaatgttgtatgtctgggatgcaagtattgctaaatatgttagccctccaggttaaagttgattcagctttaagatgttacccttccagaggtacagaagaaacctatttccaaaaaaggtcctttcagtggtagactcggggagaacttggtggcccctttgagatgccaggtttcttttttatctagaaatggctgcaagtggaagcggataatatgtaggcactttgtaaattcatattgagtaaatgaatgaaattgtgatttcctgagaatcgaaccttggttccctaaccctaattgatgagaggctcgctgcttgatggtgtgtacaaactcacctgaatgggacttttttagacagatcttcatgacctgttcccaccccagttcatcatcatctcttttacaccaaaaggtctgcagggtgtggtaactgtttcttttgtgccattttggggtggagaaggtggatgtgatgaagccaataattcaggacttattccttcttgtgttgtgtttttttttggcccttgcaccagagtatgaaatagcttccaggagctccagctataagcttggaagtgtctgtgtgattgtaatcacatggtgacaacactcagaatctaaattggacttctgttgtattctcaccactcaatttgttttttagcagtttaatgggtacattttagagtcttccattttgttggaattagatcctccccttcaaatgctgtaattaacaacacttaaaaaacttgaataaaatattgaaacctca

SEQ ID NO: 897 - DNA, 1873 bp, Homo sapiens
gtcccgggcggggcctgggggcggagcgcgccgggccgggcgcgcaggaggggaggcgggtccgcgccgccgccgtccgcgccgccccgcccttggcccagccgctcgctcggctccgctccctggctcggctccctgcctccgcgtcgcagcccccgccgtagccgcctccgagcccgccgccacatcctctgagcagaagatggctgtgccacccacgtatgccgatcttggcaaatctgccagggatgtcttcaccaagggctatggatttggcttaataaagcttgatttgaaaacaaaatctgagaatggattggaatttacaagctcaggctcagccaacactgagaccaccaaagtgacgggcagtctggaaaccaagtacagatggactgagtacggcctgacgtttacagagaaatggaataccgacaatacactaggcaccgagattactgtggaagatcagcttgcacgtggactgaagctgaccttcgattcatccttctcacctaacactgggaaaaaaaatgctaaaatcaagacagggtacaagcgggagcacattaacctgggctgcgacatggatttcgacattgctgggccttccatccggggtgctctggtgctaggttacgagggctggctggccggctaccagatgaattttgagactgcaaaatcccgagtgacccagagcaactttgcagttggctacaagactgatgaattccagcttcacactaatgtgaatgacgggacagagtttggcggctccatttaccagaaagtgaacaagaagttggagaccgctgtcaatcttgcctggacagcaggaaacagtaacacgcgcttcggaatagcagccaagtatcagattgaccctgacgcctgcttctcggctaaagtgaacaactccagcctgataggtttaggatacactcagactctaaagccaggtattaaactgacactgtcagctcttctggatggcaagaacgtcaatgctggtggccacaagcttggtctaggactggaatttcaagcataaatgaatactgtacaattgtttaattttaaactattttgcagcatagctaccttcagaatttagtgtatcttttaatgttgtatgtctgggatgcaagtattgctaaatatgttagccctccaggttaaagttgattcagctttaagatgttacccttccagaggtacagaagaaacctatttccaaaaaaggtcctttcagtggtagactcggggagaacttggtggcccctttgagatgccaggtttcttttttatctagaaatggctgcaagtggaagcggataatatgtaggcactttgtaaattcatattgagtaaatgaatgaaattgtgatttcctgagaatcgaaccttggttccctaaccctaattgatgagaggctcgctgcttgatggtgtgtacaaactcacctgaatgggacttttttagacagatcttcatgacctgttcccaccccagttcatcatcatctcttttacaccaaaaggtctgcagggtgtggtaactgtttcttttgtgccattttggggtggagaaggtggatgtgatgaagccaataattcaggacttattccttcttgtgttgtgtttttttttggcccttgcaccagagtatgaaatagcttccaggagctccagctataagcttggaagtgtctgtgtgattgtaatcacatggtgacaacactcagaatctaaattggacttctgttgtattctcaccactcaatttgttttttagcagtttaatgggtacattttagagtcttccattttgttggaattagatcctccccttcaaatgctgtaattaac

SEQ ID NO: 898 - DNA, 931 bp, Homo sapiens
ggcagtcccaaaaagcctctcaggcacacaacccagcacagcaaggcagtcacaccaagattcccctcttcccgcggcctcgccatggcgacccacggacagacttgcgcgcgtccaatgtgtattcctccatcatatgctgaccttggcaaagctgccagagatattttcaacaaaggatttggttttgggttggtgaaactggatgtgaaaacaaagtcttgcagtggcgtggaattttcaacgtccggttcatctaatacagacactggtaaagttactgggaccttggagaccaaatacaagtggtgtgagtatggtctgactttcacagaaaagtggaacactgataacactctgggaacagaaatcgcaattgaagaccagatttgtcaaggtttgaaactgacatttgatactaccttctcaccaaacacaggaaagaaaagtggtaaaatcaagtcttcttacaagagggagtgtataaaccttggttgtgatgttgactttgattttgctggacctgcaatccatggttcagctgtctttggttatgagggctggcttgctggctaccagatgacctttgacagtgccaaatcaaagctgacaaggaataactttgcagtgggctacaggactggggacttccagctacacactaatgtcaatgatgggacagaatttggaggatcaatttatcagaaagtttgtgaagatcttgacacttcagtaaaccttgcttggacatcaggtaccaactgcactcgttttggcattgcagctaaatatcagttggatcccactgcttccatttctgcaaaagtcaacaactctagcttaattggagtaggctatactcagactctgaggcctggtgtgaagcttacactctctgctctggtagatgggaagagcattaatgctggag

SEQ ID NO: 899 - DNA, 1467 bp, Homo sapiens
gctgctggagctgcagcccgaccgcgagcgtgccaagcggcttcagcagctagcggagcggtggcggcggcccccctcaggacaccaccagattcccctcttcccgcggcctcgccatggcgacccacggacagacttgcgcgcgtcgatcggatcaatcacttttctagaggaagtagcagtccctcttgtgagagcgcaaggtcattacttgtgctcctaagggcgtggacgtgctttgtggaatgaatgagctggtgtaatgagctcagattgcctgcccttaagcagcacagcattggccgaggacttgagagtcacattacaatgtgtattcctccatcatatgctgaccttggcaaagctgccagagatattttcaacaaaggatttggttttgggttggtgaaactggatgtgaaaacaaagtcttgcagtggcgtggaattttcaacgtccggttcatctaatacagacactggtaaagttactgggaccttggagaccaaatacaagtggtgtgagtatggtctgactttcacagaaaagtggaacactgataacactctgggaacagaaatcgcaattgaagaccagatttgtcaaggtttgaaactgacatttgatactaccttctcaccaaacacaggaaagaaaagtggtaaaatcaagtcttcttacaagagggagtgtataaaccttggttgtgatgttgactttgattttgctggacctgcaatccatggttcagctgtctttggttatgagggctggcttgctggctaccagatgacctttgacagtgccaaatcaaagctgacaaggaataactttgcagtgggctacaggactggggacttccagctacacactaatgtcaatgatgggacagaatttggaggatcaatttatcagaaagtttgtgaagatcttgacacttcagtaaaccttgcttggacatcaggtaccaactgcactcgttttggcattgcagctaaatatcagttggatcccactgcttccatttctgcaaaagtcaacaactctagcttaattggagtaggctatactcagactctgaggcctggtgtgaagcttacactctctgctctggtagatgggaagagcattaatgctggaggccacaaggttgggctcgccctggagttggaggcttaatccagctgaaagaaacctttgggaatggatatcagaagatttggccttaatatatttccattgtgaccagcagcaggcttttttcccccaagaagatgatcaaaacaaaggatgatctcaacaagagctgtattttaagtatttagacagttctttgttagctggtttctagttggttatctagttaccaatgctgcagtcctgcagtcacctatacattatttaaatgtatttaactgttaaatgcgctacccaccaataatgaaatagacctttatgaaaactgtg

SEQ ID NO: 900 - DNA, 1557 bp, Homo sapiens
ggcgcggcggacagccccgggggcagcggcggggtcctgtctgggagaggacagggttgcggcgggcggaacggtgtctccttcacttcgccctccagctgctggagctgcagcccgaccgcgagcgtgccaagcggcttcagcagctagcggagcggtggcggcggcccccctcaggacaccaccagattcccctcttcccgcggcctcgccatggcgacccacggacagacttgcgcgcgtccaatgtgtattcctccatcatatgctgaccttggcaaagctgccagagatattttcaacaaaggatttggttttgggttggtgaaactggatgtgaaaacaaagtcttgcagtggcgtggaattttcaacgtccggttcatctaatacagacactggtaaagttactgggaccttggagaccaaatacaagtggtgtgagtatggtctgactttcacagaaaagtggaacactgataacactctgggaacagaaatcgcaattgaagaccagatttgtcaaggtttgaaactgacatttgatactaccttctcaccaaacacaggaaagaaaagtggtaaaatcaagtcttcttacaagagggagtgtataaaccttggttgtgatgttgactttgattttgctggacctgcaatccatggttcagctgtctttggttatgagggctggcttgctggctaccagatgacctttgacagtgccaaatcaaagctgacaaggaataactttgcagtgggctacaggactggggacttccagctacacactaatgtcaatgatgggacagaatttggaggatcaatttatcagaaagtttgtgaagatcttgacacttcagtaaaccttgcttggacatcaggtaccaactgcactcgttttggcattgcagctaaatatcagttggatcccactgcttccatttctgcaaaagtcaacaactctagcttaattggagtaggctatactcagactctgaggcctggtgtgaagcttacactctctgctctggtagatgggaagagcattaatgctggaggccacaaggttgggctcgccctggagttggaggcttaatccagctgaaagaaacctttgggaatggatatcagaagatttggccttaatatatttccattgtgaccagcagcaggcttttttcccccaagaagatgatcaaaacaaaggatgatctcaacaagagctgtattttaagtatttagacagttctttgttagctggtttctagttggttatctagttaccaatgctgcagtcctgcagtcacctatacattatttaaatgtatttaactgttaaatgcgctacccaccaataatgaaatagacctttatgaaaactgtgcaattgtgtgcatgtttgtttttatgttcctttagaaaacattgactgttaccattgaatgagatggatcagtggatattaagatgaggttacaaattttgttaagttcagccattattacttttggtatcccagaacatgacaaattatgaataaaacaagtatacataa

SEQ ID NO: 901 - DNA, 681 bp, Homo sapiens
cccaccgacggacggaggcagcccacctgcaggaccggggcgctgtcggtccacgtggccgctctggagcagattcccctcttcccgcggcctcgccatggcgacccacggacagacttgcgcgcgtccaatgtgtattcctccatcatatgctgaccttggcaaagctgccagagatattttcaacaaaggatttggttttgggttggtgaaactggatgtgaaaacaaagtcttgcagtggcgtggaattttcaacgtccggttcatctaatacagacactggtaaagttactgggaccttggagaccaaatacaagtggtgtgagtatggtctgactttcacagaaaagtggaacactgataacactctgggaacagaaatcgcaattgaagaccagatttgtcaaggtttgaaactgacatttgatactaccttctcaccaaacacaggaaagaaaagtggtaaaatcaagtcttcttacaagagggagtgtataaaccttggttgtgatgttgactttgattttgctggacctgcaatccatggttcagctgtctttggttatgagggctggcttgctggctaccagatgacctttgacagtgccaaatcaaagctgacaaggaataactttgcagtgggctacaggactggggacttccagctacacactaatgt

SEQ ID NO: 902 - DNA, 457 bp, Homo sapiens
gttaattggggattctgcctttggaggatcggatcaatcacttttctagaggaagtagcagtccctcttgtgagagcgcaaggtcattacttgtgctcctaagggcgtggacgtgctttgtggaatgaatgagctggtgtaatgagctcagattgcctgcccttaagcagcacagcattggccgaggacttgagagtcacattacaatgtgtattcctccatcatatgctgaccttggcaaagctgccagagatattttcaacaaaggatttggttttgggttggtgaaactggatgtgaaaacaaagtcttgcagtggcgtggaattttcaacgtccggttcatctaatacagacactggtaaagttactgggaccttggagaccaaatacaagtggtgtgagtatggtctgactttcacagaaaagtggaacactgataacactctgggaacaga

SEQ ID NO: 903 - DNA, 738 bp, Homo sapiens
aagatggccgcgctgccccgcggcccctcgcccctctctgcccgggatctccctttggccctttgaccccagcttaccgcacttcttgtccctcccgcagattcccctcttcccgcggcctcgccatggcgacccacggacagacttgcgcgcgtccaatgtgtattcctccatcatatgctgaccttggcaaagctgccagagatattttcaacaaaggatttggttttgggttggtgaaactggatgtgaaaacaaagtcttgcagtggcgtggaattttcaacgtccggttcatctaatacagacactggtaaagttactgggaccttggagaccaaatacaagtggtgtgagtatggtctgactttcacagaaaagtggaacactgataacactctgggaacagaaatcgcaattgaagaccagatttgtcaaggtttgaaactgacatttgatactaccttctcaccaaacacaggaaagaaaagtggtaaaatcaagtcttcttacaagagggagtgtataaaccttggttgtgatgttgactttgattttgctggacctgcaatccatggttcagctgtctttggttatgagggctggcttgctggctaccagatgacctttgacagtgccaaatcaaagctgacaaggaataactttgcagtgggctacaggactggggacttccagctacacactaatgtcaatgatgggacagaatttggaggatcaa

SEQ ID NO: 904 - DNA, 1581 bp, Homo sapiens
tccttcacttcgccctccagctgctggagctgcagcccgaccgcgagcgtgccaagcggcttcagcagctagcggagcggtggcggcggcccccctcaggacaccaccagattcccctcttcccgcggcctcgccatggcgacccacggacagacttgcgcgcgtccaatgtgtattcctccatcatatgctgaccttggcaaagctgccagagatattttcaacaaaggatttggttttgggttggtgaaactggatgtgaaaacaaagtcttgcagtggcgtgatatcacaatttctggctgtagtctctttattattttcacatcagctgtcttccttaggcttggcgtggtgatgcttgtgatcccagctactcaggaggctgaggaattttcaacgtccggttcatctaatacagacactggtaaagttactgggaccttggagaccaaatacaagtggtgtgagtatggtctgactttcacagaaaagtggaacactgataacactctgggaacagaaatcgcaattgaagaccagatttgtcaaggtttgaaactgacatttgatactaccttctcaccaaacacaggaaagaaaagtggtaaaatcaagtcttcttacaagagggagtgtataaaccttggttgtgatgttgactttgattttgctggacctgcaatccatggttcagctgtctttggttatgagggctggcttgctggctaccagatgacctttgacagtgccaaatcaaagctgacaaggaataactttgcagtgggctacaggactggggacttccagctacacactaatgtcaatgatgggacagaatttggaggatcaatttatcagaaagtttgtgaagatcttgacacttcagtaaaccttgcttggacatcaggtaccaactgcactcgttttggcattgcagctaaatatcagttggatcccactgcttccatttctgcaaaagtcaacaactctagcttaattggagtaggctatactcagactctgaggcctggtgtgaagcttacactctctgctctggtagatgggaagagcattaatgctggaggccacaaggttgggctcgccctggagttggaggcttaatccagctgaaagaaacctttgggaatggatatcagaagatttggccttaatatatttccattgtgaccagcagcaggcttttttcccccaagaagatgatcaaaacaaaggatgatctcaacaagagctgtattttaagtatttagacagttctttgttagctggtttctagttggttatctagttaccaatgctgcagtcctgcagtcacctatacattatttaaatgtatttaactgttaaatgcgctacccaccaataatgaaatagacctttatgaaaactgtgcaattgtgtgcatgtttgtttttatgttcctttagaaaacattgactgttaccattgaatgagatggatcagtggatattaagatgaggttacaaattttgttaagttcagccattattacttttggtatcccagaacatgacaaattatgaataaaacaagtatacat

SEQ ID NO: 905 - DNA, 1424 bp, Homo sapiens
ggcagtcccaaaaagcctctcaggcacacaacccagcacagcaaggcagtcacaccaagattcccctcttcccgcggcctcgccatggcgacccacggacagacttgcgcgcgtccaatgtgtattcctccatcatatgctgaccttggcaaagctgccagagatattttcaacaaaggatttggttttgggttggtgaaactggatgtgaaaacaaagtcttgcagtggcgtggaattttcaacgtccggttcatctaatacagacactggtaaagttactgggaccttggagaccaaatacaagtggtgtgagtatggtctgactttcacagaaaagtggaacactgataacactctgggaacagaaatcgcaattgaagaccagatttgtcaaggtttgaaactgacatttgatactaccttctcaccaaacacaggaaagaaaagtggtaaaatcaagtcttcttacaagagggagtgtataaaccttggttgtgatgttgactttgattttgctggacctgcaatccatggttcagctgtctttggttatgagggctggcttgctggctaccagatgacctttgacagtgccaaatcaaagctgacaaggaataactttgcagtgggctacaggactggggacttccagctacacactaatgtcaatgatgggacagaatttggaggatcaatttatcagaaagtttgtgaagatcttgacacttcagtaaaccttgcttggacatcaggtaccaactgcactcgttttggcattgcagctaaatatcagttggatcccactgcttccatttctgcaaaagtcaacaactctagcttaattggagtaggctatactcagactctgaggcctggtgtgaagcttacactctctgctctggtagatgggaagagcattaatgctggaggccacaaggttgggctcgccctggagttggaggcttaatccagctgaaagaaacctttgggaatggatatcagaagatttggccttaatatatttccattgtgaccagcagcaggcttttttcccccaagaagatgatcaaaacaaaggatgatctcaacaagagctgtattttaagtatttagacagttctttgttagctggtttctagttggttatctagttaccaatgctgcagtcctgcagtcacctatacattatttaaatgtatttaactgttaaatgcgctacccaccaataatgaaatagacctttatgaaaactgtgcaattgtgtgcatgtttgtttttatgttcctttagaaaacattgactgttaccattgaatgagatggatcagtggatattaagatgaggttacaaattttgttaagttcagccattattacttttggtatcccagaacatgacaaattatgaataaaacaagtatac

SEQ ID NO: 906 - DNA, 8584 bp, Homo sapiens
tcgggccggctgtcctggcgcggtgggtacagcttgtgtaggctttcccctcccccgctttccctccttcccctctcctccctcccctcttcttttcccctccacttccctcgggccggcgctgctggggagggcgggaaggccgcgccagcccatcaggggtggcccggccccggctgcttgcccgggttcctcggactgccgacggcaggcgtgggtgggtgggtgacttcaggcctgcaggattgccttcctaaaccctgtgacacctaagaaaaggtggacaagtcctattttcaagagaagatgacttttaacagttttgaaggatctaaaacttgtgtacctgcagacatcaataaggaagaagaatttgtagaagagtttaatagattaaaaacttttgctaattttccaagtggtagtcctgtttcagcatcaacactggcacgagcagggtttctttatactggtgaaggagataccgtgcggtgctttagttgtcatgcagctgtagatagatggcaatatggagactcagcagttggaagacacaggaaagtatccccaaattgcagatttatcaacggcttttatcttgaaaatagtgccacgcagtctacaaattctggtatccagaatggtcagtacaaagttgaaaactatctgggaagcagagatcattttgccttagacaggccatctgagacacatgcagactatcttttgagaactgggcaggttgtagatatatcagacaccatatacccgaggaaccctgccatgtatagtgaagaagctagattaaagtcctttcagaactggccagactatgctcacctaaccccaagagagttagcaagtgctggactctactacacaggtattggtgaccaagtgcagtgcttttgttgtggtggaaaactgaaaaattgggaaccttgtgatcgtgcctggtcagaacacaggcgacactttcctaattgcttctttgttttgggccggaatcttaatattcgaagtgaatctgatgctgtgagttctgataggaatttcccaaattcaacaaatcttccaagaaatccatccatggcagattatgaagcacggatctttacttttgggacatggatatactcagttaacaaggagcagcttgcaagagctggattttatgctttaggtgaaggtgataaagtaaagtgctttcactgtggaggagggctaactgattggaagcccagtgaagacccttgggaacaacatgctaaatggtatccagggtgcaaatatctgttagaacagaagggacaagaatatataaacaatattcatttaactcattcacttgaggagtgtctggtaagaactactgagaaaacaccatcactaactagaagaattgatgataccatcttccaaaatcctatggtacaagaagctatacgaatggggttcagtttcaaggacattaagaaaataatggaggaaaaaattcagatatctgggagcaactataaatcacttgaggttctggttgcagatctagtgaatgctcagaaagacagtatgcaagatgagtcaagtcagacttcattacagaaagagattagtactgaagagcagctaaggcgcctgcaagaggagaagctttgcaaaatctgtatggatagaaatattgctatcgtttttgttccttgtggacatctagtcacttgtaaacaatgtgctgaagcagttgacaagtgtcccatgtgctacacagtcattactttcaagcaaaaaatttttatgtcttaatctaactctatagtaggcatgttatgttgttcttattaccctgattgaatgtgtgatgtgaactgactttaagtaatcaggattgaattccattagcatttgctaccaagtaggaaaaaaaatgtacatggcagtgttttagttggcaatataatctttgaatttcttgatttttcagggtattagctgtattatccattttttttactgttatttaattgaaaccatagactaagaataagaagcatcatactataactgaacacaatgtgtattcatagtatactgatttaatttctaagtgtaagtgaattaatcatctggattttttattcttttcagataggcttaacaaatggagctttctgtatataaatgtggagattagagttaatctccccaatcacataatttgttttgtgtgaaaaaggaataaattgttccatgctggtggaaagatagagattgtttttagaggttggttgttgtgttttaggattctgtccattttcttttaaagttataaacacgtacttgtgcgaattatttttttaaagtgatttgccatttttgaaagcgtatttaatgatagaatactatcgagccaacatgtactgacatggaaagatgtcaaagatatgttaagtgtaaaatgcaagtggcaaaacactatgtatagtctgagccagatcaaagtatgtatgtttttaatatgcatagaacaaaagatttggaaagatatacaccaaactgttaaatgtggtttctcttcggggagggggggattgggggaggggccccagaggggttttataggggccttttcactttctacttttttcattttgttctgttcgaattttttataagtatgtattacttttgtaatcagaatttttagaaagtattttgctgatttaaaggcttaggcatgttcaaacgcctgcaaaactacttatcactcagctttagtttttctaatccaagaaggcagggcagttaacctttttggtgccaatgtgaaatgtaaatgattttatgtttttcctgctttgtggatgaaaaatatttctgagtggtagttttttgacaggtagaccatgtcttatcttgtttcaaaataagtatttctgattttgtaaaatgaaatataaaatatgtctcagatcttccaattaattagtaaggattcatccttaatccttgctagtttaagcctgcctaagtcactttactaaaagatctttgttaactcagtattttaaacatctgtcagcttatgtaggtaaaagtagaagcatgtttgtacactgcttgtagttatagtgacagctttccatgttgagattctcatatcatcttgtatcttaaagtttcatgtgagtttttaccgttaggatgattaagatgtatataggacaaaatgttaagtctttcctctacctacatttgttttcttggctagtaatagtagtagatacttctgaaataaatgttctctcaagatccttaaaacctcttggaaattataaaaatattggcaagaaaagaagaatagttgtttaaatattttttaaaaaacacttgaataagaatcagtagggtataaactagaagtttaaaaatgcttcatagaacgtccagggtttacattacaagattctcacaacaaacctattgtagaggtgagtaaggcatgttactacagaggaaagtttgagagtaaaactgtaaaaaattatatttttgttgtactttctaagagaaagagtattgttatgttctcctaacttctgttgattactactttaagtgatattcatttaaaacattgcaaatttattttatttatttaattttctttttgagatggagtcttgcttgtcacccaggctggagtgcagtggagtgatctctgctcactgcaacctccgccttctgggttcaagcgattctcgtgcctcagcttcctgagtagctggaattacaggcaggtgccaccatgcccgactaatttttttttatttttagtagagacggggtttcaccatgttggccaggctggtatcaaactcctgacctcaagagatccactcgccttgccctcccaaagtgctgggattacaggcttgagccaccacgcccggctaaaacattgcaaatttaaatgagagttttaaaaattaaataatgactgccctgtttctgttttagtatgtaaatcctcagttcttcacctttgcactgtctgccacttagtttggttatatagtcattaacttgaatttggtctgtatagtctagactttaaatttaaagttttctacaaggggagaaaagtgttaaaatttttaaaatatgttttccaggacacttcacttccaagtcaggtaggtagttcaatctagttgttagccaaggactcaaggactgaattgttttaacataaggcttttcctgttctgggagccgcacttcattaaaattcttctaaaacttgtatgtttagagttaagcaagactttttttcttcctctccatgagttgtgaaatttaatgcacaacgctgatgtggctaacaagtttattttaagaattgtttagaaatgctgttgcttcaggttcttaaaatcactcagcactccaacttctaatcaaatttttggagacttaacagcatttgtctgtgtttgaactataaaaagcaccggatcttttccatctaattccgcaaaaattgatcatttgcaaagtcaaaactatagccatatccaaatcttttccccctcccaagagttctcagtgtctacatgtagactattccttttctgtataaagttcactctaggatttcaagtcaccacttattttacattttagtcatgcaaagattcaagtagttttgcaataagtacttatctttatttgtaataatttagtctgctgatcaaaagcattgtcttaatttttgagaactggttttagcatttacaaactaaattccagttaattaattaatagctttatattgcctttcctgctacatttggttttttcccctgtccctttgattacgggctaaggtagggtagagtgggtgtagtgagtgtatataatgtgatttggccctgtgtattatgatattttgttatttttgttgttatattatttacatttcagtagttgttttttgtgtttccattttagtggataaaatttgtattttgaactatgaatggagactaccgccccagcattagtttcacatgatataccctttaaacccgaatcattgttttatttcctgattacacaggtgttgaatggggaaaggggctagtatatcagtaggatatactatgggatgtatatatatcattgctgttagagaaatgaaataaaatggggctgggctcagtggctcacgcctgtaatcccagcactttgggaggctgaggcaggtggatcacgaggtcaggagatcgagaccatcctggctaacacggtgaaaccccgtctctactaaaaaacagaaaattagccgggcgtggtggcgggcgcctgtagtcccagctactcgggaggctgaggcaggagaatggtgtgaacccgggaggcagagcttgcagtgagccgagatctcgccactgcactccagcctgggcaacagagcaagactctgtctcaaaaaaaaaaaaaaaagaaataagaaaatgggaagcaatatttgacatagttctttttagtcaaatctacttgttaaaaaaagggtagcagtttattcatctgtgaaaggaaaataatacttatcttacaaggttgcaagagctcaaggagaccatgtatgtaaagttcctgctgtaaatatgaactcccatcctaatacccttttacctctctgtgggtttgtcttgacctggaaatttgggctaaaacttagaaaaaattcttacatgataactcagtgatgcttactcatagtttttggtgtttctcatagataagatataaatcagctgggcgcggtggctcatgcctgtaatcccagcactttgggaggccgaggcgggcagatcacctgaggtcgggaggtcgagaccagcctgaccaacatggagaaaccccgtctctactaaaaatacaaaattagctgggcgtggtggctcatgcctgtaatcccagctacttgggaggctgaggcaggagaatcgcttgaacccaggaggcggaggttgtggtgagcgaagatcgtgccattgcactccagcctgggcaacaagagcaaaactctgtctcaaaaaaaaaaaaagatataaatcacaataaataaataggtcaatacaaatgttagccaggcgtggtggcacatgcccatagtcgcagctactctggaggcagaggcaggaggatcacttgagcccatgaatttgaggcagcagtgagctatgattgtgccactgtactccagtctgggtgacagagtgagaccccatctctaaataaataggtcaaacccttaaaaatatttaaattcttaaaaaattgaaaagattattcttctcaaatttagttgagctttctaagagaagcaattggctttttcccacttcaataatcattttcagtttgactcatacagttaacacaatgtgaatttcttcctcagcataacagagttatagaatgacagggctggaagtgaccttagagagtatccagttctttcattttacaggtgaggcaactgagactcaaaggtgatgtaatttgtgcaaagattatagctaattagtagcagagccctgactgggacatagtttgaaggtgaaaaacttcaccaagctacctttcttgaaaggtccaaatgtttatgttttcaactactctttccactgtaccataactttcactacatattaaatgacactttataactaatataataggacaatcatcaatgcatatatagccagcccttcatatctgtgggttttgcatccatggattcaaccaaggaggaattgaaaacactgagaaaaaaaaaaaagaccacacaataaaaaaaaaaaatacaaaataatacaaagaaaaagccaaaattgtcatactgttgttaagcaacagtataacaactatttacatagcattaaggttggtgcaaaaatgcaaaaaaaaaaaaagcaattatttttaaaccaacctaatatattgtattaggtattaaagtcatctggacatgaattaaagtatatgatgccagcctggacaaaaggcaaaaccctgtctctacaaaaaatacaaaaattagctgggcatggtggtgtgtgcctgtagtcctggctactccggagcctgaggtgggaggatcgcttgagtctgggaggcagaggctgcattgagctatgatcatggcactgcattccagcctgggtgacagtgcaagaccttgtctcagaataaataaagtatgtgatgaagatgtgcatacattatatgcaaatactgttttttttttttttaatttaaacagtctcactgtgttgcccaggatggagtgcaatggcacaatcttggctcatggcaaactctgcctcgcaagcagctgggactacaggcatgctccacggtgcccagttaattttttttgtattcttagtagagacagggtttcaccatgttggccaggctagtcttgaatttctgacctcaagtgattcatctcccaaagtgctgggattacaggcgtgagccaccacggccggctaatttttgtattttttagtagtgactggtttcgcggtgttgaccaggctggtctcgaactcctgatctcaggtgatctgcctgcctcggcctcacaaagtgctgggattacaggtgtgaaccactgctcccggccttgtgtgattttatctaagggacttaagcgtcctcaggtcctagggggtcgtgaaaccaaaaccccagggatagcaagggacaattgtatcttcaaagtagacaaatggcgccgggcacggtggctcacgcctgtaatcccagcagtttccgaggctgaggcaggcggctcacctgaggtcaggagttggagaccagcctggccaacatgctgaaaccctgtctgtacaaaaatacaaaaatagctgggcatggtggcgcatgcctgtagtcccagctactagagcgactgaggcaggagaattgcttgaacctgggaggcggaggttgcagggagccaagatggcgccaccgcactccagcctaggtgatagagtgagactccctctcaaaaacaaaacaaaacaaaaaaattagacaaatgctacattaatgtttgggtggtcagattctactttgaatctgaagtttgcagatatgcctatagatttttggagtttaccactttcttattctgtatcattaatgtaatattttaaattactatatatgttaccatttttctggatttagtaagaaatttgcagttttggtttgatgtaacaagggttttaatgtaatttatgttagattttgcatttttttcattactgttatattttaacctgactgactgatctaattgtattagtattgtgaataatcatgtgaaatgttttgagacagagtactatatttgtgaatataattttatggtttttttcacttagaacctttctgtgtggaaaactaagaaaattgctttctgctgtataatctggcattcattgtagattaaagcttatttttctgtgaataaaacgtattcaataaaatactattcttt

SEQ ID NO: 907 - DNA, 8591 bp, Homo sapiens
tgacggaccgcgcccggtgtctctttgaggccctgacgtggacacacttcgggtttcacgactccgggtttctccaggggatgggccggccggtagaggcgcgtgagggagacgaagggacttccgtttccttcacctaggctggggccaagccgcagagcggagttggcatttccagattggggctcgggccgcgcctcctccgggaccctccccttggaccgagccgatcgccgcggggcagttcgggccggctgtcctggcgcgaaaaggtggacaagtcctattttcaagagaagatgacttttaacagttttgaaggatctaaaacttgtgtacctgcagacatcaataaggaagaagaatttgtagaagagtttaatagattaaaaacttttgctaattttccaagtggtagtcctgtttcagcatcaacactggcacgagcagggtttctttatactggtgaaggagataccgtgcggtgctttagttgtcatgcagctgtagatagatggcaatatggagactcagcagttggaagacacaggaaagtatccccaaattgcagatttatcaacggcttttatcttgaaaatagtgccacgcagtctacaaattctggtatccagaatggtcagtacaaagttgaaaactatctgggaagcagagatcattttgccttagacaggccatctgagacacatgcagactatcttttgagaactgggcaggttgtagatatatcagacaccatatacccgaggaaccctgccatgtatagtgaagaagctagattaaagtcctttcagaactggccagactatgctcacctaaccccaagagagttagcaagtgctggactctactacacaggtattggtgaccaagtgcagtgcttttgttgtggtggaaaactgaaaaattgggaaccttgtgatcgtgcctggtcagaacacaggcgacactttcctaattgcttctttgttttgggccggaatcttaatattcgaagtgaatctgatgctgtgagttctgataggaatttcccaaattcaacaaatcttccaagaaatccatccatggcagattatgaagcacggatctttacttttgggacatggatatactcagttaacaaggagcagcttgcaagagctggattttatgctttaggtgaaggtgataaagtaaagtgctttcactgtggaggagggctaactgattggaagcccagtgaagacccttgggaacaacatgctaaatggtatccagggtgcaaatatctgttagaacagaagggacaagaatatataaacaatattcatttaactcattcacttgaggagtgtctggtaagaactactgagaaaacaccatcactaactagaagaattgatgataccatcttccaaaatcctatggtacaagaagctatacgaatggggttcagtttcaaggacattaagaaaataatggaggaaaaaattcagatatctgggagcaactataaatcacttgaggttctggttgcagatctagtgaatgctcagaaagacagtatgcaagatgagtcaagtcagacttcattacagaaagagattagtactgaagagcagctaaggcgcctgcaagaggagaagctttgcaaaatctgtatggatagaaatattgctatcgtttttgttccttgtggacatctagtcacttgtaaacaatgtgctgaagcagttgacaagtgtcccatgtgctacacagtcattactttcaagcaaaaaatttttatgtcttaatctaactctatagtaggcatgttatgttgttcttattaccctgattgaatgtgtgatgtgaactgactttaagtaatcaggattgaattccattagcatttgctaccaagtaggaaaaaaaatgtacatggcagtgttttagttggcaatataatctttgaatttcttgatttttcagggtattagctgtattatccattttttttactgttatttaattgaaaccatagactaagaataagaagcatcatactataactgaacacaatgtgtattcatagtatactgatttaatttctaagtgtaagtgaattaatcatctggattttttattcttttcagataggcttaacaaatggagctttctgtatataaatgtggagattagagttaatctccccaatcacataatttgttttgtgtgaaaaaggaataaattgttccatgctggtggaaagatagagattgtttttagaggttggttgttgtgttttaggattctgtccattttcttttaaagttataaacacgtacttgtgcgaattatttttttaaagtgatttgccatttttgaaagcgtatttaatgatagaatactatcgagccaacatgtactgacatggaaagatgtcaaagatatgttaagtgtaaaatgcaagtggcaaaacactatgtatagtctgagccagatcaaagtatgtatgtttttaatatgcatagaacaaaagatttggaaagatatacaccaaactgttaaatgtggtttctcttcggggagggggggattgggggaggggccccagaggggttttataggggccttttcactttctacttttttcattttgttctgttcgaattttttataagtatgtattacttttgtaatcagaatttttagaaagtattttgctgatttaaaggcttaggcatgttcaaacgcctgcaaaactacttatcactcagctttagtttttctaatccaagaaggcagggcagttaacctttttggtgccaatgtgaaatgtaaatgattttatgtttttcctgctttgtggatgaaaaatatttctgagtggtagttttttgacaggtagaccatgtcttatcttgtttcaaaataagtatttctgattttgtaaaatgaaatataaaatatgtctcagatcttccaattaattagtaaggattcatccttaatccttgctagtttaagcctgcctaagtcactttactaaaagatctttgttaactcagtattttaaacatctgtcagcttatgtaggtaaaagtagaagcatgtttgtacactgcttgtagttatagtgacagctttccatgttgagattctcatatcatcttgtatcttaaagtttcatgtgagtttttaccgttaggatgattaagatgtatataggacaaaatgttaagtctttcctctacctacatttgttttcttggctagtaatagtagtagatacttctgaaataaatgttctctcaagatccttaaaacctcttggaaattataaaaatattggcaagaaaagaagaatagttgtttaaatattttttaaaaaacacttgaataagaatcagtagggtataaactagaagtttaaaaatgcttcatagaacgtccagggtttacattacaagattctcacaacaaacctattgtagaggtgagtaaggcatgttactacagaggaaagtttgagagtaaaactgtaaaaaattatatttttgttgtactttctaagagaaagagtattgttatgttctcctaacttctgttgattactactttaagtgatattcatttaaaacattgcaaatttattttatttatttaattttctttttgagatggagtcttgcttgtcacccaggctggagtgcagtggagtgatctctgctcactgcaacctccgccttctgggttcaagcgattctcgtgcctcagcttcctgagtagctggaattacaggcaggtgccaccatgcccgactaatttttttttatttttagtagagacggggtttcaccatgttggccaggctggtatcaaactcctgacctcaagagatccactcgccttgccctcccaaagtgctgggattacaggcttgagccaccacgcccggctaaaacattgcaaatttaaatgagagttttaaaaattaaataatgactgccctgtttctgttttagtatgtaaatcctcagttcttcacctttgcactgtctgccacttagtttggttatatagtcattaacttgaatttggtctgtatagtctagactttaaatttaaagttttctacaaggggagaaaagtgttaaaatttttaaaatatgttttccaggacacttcacttccaagtcaggtaggtagttcaatctagttgttagccaaggactcaaggactgaattgttttaacataaggcttttcctgttctgggagccgcacttcattaaaattcttctaaaacttgtatgtttagagttaagcaagactttttttcttcctctccatgagttgtgaaatttaatgcacaacgctgatgtggctaacaagtttattttaagaattgtttagaaatgctgttgcttcaggttcttaaaatcactcagcactccaacttctaatcaaatttttggagacttaacagcatttgtctgtgtttgaactataaaaagcaccggatcttttccatctaattccgcaaaaattgatcatttgcaaagtcaaaactatagccatatccaaatcttttccccctcccaagagttctcagtgtctacatgtagactattccttttctgtataaagttcactctaggatttcaagtcaccacttattttacattttagtcatgcaaagattcaagtagttttgcaataagtacttatctttatttgtaataatttagtctgctgatcaaaagcattgtcttaatttttgagaactggttttagcatttacaaactaaattccagttaattaattaatagctttatattgcctttcctgctacatttggttttttcccctgtccctttgattacgggctaaggtagggtagagtgggtgtagtgagtgtatataatgtgatttggccctgtgtattatgatattttgttatttttgttgttatattatttacatttcagtagttgttttttgtgtttccattttagtggataaaatttgtattttgaactatgaatggagactaccgccccagcattagtttcacatgatataccctttaaacccgaatcattgttttatttcctgattacacaggtgttgaatggggaaaggggctagtatatcagtaggatatactatgggatgtatatatatcattgctgttagagaaatgaaataaaatggggctgggctcagtggctcacgcctgtaatcccagcactttgggaggctgaggcaggtggatcacgaggtcaggagatcgagaccatcctggctaacacggtgaaaccccgtctctactaaaaaacagaaaattagccgggcgtggtggcgggcgcctgtagtcccagctactcgggaggctgaggcaggagaatggtgtgaacccgggaggcagagcttgcagtgagccgagatctcgccactgcactccagcctgggcaacagagcaagactctgtctcaaaaaaaaaaaaaaaagaaataagaaaatgggaagcaatatttgacatagttctttttagtcaaatctacttgttaaaaaaagggtagcagtttattcatctgtgaaaggaaaataatacttatcttacaaggttgcaagagctcaaggagaccatgtatgtaaagttcctgctgtaaatatgaactcccatcctaatacccttttacctctctgtgggtttgtcttgacctggaaatttgggctaaaacttagaaaaaattcttacatgataactcagtgatgcttactcatagtttttggtgtttctcatagataagatataaatcagctgggcgcggtggctcatgcctgtaatcccagcactttgggaggccgaggcgggcagatcacctgaggtcgggaggtcgagaccagcctgaccaacatggagaaaccccgtctctactaaaaatacaaaattagctgggcgtggtggctcatgcctgtaatcccagctacttgggaggctgaggcaggagaatcgcttgaacccaggaggcggaggttgtggtgagcgaagatcgtgccattgcactccagcctgggcaacaagagcaaaactctgtctcaaaaaaaaaaaaagatataaatcacaataaataaataggtcaatacaaatgttagccaggcgtggtggcacatgcccatagtcgcagctactctggaggcagaggcaggaggatcacttgagcccatgaatttgaggcagcagtgagctatgattgtgccactgtactccagtctgggtgacagagtgagaccccatctctaaataaataggtcaaacccttaaaaatatttaaattcttaaaaaattgaaaagattattcttctcaaatttagttgagctttctaagagaagcaattggctttttcccacttcaataatcattttcagtttgactcatacagttaacacaatgtgaatttcttcctcagcataacagagttatagaatgacagggctggaagtgaccttagagagtatccagttctttcattttacaggtgaggcaactgagactcaaaggtgatgtaatttgtgcaaagattatagctaattagtagcagagccctgactgggacatagtttgaaggtgaaaaacttcaccaagctacctttcttgaaaggtccaaatgtttatgttttcaactactctttccactgtaccataactttcactacatattaaatgacactttataactaatataataggacaatcatcaatgcatatatagccagcccttcatatctgtgggttttgcatccatggattcaaccaaggaggaattgaaaacactgagaaaaaaaaaaaagaccacacaataaaaaaaaaaaatacaaaataatacaaagaaaaagccaaaattgtcatactgttgttaagcaacagtataacaactatttacatagcattaaggttggtgcaaaaatgcaaaaaaaaaaaaagcaattatttttaaaccaacctaatatattgtattaggtattaaagtcatctggacatgaattaaagtatatgatgccagcctggacaaaaggcaaaaccctgtctctacaaaaaatacaaaaattagctgggcatggtggtgtgtgcctgtagtcctggctactccggagcctgaggtgggaggatcgcttgagtctgggaggcagaggctgcattgagctatgatcatggcactgcattccagcctgggtgacagtgcaagaccttgtctcagaataaataaagtatgtgatgaagatgtgcatacattatatgcaaatactgttttttttttttttaatttaaacagtctcactgtgttgcccaggatggagtgcaatggcacaatcttggctcatggcaaactctgcctcgcaagcagctgggactacaggcatgctccacggtgcccagttaattttttttgtattcttagtagagacagggtttcaccatgttggccaggctagtcttgaatttctgacctcaagtgattcatctcccaaagtgctgggattacaggcgtgagccaccacggccggctaatttttgtattttttagtagtgactggtttcgcggtgttgaccaggctggtctcgaactcctgatctcaggtgatctgcctgcctcggcctcacaaagtgctgggattacaggtgtgaaccactgctcccggccttgtgtgattttatctaagggacttaagcgtcctcaggtcctagggggtcgtgaaaccaaaaccccagggatagcaagggacaattgtatcttcaaagtagacaaatggcgccgggcacggtggctcacgcctgtaatcccagcagtttccgaggctgaggcaggcggctcacctgaggtcaggagttggagaccagcctggccaacatgctgaaaccctgtctgtacaaaaatacaaaaatagctgggcatggtggcgcatgcctgtagtcccagctactagagcgactgaggcaggagaattgcttgaacctgggaggcggaggttgcagggagccaagatggcgccaccgcactccagcctaggtgatagagtgagactccctctcaaaaacaaaacaaaacaaaaaaattagacaaatgctacattaatgtttgggtggtcagattctactttgaatctgaagtttgcagatatgcctatagatttttggagtttaccactttcttattctgtatcattaatgtaatattttaaattactatatatgttaccatttttctggatttagtaagaaatttgcagttttggtttgatgtaacaagggttttaatgtaatttatgttagattttgcatttttttcattactgttatattttaacctgactgactgatctaattgtattagtattgtgaataatcatgtgaaatgttttgagacagagtactatatttgtgaatataattttatggtttttttcacttagaacctttctgtgtggaaaactaagaaaattgctttctgctgtataatctggcattcattgtagattaaagcttatttttctgtgaataaaacgtattcaataaaatactattctttaaaattatatcata

SEQ ID NO: 908 - DNA, 528 bp, Homo sapiens
gctcatcgagggacgcccggcccaagtgaaaaggtggacaagtcctattttcaagagaagatgacttttaacagttttgaaggatctaaaacttgtgtacctgcagacatcaataaggaagaagaatttgtagaagagtttaatagattaaaaacttttgctaattttccaagtggtagtcctgtttcagcatcaacactggcacgagcagggtttctttatactggtgaaggagataccgtgcggtgctttagttgtcatgcagctgtagatagatggcaatatggagactcagcagttggaagacacaggaaagtatccccaaattgcagatttatcaacggcttttatcttgaaaatagtgccacgcagtctacaaattctggtatccagaatggtcagtacaaagttgaaaactatctgggaagcagagatcattttgccttagacaggccatctgagacacatgcagactatcttttgagaactgggcaggttgtagatatatcagacaccatatacccgagg

SEQ ID NO: 909 - DNA, 1620 bp, Homo sapiens
ttcttactgcccccatccggttcggggaggtggcgggaccttggcggcgcccggagccggcgtggcgctcatcgagggacgcccggcccaagtgaaaaggtggacaagtcctattttcaagagaagatgacttttaacagttttgaaggatctaaaacttgtgtacctgcagacatcaataaggaagaagaatttgtagaagagtttaatagattaaaaacttttgctaattttccaagtggtagtcctgtttcagcatcaacactggcacgagcagggtttctttatactggtgaaggagataccgtgcggtgctttagttgtcatgcagctgtagatagatggcaatatggagactcagcagttggaagacacaggaaagtatccccaaattgcagatttatcaacggcttttatcttgaaaatagtgccacgcagtctacaaattctggtatccagaatggtcagtacaaagttgaaaactatctgggaagcagagatcattttgccttagacaggccatctgagacacatgcagactatcttttgagaactgggcaggttgtagatatatcagacaccatatacccgaggaaccctgccatgtatagtgaagaagctagattaaagtcctttcagaactggccagactatgctcacctaaccccaagagagttagcaagtgctggactctactacacaggtattggtgaccaagtgcagtgcttttgttgtggtggaaaactgaaaaattgggaaccttgtgatcgtgcctggtcagaacacaggcgacactttcctaattgcttctttgttttgggccggaatcttaatattcgaagtgaatctgatgctgtgagttctgataggaatttcccaaattcaacaaatcttccaagaaatccatccatggcagattatgaagcacggatctttacttttgggacatggatatactcagttaacaaggagcagcttgcaagagctggattttatgctttaggtgaaggtgataaagtaaagtgctttcactgtggaggagggctaactgattggaagcccagtgaagacccttgggaacaacatgctaaatggtatccagggtgcaaatatctgttagaacagaagggacaagaatatataaacaatattcatttaactcattcacttgaggagtgtctggtaagaactactgagaaaacaccatcactaactagaagaattgatgataccatcttccaaaatcctatggtacaagaagctatacgaatggggttcagtttcaaggacattaagaaaataatggaggaaaaaattcagatatctgggagcaactataaatcacttgaggttctggttgcagatctagtgaatgctcagaaagacagtatgcaagatgagtcaagtcagacttcattacagaaagagattagtactgaagagcagctaaggcgcctgcaagaggagaagctttgcaaaatctgtatggatagaaatattgctatcgtttttgttccttgtggacatctagtcacttgtaaacaatgtgctgaagcagttgacaagtgtcccatgtgctacacagtcattactttcaagcaaaaaatttttatgtcttaa

SEQ ID NO: 910 - DNA, 1680 bp, Homo sapiens
taatacgactcactatagggaaataagagagaaaagaagagtaagaagaaatataagagccaccatgacttttaacagttttgaaggatctaaaacttgtgtacctgcagacatcaataaggaagaagaatttgtagaagagtttaatagattaaaaacttttgctaattttccaagtggtagtcctgtttcagcatcaacactggcacgagcagggtttctttatactggtgaaggagataccgtgcggtgctttagttgtcatgcagctgtagatagatggcaatatggagactcagcagttggaagacacaggaaagtatccccaaattgcagatttatcaacggcttttatcttgaaaatagtgccacgcagtctacaaattctggtatccagaatggtcagtacaaagttgaaaactatctgggaagcagagatcattttgccttagacaggccatctgagacacatgcagactatcttttgagaactgggcaggttgtagatatatcagacaccatatacccgaggaaccctgccatgtatagtgaagaagctagattaaagtcctttcagaactggccagactatgctcacctaaccccaagagagttagcaagtgctggactctactacacaggtattggtgaccaagtgcagtgcttttgttgtggtggaaaactgaaaaattgggaaccttgtgatcgtgcctggtcagaacacaggcgacactttcctaattgcttctttgttttgggccggaatcttaatattcgaagtgaatctgatgctgtgagttctgataggaatttcccaaattcaacaaatcttccaagaaatccatccatggcagattatgaagcacggatctttacttttgggacatggatatactcagttaacaaggagcagcttgcaagagctggattttatgctttaggtgaaggtgataaagtaaagtgctttcactgtggaggagggctaactgattggaagcccagtgaagacccttgggaacaacatgctaaatggtatccagggtgcaaatatctgttagaacagaagggacaagaatatataaacaatattcatttaactcattcacttgaggagtgtctggtaagaactactgagaaaacaccatcactaactagaagaattgatgataccatcttccaaaatcctatggtacaagaagctatacgaatggggttcagtttcaaggacattaagaaaataatggaggaaaaaattcagatatctgggagcaactataaatcacttgaggttctggttgcagatctagtgaatgctcagaaagacagtatgcaagatgagtcaagtcagacttcattacagaaagagattagtactgaagagcagctaaggcgcctgcaagaggagaagctttgcaaaatctgtatggatagaaatattgctatcgtttttgttccttgtggacatctagtcacttgtaaacaatgtgctgaagcagttgacaagtgtcccatgtgctacacagtcattactttcaagcaaaaaatttttatgtcttgataataggctggagcctcggtggccatgcttcttgccccttgggcctccccccagcccctcctccccttcctgcacccgtacccccgtggtctttgaataaagtctgagtgggcggctctaga

SEQ ID NO: 911 - DNA, 13147 bp, Homo sapiens
ccggagcccgagccgaagggcgagccgcaaacgctaagtcgctggccattggtggacatggcgcaggcgcgtttgctccgacgggccgaatgttttggggcagtgttttgagcgcggagaccgcgtgatactggatgcgcatgggcataccgtgctctgcggctgcttggcgttgcttcttcctccagaagtgggcgctgggcagtcacgcagggtttgaaccggaagcgggagtaggtagctgcgtggctaacggagaaaagaagccgtggccgcgggaggaggcgagaggagtcgggatctgcgctgcagccaccgccgcggttgatactactttgaccttccgagtgcagtgacagtgatgtgtgttctgaaattgtgaaccatgagtctagtacttaatgatctgcttatctgctgccgtcaactagaacatgatagagctacagaacgaaagaaagaagttgagaaatttaagcgcctgattcgagatcctgaaacaattaaacatctagatcggcattcagattccaaacaaggaaaatatttgaattgggatgctgtttttagatttttacagaaatatattcagaaagaaacagaatgtctgagaatagcaaaaccaaatgtatcagcctcaacacaagcctccaggcagaaaaagatgcaggaaatcagtagtttggtcaaatacttcatcaaatgtgcaaacagaagagcacctaggctaaaatgtcaagaactcttaaattatatcatggatacagtgaaagattcatctaatggtgctatttacggagctgattgtagcaacatactactcaaagacattctttctgtgagaaaatactggtgtgaaatatctcagcaacagtggttagaattgttctctgtgtacttcaggctctatctgaaaccttcacaagatgttcatagagttttagtggctagaataattcatgctgttaccaaaggatgctgttctcagactgacggattaaattccaaatttttggactttttttccaaggctattcagtgtgcgagacaagaaaagagctcttcaggtctaaatcatatcttagcagctcttactatcttcctcaagactttggctgtcaactttcgaattcgagtgtgtgaattaggagatgaaattcttcccactttgctttatatttggactcaacataggcttaatgattctttaaaagaagtcattattgaattatttcaactgcaaatttatatccatcatccgaaaggagccaaaacccaagaaaaaggtgcttatgaatcaacaaaatggagaagtattttatacaacttatatgatctgctagtgaatgagataagtcatataggaagtagaggaaagtattcttcaggatttcgtaatattgccgtcaaagaaaatttgattgaattgatggcagatatctgtcaccaggtttttaatgaagataccagatccttggagatttctcaatcttacactactacacaaagagaatctagtgattacagtgtcccttgcaaaaggaagaaaatagaactaggctgggaagtaataaaagatcaccttcagaagtcacagaatgattttgatcttgtgccttggctacagattgcaacccaattaatatcaaagtatcctgcaagtttacctaactgtgagctgtctccattactgatgatactatctcagcttctaccccaacagcgacatggggaacgtacaccatatgtgttacgatgccttacggaagttgcattgtgtcaagacaagaggtcaaacctagaaagctcacaaaagtcagatttattaaaactctggaataaaatttggtgtattacctttcgtggtataagttctgagcaaatacaagctgaaaactttggcttacttggagccataattcagggtagtttagttgaggttgacagagaattctggaagttatttactgggtcagcctgcagaccttcatgtcctgcagtatgctgtttgactttggcactgaccaccagtatagttccaggaacggtaaaaatgggaatagagcaaaatatgtgtgaagtaaatagaagcttttctttaaaggaatcaataatgaaatggctcttattctatcagttagagggtgacttagaaaatagcacagaagtgcctccaattcttcacagtaattttcctcatcttgtactggagaaaattcttgtgagtctcactatgaaaaactgtaaagctgcaatgaattttttccaaagcgtgccagaatgtgaacaccaccaaaaagataaagaagaactttcattctcagaagtagaagaactatttcttcagacaacttttgacaagatggactttttaaccattgtgagagaatgtggtatagaaaagcaccagtccagtattggcttctctgtccaccagaatctcaaggaatcactggatcgctgtcttctgggattatcagaacagcttctgaataattactcatctgagattacaaattcagaaactcttgtccggtgttcacgtcttttggtgggtgtccttggctgctactgttacatgggtgtaatagctgaagaggaagcatataagtcagaattattccagaaagccaagtctctaatgcaatgtgcaggagaaagtatcactctgtttaaaaataagacaaatgaggaattcagaattggttccttgagaaatatgatgcagctatgtacacgttgcttgagcaactgtaccaagaagagtccaaataagattgcatctggctttttcctgcgattgttaacatcaaagctaatgaatgacattgcagatatttgtaaaagtttagcatccttcatcaaaaagccatttgaccgtggagaagtagaatcaatggaagatgatactaatggaaatctaatggaggtggaggatcagtcatccatgaatctatttaacgattaccctgatagtagtgttagtgatgcaaacgaacctggagagagccaaagtaccataggtgccattaatcctttagctgaagaatatctgtcaaagcaagatctacttttcttagacatgctcaagttcttgtgtttgtgtgtaactactgctcagaccaatactgtgtcctttagggcagctgatattcggaggaaattgttaatgttaattgattctagcacgctagaacctaccaaatccctccacctgcatatgtatctaatgcttttaaaggagcttcctggagaagagtaccccttgccaatggaagatgttcttgaacttctgaaaccactatccaatgtgtgttctttgtatcgtcgtgaccaagatgtttgtaaaactattttaaaccatgtccttcatgtagtgaaaaacctaggtcaaagcaatatggactctgagaacacaagggatgctcaaggacagtttcttacagtaattggagcattttggcatctaacaaaggagaggaaatatatattctctgtaagaatggccctagtaaattgccttaaaactttgcttgaggctgatccttattcaaaatgggccattcttaatgtaatgggaaaagactttcctgtaaatgaagtatttacacaatttcttgctgacaatcatcaccaagttcgcatgttggctgcagagtcaatcaatagattgttccaggacacgaagggagattcttccaggttactgaaagcacttcctttgaagcttcagcaaacagcttttgaaaatgcatacttgaaagctcaggaaggaatgagagaaatgtcccatagtgctgagaaccctgaaactttggatgaaatttataatagaaaatctgttttactgacgttgatagctgtggttttatcctgtagccctatctgcgaaaaacaggctttgtttgccctgtgtaaatctgtgaaagagaatggattagaacctcaccttgtgaaaaaggttttagagaaagtttctgaaacttttggatatagacgtttagaagactttatggcatctcatttagattatctggttttggaatggctaaatcttcaagatactgaatacaacttatcttcttttccttttattttattaaactacacaaatattgaggatttctatagatcttgttataaggttttgattccacatctggtgattagaagtcattttgatgaggtgaagtccattgctaatcagattcaagaggactggaaaagtcttctaacagactgctttccaaagattcttgtaaatattcttccttattttgcctatgagggtaccagagacagtgggatggcacagcaaagagagactgctaccaaggtctatgatatgcttaaaagtgaaaacttattgggaaaacagattgatcacttattcattagtaatttaccagagattgtggtggagttattgatgacgttacatgagccagcaaattctagtgccagtcagagcactgacctctgtgacttttcaggggatttggatcctgctcctaatccacctcattttccatcgcatgtgattaaagcaacatttgcctatatcagcaattgtcataaaaccaagttaaaaagcattttagaaattctttccaaaagccctgattcctatcagaaaattcttcttgccatatgtgagcaagcagctgaaacaaataatgtttataagaagcacagaattcttaaaatatatcacctgtttgttagtttattactgaaagatataaaaagtggcttaggaggagcttgggcctttgttcttcgagacgttatttatactttgattcactatatcaaccaaaggccttcttgtatcatggatgtgtcattacgtagcttctccctttgttgtgacttattaagtcaggtttgccagacagccgtgacttactgtaaggatgctctagaaaaccatcttcatgttattgttggtacacttataccccttgtgtatgagcaggtggaggttcagaaacaggtattggacttgttgaaatacttagtgatagataacaaggataatgaaaacctctatatcacgattaagcttttagatccttttcctgaccatgttgtttttaaggatttgcgtattactcagcaaaaaatcaaatacagtagaggacccttttcactcttggaggaaattaaccattttctctcagtaagtgtttatgatgcacttccattgacaagacttgaaggactaaaggatcttcgaagacaactggaactacataaagatcagatggtggacattatgagagcttctcaggataatccgcaagatgggattatggtgaaactagttgtcaatttgttgcagttatccaagatggcaataaaccacactggtgaaaaagaagttctagaggctgttggaagctgcttgggagaagtgggtcctatagatttctctaccatagctatacaacatagtaaagatgcatcttataccaaggcccttaagttatttgaagataaagaacttcagtggaccttcataatgctgacctacctgaataacacactggtagaagattgtgtcaaagttcgatcagcagctgttacctgtttgaaaaacattttagccacaaagactggacatagtttctgggagatttataagatgacaacagatccaatgctggcctatctacagccttttagaacatcaagaaaaaagtttttagaagtacccagatttgacaaagaaaacccttttgaaggcctggatgatataaatctgtggattcctctaagtgaaaatcatgacatttggataaagacactgacttgtgcttttttggacagtggaggcacaaaatgtgaaattcttcaattattaaagccaatgtgtgaagtgaaaactgacttttgtcagactgtacttccatacttgattcatgatattttactccaagatacaaatgaatcatggagaaatctgctttctacacatgttcagggatttttcaccagctgtcttcgacacttctcgcaaacgagccgatccacaacccctgcaaacttggattcagagtcagagcactttttccgatgctgtttggataaaaaatcacaaagaacaatgcttgctgttgtggactacatgagaagacaaaagagaccttcttcaggaacaatttttaatgatgctttctggctggatttaaattatctagaagttgccaaggtagctcagtcttgtgctgctcactttacagctttactctatgcagaaatctatgcagataagaaaagtatggatgatcaagagaaaagaagtcttgcatttgaagaaggaagccagaatacaactatttctagcttgagtgaaaaaagtaaagaagaaactggaataagtttacaggatcttctcttagaaatctacagaagtataggggagccagatagtttgtatggctgtggtggagggaagatgttacaacccattactagactacgaacatatgaacacgaagcaatgtggggcaaagccctagtaacatatgacctcgaaacagcaatcccctcatcaacacgccaggcaggaatcattcaggccttgcagaatttgggactctgccatattctttccgtctatttaaaaggattggattatgaaaataaagactggtgtcctgaactagaagaacttcattaccaagcagcatggaggaatatgcagtgggaccattgcacttccgtcagcaaagaagtagaaggaaccagttaccatgaatcattgtacaatgctctacaatctctaagagacagagaattctctacattttatgaaagtctcaaatatgccagagtaaaagaagtggaagagatgtgtaagcgcagccttgagtctgtgtattcgctctatcccacacttagcaggttgcaggccattggagagctggaaagcattggggagcttttctcaagatcagtcacacatagacaactctctgaagtatatattaagtggcagaaacactcccagcttctcaaggacagtgattttagttttcaggagcctatcatggctctacgcacagtcattttggagatcctgatggaaaaggaaatggacaactcacaaagagaatgtattaaggacattctcaccaaacaccttgtagaactctctatactggccagaactttcaagaacactcagctccctgaaagggcaatatttcaaattaaacagtacaattcagttagctgtggagtctctgagtggcagctggaagaagcacaagtattctgggcaaaaaaggagcagagtcttgccctgagtattctcaagcaaatgatcaagaagttggatgccagctgtgcagcgaacaatcccagcctaaaacttacatacacagaatgtctgagggtttgtggcaactggttagcagaaacgtgcttagaaaatcctgcggtcatcatgcagacctatctagaaaaggcagtagaagttgctggaaattatgatggagaaagtagtgatgagctaagaaatggaaaaatgaaggcatttctctcattagcccggttttcagatactcaataccaaagaattgaaaactacatgaaatcatcggaatttgaaaacaagcaagctctcctgaaaagagccaaagaggaagtaggtctccttagggaacataaaattcagacaaacagatacacagtaaaggttcagcgagagctggagttggatgaattagccctgcgtgcactgaaagaggatcgtaaacgcttcttatgtaaagcagttgaaaattatatcaactgcttattaagtggagaagaacatgatatgtgggtattccgactttgttccctctggcttgaaaattctggagtttctgaagtcaatggcatgatgaagagagacggaatgaagattccaacatataaatttttgcctcttatgtaccaattggctgctagaatggggaccaagatgatgggaggcctaggatttcatgaagtcctcaataatctaatctctagaatttcaatggatcacccccatcacactttgtttattatactggccttagcaaatgcaaacagagatgaatttctgactaaaccagaggtagccagaagaagcagaataactaaaaatgtgcctaaacaaagctctcagcttgatgaggatcgaacagaggctgcaaatagaataatatgtactatcagaagtaggagacctcagatggtcagaagtgttgaggcactttgtgatgcttatattatattagcaaacttagatgccactcagtggaagactcagagaaaaggcataaatattccagcagaccagccaattactaaacttaagaatttagaagatgttgttgtccctactatggaaattaaggtggaccacacaggagaatatggaaatctggtgactatacagtcatttaaagcagaatttcgcttagcaggaggtgtaaatttaccaaaaataatagattgtgtaggttccgatggcaaggagaggagacagcttgttaagggccgtgatgacctgagacaagatgctgtcatgcaacaggtcttccagatgtgtaatacattactgcagagaaacacggaaactaggaagaggaaattaactatctgtacttataaggtggttcccctctctcagcgaagtggtgttcttgaatggtgcacaggaactgtccccattggtgaatttcttgttaacaatgaagatggtgctcataaaagatacaggccaaatgatttcagtgcctttcagtgccaaaagaaaatgatggaggtgcaaaaaaagtcttttgaagagaaatatgaagtcttcatggatgtttgccaaaattttcaaccagttttccgttacttctgcatggaaaaattcttggatccagctatttggtttgagaagcgattggcttatacgcgcagtgtagctacttcttctattgttggttacatacttggacttggtgatagacatgtacagaatatcttgataaatgagcagtcagcagaacttgtacatatagatctaggtgttgcttttgaacagggcaaaatccttcctactcctgagacagttccttttagactcaccagagatattgtggatggcatgggcattacgggtgttgaaggtgtcttcagaagatgctgtgagaaaaccatggaagtgatgagaaactctcaggaaactctgttaaccattgtagaggtccttctatatgatccactctttgactggaccatgaatcctttgaaagctttgtatttacagcagaggccggaagatgaaactgagcttcaccctactctgaatgcagatgaccaagaatgcaaacgaaatctcagtgatattgaccagagtttcaacaaagtagctgaacgtgtcttaatgagactacaagagaaactgaaaggagtggaagaaggcactgtgctcagtgttggtggacaagtgaatttgctcatacagcaggccatagaccccaaaaatctcagccgacttttcccaggatggaaagcttgggtgtgatcttcagtatatgaattaccctttcattcagcctttagaaattatattttagcctttatttttaacctgccaacatactttaagtagggattaatatttaagtgaactattgtgggtttttttgaatgttggttttaatacttgatttaatcaccactcaaaaatgttttgatggtcttaaggaacatctctgctttcactctttagaaataatggtcattcgggctgggcgcagcggctcacgcctgtaatcccagcactttgggaggccgaggtgagcggatcacaaggtcaggagttcgagaccagcctggccaagagaccagcctggccagtatggtgaaaccctgtctctactaaaaatacaaaaattagccgagcatggtggcgggcacctgtaatcccagctactcgagaggctgaggcaggagaatctcttgaacctgggaggtgaaggttgctgtgggccaaaatcatgccattgcactccagcctgggtgacaagagcgaaactccatctcaaaaaaaaaaaaaaaaaaacagaaacgtatttggatttttcctagtaagatcactcagtgttactaaataatgaagttgttatggagaacaaatttcaaagacacagttagtgtagttactatttttttaagtgtgtattaaaacttctcattctattctctttatcttttaagcccttctgtactgtccatgtatgttatctttctgtgataacttcatagattgccttctagttcatgaattctcttgtcagatgtatataatctcttttaccctatccattgggcttcttctttcagaaattgtttttcatttctaattatgcatcatttttcagatctctgtttcttgatgtcatttttaatgtttttttaatgttttttatgtcactaattattttaaatgtctgtacttgatagacactgtaatagttctattaaatttagttcctgctgtttatatctgttgatttttgtatttgataggctgttcatccagttttgtctttttgaaaagtgagtttattttcagcaaggctttatctatgggaatcttgagtgtctgtttatgtcatattcccagggctgttgctgcacacaagcccattcttattttaatttcttggctttagggtttccatacctgaagtgtagcataaatactgataggagatttcccaggccaaggcaaacacacttcctcctcatctccttgtgctagtgggcagaatatttgattgatgcctttttcactgagagtataagcttccatgtgtcccacctttatggcaggggtggaaggaggtacatttaattcccactgcctgcctttggcaagccctgggttctttgctccccatatagatgtctaagctaaaagccgtgggttaatgagactggcaaattgttccaggacagctacagcatcagctcacatattcacctctctggtttttcattcccctcatttttttctgagacagagtcttgctctgtcacccaggctggagtgcagtggcatgatctcagctcactgaaacctctgcctcctgggttcaagcaattctcctgcctcagcctcccgagtagctgggactacaggcgtgtgccaacacgcccggctaattttttgtatttttattagagacggagtttcaccgtgttagccaggatggtctcgatcgcttgacctcgtgatccaccctcctcggcctcccaaagtgctgggattacaggtgtgagccaccgcgcccggcctcattcccctcatttttgaccgtaaggatttcccctttcttgtaagttctgctatgtatttaaaagaatgttttctacattttatccagcatttctctgtgttctgttggaagggaagggcttaggtatctagtttgatacataggtagaagtggaacatttctctgtcccccagctgtcatcatataagataaacatcagataaaaagccacctgaaagtaaaactactgactcgtgtattagtgagtataatctcttctccatccttaggaaaatgttcatcccagctgcggagattaacaaatgggtgattgagctttctcctcgtatttggaccttgaaggttatataaatttttttcttatgaagagttggcatttctttttattgccaatggcaggcactcattcatatttgatctcctcaccttcccctcccctaaaaccaatctccagaactttttggactataaatttcttggtttgacttctggagaactgttcagaatattactttgcatttcaaattacaaacttaccttggtgtatctttttcttacaagctgcctaaatgaatatttggtatatattggtagttttattactatagtaaatcaaggaaatgcagtaaacttaaaatgtctttaagaaagccctgaaatcttcatgggtgaaattagaaattatcaactagataatagtatagataaatgaatttgtagctaattcttgctagttgttgcatccagagagctttgaataacatcattaatctactctttagccttgcatggtatgctatgaggctcctgttctgttcaagtattctaatcaatggctttgaaaagtttatcaaatttacatacagatcacaagcctaggagaaataactaattcacagatgacagaattaagattataaaagattttttttttgtaattttagtagagacagggttgccattgtattccagccttggcgacagagcaagactctgcctcaaaaaaaaaaaaaaaaaggttttggcaagctggaactctttctgcaaatgactaagatagaaaactgccaaggacaaatgaggagtagttagattttgaaaatattaatcatagaatagttgttgtatgctaagtcactgacccatattatgtacagcatttctgatctttactttgcaagattagtgatactatcccaatacactgctggagaaatcagaatttggagaaataagttgtccaaggcaagaagatagtaaattataagtacaagtgtaatatggacagtatctaacttgaaaagatttcaggcgaaaagaatctggggtttgccagtcagttgctcaaaaggtcaatgaaaaccaaatagtgaagctatcagagaagctaataaattatagactgcttgaacagttgtgtccagattaagggagataatagctttcccaccctactttgtgcaggtcatacctccccaaagtgtttacctaatcagtaggttcacaaactcttggtcattatagtatatgcctaaaatgtatgcacttaggaatgctaaaaatttaaatatggtctaaagcaaataaaagcaaagaggaaaaactttggacagcgtaaagactagaatagtcttttaaaaagaaagccagtatattggtttgaaatatagagatgtgtcccaatttcaagtattttaattgcaccttaatgaaattatctattttctatagattttagtactattgaatgtattactttactgttacctgaatttattataaagtgtttttgaataaataattctaaaagc

SEQ ID NO: 912 - DNA, 1511 bp, Homo sapiens
agattgatcacttattcattagtaatttaccagagattgtggtggagttattgatgacgttacatgagccagcaaattctagtgccagtcagagcactgacctctgtgacttttcaggggatttggatcctgctcctaatccacctcattttccatcgcatgtgattaaagcaacatttgcctatatcagcaattgtcataaaaccaagttaaaaagcattttagaaattctttccaaaagccctgattcctatcagaaaattcttcttgccatatgtgagcaagcagctgaaacaaataatgtttataagaagcacagaattcttaaaatatatcacctgtttgttagtttattactgaaagatataaaaagtggcttaggaggagcttgggcctttgttcttcgagacgttatttatactttgattcactatatcaaccaaaggaaattaaccattttctctcagtaagtgtttatgatgcacttccattgacaagacttgaaggactaaaggatcttcgaagacaactggaactacataaagatcagatggtggacattatgagagcttctcagggtgctaattttaaatgacatgggctatttctacctgtttctttttgaaagaatattttgcaaagtcttgctcttggtttcattgtcacagacttagttcagactctcatcatttagttcagaccctcatttctcatctaactgtaaaactggtcctaactggtcttctcaccctgaactcttcctgttttattcatcctctgccagatgatttctctaaacccaaatatgatcatgtttttctactgcctaaattttttttttaagagacagagtttttttttttttttaagagtctcactctgtcacctaggctggagtgtagtggcaccatcataacttactatgaccttgaattcctgggtacaaggaattctcctgtctcagccttctgaatagctggaacaacaggcacacaccactacacctagctactttatttattttttttattttttgtagggacaggggtcccactatgttgcctaggttggtctcgaattcttggcctcaagtgatcctcctgccttagcctcacaaagcattgggattagaggtgtgagccacggcatctagccatgcttaaacatttttcatttctttttctttttttttaagacggagtttcgctcttgttgcccaggctggaatgcagtggcactatcttagctcactgcaacctccacctcctgagctcagattctcgtgcctcagccttcctagtagctaggattacaggcacctgccaccatgcctggctaattttttgtattttttttagtagagacggggtttcaccatgttggccagggtggtctcaaactcctgagctcaggcaatccgcccacctcagcctcccaaagtgctgggattacaggcatgagccaccgcggctggcccatgcttaaacatttttaacaccttccaaccatgt

SEQ ID NO: 913 - DNA, 12954 bp, Homo sapiens
gcgagaggagtcgggatctgcgctgcagccaccgccgcggttgatactactttgaccttccgagtgcagtgaggcatacatcacaatttggaattatgcattggtttatcaatttacttgtttattgtcaccctgctgcccagatatgacttcatgaggacagtgatgtgtgttctgaaattgtgaaccatgagtctagtacttaatgatctgcttatctgctgccgtcaactagaacatgatagagctacagaacgaaagaaagaagttgagaaatttaagcgcctgattcgagatcctgaaacaattaaacatctagatcggcattcagattccaaacaaggaaaatatttgaattgggatgctgtttttagatttttacagaaatatattcagaaagaaacagaatgtctgagaatagcaaaaccaaatgtatcagcctcaacacaagcctccaggcagaaaaagatgcaggaaatcagtagtttggtcaaatacttcatcaaatgtgcaaacagaagagcacctaggctaaaatgtcaagaactcttaaattatatcatggatacagtgaaagattcatctaatggtgctatttacggagctgattgtagcaacatactactcaaagacattctttctgtgagaaaatactggtgtgaaatatctcagcaacagtggttagaattgttctctgtgtacttcaggctctatctgaaaccttcacaagatgttcatagagttttagtggctagaataattcatgctgttaccaaaggatgctgttctcagactgacggattaaattccaaatttttggactttttttccaaggctattcagtgtgcgagacaagaaaagagctcttcaggtctaaatcatatcttagcagctcttactatcttcctcaagactttggctgtcaactttcgaattcgagtgtgtgaattaggagatgaaattcttcccactttgctttatatttggactcaacataggcttaatgattctttaaaagaagtcattattgaattatttcaactgcaaatttatatccatcatccgaaaggagccaaaacccaagaaaaaggtgcttatgaatcaacaaaatggagaagtattttatacaacttatatgatctgctagtgaatgagataagtcatataggaagtagaggaaagtattcttcaggatttcgtaatattgccgtcaaagaaaatttgattgaattgatggcagatatctgtcaccaggtttttaatgaagataccagatccttggagatttctcaatcttacactactacacaaagagaatctagtgattacagtgtcccttgcaaaaggaagaaaatagaactaggctgggaagtaataaaagatcaccttcagaagtcacagaatgattttgatcttgtgccttggctacagattgcaacccaattaatatcaaagtatcctgcaagtttacctaactgtgagctgtctccattactgatgatactatctcagcttctaccccaacagcgacatggggaacgtacaccatatgtgttacgatgccttacggaagttgcattgtgtcaagacaagaggtcaaacctagaaagctcacaaaagtcagatttattaaaactctggaataaaatttggtgtattacctttcgtggtataagttctgagcaaatacaagctgaaaactttggcttacttggagccataattcagggtagtttagttgaggttgacagagaattctggaagttatttactgggtcagcctgcagaccttcatgtcctgcagtatgctgtttgactttggcactgaccaccagtatagttccaggaacggtaaaaatgggaatagagcaaaatatgtgtgaagtaaatagaagcttttctttaaaggaatcaataatgaaatggctcttattctatcagttagagggtgacttagaaaatagcacagaagtgcctccaattcttcacagtaattttcctcatcttgtactggagaaaattcttgtgagtctcactatgaaaaactgtaaagctgcaatgaattttttccaaagcgtgccagaatgtgaacaccaccaaaaagataaagaagaactttcattctcagaagtagaagaactatttcttcagacaacttttgacaagatggactttttaaccattgtgagagaatgtggtatagaaaagcaccagtccagtattggcttctctgtccaccagaatctcaaggaatcactggatcgctgtcttctgggattatcagaacagcttctgaataattactcatctgagattacaaattcagaaactcttgtccggtgttcacgtcttttggtgggtgtccttggctgctactgttacatgggtgtaatagctgaagaggaagcatataagtcagaattattccagaaagccaagtctctaatgcaatgtgcaggagaaagtatcactctgtttaaaaataagacaaatgaggaattcagaattggttccttgagaaatatgatgcagctatgtacacgttgcttgagcaactgtaccaagaagagtccaaataagattgcatctggctttttcctgcgattgttaacatcaaagctaatgaatgacattgcagatatttgtaaaagtttagcatccttcatcaaaaagccatttgaccgtggagaagtagaatcaatggaagatgatactaatggaaatctaatggaggtggaggatcagtcatccatgaatctatttaacgattaccctgatagtagtgttagtgatgcaaacgaacctggagagagccaaagtaccataggtgccattaatcctttagctgaagaatatctgtcaaagcaagatctacttttcttagacatgctcaagttcttgtgtttgtgtgtaactactgctcagaccaatactgtgtcctttagggcagctgatattcggaggaaattgttaatgttaattgattctagcacgctagaacctaccaaatccctccacctgcatatgtatctaatgcttttaaaggagcttcctggagaagagtaccccttgccaatggaagatgttcttgaacttctgaaaccactatccaatgtgtgttctttgtatcgtcgtgaccaagatgtttgtaaaactattttaaaccatgtccttcatgtagtgaaaaacctaggtcaaagcaatatggactctgagaacacaagggatgctcaaggacagtttcttacagtaattggagcattttggcatctaacaaaggagaggaaatatatattctctgtaagaatggccctagtaaattgccttaaaactttgcttgaggctgatccttattcaaaatgggccattcttaatgtaatgggaaaagactttcctgtaaatgaagtatttacacaatttcttgctgacaatcatcaccaagttcgcatgttggctgcagagtcaatcaatagattgttccaggacacgaagggagattcttccaggttactgaaagcacttcctttgaagcttcagcaaacagcttttgaaaatgcatacttgaaagctcaggaaggaatgagagaaatgtcccatagtgctgagaaccctgaaactttggatgaaatttataatagaaaatctgttttactgacgttgatagctgtggttttatcctgtagccctatctgcgaaaaacaggctttgtttgccctgtgtaaatctgtgaaagagaatggattagaacctcaccttgtgaaaaaggttttagagaaagtttctgaaacttttggatatagacgtttagaagactttatggcatctcatttagattatctggttttggaatggctaaatcttcaagatactgaatacaacttatcttcttttccttttattttattaaactacacaaatattgaggatttctatagatcttgttataaggttttgattccacatctggtgattagaagtcattttgatgaggtgaagtccattgctaatcagattcaagaggactggaaaagtcttctaacagactgctttccaaagattcttgtaaatattcttccttattttgcctatgagggtaccagagacagtgggatggcacagcaaagagagactgctaccaaggtctatgatatgcttaaaagtgaaaacttattgggaaaacagattgatcacttattcattagtaatttaccagagattgtggtggagttattgatgacgttacatgagccagcaaattctagtgccagtcagagcactgacctctgtgacttttcaggggatttggatcctgctcctaatccacctcattttccatcgcatgtgattaaagcaacatttgcctatatcagcaattgtcataaaaccaagttaaaaagcattttagaaattctttccaaaagccctgattcctatcagaaaattcttcttgccatatgtgagcaagcagctgaaacaaataatgtttataagaagcacagaattcttaaaatatatcacctgtttgttagtttattactgaaagatataaaaagtggcttaggaggagcttgggcctttgttcttcgagacgttatttatactttgattcactatatcaaccaaaggccttcttgtatcatggatgtgtcattacgtagcttctccctttgttgtgacttattaagtcaggtttgccagacagccgtgacttactgtaaggatgctctagaaaaccatcttcatgttattgttggtacacttataccccttgtgtatgagcaggtggaggttcagaaacaggtattggacttgttgaaatacttagtgatagataacaaggataatgaaaacctctatatcacgattaagcttttagatccttttcctgaccatgttgtttttaaggatttgcgtattactcagcaaaaaatcaaatacagtagaggacccttttcactcttggaggaaattaaccattttctctcagtaagtgtttatgatgcacttccattgacaagacttgaaggactaaaggatcttcgaagacaactggaactacataaagatcagatggtggacattatgagagcttctcaggataatccgcaagatgggattatggtgaaactagttgtcaatttgttgcagttatccaagatggcaataaaccacactggtgaaaaagaagttctagaggctgttggaagctgcttgggagaagtgggtcctatagatttctctaccatagctatacaacatagtaaagatgcatcttataccaaggcccttaagttatttgaagataaagaacttcagtggaccttcataatgctgacctacctgaataacacactggtagaagattgtgtcaaagttcgatcagcagctgttacctgtttgaaaaacattttagccacaaagactggacatagtttctgggagatttataagatgacaacagatccaatgctggcctatctacagccttttagaacatcaagaaaaaagtttttagaagtacccagatttgacaaagaaaacccttttgaaggcctggatgatataaatctgtggattcctctaagtgaaaatcatgacatttggataaagacactgacttgtgcttttttggacagtggaggcacaaaatgtgaaattcttcaattattaaagccaatgtgtgaagtgaaaactgacttttgtcagactgtacttccatacttgattcatgatattttactccaagatacaaatgaatcatggagaaatctgctttctacacatgttcagggatttttcaccagctgtcttcgacacttctcgcaaacgagccgatccacaacccctgcaaacttggattcagagtcagagcactttttccgatgctgtttggataaaaaatcacaaagaacaatgcttgctgttgtggactacatgagaagacaaaagagaccttcttcaggaacaatttttaatgatgctttctggctggatttaaattatctagaagttgccaaggtagctcagtcttgtgctgctcactttacagctttactctatgcagaaatctatgcagataagaaaagtatggatgatcaagagaaaagaagtcttgcatttgaagaaggaagccagaatacaactatttctagcttgagtgaaaaaagtaaagaagaaactggaataagtttacaggatcttctcttagaaatctacagaagtataggggagccagatagtttgtatggctgtggtggagggaagatgttacaacccattactagactacgaacatatgaacacgaagcaatgtggggcaaagccctagtaacatatgacctcgaaacagcaatcccctcatcaacacgccaggcaggaatcattcaggccttgcagaatttgggactctgccatattctttccgtctatttaaaaggattggattatgaaaataaagactggtgtcctgaactagaagaacttcattaccaagcagcatggaggaatatgcagtgggaccattgcacttccgtcagcaaagaagtagaaggaaccagttaccatgaatcattgtacaatgctctacaatctctaagagacagagaattctctacattttatgaaagtctcaaatatgccagagtaaaagaagtggaagagatgtgtaagcgcagccttgagtctgtgtattcgctctatcccacacttagcaggttgcaggccattggagagctggaaagcattggggagcttttctcaagatcagtcacacatagacaactctctgaagtatatattaagtggcagaaacactcccagcttctcaaggacagtgattttagttttcaggagcctatcatggctctacgcacagtcattttggagatcctgatggaaaaggaaatggacaactcacaaagagaatgtattaaggacattctcaccaaacaccttgtagaactctctatactggccagaactttcaagaacactcagctccctgaaagggcaatatttcaaattaaacagtacaattcagttagctgtggagtctctgagtggcagctggaagaagcacaagtattctgggcaaaaaaggagcagagtcttgccctgagtattctcaagcaaatgatcaagaagttggatgccagctgtgcagcgaacaatcccagcctaaaacttacatacacagaatgtctgagggtttgtggcaactggttagcagaaacgtgcttagaaaatcctgcggtcatcatgcagacctatctagaaaaggcagtagaagttgctggaaattatgatggagaaagtagtgatgagctaagaaatggaaaaatgaaggcatttctctcattagcccggttttcagatactcaataccaaagaattgaaaactacatgaaatcatcggaatttgaaaacaagcaagctctcctgaaaagagccaaagaggaagtaggtctccttagggaacataaaattcagacaaacagatacacagtaaaggttcagcgagagctggagttggatgaattagccctgcgtgcactgaaagaggatcgtaaacgcttcttatgtaaagcagttgaaaattatatcaactgcttattaagtggagaagaacatgatatgtgggtattccgactttgttccctctggcttgaaaattctggagtttctgaagtcaatggcatgatgaagagagacggaatgaagattccaacatataaatttttgcctcttatgtaccaattggctgctagaatggggaccaagatgatgggaggcctaggatttcatgaagtcctcaataatctaatctctagaatttcaatggatcacccccatcacactttgtttattatactggccttagcaaatgcaaacagagatgaatttctgactaaaccagaggtagccagaagaagcagaataactaaaaatgtgcctaaacaaagctctcagcttgatgaggatcgaacagaggctgcaaatagaataatatgtactatcagaagtaggagacctcagatggtcagaagtgttgaggcactttgtgatgcttatattatattagcaaacttagatgccactcagtggaagactcagagaaaaggcataaatattccagcagaccagccaattactaaacttaagaatttagaagatgttgttgtccctactatggaaattaaggtggaccacacaggagaatatggaaatctggtgactatacagtcatttaaagcagaatttcgcttagcaggaggtgtaaatttaccaaaaataatagattgtgtaggttccgatggcaaggagaggagacagcttgttaagggccgtgatgacctgagacaagatgctgtcatgcaacaggtcttccagatgtgtaatacattactgcagagaaacacggaaactaggaagaggaaattaactatctgtacttataaggtggttcccctctctcagcgaagtggtgttcttgaatggtgcacaggaactgtccccattggtgaatttcttgttaacaatgaagatggtgctcataaaagatacaggccaaatgatttcagtgcctttcagtgccaaaagaaaatgatggaggtgcaaaaaaagtcttttgaagagaaatatgaagtcttcatggatgtttgccaaaattttcaaccagttttccgttacttctgcatggaaaaattcttggatccagctatttggtttgagaagcgattggcttatacgcgcagtgtagctacttcttctattgttggttacatacttggacttggtgatagacatgtacagaatatcttgataaatgagcagtcagcagaacttgtacatatagatctaggtgttgcttttgaacagggcaaaatccttcctactcctgagacagttccttttagactcaccagagatattgtggatggcatgggcattacgggtgttgaaggtgtcttcagaagatgctgtgagaaaaccatggaagtgatgagaaactctcaggaaactctgttaaccattgtagaggtccttctatatgatccactctttgactggaccatgaatcctttgaaagctttgtatttacagcagaggccggaagatgaaactgagcttcaccctactctgaatgcagatgaccaagaatgcaaacgaaatctcagtgatattgaccagagtttcaacaaagtagctgaacgtgtcttaatgagactacaagagaaactgaaaggagtggaagaaggcactgtgctcagtgttggtggacaagtgaatttgctcatacagcaggccatagaccccaaaaatctcagccgacttttcccaggatggaaagcttgggtgtgatcttcagtatatgaattaccctttcattcagcctttagaaattatattttagcctttatttttaacctgccaacatactttaagtagggattaatatttaagtgaactattgtgggtttttttgaatgttggttttaatacttgatttaatcaccactcaaaaatgttttgatggtcttaaggaacatctctgctttcactctttagaaataatggtcattcgggctgggcgcagcggctcacgcctgtaatcccagcactttgggaggccgaggtgagcggatcacaaggtcaggagttcgagaccagcctggccaagagaccagcctggccagtatggtgaaaccctgtctctactaaaaatacaaaaattagccgagcatggtggcgggcacctgtaatcccagctactcgagaggctgaggcaggagaatctcttgaacctgggaggtgaaggttgctgtgggccaaaatcatgccattgcactccagcctgggtgacaagagcgaaactccatctcaaaaaaaaaaaaaaaaaaacagaaacgtatttggatttttcctagtaagatcactcagtgttactaaataatgaagttgttatggagaacaaatttcaaagacacagttagtgtagttactatttttttaagtgtgtattaaaacttctcattctattctctttatcttttaagcccttctgtactgtccatgtatgttatctttctgtgataacttcatagattgccttctagttcatgaattctcttgtcagatgtatataatctcttttaccctatccattgggcttcttctttcagaaattgtttttcatttctaattatgcatcatttttcagatctctgtttcttgatgtcatttttaatgtttttttaatgttttttatgtcactaattattttaaatgtctgtacttgatagacactgtaatagttctattaaatttagttcctgctgtttatatctgttgatttttgtatttgataggctgttcatccagttttgtctttttgaaaagtgagtttattttcagcaaggctttatctatgggaatcttgagtgtctgtttatgtcatattcccagggctgttgctgcacacaagcccattcttattttaatttcttggctttagggtttccatacctgaagtgtagcataaatactgataggagatttcccaggccaaggcaaacacacttcctcctcatctccttgtgctagtgggcagaatatttgattgatgcctttttcactgagagtataagcttccatgtgtcccacctttatggcaggggtggaaggaggtacatttaattcccactgcctgcctttggcaagccctgggttctttgctccccatatagatgtctaagctaaaagccgtgggttaatgagactggcaaattgttccaggacagctacagcatcagctcacatattcacctctctggtttttcattcccctcatttttttctgagacagagtcttgctctgtcacccaggctggagtgcagtggcatgatctcagctcactgaaacctctgcctcctgggttcaagcaattctcctgcctcagcctcccgagtagctgggactacaggcgtgtgccaacacgcccggctaattttttgtatttttattagagacggagtttcaccgtgttagccaggatggtctcgatcgcttgacctcgtgatccaccctcctcggcctcccaaagtgctgggattacaggtgtgagccaccgcgcccggcctcattcccctcatttttgaccgtaaggatttcccctttcttgtaagttctgctatgtatttaaaagaatgttttctacattttatccagcatttctctgtgttctgttggaagggaagggcttaggtatctagtttgatacataggtagaagtggaacatttctctgtcccccagctgtcatcatataagataaacatcagataaaaagccacctgaaagtaaaactactgactcgtgtattagtgagtataatctcttctccatccttaggaaaatgttcatcccagctgcggagattaacaaatgggtgattgagctttctcctcgtatttggaccttgaaggttatataaatttttttcttatgaagagttggcatttctttttattgccaatggcaggcactcattcatatttgatctcctcaccttcccctcccctaaaaccaatctccagaactttttggactataaatttcttggtttgacttctggagaactgttcagaatattactttgcatttcaaattacaaacttaccttggtgtatctttttcttacaagctgcctaaatgaatatttggtatatattggtagttttattactatagtaaatcaaggaaatgcagtaaacttaaaatgtctttaagaaagccctgaaatcttcatgggtgaaattagaaattatcaactagataatagtatagataaatgaatttgtagctaattcttgctagttgttgcatccagagagctttgaataacatcattaatctactctttagccttgcatggtatgctatgaggctcctgttctgttcaagtattctaatcaatggctttgaaaagtttatcaaatttacatacagatcacaagcctaggagaaataactaattcacagatgacagaattaagattataaaagattttttttttgtaattttagtagagacagggttgccattgtattccagccttggcgacagagcaagactctgcctcaaaaaaaaaaaaaaaaaggttttggcaagctggaactctttctgcaaatgactaagatagaaaactgccaaggacaaatgaggagtagttagattttgaaaatattaatcatagaatagttgttgtatgctaagtcactgacccatattatgtacagcatttctgatctttactttgcaagattagtgatactatcccaatacactgctggagaaatcagaatttggagaaataagttgtccaaggcaagaagatagtaaattataagtacaagtgtaatatggacagtatctaacttgaaaagatttcaggcgaaaagaatctggggtttgccagtcagttgctcaaaaggtcaatgaaaaccaaatagtgaagctatcagagaagctaataaattatagactgcttgaacagttgtgtccagattaagggagataatagctttcccaccctactttgtgcaggtcatacctccccaaagtgtttacctaatcagtaggttcacaaactcttggtcattatagtatatgcctaaaatgtatgcacttaggaatgctaaaaatttaaatatggtctaaagcaaataaaagcaaagaggaaaaactttggacagcgtaaagactagaatagtcttttaaaaagaaagccagtatattggtttgaaatatagagatgtgtcccaatttcaagtattttaattgcaccttaatgaaattatctattttctatagattttagtactattgaatgtattactttactgttacctgaatttattataaagtgtttttgaataaataattctaaaagcata

SEQ ID NO: 914 - DNA, 481 bp, Homo sapiens
aaaagaagccgtggccgcgggaggaggcgagaggagtcgggatctgcgctgcagccaccgccgcggttgatactactttgaccttccgagtgcagtgtctcgctctgtcgcccatgctggagtgcaattgcgtgatctcagctaactgcactttccgcctcctgggttcaaacagtgatgtgtgttctgaaattgtgaaccatgagtctagtacttaatgatctgcttatctgctgccgtcaactagaacatgatagagctacagaacgaaagaaagaagttgagaaatttaagcgcctgattcgagatcctgaaacaattaaacatctagatcggcattcagattccaaacaaggaaaatatttgaattgggatgctgtttttagatttttacagaaatatattcagaaagaaacagaatgtctgagaatagcaaaaccaaatgtatcagcctcaacacaagcctccaggcagaaaaaga

SEQ ID NO: 915 - DNA, 8249 bp, Homo sapiens
ttccgggaggagttttggcctccacacggctccgtcgggcgccgcgctcttccggcagcggtagctttggagacgccgggaacccgcgttggcgtggttgactagtgcctcgcagcctcagcatgggggaacatggcctggagctggcttccatgatccccgccctgcgggagctgggcagtgccacaccagaggaatataatacagttgtacagaagccaagacaaattctgtgtcaattcattgaccggatacttacagatgtaaatgttgttgctgtagaacttgtaaagaaaactgactctcagccaacctccgtgatgttgcttgatttcatccagcatatcatgaaatcctccccacttatgtttgtaaatgtgagtggaagccatgaggccaaaggcagttgtattgaattcagtaattggatcataacgagacttctgcggattgcagcaactccctcctgtcatttgttacacaagaaaatctgtgaagtcatctgttcattattatttctttttaaaagcaagagtcctgctatttttggggtactcacaaaagaattattacaactttttgaagacttggtttacctccatagaagaaatgtgatgggtcatgctgtggaatggccagtggtcatgagccgatttttaagtcaattagatgaacacatgggatatttacaatcagctcctttgcagttgatgagtatgcaaaatttagaatttattgaagtcactttattaatggttcttactcgtattattgcaattgtgttttttagaaggcaagaactcttactttggcagataggttgtgttctgctagagtatggtagtccaaaaattaaatccctagcaattagctttttaacagaactttttcagcttggaggactaccagcacaaccagctagcacttttttcagctcatttttggaattattaaaacaccttgtagaaatggatactgaccaattgaaactctatgaagagccattatcaaagctgataaagacactatttccctttgaagcagaagcttatagaaatattgaacctgtctatttaaatatgctgctggaaaaactctgtgtcatgtttgaagacggtgtgctcatgcggcttaagtctgatttgctaaaagcagctttgtgccatttactgcagtatttccttaaatttgtgccagctgggtatgaatctgctttacaagtcaggaaggtctatgtgagaaatatttgtaaagctcttttggatgtgcttggaattgaggtagatgcagagtacttgttgggcccactttatgcagctttgaaaatggaaagtatggaaatcattgaggagattcaatgccaaactcaacaggaaaacctcagcagtaatagtgatggaatatcacccaaaaggcgtcgtctcagctcgtctctaaacccttctaaaagagcaccaaaacagactgaggaaattaaacatgtggacatgaaccaaaagagcatattatggagtgcactgaaacagaaagctgaatcccttcagatttcccttgaatacagtggcctaaagaatcctgttattgagatgttagaaggaattgctgttgtcttacaactgactgctctgtgtactgttcattgttctcatcaaaacatgaactgccgtactttcaaggactgtcaacataaatccaagaagaaaccttctgtagtgataacttggatgtcattggatttttacacaaaagtgcttaagagctgtagaagtttgttagaatctgttcagaaactggacctggaggcaaccattgataaggtggtgaaaatttatgatgctttgatttatatgcaagtaaacagttcatttgaagatcatatcctggaagatttatgtggtatgctctcacttccatggatttattcccattctgatgatggctgtttaaagttgaccacatttgccgctaatcttctaacattaagctgtaggatttcagatagctattcaccacaggcacaatcacgatgtgtgtttcttctgactctgtttccaagaagaatattccttgagtggagaacagcagtttacaactgggccctgcagagctcccatgaagtaatccgggctagttgtgttagtggattttttatcttattgcagcagcagaattcttgtaacagagttcccaagattcttatagataaagtcaaagatgattctgacattgtcaagaaagaatttgcttctatacttggtcaacttgtctgtactcttcacggcatgttttatctgacaagttctttaacagaacctttctctgaacacggacatgtggacctcttctgtaggaacttgaaagccacttctcaacatgaatgttcatcttctcaactaaaagcttctgtctgcaagccattccttttcctactgaaaaaaaaaatacctagtccagtaaaacttgctttcatagataatctacatcatctttgtaagcatcttgattttagagaagatgaaacagatgtaaaagcagttcttggaactttattaaatttaatggaagatccagacaaagatgttagagtggcttttagtggaaatatcaagcacatattggaatccttggactctgaagatggatttataaaggagctttttgtcttaagaatgaaggaagcatatacacatgcccaaatatcaagaaataatgagctgaaggataccttgattcttacaacaggggatattggaagggccgcaaaaggagatttggtaccatttgcactcttacacttattgcattgtttgttatccaagtcagcatctgtctctggagcagcatacacagaaattagagctctggttgcagctaaaagtgttaaactgcaaagttttttcagccagtataagaaacccatctgtcagtttttggtagaatcccttcactctagtcagatgacagcacttccgaatactccatgccagaatgctgacgtgcgaaaacaagatgtggctcaccagagagaaatggctttaaatacgttgtctgaaattgccaacgttttcgactttcctgatcttaatcgttttcttactaggacattacaagttctactacctgatcttgctgccaaagcaagccctgcagcttctgctctcattcgaactttaggaaaacaattaaatgtcaatcgtagagagattttaataaacaacttcaaatatattttttctcatttggtctgttcttgttccaaagatgaattagaacgtgcccttcattatctgaagaatgaaacagaaattgaactggggagcctgttgagacaagatttccaaggattgcataatgaattattgctgcgtattggagaacactatcaacaggtttttaatggtttgtcaatacttgcctcatttgcatccagtgatgatccatatcagggcccgagagatatcatatcacctgaactgatggctgattatttacaacccaaattgttgggcattttggctttttttaacatgcagttactgagctctagtgttggcattgaagataagaaaatggccttgaacagtttgatgtctttgatgaagttaatgggacccaaacatgtcagttctgtgagggtgaagatgatgaccacactgagaactggccttcgattcaaggatgattttcctgaattgtgttgcagagcttgggactgctttgttcgctgcctggatcatgcttgtctgggctcccttctcagtcatgtaatagtagctttgttacctcttatacacatccagcctaaagaaactgcagctatcttccactacctcataattgaaaacagggatgctgtgcaagattttcttcatgaaatatattttttacctgatcatccagaattaaaaaagataaaagccgttctccaggaatacagaaaggagacctctgagagcactgatcttcagacaactcttcagctctctatgaaggccattcaacatgaaaatgtcgatgttcgtattcatgctcttacaagcttgaaggaaaccttgtataaaaatcaggaaaaactgataaagtatgcaacagacagtgaaacagtagaacctattatctcacagttggtgacagtgcttttgaaaggttgccaagatgcaaactctcaagctcggttgctctgtggggaatgtttaggggaattgggggcgatagatccaggtcgattagatttctcaacaactgaaactcaaggaaaagattttacatttgtgactggagtagaagattcaagctttgcctatggattattgatggagctaacaagagcttaccttgcgtatgctgataatagccgagctcaagattcagctgcctatgccattcaggagttgctttctatttatgactgtagagagatggagaccaacggcccaggtcaccaattgtggaggagatttcctgagcatgttcgggaaatactagaacctcatctaaataccagatacaagagttctcagaagtcaaccgattggtctggagtaaagaagccaatttacttaagtaaattgggtagtaactttgcagaatggtcagcatcttgggcaggttatcttattacaaaggttcgacatgatcttgccagtaaaattttcacctgctgtagcattatgatgaagcatgatttcaaagtgaccatctatcttcttccacatattctggtgtatgtcttactgggttgtaatcaagaagatcagcaggaggtttatgcagaaattatggcagttctaaagcatgacgatcagcataccataaatacccaagacattgcatctgatctgtgtcaactcagtacacagactgtgttctccatgcttgaccatctcacacagtgggcaaggcacaaatttcaggcactgaaagctgagaaatgtccacacagcaaatcaaacagaaataaggtagactcaatggtatctactgtggattatgaagactatcagagtgtaacccgttttctagacctcataccccaggatactctggcagtagcttcctttcgctccaaagcatacacacgagctgtaatgcactttgaatcatttattacagaaaagaagcaaaatattcaggaacatcttggatttttacagaaattgtatgctgctatgcatgaacctgatggagtggccggagtcagtgcaattagaaaggcagaaccatctctaaaagaacagatccttgaacatgaaagccttggcttgctgagggatgccactgcttgttatgacagggctattcagctagaaccagaccagatcattcattatcatggtgtagtaaagtccatgttaggtcttggtcagctgtctactgttatcactcaggtgaatggagtgcatgctaacaggtccgagtggacagatgaattaaacacgtacagagtggaagcagcttggaaattgtcacagtgggatttggtggaaaactatttggcagcagatggaaaatctacaacatggagtgtcagactgggacagctattattatcagccaaaaaaagagatatcacagctttttatgactcactgaaactagtgagagcagaacaaattgtacctctttcagctgcaagctttgaaagaggctcctaccaacgaggatatgaatatattgtgagattgcacatgttatgtgagttggagcatagcatcaaaccacttttccagcattctccaggtgacagttctcaagaagattctctaaactgggtagctcgactagaaatgacccagaattcctacagagccaaggagcctatcctggctctccggagggctttactaagcctcaacaaaagaccagattacaatgaaatggttggagaatgctggctgcagagtgccagggtagctagaaaggctggtcaccaccagacagcctacaatgctctccttaatgcaggggaatcacgactcgctgaactgtacgtggaaagggcaaagtggctctggtccaagggtgatgttcaccaggcactaattgttcttcaaaaaggtgttgaattatgttttcctgaaaatgaaaccccacctgagggtaagaacatgttaatccatggtcgagctatgctactagtgggccgatttatggaagaaacagctaactttgaaagcaatgcaattatgaaaaaatataaggatgtgaccgcgtgcctgccagaatgggaggatgggcatttttaccttgccaagtactatgacaaattgatgcccatggtcacagacaacaaaatggaaaagcaaggtgatctcatccggtatatagttcttcattttggcagatctctacaatatggaaatcagttcatatatcagtcaatgccacgaatgttaactctatggcttgattatggtacaaaggcatatgaatgggaaaaagctggccgctccgatcgtgtacaaatgaggaatgatttgggtaaaataaacaaggttatcacagagcatacaaactatttagctccatatcaatttttgactgctttttcacaattgatctctcgaatttgtcattctcacgatgaagtttttgttgtcttgatggaaataatagccaaagtatttctagcctatcctcaacaagcaatgtggatgatgacagctgtgtcaaagtcatcttatcccatgcgtgtgaacagatgcaaggaaatcctcaataaagctattcatatgaaaaaatccttagagaagtttgttggagatgcaactcgcctaacagataagcttctagaattgtgcaataaaccggttgatggaagtagttccacattaagcatgagcactcattttaaaatgcttaaaaagctggtagaagaagcaacatttagtgaaatcctcattcctctacaatcagtcatgatacctacacttccatcaattctgggtacccatgctaaccatgctagccatgaaccatttcctggacattgggcctatattgcagggtttgatgatatggtggaaattcttgcttctcttcagaaaccaaagaagatttctttaaaaggctcagatggaaagttctacatcatgatgtgtaagccaaaagatgacctgagaaaggattgtagactaatggaattcaattccttgattaataagtgcttaagaaaagatgcagagtctcgtagaagagaacttcatattcgaacatatgcagttattccactaaatgatgaatgtgggattattgaatgggtgaacaacactgctggtttgagacctattctgaccaaactatataaagaaaagggagtgtatatgacaggaaaagaacttcgccagtgtatgctaccaaagtcagcagctttatctgaaaaactcaaagtattccgagaatttctcctgcccaggcatcctcctatttttcatgagtggtttctgagaacattccctgatcctacatcatggtacagtagtagatcagcttactgccgttccactgcagtaatgtcaatggttggttatattctggggcttggagaccgtcatggtgaaaatattctctttgattctttgactggtgaatgcgtacatgtagatttcaattgtcttttcaataagggagaaacctttgaagttccagaaattgtgccatttcgcctgactcataatatggttaatggaatgggtcctatgggaacagagggtctttttcgaagagcatgtgaagttacaatgaggctgatgcgtgatcagcgagagcctttaatgagtgtcttaaagacttttctacatgatcctcttgtggaatggagtaaaccagtgaaagggcattccaaagcgccactgaatgaaactggagaagttgtcaatgaaaaggccaagacccatgttcttgacattgagcagcgactacaaggtgtaatcaagactcgaaatagagtgacaggactgccgttatctattgaaggacatgtgcattaccttatacaggaagctactgatgaaaacttactatgccagatgtatcttggttggactccatatatgtgaaatgaaattatgtaaaagaatatgttaataatctaaaagtaatgcatttggtatgaatctgtggttgtatctgttcaattctaaagtacaacataaatttacgttctcagcaactgttatttctctctgatcattaattatatgtaaaataatatacattcagttattaagaaataaactgctttcttaata

SEQ ID NO: 916 - DNA, 8056 bp, Homo sapiens
ttccgggaggagttttggcctccacacggctccgtcgggcgccgcgctcttccggcagcggtagctttggagacgccgggaacccgcgttggcgtggttgactagtgcctcgcagcctcagcatgggggaacatggcctggagctggcttccatgatccccgccctgcgggagctgggcagtgccacaccagaggaatataatacagttgtacagaagccaagacaaattctgtgtcaattcattgaccggatacttacagatgtaaatgttgttgctgtagaacttgtaaagaaaactgactctcagccaacctccgtgatgttgcttgatttcatccagcatatcatgaaatcctccccacttatgtttgtaaatgtgagtggaagccatgaggccaaaggcagttgtattgaattcagtaattggatcataacgagacttctgcggattgcagcaactccctcctgtcatttgttacacaagaaaatctgtgaagtcatctgttcattattatttctttttaaaagcaagagtcctgctatttttggggtactcacaaaagaattattacaactttttgaagacttggtttacctccatagaagaaatgtgatgggtcatgctgtggaatggccagtggtcatgagccgatttttaagtcaattagatgaacacatgggatatttacaatcagctcctttgcagttgatgagtatgcaaaatttagaatttattgaagtcactttattaatggttcttactcgtattattgcaattgtgttttttagaaggcaagaactcttactttggcagataggttgtgttctgctagagtatggtagtccaaaaattaaatccctagcaattagctttttaacagaactttttcagcttggaggactaccagcacaaccagctagcacttttttcagctcatttttggaattattaaaacaccttgtagaaatggatactgaccaattgaaactctatgaagagccattatcaaagctgataaagacactatttccctttgaagcagaagcttatagaaatattgaacctgtctatttaaatatgctgctggaaaaactctgtgtcatgtttgaagacggtgtgctcatgcggcttaagtctgatttgctaaaagcagctttgtgccatttactgcagtatttccttaaatttgtgccagctgggtatgaatctgctttacaagtcaggaaggtctatgtgagaaatatttgtaaagctcttttggatgtgcttggaattgaggtagatgcagagtacttgttgggcccactttatgcagctttgaaaatggaaagtatggaaatcattgaggagattcaatgccaaactcaacaggaaaacctcagcagtaatagtgatggaatatcacccaaaaggcgtcgtctcagctcgtctctaaacccttctaaaagagcaccaaaacagactgaggaccgtactttcaaggactgtcaacataaatccaagaagaaaccttctgtagtgataacttggatgtcattggatttttacacaaaagtgcttaagagctgtagaagtttgttagaatctgttcagaaactggacctggaggcaaccattgataaggtggtgaaaatttatgatgctttgatttatatgcaagtaaacagttcatttgaagatcatatcctggaagatttatgtggtatgctctcacttccatggatttattcccattctgatgatggctgtttaaagttgaccacatttgccgctaatcttctaacattaagctgtaggatttcagatagctattcaccacaggcacaatcacgatgtgtgtttcttctgactctgtttccaagaagaatattccttgagtggagaacagcagtttacaactgggccctgcagagctcccatgaagtaatccgggctagttgtgttagtggattttttatcttattgcagcagcagaattcttgtaacagagttcccaagattcttatagataaagtcaaagatgattctgacattgtcaagaaagaatttgcttctatacttggtcaacttgtctgtactcttcacggcatgttttatctgacaagttctttaacagaacctttctctgaacacggacatgtggacctcttctgtaggaacttgaaagccacttctcaacatgaatgttcatcttctcaactaaaagcttctgtctgcaagccattccttttcctactgaaaaaaaaaatacctagtccagtaaaacttgctttcatagataatctacatcatctttgtaagcatcttgattttagagaagatgaaacagatgtaaaagcagttcttggaactttattaaatttaatggaagatccagacaaagatgttagagtggcttttagtggaaatatcaagcacatattggaatccttggactctgaagatggatttataaaggagctttttgtcttaagaatgaaggaagcatatacacatgcccaaatatcaagaaataatgagctgaaggataccttgattcttacaacaggggatattggaagggccgcaaaaggagatttggtaccatttgcactcttacacttattgcattgtttgttatccaagtcagcatctgtctctggagcagcatacacagaaattagagctctggttgcagctaaaagtgttaaactgcaaagttttttcagccagtataagaaacccatctgtcagtttttggtagaatcccttcactctagtcagatgacagcacttccgaatactccatgccagaatgctgacgtgcgaaaacaagatgtggctcaccagagagaaatggctttaaatacgttgtctgaaattgccaacgttttcgactttcctgatcttaatcgttttcttactaggacattacaagttctactacctgatcttgctgccaaagcaagccctgcagcttctgctctcattcgaactttaggaaaacaattaaatgtcaatcgtagagagattttaataaacaacttcaaatatattttttctcatttggtctgttcttgttccaaagatgaattagaacgtgcccttcattatctgaagaatgaaacagaaattgaactggggagcctgttgagacaagatttccaaggattgcataatgaattattgctgcgtattggagaacactatcaacaggtttttaatggtttgtcaatacttgcctcatttgcatccagtgatgatccatatcagggcccgagagatatcatatcacctgaactgatggctgattatttacaacccaaattgttgggcattttggctttttttaacatgcagttactgagctctagtgttggcattgaagataagaaaatggccttgaacagtttgatgtctttgatgaagttaatgggacccaaacatgtcagttctgtgagggtgaagatgatgaccacactgagaactggccttcgattcaaggatgattttcctgaattgtgttgcagagcttgggactgctttgttcgctgcctggatcatgcttgtctgggctcccttctcagtcatgtaatagtagctttgttacctcttatacacatccagcctaaagaaactgcagctatcttccactacctcataattgaaaacagggatgctgtgcaagattttcttcatgaaatatattttttacctgatcatccagaattaaaaaagataaaagccgttctccaggaatacagaaaggagacctctgagagcactgatcttcagacaactcttcagctctctatgaaggccattcaacatgaaaatgtcgatgttcgtattcatgctcttacaagcttgaaggaaaccttgtataaaaatcaggaaaaactgataaagtatgcaacagacagtgaaacagtagaacctattatctcacagttggtgacagtgcttttgaaaggttgccaagatgcaaactctcaagctcggttgctctgtggggaatgtttaggggaattgggggcgatagatccaggtcgattagatttctcaacaactgaaactcaaggaaaagattttacatttgtgactggagtagaagattcaagctttgcctatggattattgatggagctaacaagagcttaccttgcgtatgctgataatagccgagctcaagattcagctgcctatgccattcaggagttgctttctatttatgactgtagagagatggagaccaacggcccaggtcaccaattgtggaggagatttcctgagcatgttcgggaaatactagaacctcatctaaataccagatacaagagttctcagaagtcaaccgattggtctggagtaaagaagccaatttacttaagtaaattgggtagtaactttgcagaatggtcagcatcttgggcaggttatcttattacaaaggttcgacatgatcttgccagtaaaattttcacctgctgtagcattatgatgaagcatgatttcaaagtgaccatctatcttcttccacatattctggtgtatgtcttactgggttgtaatcaagaagatcagcaggaggtttatgcagaaattatggcagttctaaagcatgacgatcagcataccataaatacccaagacattgcatctgatctgtgtcaactcagtacacagactgtgttctccatgcttgaccatctcacacagtgggcaaggcacaaatttcaggcactgaaagctgagaaatgtccacacagcaaatcaaacagaaataaggtagactcaatggtatctactgtggattatgaagactatcagagtgtaacccgttttctagacctcataccccaggatactctggcagtagcttcctttcgctccaaagcatacacacgagctgtaatgcactttgaatcatttattacagaaaagaagcaaaatattcaggaacatcttggatttttacagaaattgtatgctgctatgcatgaacctgatggagtggccggagtcagtgcaattagaaaggcagaaccatctctaaaagaacagatccttgaacatgaaagccttggcttgctgagggatgccactgcttgttatgacagggctattcagctagaaccagaccagatcattcattatcatggtgtagtaaagtccatgttaggtcttggtcagctgtctactgttatcactcaggtgaatggagtgcatgctaacaggtccgagtggacagatgaattaaacacgtacagagtggaagcagcttggaaattgtcacagtgggatttggtggaaaactatttggcagcagatggaaaatctacaacatggagtgtcagactgggacagctattattatcagccaaaaaaagagatatcacagctttttatgactcactgaaactagtgagagcagaacaaattgtacctctttcagctgcaagctttgaaagaggctcctaccaacgaggatatgaatatattgtgagattgcacatgttatgtgagttggagcatagcatcaaaccacttttccagcattctccaggtgacagttctcaagaagattctctaaactgggtagctcgactagaaatgacccagaattcctacagagccaaggagcctatcctggctctccggagggctttactaagcctcaacaaaagaccagattacaatgaaatggttggagaatgctggctgcagagtgccagggtagctagaaaggctggtcaccaccagacagcctacaatgctctccttaatgcaggggaatcacgactcgctgaactgtacgtggaaagggcaaagtggctctggtccaagggtgatgttcaccaggcactaattgttcttcaaaaaggtgttgaattatgttttcctgaaaatgaaaccccacctgagggtaagaacatgttaatccatggtcgagctatgctactagtgggccgatttatggaagaaacagctaactttgaaagcaatgcaattatgaaaaaatataaggatgtgaccgcgtgcctgccagaatgggaggatgggcatttttaccttgccaagtactatgacaaattgatgcccatggtcacagacaacaaaatggaaaagcaaggtgatctcatccggtatatagttcttcattttggcagatctctacaatatggaaatcagttcatatatcagtcaatgccacgaatgttaactctatggcttgattatggtacaaaggcatatgaatgggaaaaagctggccgctccgatcgtgtacaaatgaggaatgatttgggtaaaataaacaaggttatcacagagcatacaaactatttagctccatatcaatttttgactgctttttcacaattgatctctcgaatttgtcattctcacgatgaagtttttgttgtcttgatggaaataatagccaaagtatttctagcctatcctcaacaagcaatgtggatgatgacagctgtgtcaaagtcatcttatcccatgcgtgtgaacagatgcaaggaaatcctcaataaagctattcatatgaaaaaatccttagagaagtttgttggagatgcaactcgcctaacagataagcttctagaattgtgcaataaaccggttgatggaagtagttccacattaagcatgagcactcattttaaaatgcttaaaaagctggtagaagaagcaacatttagtgaaatcctcattcctctacaatcagtcatgatacctacacttccatcaattctgggtacccatgctaaccatgctagccatgaaccatttcctggacattgggcctatattgcagggtttgatgatatggtggaaattcttgcttctcttcagaaaccaaagaagatttctttaaaaggctcagatggaaagttctacatcatgatgtgtaagccaaaagatgacctgagaaaggattgtagactaatggaattcaattccttgattaataagtgcttaagaaaagatgcagagtctcgtagaagagaacttcatattcgaacatatgcagttattccactaaatgatgaatgtgggattattgaatgggtgaacaacactgctggtttgagacctattctgaccaaactatataaagaaaagggagtgtatatgacaggaaaagaacttcgccagtgtatgctaccaaagtcagcagctttatctgaaaaactcaaagtattccgagaatttctcctgcccaggcatcctcctatttttcatgagtggtttctgagaacattccctgatcctacatcatggtacagtagtagatcagcttactgccgttccactgcagtaatgtcaatggttggttatattctggggcttggagaccgtcatggtgaaaatattctctttgattctttgactggtgaatgcgtacatgtagatttcaattgtcttttcaataagggagaaacctttgaagttccagaaattgtgccatttcgcctgactcataatatggttaatggaatgggtcctatgggaacagagggtctttttcgaagagcatgtgaagttacaatgaggctgatgcgtgatcagcgagagcctttaatgagtgtcttaaagacttttctacatgatcctcttgtggaatggagtaaaccagtgaaagggcattccaaagcgccactgaatgaaactggagaagttgtcaatgaaaaggccaagacccatgttcttgacattgagcagcgactacaaggtgtaatcaagactcgaaatagagtgacaggactgccgttatctattgaaggacatgtgcattaccttatacaggaagctactgatgaaaacttactatgccagatgtatcttggttggactccatatatgtgaaatgaaattatgtaaaagaatatgttaataatctaaaagtaatgcatttggtatgaatctgtggttgtatctgttcaattctaaagtacaacataaatttacgttctcagcaactgttatttctctctgatcattaattatatgtaaaataatatacattcagttattaagaaataaactgctttcttaat

SEQ ID NO: 917 - DNA, 2590 bp, Homo sapiens
gggcactcgcggcggaggcaagcggcggcgcgcggacggttggtccagttctccggcctggcggcaggcaagtctagctcggcgctgtcggatacttggggtgagcggaaagcatggcggggacctccgcgccaggcagcaagaggcggagcgagcccccggcgcctcgccccggcccgccgccgggcaccgggcaccccccgagcaagcgggcccggggcttctccgcagccgctgccccggaccctgacgacccgttcggcgcgcatggggacttcactgccgacgacctggaggagcttgacaccctcgcgtcacaggccctgagccaatgtccggccgcggctcgggacgtgtccagtgatcataaggtccacagattattagatggcatgtcaaaaaatccttcagggaaaaacagagaaactgttccaattaaagataatttcgaattagaggtacttcaggcacaatacaaagaacttaaagaaaagatgaaagtaatggaagaagaagttctcattaagaatggagaaattaaaattttgcgagactcactacatcagacggaatccgttctagaggaacagagaagatcacattttcttcttgagcaagagaaaacccaagcactcagtgacaaggaaaaggaattctccaaaaagctccaatcattgcagtctgaactccagtttaaagatgcagagatgaatgaattaaggacaaagctccagaccagtgaacgagcaaataaactggctgctccctctgtttcccatgtcagtcctaggaaaaacccttctgtggttataaagccagaagcatgttctccacaatttggaaaaacatcttttcctacaaaggagtcttttagtgctaacatgtcccttccccacccctgccagacggagtcaggatacaagcctctggtgggcagagaggatagtaagccccacagtctgagaggtgactccataaaacaagaagaggcccagaaaagctttgttgacagctggagacagagatcaaacactcaaggttccattttgataaacctgctcctgaagcagcctttgatcccagggtcatccctaagcctttgccacctcctgagtagtagttctgagtctcctgctggcacccccctgcagccaccagggtttggcagtaccttggctggaatgtcaggcctcaggaccacaggttcttatgatgggtcattttccctctcagccctgagagaagcacagaacctggcattcactggactgaatctggttgcccggaatgagtgctcacgtgatggagacccagcagagggaggcagaagggccttcccactctgccagcttcctggagccgtgcatttcctcccccttgtacagttcttcatcggcttacactgccaggccctgcaggacttggcagctgctaagagaagcggagcacctggggactcaccgacacattcctcctgcgtgagctctggggtagagaccaaccctgaggactcagtgtgcatcctggaaggcttctctgtgactgcacttagcattcttcagcacctggtgtgccacagcggagcagtcgtctccctattactgtcaggagtgggggcagattctgctgctggggaaggaaacaggagcctggttcacaggcttagtgatggagatatgacctcagccctaaggggggttgctgatgaccaaggacagcacccactgttgaagatgcttcttcacctgttggctttctcttctgcagcaacaggtcaccttcaagccagtgtcctgacccagtgccttaaggttttggtgaaattagccgaaaacacttcctgtgatttcttgcccaggttccagtgtgtgttccaagtgctgccaaagtgcctcagcccagagacacccctgcctagcgtgctgctggctgttgagctcctctccctgctggcggaccacgaccagctggcacctcagctctgttcccactcagaaggctgcctcctgctgctgctgtacatgtacatcacatcacggcctgacagagtggccttggagacacaatggctccagctggaacaagaggtggtgtggctcctggctaagcttggtgtgcagagccccttgcccccagtcactggctccaactgccagtgtaatgtggaggtggtcagagcgctcacggtgatgttgcacagacagtggctgacagtgcggagggcagggggacccccaaggaccgaccagcagaggcggacagtgcgctgtctgcgggacacggtgctgctgctgcacggcctatcgcagaaggacaagctcttcatgatgcactgcgtggaggtcctgcatcagtttgaccaggtgatgccgggggtcagcatgctcatccgagggcttcctgatgtgacggactgtgaagaggcagccctggatgacctctgtgccgcggaaaccgatgtggaagaccccgaggtggagtgtggctgaggccctgagtgtccagccacatggtggcaccagcaccactcctttccttaccacatcaactgattaaagcagtgaccagcaggaactgcccagagaactgg

SEQ ID NO: 918 - DNA, 2509 bp, Homo sapiens
gggcactcgcggcggaggcaagcggcggcgcgcggacggttggtccagttctccggcctggcggcaggcaagtctagctcggcgctgtcggatacttggggtgagcggaaagcatggcggggacctccgcgccaggcagcaagaggcggagcgagcccccggcgcctcgccccggcccgccgccgggcaccgggcaccccccgagcaagcgggcccggggcttctccgcagccgctgccccggaccctgacgacccgttcggcgcgcatggggacttcactgccgacgacctggaggagcttgacaccctcgcgtcacaggccctgagccaatgtccggccgcggctcgggacgtgtccagtgatcataaggtccacagattattagatggcatgtcaaaaaatccttcagggaaaaacagagaaactgttccaattaaagataatttcgaattagaggtacttcaggcacaatacaaagaacttaaagaaaagatgaaagtaatggaagaagaagttctcattaagaatggagaaattaaaattttgcgagactcactacatcagacggaatccgttctagaggaacagagaagatcacattttcttcttgagcaagagaaaacccaagcactcagtgacaaggaaaaggaattctccaaaaagctccaatcattgcagtctgaactccagtttaaagatgcagagatgaatgaattaaggacaaagctccagaccagtgaacgagcaaataaactggctgctccctctgtttcccatgtcagtcctaggaaaaacccttctgtggttataaagccagaagcatgttctccacaatttggaaaaacatcttttcctacaaaggagtcttttagtgctaacatgtcccttccccacccctgccagacggagtcaggatacaagcctctggtgggcagagaggatagtaagccccacagtctgagaggtgactccataaaacaagaagaggcccagaaaagctttgttgacagctggagacagagatcaaacactcaaggttccattttgataaacctgctcctgaagcagcctttgatcccagggtcatccctaagcctttgccacctcctgagtagtagttctgagtctcctgctggcacccccctgcagccaccagggtttggcagtaccttggctggaatgtcaggcctcaggaccacaggttcttatgatgggtcattttccctctcagccctgagagaagcacagaacctggcattcactggactgaatctggttgcccggaatgagtgctcacgtgatggagacccagcagagggaggcagaagggccttcccactctgccagcttcctggagccgtgcatttcctcccccttgtacagttcttcatcggcttacactgccaggccctgcaggacttggcagctgctaagagaagcggagcacctggggactcaccgacacattcctcctgcgtgagctctggggtagagaccaaccctgaggactcagtgtgcatcctggaaggcttctctgtgactgcacttagcattcttcagcacctggtgtgccacagcggagcagtcgtctccctattactgtcaggagtgggggcagattctgctgctggggaaggaaacaggagcctggttcacaggcttagtgatggagatatgacctcagccctaaggggggttgctgatgaccaaggacagcacccactgttgaagatgcttcttcacctgttggctttctcttctgcagcaacaggtcaccttcaagccagtgtcctgacccagtgccttaaggttttggtgaaattagccgaaaacacttcctgtgatttcttgcccaggttccagtgtgtgttccaagtgctgccaaagtgcctcagcccagagacacccctgcctagcgtgctgctggctgttgagctcctctccctgctggcggaccacgaccagctggcacctcagctctgttcccactcagaaggctgcctcctgctgctgctgtacatgtacatcacatcacggcctgacagagtggccttggagacacaatggctccagctggaacaagaggtggtcagagcgctcacggtgatgttgcacagacagtggctgacagtgcggagggcagggggacccccaaggaccgaccagcagaggcggacagtgcgctgtctgcgggacacggtgctgctgctgcacggcctatcgcagaaggacaagctcttcatgatgcactgcgtggaggtcctgcatcagtttgaccaggtgatgccgggggtcagcatgctcatccgagggcttcctgatgtgacggactgtgaagaggcagccctggatgacctctgtgccgcggaaaccgatgtggaagaccccgaggtggagtgtggctgaggccctgagtgtccagccacatggtggcaccagcaccactcctttccttaccacatcaactgattaaagcagtgaccagcaggaactgcccagagaactgg

SEQ ID NO: 919 - DNA, 2376 bp, Homo sapiens
actcgcggcggaggcaagcggcggcgcgcggacggttggtccagttctccggcctggcggcaggtgatcataaggtccacagattattagatggcatgtcaaaaaatccttcagggaaaaacagagaaactgttccaattaaagataatttcgaattagaggtacttcaggcacaatacaaagaacttaaagaaaagctttgcaagaaagcagacacttcatatcaccatctgtaggtccctaagaaaaccaggaatatgtggaattttagttgtgcaagatgaaagtaatggaagaagaagttctcattaagaatggagaaattaaaattttgcgagactcactacatcagacggaatccgttctagaggaacagagaagatcacattttcttcttgagcaagagaaaacccaagcactcagtgacaaggaaaaggaattctccaaaaagctccaatcattgcagtctgaactccagtttaaagatgcagagatgaatgaattaaggacaaagctccagaccagtgaacgagcaaataaactggctgctccctctgtttcccatgtcagtcctaggaaaaacccttctgtggttataaagccagaagcatgttctccacaatttggaaaaacatcttttcctacaaaggagtcttttagtgctaacatgtcccttccccacccctgccagacggagtcaggatacaagcctctggtgggcagagaggatagtaagccccacagtctgagaggtgactccataaaacaagaagaggcccagaaaagctttgttgacagctggagacagagatcaaacactcaaggttccattttgataaacctgctcctgaagcagcctttgatcccagggtcatccctaagcctttgccacctcctgagtagtagttctgagtctcctgctggcacccccctgcagccaccagggtttggcagtaccttggctggaatgtcaggcctcaggaccacaggttcttatgatgggtcattttccctctcagccctgagagaagcacagaacctggcattcactggactgaatctggttgcccggaatgagtgctcacgtgatggagacccagcagagggaggcagaagggccttcccactctgccagcttcctggagccgtgcatttcctcccccttgtacagttcttcatcggcttacactgccaggccctgcaggacttggcagctgctaagagaagcggagcacctggggactcaccgacacattcctcctgcgtgagctctggggtagagaccaaccctgaggactcagtgtgcatcctggaaggcttctctgtgactgcacttagcattcttcagcacctggtgtgccacagcggagcagtcgtctccctattactgtcaggagtgggggcagattctgctgctggggaaggaaacaggagcctggttcacaggcttagtgatggagatatgacctcagccctaaggggggttgctgatgaccaaggacagcacccactgttgaagatgcttcttcacctgttggctttctcttctgcagcaacaggtcaccttcaagccagtgtcctgacccagtgccttaaggttttggtgaaattagccgaaaacacttcctgtgatttcttgcccaggttccagtgtgtgttccaagtgctgccaaagtgcctcagcccagagacacccctgcctagcgtgctgctggctgttgagctcctctccctgctggcggaccacgaccagctggcacctcagctctgttcccactcagaaggctgcctcctgctgctgctgtacatgtacatcacatcacggcctgacagagtggccttggagacacaatggctccagctggaacaagaggtggtgtggctcctggctaagcttggtgtgcagagccccttgcccccagtcactggctccaactgccagtgtaatgtggaggtggtcagagcgctcacggtgatgttgcacagacagtggctgacagtgcggagggcagggggacccccaaggaccgaccagcagaggcggacagtgcgctgtctgcgggacacggtgctgctgctgcacggcctatcgcagaaggacaagctcttcatgatgcactgcgtggaggtcctgcatcagtttgaccaggtgatgccgggggtcagcatgctcatccgagggcttcctgatgtgacggactgtgaagaggcagccctggatgacctctgtgccgcggaaaccgatgtggaagaccccgaggtggagtgtggctgaggccctgagtgtccagccacatggtggcaccagcaccactcctttccttaccacatcaactgattaaagcagtgaccagcaggaactgcccagagaactgg

SEQ ID NO: 920 - DNA, 2721 bp, Homo sapiens
gtgagtgctcctcgcggccttttgctcggagggagttgtcaaccgcgccagatccccttgatggctgtggcttcggaacctcgcggccagcactgccttttcgcctttttaaaatatgggaacaccctgatttaagcagcggttgtcttccagaaggtcctttgattttagggggaaatgcattagccaggtcaaacagccgatttgaaacacagaaggctaagttgacattttacgttattttctaaagtttaggccacttggttcttggttctaagcagagatccttggaacacacctaccaccaccatcagaaccatcactacccatgcatggggacccattcttgtgacaagtttgagcggctttagatcttatgaagcccactgtctcccttgggcagtgtgagcatgggaggagccagacacaggtgatcataaggtccacagattattagatggcatgtcaaaaaatccttcagggaaaaacagagaaactgttccaattaaagataatttcgaattagaggtacttcaggcacaatacaaagaacttaaagaaaagatgaaagtaatggaagaagaagttctcattaagaatggagaaattaaaattttgcgagactcactacatcagacggaatccgttctagaggaacagagaagatcacattttcttcttgagcaagagaaaacccaagcactcagtgacaaggaaaaggaattctccaaaaagctccaatcattgcagtctgaactccagtttaaagatgcagagatgaatgaattaaggacaaagctccagaccagtgaacgagcaaataaactggctgctccctctgtttcccatgtcagtcctaggaaaaacccttctgtggttataaagccagaagcatgttctccacaatttggaaaaacatcttttcctacaaaggagtcttttagtgctaacatgtcccttccccacccctgccagacggagtcaggatacaagcctctggtgggcagagaggatagtaagccccacagtctgagaggtgactccataaaacaagaagaggcccagaaaagctttgttgacagctggagacagagatcaaacactcaaggttccattttgataaacctgctcctgaagcagcctttgatcccagggtcatccctaagcctttgccacctcctgagtagtagttctgagtctcctgctggcacccccctgcagccaccagggtttggcagtaccttggctggaatgtcaggcctcaggaccacaggttcttatgatgggtcattttccctctcagccctgagagaagcacagaacctggcattcactggactgaatctggttgcccggaatgagtgctcacgtgatggagacccagcagagggaggcagaagggccttcccactctgccagcttcctggagccgtgcatttcctcccccttgtacagttcttcatcggcttacactgccaggccctgcaggacttggcagctgctaagagaagcggagcacctggggactcaccgacacattcctcctgcgtgagctctggggtagagaccaaccctgaggactcagtgtgcatcctggaaggcttctctgtgactgcacttagcattcttcagcacctggtgtgccacagcggagcagtcgtctccctattactgtcaggagtgggggcagattctgctgctggggaaggaaacaggagcctggttcacaggcttagtgatggagatatgacctcagccctaaggggggttgctgatgaccaaggacagcacccactgttgaagatgcttcttcacctgttggctttctcttctgcagcaacaggtcaccttcaagccagtgtcctgacccagtgccttaaggttttggtgaaattagccgaaaacacttcctgtgatttcttgcccaggttccagtgtgtgttccaagtgctgccaaagtgcctcagcccagagacacccctgcctagcgtgctgctggctgttgagctcctctccctgctggcggaccacgaccagctggcacctcagctctgttcccactcagaaggctgcctcctgctgctgctgtacatgtacatcacatcacggcctgacagagtggccttggagacacaatggctccagctggaacaagaggtggtgtggctcctggctaagcttggtgtgcagagccccttgcccccagtcactggctccaactgccagtgtaatgtggaggtggtcagagcgctcacggtgatgttgcacagacagtggctgacagtgcggagggcagggggacccccaaggaccgaccagcagaggcggacagtgcgctgtctgcgggacacggtgctgctgctgcacggcctatcgcagaaggacaagctcttcatgatgcactgcgtggaggtcctgcatcagtttgaccaggtgatgccgggggtcagcatgctcatccgagggcttcctgatgtgacggactgtgaagaggcagccctggatgacctctgtgccgcggaaaccgatgtggaagaccccgaggtggagtgtggctgaggccctgagtgtccagccacatggtggcaccagcaccactcctttccttaccacatcaactgattaaagcagtgaccagcaggaactgcccagagaactggctggccttgtttcctgagtctgatctgtttggcggagtgggaggggtggagcaggacccgg

SEQ ID NO: 921 - DNA, 711 bp, Homo sapiens
gattggcccctgggccaggggcggggcactcgcggcggaggcaagcggcggcgcgcggacggttggtccagttctccggcctggcggcaggtgatcataaggtccacagattattagatggcatgtcaaaaaatccttcagggaaaaacagagaaactgttccaattaaagataatttcgaattagaggtacttcaggcacaatacaaagaacttaaagaaaagatgaaagtaatggaagaagaagttctcattaagaatggagaaattaaaattttgcgagactcactacatcagacggaatccgttctagaggaacagagaagatcacattttcttcttgagcaagagaaaacccaagcactcagtgacaaggaaaaggaattctccaaaaagctccaatcattgcagtctgaactccagtttaaagatgcagagatgaatgaattaaggacaaagctccagaccagtgaacgagcaaataaactggctgctccctctgtttcccatgtcagtcctaggaaaaacccttctgtggttataaagccagaagcatgttctccacaatttggaaaaacatcttttcctacaaaggagtcttttagtgctaacatgtcccttccccacccctgccagacggagtcaggatacaagcctctggtgggcagagaggatagtaagccccacagtctgagaggtgactccataaaac

SEQ ID NO: 922 - DNA, 5499 bp, Homo sapiens
cctctggcggcccgccgtcccagacgcgggaagagcttggccggtttcgagtcgctggcctgcagcttccctgtggtttcccgaggcttccttgcttcccgctctgcgaggagcctttcatccgaaggcgggacgatgccggataatcggcagccgaggaaccggcagccgaggatccgctccgggaacgagcctcgttccgcgcccgccatggaaccggatggtcgcggtgcctgggcccacagtcgcgccgcgctcgaccgcctggagaagctgctgcgctgctcgcgttgtactaacattctgagagagcctgtgtgtttaggaggatgtgagcacatcttctgtagtaattgtgtaagtgactgcattggaactggatgtccagtgtgttacaccccggcctggatacaagacttgaagataaatagacaactggacagcatgattcaactttgtagtaagcttcgaaatttgctacatgacaatgagctgtcagatttgaaagaagataaacctaggaaaagtttgtttaatgatgcaggaaacaagaagaattcaattaaaatgtggtttagccctcgaagtaagaaagtcagatatgttgtgagtaaagcttcagtgcaaacccagcctgcaataaaaaaagatgcaagtgctcagcaagactcatatgaatttgtttccccaagtcctcctgcagatgtttctgagagggctaaaaaggcttctgcaagatctggaaaaaagcaaaaaaagaaaactttagctgaaatcaaccaaaaatggaatttagaggcagaaaaagaagatggtgaatttgactccaaagaggaatctaagcaaaagctggtatccttctgtagccaaccatctgttatctccagtcctcagataaatggtgaaatagacttactagcaagtggctccttgacagaatctgaatgttttggaagtttaactgaagtctctttaccattggctgagcaaatagagtctccagacactaagagcaggaatgaagtagtgactcctgagaaggtctgcaaaaattatcttacatctaagaaatctttgccattagaaaataatggaaaacgtggccatcacaatagactttccagtcccatttctaagagatgtagaaccagcattctgagcaccagtggagattttgttaagcaaacggtgccctcagaaaatataccattgcctgaatgttcttcaccaccttcatgcaaacgtaaagttggtggtacatcagggaggaaaaacagtaacatgtccgatgaattcattagtctttcaccaggtacaccaccttctacattaagtagttcaagttacaggcgagtgatgtctagtccctcagcaatgaagctgttgcccaatatggctgtgaaaagaaatcatagaggagagactttgctccatattgcttctattaagggcgacataccttctgttgaataccttttacaaaatggaagtgatccaaatgttaaagaccatgctggatggacaccattgcatgaagcttgcaatcatgggcacctgaaggtagtggaattattgctccagcataaggcattggtgaacaccaccgggtatcaaaatgactcaccacttcacgatgcagccaagaatgggcatgtggatatagtcaagctgttactttcctatggagcctccagaaatgctgttaatatatttggtctgcggcctgtcgattatacagatgatgaaagtatgaaatcgctattgctgctaccagagaagaatgaatcatcctcagctagccactgctcagtaatgaacactgggcagcgtagggatggacctcttgtacttataggcagtgggctgtcttcagaacaacagaaaatgctcagtgagcttgcagtaattcttaaggctaaaaaatatactgagtttgacagtacagtaactcatgttgttgttcctggtgatgcagttcaaagtaccttgaagtgtatgcttgggattctcaatggatgctggattctaaaatttgaatgggtaaaagcatgtctacgaagaaaagtatgtgaacaggaagaaaagtatgaaattcctgaaggtccacgcagaagcaggctcaacagagaacagctgttgccaaagctgtttgatggatgctacttctatttgtggggaaccttcaaacaccatccaaaggacaaccttattaagctcgtcactgcaggtgggggccagatcctcagtagaaagcccaagccagacagtgacgtgactcagaccatcaatacagtcgcataccatgcgagacccgattctgatcagcgcttctgcacacagtatatcatctatgaagatttgtgtaattatcacccagagagggttcggcagggcaaagtctggaaggctccttcgagctggtttatagactgtgtgatgtcctttgagttgcttcctcttgacagctgaatattataccagatgaacatttcaaattgaatttgcacggtttgtgagagcccagtcattgtactgtttttaatgttcacatttttacaaataggtagagtcattcatatttgtctttgaatcaaaaaaaaaaaaaaagtctaatgccagattaggaattcatgttatgtttaccatttagaagctgggattgcttttaaaggtttttctttttaaaattggcatgtttttgatttatcatgtctttctattcagattattgggtatcaaagattaatgaggacaccagaatcttggttaaatagacaagtggtatcattactgtttgagtcttttaatattctccatacctgccaccagtgaaaaaacttgccttttttttttttttttttttagtaaacagaatattatcaaacaatttattttggctttattgaaaaaagagtatttggtctaaatgtgccaccataggtgttaaattctcctatctgcaattgtctttatcctatattgtgttcatttcttttcttaataatttactttgttgtgtgtttctacactttcatccctgttttttatcttgtatatcatcaggaaattgtgatttaatcattaacattggtttttttgtgtgtgtggtaaaaatcaacactaggctcatggtacatatttttattctgtacatttgcttgtaactatcaatttgtaactctgtttatctactacatgtgtatatatacttagagcattttctctaacacattttaatgttagtattttttaaaaggtctgaccagtctagcaaattgtcagtccaacgtcattactttaaattaagaagcagtcttcttctggtaaaccttgttggtatttgtaaaataattttgaaggtcttaatttcttcctttgtaaaaggaaaaggttttttttaaagtttttaggttggcatggaggcagaagttggtgattacttgatttacaacagattttttccagatcatacaaaaggccatacagtaagtatagaagtaggtatggggagggcttactaatatcaaataggcaaggccttagtgagtgggcaggataccacctgagagtggccagatgtggggaggttactctgctctgggtgctctcattcatgaatcgacaaggatacattagattattttgaaacatttttttaagaagcagaattctttaataattccttcctagacattgaatatacttataaaattaaagacttggggaaggagacactgagagacttgccagtttggttcctcatgaacaaaagaggacagtttgataactaccagaatagaatatccctagttttaaaatagtgagaatctctgaagttcatcaacatcttaagatgcacttacttgaaagtttgagattctgtttatcatttgaaaacacattttgctttaattctttctttgacatgttgttttttcatatcaagaaatatatgaacaaaataataaccttttgaccctgaccttgctgggtgaattagctctgaaacactctctacaaccagtaatgcatttgtcccacatttcattctgatagaaaatgaacaccatagcaccaaacaaaaatccgaggcgttagataatgtctggattaaataatttaagactctctaggattttggttgtcattttttatttataacagactttaagtcactttctgttgcctcataggtcacattttagacaggtttgtgtctgttccttgcatctgaattcctgattgtaaagacacctatgaggtctcttagtttttgtcattcattttcttggtttatcacccctcccttctttttgttgtttttccctgactgttaagcagtttcatctttgcttttgttaaatatttgacagcagttagtttgtgttaagctcttgaaacttgtgattgtactttctgtgtagatatacatgtaattattttttatttttcaatcatagattcaagcttccttcttttttaccacaaatcattaaagttatttgtgtttccatatacctgtgtcttgtataaaattggcttattctgtgctgttgaatgaggctcaacatgacttggtgaggaagtctattaactaacaaaagcttatcttttttaacataatgctttttaattaattttgaataaaaatatttctaaagtgtactagatactttattaccttagattattccgaatacagtataactttgatagtttggaatagtcattaagaaacaattacacactgattgctttgtgtctctaaaagtgagaggctggtagcttttccacattctcatggctattttctagttctacttgaatttataactgtttccctttttccttgacagctgccactttgtagctatttttctgtctctgctaatactttaccatatctatctcaattgttttttcttttgacttgctgaaaaatagaaaccagatgggaagtatattagcattatgattgaaataagggtaaatgagcaatgtgtgaaggttttcactgacttcacctaaaagatagtttagctacttgaattttagtaaatagaatttttcctttatttcatcggtccccccacctttttttttttttgcacctgccttgtaaatttaatagttaagtgacctctgcctagaggatgatatttggggaggtttgatgtttcctgtgggaataagacgattcacaggtgagagtggggccacattagctgttattgtttccatgggtcagtgtggaaaatgcattaatcatattctaaacgttcatgggcctcattacagtcacaattgtctattctgtttcctaccctgaacacattaaaatggtaggaactaatgcttgtcttatttaattactaaaagccaccattttctttgatagattgagctacagattgtaaacttcatgtatttctttataagtcaacccttttcaaagatacgcacatcaaactgaatgaataaataaatattgagaagttg

SEQ ID NO: 923 - DNA, 2257 bp, Homo sapiens
agagcttggccggtttcgagtcgctggcctgcagcttccctgtggtttcccgaggcttccttgcttcccgctctgcgaggagcctttcatccgaaggcgggacgatgccggataatcggcagccgaggaaccggcagccgaggatccgctccgggaacgagcctcgttccgcgcccgccatggaaccggatggtcgcggtgcctgggcccacagtcgcgccgcgctcgaccgcctggagaagctgctgcgctgctcgcgttgtactaacattctgagagagcctgtgtgtttaggaggatgtgagcacatcttctgtagatttgaaagaagataaacctaggaaaagtttgtttaatgatgcaggaaacaagaagaattcaattaaaatgtggtttagccctcgaagtaagaaagtcagatatgttgtgagtaaagcttcagtgcaaacccagcctgcaataaaaaaagatgcaagtgctcagcaagactcatatgaatttgtttccccaagtcctcctgcagatgtttctgagagggctaaaaaggcttctgcaagatctggaaaaaagcaaaaaaagaaaactttagctgaaatcaaccaaaaatggaatttagaggcagaaaaagaagatggtgaatttgactccaaagaggaatctaagcaaaagctggtatccttctgtagccaaccatctgttatctccagtcctcagataaatggtgaaatagacttactagcaagtggctccttgacagaatctgaatgttttggaagtttaactgaagtctctttaccattggctgagcaaatagagtctccagacactaagagcaggaatgaagtagtgactcctgagaaggtctgcaaaaattatcttacatctaagaaatctttgccattagaaaataatggaaaacgtggccatcacaatagactttccagtcccatttctaagagatgtagaaccagcattctgagcaccagtggagattttgttaagcaaacggtgccctcagaaaatataccattgcctgaatgttcttcaccaccttcatgcaaacgtaaagttggtggtacatcagggaggaaaaacagtaacatgtccgatgaattcattagtctttcaccaggtacaccaccttctacattaagtagttcaagttacaggcgagtgatgtctagtccctcagcaatgaagctgttgcccaatatggctgtgaaaagaaatcatagaggagagactttgctccatattgcttctattaagggcgacataccttctgttgaataccttttacaaaatggaagtgatccaaatgttaaagaccatgctggatggacaccattgcatgaagcttgcaatcatgggcacctgaaggtagtggaattattgctccagcataaggcattggtgaacaccaccgggtatcaaaatgactcaccacttcacgatgcagccaagaatgggcatgtggatatagtcaagctgttactttcctatggagcctccagaaatgctgttaatatatttggtctgcggcctgtcgattatacagatgatgaaagtatgaaatcgctattgctgctaccagagaagaatgaatcatcctcagctagccactgctcagtaatgaacactgggcagcgtagggatggacctcttgtacttataggcagtgggctgtcttcagaacaacagaaaatgctcagtgagcttgcagtaattcttaaggctaaaaaatatactgagtttgacagtacagtaactcatgttgttgttcctggtgatgcagttcaaagtaccttgaagtgtatgcttgggattctcaatggatgctggattctaaaatttgaatgggtaaaagcatgtctacgaagaaaagtatgtgaacaggaagaaaagtatgaaattcctgaaggtccacgcagaagcaggctcaacagagaacattgccaaagctgtttgatggatgctacttctatttgtggggaaccttcaaacaccatccaaaggacaaccttattaagctcgtcactgcaggtgggggccagatcctcagtagaaagcccaagccagacagtgacgtgactcagaccatcaatacagtcgcataccatgcgagacccgattctgatcagcgcttctgcacacagtatatcatctatgaagatttgtgtaattatcacccagagagggttcggcagggcaaagtctggaaggctccttcgagctggtttatagactgtgtgatgtc

SEQ ID NO: 924 - DNA, 4555 bp, Homo sapiens
aatcggaataggcaagcttccggcgggaagtgagccagggcttggcgcggcggccgtggttgcggcgcgggaagtttggatcctggttccgtccgctaggagtctgcgtgcgaggattatggctgctgttcctcaaaataatctacaggagcaactagaacgtcactcagccagaacacttaataataaattaagtctttcaaaaccaaaattttcaggtttcacttttaaaaagaaaacatcttcagataacaatgtatctgtaactaatgtgtcagtagcaaaaacacctgtattaagaaataaagatgttaatgttaccgaagacttttccttcagtgaacctctacccaacaccacaaatcagcaaagggtcaaggacttctttaaaaatgctccagcaggacaggaaacacagagaggtggatcaaaatcattattgccagatttcttgcagactccgaaggaagttgtatgcactacccaaaacacaccaactgtaaagaaatcccgggatactgctctcaagaaattagaatttagttcttcaccagattctttaagtaccatcaatgattgggatgatatggatgactttgatacttctgagacttcaaaatcatttgttacaccaccccaaagtcactttgtaagagtaagcactgctcagaaatcaaaaaagggtaagagaaacttttttaaagcacagctttatacaacaaacacagtaaagactgatttgcctccaccctcctctgaaagcgagcaaatagatttgactgaggaacagaaggatgactcagaatggttaagcagcgatgtgatttgcatcgatgatggccccattgctgaagtgcatataaatgaagatgctcaggaaagtgactctctgaaaactcatttggaagatgaaagagataatagcgaaaagaagaagaatttggaagaagctgaattacattcaactgagaaagttccatgtattgaatttgatgatgatgattatgatacggattttgttccaccttctccagaagaaattatttctgcttcttcttcctcttcaaaatgccttagtacgttaaaggaccttgacacctctgacagaaaagaggatgttcttagcacatcaaaagatcttttgtcaaaacctgagaaaatgagtatgcaggagctgaatccagaaaccagcacagactgtgacgctagacagataagtttacagcagcagcttattcatgtgatggagcacatctgtaaattaattgatactattcctgatgataaactgaaacttttggattgtgggaacgaactgcttcagcagcggaacataagaaggaaacttctaacggaagtagattttaataaaagtgatgccagtcttcttggctcattgtggagatacaggcctgattcacttgatggccctatggagggtgattcctgccctacagggaattctatgaaggagttaaatttttcacaccttccctcaaattctgtttctcctggggactgtttactgactaccaccctaggaaagacaggattctctgccaccaggaagaatctttttgaaaggcctttattcaatacccatttacagaagtcctttgtaagtagcaactgggctgaaacaccaagactaggaaaaaaaaatgaaagctcttatttcccaggaaatgttctcacaagcactgctgtgaaagatcagaataaacatactgcttcaataaatgacttagaaagagaaacccaaccttcctatgatattgataattttgacatagatgactttgatgatgatgatgactgggaagacataatgcataatttagcagccagcaaatcttccacagctgcctatcaacccatcaaggaaggtcggccaattaaatcagtatcagaaagactttcctcagccaagacagactgtcttccagtgtcatctactgctcaaaatataaacttctcagagtcaattcagaattatactgacaagtcagcacaaaatttagcatccagaaatctgaaacatgagcgtttccaaagtcttagttttcctcatacaaaggaaatgatgaagatttttcataaaaaatttggcctgcataattttagaactaatcagctagaggcgatcaatgctgcactgcttggtgaagactgttttatcctgatgccgactggaggtggtaagagtttgtgttaccagctccctgcctgtgtttctcctggggtcactgttgtcatttctcccttgagatcacttatcgtagatcaagtccaaaagctgacttccttggatattccagctacatatctgacaggtgataagactgactcagaagctacaaatatttacctccagttatcaaaaaaagacccaatcataaaacttctatatgtcactccagaaaagatctgtgcaagtaacagactcatttctactctggagaatctctatgagaggaagctcttggcacgttttgttattgatgaagcacattgtgtcagtcagtggggacatgattttcgtcaagattacaaaagaatgaatatgcttcgccagaagtttccttctgttccggtgatggctcttacggccacagctaatcccagggtacagaaggacatcctgactcagctgaagattctcagacctcaggtgtttagcatgagctttaacagacataatctgaaatactatgtattaccgaaaaagcctaaaaaggtggcatttgattgcctagaatggatcagaaagcaccacccatatgattcagggataatttactgcctctccaggcgagaatgtgacaccatggctgacacgttacagagagatgggctcgctgctcttgcttaccatgctggcctcagtgattctgccagagatgaagtgcagcagaagtggattaatcaggatggctgtcaggttatctgtgctacaattgcatttggaatggggattgacaaaccggacgtgcgatttgtgattcatgcatctctccctaaatctgtggagggttactaccaagaatctggcagagctggaagagatggggaaatatctcactgcctgcttttctatacctatcatgatgtgaccagactgaaaagacttataatgatggaaaaagatggaaaccatcatacaagagaaactcacttcaataatttgtatagcatggtacattactgtgaaaatataacggaatgcaggagaatacagcttttggcctactttggtgaaaatggatttaatcctgatttttgtaagaaacacccagatgtttcttgtgataattgctgtaaaacaaaggattataaaacaagagatgtgactgacgatgtgaaaagtattgtaagatttgttcaagaacatagttcatcacaaggaatgagaaatataaaacatgtaggtccttctggaagatttactatgaatatgctggtcgacattttcttggggagtaagagtgcaaaaatccagtcaggtatatttggaaaaggatctgcttattcacgacacaatgccgaaagactttttaaaaagctgatacttgacaagattttggatgaagacttatatatcaatgccaatgaccaggcgatcgcttatgtgatgctcggaaataaagcccaaactgtactaaatggcaatttaaaggtagactttatggaaacagaaaattccagcagtgtgaaaaaacaaaaagcgttagtagcaaaagtgtctcagagggaagagatggttaaaaaatgtcttggagaacttacagaagtctgcaaatctctggggaaagtttttggtgtccattacttcaatatttttaataccgtcactctcaagaagcttgcagaatctttatcttctgatcctgaggttttgcttcaaattgatggtgttactgaagacaaactggaaaaatatggtgcggaagtgatttcagtattacagaaatactctgaatggacatcgccagctgaagacagttccccagggataagcctgtccagcagcagaggccccggaagaagtgccgctgaggagctcgacgaggaaatacccgtatcttcccactactttgcaagtaaaaccagaaatgaaaggaagaggaaaaagatgccagcctcccaaaggtctaagaggagaaaaactgcttccagtggttccaaggcaaagggggggtctgccacatgtagaaagatatcttccaaaacgaaatcctccagcatcattggatccagttcagcctcacatacttctcaagcgacatcaggagccaatagcaaattggggattatggctccaccgaagcctataaatagaccgtttcttaagccttcatatgcattctcataacaaccgaatctcaatgtacatagaccctctttcttgtttgtcagcatctgaccatctgtgactataaagctgttattcttgttataccatttgaagtttttactcgtctctattaatatttaaataaatgctggggggtgatagttcttctttttaaaataaacattttcttttgaataagca

SEQ ID NO: 925 - DNA, 3505 bp, Homo sapiens
gaagatgctcaggaaagtgactctctgaaaactcatttggaagatgaaagagataatagcgaaaagaagaagaatttggaagaagctgaattacattcaactgagaaagttccatgtattgaatttgatgatgatgattatgatacggattttgttccaccttctccagaagaaattatttctgcttcttcttcctcttcaaaatgccttagtacgttaaaggaccttgacacctctgacagaaaagaggatgttcttagcacatcaaaagatcttttgtcaaaacctgagaaaatgagtatgcaggagctgaatccagaaaccagcacagactgtgacgctagacagataagtttacagcagcagcttattcatgtgatggagcacatctgtaaattaattgatactattcctgatgataaactgaaacttttggattgtgggaacgaactgcttcagcagcggaacataagaaggaaacttctaacggaagtagattttaataaaagtgatgccagtcttcttggctcattgtggagatacaggcctgattcacttgatggccctatggagggtgattcctgccctacagggaattctatgaaggagttaaatttttcacaccttccctcaaattctgtttctcctggggactgtttactgactaccaccctaggaaagacaggattctctgccaccaggaagaatctttttgaaaggcctttattcaatacccatttacagaagtcctttgtaagtagcaactgggctgaaacaccaagactaggaaaaaaaaatgaaagctcttatttcccaggaaatgttctcacaagcactgctgtgaaagatcagaataaacatactgcttcaataaatgacttagaaagagaaacccaaccttcctatgatattgataattttgacatagatgactttgatgatgatgatgactgggaagacataatgcataatttagcagccagcaaatcttccacagctgcctatcaacccatcaaggaaggtcggccaattaaatcagtatcagaaagactttcctcagccaagacagactgtcttccagtgtcatctactgctcaaaatataaacttctcagagtcaattcagaattatactgacaagtcagcacaaaatttagcatccagaaatctgaaacatgagcgtttccaaagtcttagttttcctcatacaaaggaaatgatgaagatttttcataaaaaatttggcctgcataattttagaactaatcagctagaggcgatcaatgctgcactgcttggtgaagactgttttatcctgatgccgactggaggtggtaagagtttgtgttaccagctccctgcctgtgtttctcctggggtcactgttgtcatttctcccttgagatcacttatcgtagatcaagtccaaaagctgacttccttggatattccagctacatatctgacaggtgataagactgactcagaagctacaaatatttacctccagttatcaaaaaaagacccaatcataaaacttctatatgtcactccagaaaagatctgtgcaagtaacagactcatttctactctggagaatctctatgagaggaagctcttggcacgttttgttattgatgaagcacattgtgtcagtcagtggggacatgattttcgtcaagattacaaaagaatgaatatgcttcgccagaagtttccttctgttccggtgatggctcttacggccacagctaatcccagggtacagaaggacatcctgactcagctgaagattctcagacctcaggtgtttagcatgagctttaacagacataatctgaaatactatgtattaccgaaaaagcctaaaaaggtggcatttgattgcctagaatggatcagaaagcaccacccatatgattcagggataatttactgcctctccaggcgagaatgtgacaccatggctgacacgttacagaagtggattaatcaggatggctgtcaggttatctgtgctacaattgcatttggaatggggattgacaaaccggacgtgcgatttgtgattcatgcatctctccctaaatctgtggagggttactaccaagaatctggcagagctggaagagatggggaaatatctcactgcctgcttttctatacctatcatgatgtgaccagactgaaaagacttataatgatggaaaaagatggaaaccatcatacaagagaaactcacttcaataatttgtatagcatggtacattactgtgaaaatataacggaatgcaggagaatacagcttttggcctactttggtgaaaatggatttaatcctgatttttgtaagaaacacccagatgtttcttgtgataattgctgtaaaacaaaggattataaaacaagagatgtgactgacgatgtgaaaagtattgtaagatttgttcaagaacatagttcatcacaaggaatgagaaatataaaacatgtaggtccttctggaagatttactatgaatatgctggtcgacattttcttggggagtaagagtgcaaaaatccagtcaggtatatttggaaaaggatctgcttattcacgacacaatgccgaaagactttttaaaaagctgatacttgacaagattttggatgaagacttatatatcaatgccaatgaccaggcgatcgcttatgtgatgctcggaaataaagcccaaactgtactaaatggcaatttaaaggtagactttatggaaacagaaaattccagcagtgtgaaaaaacaaaaagcgttagtagcaaaagtgtctcagagggaagagatggttaaaaaatgtcttggagaacttacagaagtctgcaaatctctggggaaagtttttggtgtccattacttcaatatttttaataccgtcactctcaagaagcttgcagaatctttatcttctgatcctgaggttttgcttcaaattgatggtgttactgaagacaaactggaaaaatatggtgcggaagtgatttcagtattacagaaatactctgaatggacatcgccagctgaagacagttccccagggataagcctgtccagcagcagaggccccggaagaagtgccgctgaggagctcgacgaggaaatacccgtatcttcccactactttgcaagtaaaaccagaaatgaaaggaagaggaaaaagatgccagcctcccaaaggtctaagaggagaaaaactgcttccagtggttccaaggcaaagggggggtctgccacatgtagaaagatatcttccaaaacgaaatcctccagcatcattggatccagttcagcctcacatacttctcaagcgacatcaggagccaatagcaaattggggattatggctccaccgaagcctataaatagaccgtttcttaagccttcatatgcattctcataacaaccgaatctcaatgtacatagaccctctttcttgtttgtcagcatctgaccatctgtgactataa

SEQ ID NO: 926 - DNA, 2011 bp, Homo sapiens
ttattttcctagacaagtcagcacaaaatttagcatccagaaatctgaaacatgagcgtttccaaagtcttagttttcctcatacaaaggaaatgatgaagatttttcataaaaaatttggcctgcataattttagaactaatcagctagaggcgatcaatgctgcactgcttggtgaagactgttttatcctgatgccgactgtagattccagctacatatctgacaggtgataagactgactcagaagctacaaatatttacctccagttatcaaaaaaagacccaatcataaaacttctatatgtcactccagaaaagatctgtgcaagtaacagactcatttctactctggagaatctctatgagaggaagctcttggcacgttttgttattgatgaagcacattgtgtcagtcagtggggacatgattttcgtcaagattacaaaagaatgaatatgcttcgccagaagtttccttctgttccggtgatggctcttacggccacagctaatcccagggtacagaaggacatcctgactcagctgaagattctcagacctcaggtgtttagcatgagctttaacagacataatctgaaatactatgtattaccgaaaaagcctaaaaaggtggcatttgattgcctagaatggatcagaaagcaccacccatatgattcagggataatttactgcctctccaggcgagaatgtgacaccatggctgacacgttacagagagatgggctcgctgctcttgcttaccatgctggcctcagtgattctgccagagatgaagtgcagcagaagtggattaatcaggatggctgtcaggttatctgtgctacaattgcatttggaatggggattgacaaaccggacgtgcgatttgtgattcatgcatctctccctaaatctgtggagggttactaccaagaatctggcagagctggaagagatggggaaatatctcactgcctgcttttctatacctatcatgatgtgaccagactgaaaagacttataatgatggaaaaagatggaaaccatcatacaagagaaactcacttcaataatttgtatagcatggtacattactgtgaaaatataacggaatgcaggagaatacagcttttggcctactttggtgaaaatggatttaatcctgatttttgtaagaaacacccagatgtttcttgtgataattgctgtaaaacaaaggattataaaacaagagatgtgactgacgatgtgaaaagtattgtaagatttgttcaagaacatagttcatcacaaggaatgagaaatataaaacatgtaggtccttctggaagatttactatgaatatgctggtcgacattttcttggggagtaagagtgcaaaaatccagtcaggtatatttggaaaaggatctgcttattcacgacacaatgccgaaagactttttaaaaagctgatacttgacaagattttggatgaagacttatatatcaatgccaatgaccaggcgatcgcttatgtgatgctcggaaataaagcccaaactgtactaaatggcaatttaaaggtagactttatggaaacagaaaattccagcagtgtgaaaaaacaaaaagcgttagtagcaaaagtgtctcagagggaagagatggttaaaaaatgtcttggagaacttacagaagtctgcaaatctctggggaaagtttttggtgtccattacttcaatatttttaataccgtcactctcaagaagcttgcagaatctttatcttctgatcctgaggttttgcttcaaattgatggtgttactgaagacaaactggaaaaatatggtgcggaagtgatttcagtattacagaaatactctgaatggacatcgccagctgaagacagttccccagggataagcctgtccagcagcagaggccccggaagaagtgccgctgaggagctcgacgaggaaatacccgtatcttcccactactttgcaagtaaaaccagaaatg

SEQ ID NO: 927 - DNA, 7114 bp, Homo sapiens
cttagcggtagccccttggtttccgtggcaacggaaaagcgcgggaattacagataaattaaaactgcgactgcgcggcgtgagctcgctgagacttcctggacgggggacaggctgtggggtttctcagataactgggcccctgcgctcaggaggccttcaccctctgctctggttcattggaacagaaagaaatggatttatctgctcttcgcgttgaagaagtacaaaatgtcattaatgctatgcagaaaatcttagagtgtcccatctgattttgcatgctgaaacttctcaaccagaagaaagggccttcacagtgtcctttatgtaagaatgatataaccaaaaggagcctacaagaaagtacgagatttagtcaacttgttgaagagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttgcaggaaaccagtctcagtgtccaactctctaaccttggaactgtgagaactctgaggacaaagcagcggatacaacctcaaaagacgtctgtctacattgaattgggatctgattcttctgaagataccgttaataaggcaacttattgcagtgtgggagatcaagaattgttacaaatcacccctcaaggaaccagggatgaaatcagtttggattctgcaaaaaaggctgcttgtgaattttctgagacggatgtaacaaatactgaacatcatcaacccagtaataatgatttgaacaccactgagaagcgtgcagctgagaggcatccagaaaagtatcagggtagttctgtttcaaacttgcatgtggagccatgtggcacaaatactcatgccagctcattacagcatgagaacagcagtttattactcactaaagacagaatgaatgtagaaaaggctgaattctgtaataaaagcaaacagcctggcttagcaaggagccaacataacagatgggctggaagtaaggaaacatgtaatgataggcggactcccagcacagaaaaaaaggtagatctgaatgctgatcccctgtgtgagagaaaagaatggaataagcagaaactgccatgctcagagaatcctagagatactgaagatgttccttggataacactaaatagcagcattcagaaagttaatgagtggttttccagaagtgatgaactgttaggttctgatgactcacatgatggggagtctgaatcaaatgccaaagtagctgatgtattggacgttctaaatgaggtagatgaatattctggttcttcagagaaaatagacttactggccagtgatcctcatgaggctttaatatgtaaaagtgaaagagttcactccaaatcagtagagagtaatattgaagacaaaatatttgggaaaacctatcggaagaaggcaagcctccccaacttaagccatgtaactgaaaatctaattataggagcatttgttactgagccacagataatacaagagcgtcccctcacaaataaattaaagcgtaaaaggagacctacatcaggccttcatcctgaggattttatcaagaaagcagatttggcagttcaaaagactcctgaaatgataaatcagggaactaaccaaacggagcagaatggtcaagtgatgaatattactaatagtggtcatgagaataaaacaaaaggtgattctattcagaatgagaaaaatcctaacccaatagaatcactcgaaaaagaatctgctttcaaaacgaaagctgaacctataagcagcagtataagcaatatggaactcgaattaaatatccacaattcaaaagcacctaaaaagaataggctgaggaggaagtcttctaccaggcatattcatgcgcttgaactagtagtcagtagaaatctaagcccacctaattgtactgaattgcaaattgatagttgttctagcagtgaagagataaagaaaaaaaagtacaaccaaatgccagtcaggcacagcagaaacctacaactcatggaaggtaaagaacctgcaactggagccaagaagagtaacaagccaaatgaacagacaagtaaaagacatgacagcgatactttcccagagctgaagttaacaaatgcacctggttcttttactaagtgttcaaataccagtgaacttaaagaatttgtcaatcctagccttccaagagaagaaaaagaagagaaactagaaacagttaaagtgtctaataatgctgaagaccccaaagatctcatgttaagtggagaaagggttttgcaaactgaaagatctgtagagagtagcagtatttcattggtacctggtactgattatggcactcaggaaagtatctcgttactggaagttagcactctagggaaggcaaaaacagaaccaaataaatgtgtgagtcagtgtgcagcatttgaaaaccccaagggactaattcatggttgttccaaagataatagaaatgacacagaaggctttaagtatccattgggacatgaagttaaccacagtcgggaaacaagcatagaaatggaagaaagtgaacttgatgctcagtatttgcagaatacattcaaggtttcaaagcgccagtcatttgctccgttttcaaatccaggaaatgcagaagaggaatgtgcaacattctctgcccactctgggtccttaaagaaacaaagtccaaaagtcacttttgaatgtgaacaaaaggaagaaaatcaaggaaagaatgagtctaatatcaagcctgtacagacagttaatatcactgcaggctttcctgtggttggtcagaaagataagccagttgataatgccaaatgtagtatcaaaggaggctctaggttttgtctatcatctcagttcagaggcaacgaaactggactcattactccaaataaacatggacttttacaaaacccatatcgtataccaccactttttcccatcaagtcatttgttaaaactaaatgtaagaaaaatctgctagaggaaaactttgaggaacattcaatgtcacctgaaagagaaatgggaaatgagaacattccaagtacagtgagcacaattagccgtaataacattagagaaaatgtttttaaagaagccagctcaagcaatattaatgaagtaggttccagtactaatgaagtgggctccagtattaatgaaataggttccagtgatgaaaacattcaagcagaactaggtagaaacagagggccaaaattgaatgctatgcttagattaggggttttgcaacctgaggtctataaacaaagtcttcctggaagtaattgtaagcatcctgaaataaaaaagcaagaatatgaagaagtagttcagactgttaatacagatttctctccatatctgatttcagataacttagaacagcctatgggaagtagtcatgcatctcaggtttgttctgagacacctgatgacctgttagatgatggtgaaataaaggaagatactagttttgctgaaaatgacattaaggaaagttctgctgtttttagcaaaagcgtccagaaaggagagcttagcaggagtcctagccctttcacccatacacatttggctcagggttaccgaagaggggccaagaaattagagtcctcagaagagaacttatctagtgaggatgaagagcttccctgcttccaacacttgttatttggtaaagtaaacaatataccttctcagtctactaggcatagcaccgttgctaccgagtgtctgtctaagaacacagaggagaatttattatcattgaagaatagcttaaatgactgcagtaaccaggtaatattggcaaaggcatctcaggaacatcaccttagtgaggaaacaaaatgttctgctagcttgttttcttcacagtgcagtgaattggaagacttgactgcaaatacaaacacccaggatcctttcttgattggttcttccaaacaaatgaggcatcagtctgaaagccagggagttggtctgagtgacaaggaattggtttcagatgatgaagaaagaggaacgggcttggaagaaaataatcaagaagagcaaagcatggattcaaacttaggtgaagcagcatctgggtgtgagagtgaaacaagcgtctctgaagactgctcagggctatcctctcagagtgacattttaaccactcagcagagggataccatgcaacataacctgataaagctccagcaggaaatggctgaactagaagctgtgttagaacagcatgggagccagccttctaacagctacccttccatcataagtgactcttctgcccttgaggacctgcgaaatccagaacaaagcacatcagaaaaagcagtattaacttcacagaaaagtagtgaataccctataagccagaatccagaaggcctttctgctgacaagtttgaggtgtctgcagatagttctaccagtaaaaataaagaaccaggagtggaaaggtcatccccttctaaatgcccatcattagatgataggtggtacatgcacagttgctctgggagtcttcagaatagaaactacccatctcaagaggagctcattaaggttgttgatgtggaggagcaacagctggaagagtctgggccacacgatttgacggaaacatcttacttgccaaggcaagatctagagggaaccccttacctggaatctggaatcagcctcttctctgatgaccctgaatctgatccttctgaagacagagccccagagtcagctcgtgttggcaacataccatcttcaacctctgcattgaaagttccccaattgaaagttgcagaatctgcccagagtccagctgctgctcatactactgatactgctgggtataatgcaatggaagaaagtgtgagcagggagaagccagaattgacagcttcaacagaaagggtcaacaaaagaatgtccatggtggtgtctggcctgaccccagaagaatttatgctcgtgtacaagtttgccagaaaacaccacatcactttaactaatctaattactgaagagactactcatgttgttatgaaaacagatgctgagtttgtgtgtgaacggacactgaaatattttctaggaattgcgggaggaaaatgggtagttagctatttctgggtgacccagtctattaaagaaagaaaaatgctgaatgagcatgattttgaagtcagaggagatgtggtcaatggaagaaaccaccaaggtccaaagcgagcaagagaatcccaggacagaaagatcttcagggggctagaaatctgttgctatgggcccttcaccaacatgcccacagatcaactggaatggatggtacagctgtgtggtgcttctgtggtgaaggagctttcatcattcacccttggcacaggtgtccacccaattgtggttgtgcagccagatgcctggacagaggacaatggcttccatgcaattgggcagatgtgtgaggcacctgtggtgacccgagagtgggtgttggacagtgtagcactctaccagtgccaggagctggacacctacctgataccccagatcccccacagccactactgactgcagccagccacaggtacagagccacaggaccccaagaatgagcttacaaagtggcctttccaggccctgggagctcctctcactcttcagtccttctactgtcctggctactaaatattttatgtacatcagcctgaaaaggacttctggctatgcaagggtcccttaaagattttctgcttgaagtctcccttggaaatctgccatgagcacaaaattatggtaatttttcacctgagaagattttaaaaccatttaaacgccaccaattgagcaagatgctgattcattatttatcagccctattctttctattcaggctgttgttggcttagggctggaagcacagagtggcttggcctcaagagaatagctggtttccctaagtttacttctctaaaaccctgtgttcacaaaggcagagagtcagacccttcaatggaaggagagtgcttgggatcgattatgtgacttaaagtcagaatagtccttgggcagttctcaaatgttggagtggaacattggggaggaaattctgaggcaggtattagaaatgaaaaggaaacttgaaacctgggcatggtggctcacgcctgtaatcccagcactttgggaggccaaggtgggcagatcactggaggtcaggagttcgaaaccagcctggccaacatggtgaaaccccatctctactaaaaatacagaaattagccggtcatggtggtggacacctgtaatcccagctactcaggtggctaaggcaggagaatcacttcagcccgggaggtggaggttgcagtgagccaagatcataccacggcactccagcctgggtgacagtgagactgtggctcaaaaaaaaaaaaaaaaaaaggaaaatgaaactagaagagatttctaaaagtctgagatatatttgctagatttctaaagaatgtgttctaaaacagcagaagattttcaagaaccggtttccaaagacagtcttctaattcctcattagtaataagtaaaatgtttattgttgtagctctggtatataatccattcctcttaaaatataagacctctggcatgaatatttcatatctataaaatgacagatcccaccaggaaggaagctgttgctttctttgaggtgatttttttcctttgctccctgttgctgaaaccatacagcttcataaataattttgcttgctgaaggaagaaaaagtgtttttcataaacccattatccaggactgtttatagctgttggaaggactaggtcttccctagcccccccagtgtgcaagggcagtgaagacttgattgtacaaaatacgttttgtaaatgttgtgctgttaacactgcaaataaacttggtagcaaacacttcc

SEQ ID NO: 928 - DNA, 6451 bp, Homo sapiens
cttagcggtagccccttggtttccgtggcaacggaaaagcgcgggaattacagataaattaaaactgcgactgcgcggcgtgagctcgctgagacttcctggacgggggacaggctgtggggtttctcagataactgggcccctgcgctcaggaggccttcaccctctgctctggttcattggaacagaaagaaatggatttatctgctcttcgcgttgaagaagtacaaaatgtcattaatgctatgcagaaaatcttagagtgtcccatctgtctggagttgatcaaggaacctgtctccacaaagtgtgaccacatattttgcaaattttgcatgctgaaacttctcaaccagaagaaagggccttcacagtgtcctttatgtaagaatgatataaccaaaaggagcctacaagaaagtacgagatttagtcaacttgttgaagagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttgcaggaaaccagtctcagtgtccaactctctaaccttggaactgtgagaactctgaggacaaagcagcggatacaacctcaaaagacgtctgtctacattgaattgggatctgattcttctgaagataccgttaataaggcaacttattgcagtgtgggagatcaagaattgttacaaatcacccctcaaggaaccagggatgaaatcagtttggattctgcaaaaaaggctgcttgtgaattttctgagacggatgtaacaaatactgaacatcatcaacccagtaataatgatttgaacaccactgagaagcgtgcagctgagaggcatccagaaaagtatcagggtagttctgtttcaaacttgcatgtggagccatgtggcacaaatactcatgccagctcattacagcatgagaacagcagtttattactcactaaagacagaatgaatgtagaaaaggctgaattctgtaataaaagcaaacagcctggcttagcaaggagccaacataacagatgggctggaagtaaggaaacatgtaatgataggcggactcccagcacagaaaaaaaggtagatctgaatgctgatcccctgtgtgagagaaaagaatggaataagcagaaactgccatgctcagagaatcctagagatactgaagatgttccttggataacactaaatagcagcattcagaaagttaatgagtggttttccagaagtgatgaactgttaggttctgatgactcacatgatggggagtctgaatcaaatgccaaagtagctgatgtattggacgttctaaatgaggtagatgaatattctggttcttcagagaaaatagacttactggccagtgatcctcatgaggctttaatatgtaaaagtgaaagagttcactccaaatcagtagagagtaatattgaagacaaaatatttgggaaaacctatcggaagaaggcaagcctccccaacttaagccatgtaactgaaaatctaattataggagcatttgttactgagccacagataatacaagagcgtcccctcacaaataaattaaagcgtaaaaggagacctacatcaggccttcatcctgaggattttatcaagaaagcagatttggcagttcaaaagactcctgaaatgataaatcagggaactaaccaaacggagcagaatggtcaagtgatgaatattactaatagtggtcatgagaataaaacaaaaggtgattctattcagaatgagaaaaatcctaacccaatagaatcactcgaaaaagaatctgctttcaaaacgaaagctgaacctataagcagcagtataagcaatatggaactcgaattaaatatccacaattcaaaagcacctaaaaagaataggctgaggaggaagtcttctaccaggcatattcatgcgcttgaactagtagtcagtagaaatctaagcccacctaattgtactgaattgcaaattgatagttgttctagcagtgaagagataaagaaaaaaaagtacaaccaaatgccagtcaggcacagcagaaacctacaactcatggaaggtaaagaacctgcaactggagccaagaagagtaacaagccaaatgaacagacaagtaaaagacatgacagcgatactttcccagagctgaagttaacaaatgcacctggttcttttactaagtgttcaaataccagtgaacttaaagaatttgtcaatcctagccttccaagagaagaaaaagaagagaaactagaaacagttaaagtgtctaataatgctgaagaccccaaagatctcatgttaagtggagaaagggttttgcaaactgaaagatctgtagagagtagcagtatttcattggtacctggtactgattatggcactcaggaaagtatctcgttactggaagttagcactctagggaaggcaaaaacagaaccaaataaatgtgtgagtcagtgtgcagcatttgaaaaccccaagggactaattcatggttgttccaaagataatagaaatgacacagaaggctttaagtatccattgggacatgaagttaaccacagtcgggaaacaagcatagaaatggaagaaagtgaacttgatgctcagtatttgcagaatacattcaaggtttcaaagcgccagtcatttgctccgttttcaaatccaggaaatgcagaagaggaatgtgcaacattctctgcccactctgggtccttaaagaaacaaagtccaaaagtcacttttgaatgtgaacaaaaggaagaaaatcaaggaaagaatgagtctaatatcaagcctgtacagacagttaatatcactgcaggctttcctgtggttggtcagaaagataagccagttgataatgccaaatgtagtatcaaaggaggctctaggttttgtctatcatctcagttcagaggcaacgaaactggactcattactccaaataaacatggacttttacaaaacccatatcgtataccaccactttttcccatcaagtcatttgttaaaactaaatgtaagaaaaatctgctagaggaaaactttgaggaacattcaatgtcacctgaaagagaaatgggaaatgagaacattccaagtacagtgagcacaattagccgtaataacattagagaaaatgtttttaaagaagccagctcaagcaatattaatgaagtaggttccagtactaatgaagtgggctccagtattaatgaaataggttccagtgatgaaaacattcaagcagaactaggtagaaacagagggccaaaattgaatgctatgcttagattaggggttttgcaacctgaggtctataaacaaagtcttcctggaagtaattgtaagcatcctgaaataaaaaagcaagaatatgaagaagtagttcagactgttaatacagatttctctccatatctgatttcagataacttagaacagcctatgggaagtagtcatgcatctcaggtttgttctgagacacctgatgacctgttagatgatggtgaaataaaggaagatactagttttgctgaaaatgacattaaggaaagttctgctgtttttagcaaaagcgtccagaaaggagagcttagcaggagtcctagccctttcacccatacacatttggctcagggttaccgaagaggggccaagaaattagagtcctcagaagagaacttatctagtgaggatgaagagcttccctgcttccaacacttgttatttggtaaagtaaacaatataccttctcagtctactaggcatagcaccgttgctaccgagtgtctgtctaagaacacagaggagaatttattatcattgaagaatagcttaaatgactgcagtaaccaggtaatattggcaaaggcatctcaggaacatcaccttagtgaggaaacaaaatgttctgctagcttgttttcttcacagtgcagtgaattggaagacttgactgcaaatacaaacacccaggatcctttcttgattggttcttccaaacaaatgaggcatcagtctgaaagccagggagttggtctgagtgacaaggaattggtttcagatgatgaagaaagaggaacgggcttggaagaaaataatcaagaagagcaaagcatggattcaaacttaggtgaagcagcatctgggtgtgagagtgaaacaagcgtctctgaagactgctcagggctatcctctcagagtgacattttaaccactcagcagagggataccatgcaacataacctgataaagctccagcaggaaatggctgaactagaagctgtgttagaacagcatgggagccagccttctaacagctacccttccatcataagtgactcttctgcccttgaggacctgcgaaatccagaacaaagcacatcagaaaaagatgctgagtttgtgtgtgaacggacactgaaatattttctaggaattgcgggaggaaaatgggtagttagctatttctgggtgacccagtctattaaagaaagaaaaatgctgaatgagcatgattttgaagtcagaggagatgtggtcaatggaagaaaccaccaaggtccaaagcgagcaagagaatcccaggacagaaagatcttcagggggctagaaatctgttgctatgggcccttcaccaacatgcccacagatcaactggaatggatggtacagctgtgtggtgcttctgtggtgaaggagctttcatcattcacccttggcacaggtgtccacccaattgtggttgtgcagccagatgcctggacagaggacaatggcttccatgcaattgggcagatgtgtgaggcacctgtggtgacccgagagtgggtgttggacagtgtagcactctaccagtgccaggagctggacacctacctgataccccagatcccccacagccactactgactgcagccagccacaggtacagagccacaggaccccaagaatgagcttacaaagtggcctttccaggccctgggagctcctctcactcttcagtccttctactgtcctggctactaaatattttatgtacatcagcctgaaaaggacttctggctatgcaagggtcccttaaagattttctgcttgaagtctcccttggaaatctgccatgagcacaaaattatggtaatttttcacctgagaagattttaaaaccatttaaacgccaccaattgagcaagatgctgattcattatttatcagccctattctttctattcaggctgttgttggcttagggctggaagcacagagtggcttggcctcaagagaatagctggtttccctaagtttacttctctaaaaccctgtgttcacaaaggcagagagtcagacccttcaatggaaggagagtgcttgggatcgattatgtgacttaaagtcagaatagtccttgggcagttctcaaatgttggagtggaacattggggaggaaattctgaggcaggtattagaaatgaaaaggaaacttgaaacctgggcatggtggctcacgcctgtaatcccagcactttgggaggccaaggtgggcagatcactggaggtcaggagttcgaaaccagcctggccaacatggtgaaaccccatctctactaaaaatacagaaattagccggtcatggtggtggacacctgtaatcccagctactcaggtggctaaggcaggagaatcacttcagcccgggaggtggaggttgcagtgagccaagatcataccacggcactccagcctgggtgacagtgagactgtggctcaaaaaaaaaaaaaaaaaaaggaaaatgaaactagaagagatttctaaaagtctgagatatatttgctagatttctaaagaatgtgttctaaaacagcagaagattttcaagaaccggtttccaaagacagtcttctaattcctcattagtaataagtaaaatgtttattgttgtagctctggtatataatccattcctcttaaaatataagacctctggcatgaatatttcatatctataaaatgacagatcccaccaggaaggaagctgttgctttctttgaggtgatttttttcctttgctccctgttgctgaaaccatacagcttcataaataattttgcttgctgaaggaagaaaaagtgtttttcataaacccattatccaggactgtttatagctgttggaaggactaggtcttccctagcccccccagtgtgcaagggcagtgaagacttgattgtacaaaatacgttttgtaaatgttgtgctgttaacactgcaaataaacttggtagcaaacacttcc

SEQ ID NO: 929 - DNA, 3444 bp, Homo sapiens
ttcattggaacagaaagaaatggatttatctgctcttcgcgttgaagaagtacaaaatgtcattaatgctatgcagaaaatcttagagtgtcccatctgtctggagttgatcaaggaacctgtctccacaaagtgtgaccacatattttgcaaattttgcatgctgaaacttctcaaccagaagaaagggccttcacagtgtcctttatgtaagaatgatataaccaaaaggagcctacaagaaagtacgagatttagtcaacttgttgaagagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttgcaggaaaccagtctcagtgtccaactctctaaccttggaactgtgagaactctgaggacaaagcagcggatacaacctcaaaagacgtctgtctacattgaattgggtgaagcagcatctgggtgtgagagtgaaacaagcgtctctgaagactgctcagggctatcctctcagagtgacattttaaccactcagcagagggataccatgcaacataacctgataaagctccagcaggaaatggctgaactagaagctgtgttagaacagcatgggagccagccttctaacagctacccttccatcataagtgactcttctgcccttgaggacctgcgaaatccagaacaaagcacatcagaaaaagcagtattaacttcacagaaaagtagtgaataccctataagccagaatccagaaggcctttctgctgacaagtttgaggtgtctgcagatagttctaccagtaaaaataaagaaccaggagtggaaaggtcatccccttctaaatgcccatcattagatgataggtggtacatgcacagttgctctgggagtcttcagaatagaaactacccatctcaagaggagctcattaaggttgttgatgtggaggagcaacagctggaagagtctgggccacacgatttgacggaaacatcttacttgccaaggcaagatctagagggaaccccttacctggaatctggaatcagcctcttctctgatgaccctgaatctgatccttctgaagacagagccccagagtcagctcgtgttggcaacataccatcttcaacctctgcattgaaagttccccaattgaaagttgcagaatctgcccagagtccagctgctgctcatactactgatactgctgggtataatgcaatggaagaaagtgtgagcagggagaagccagaattgacagcttcaacagaaagggtcaacaaaagaatgtccatggtggtgtctggcctgaccccagaagaatttatgctcgtgtacaagtttgccagaaaacaccacatcactttaactaatctaattactgaagagactactcatgttgttatgaaaacagatgctgagtttgtgtgtgaacggacactgaaatattttctaggaattgcgggaggaaaatgggtagttagctatttctgggtgacccagtctattaaagaaagaaaaatgctgaatgagcatgattttgaagtcagaggagatgtggtcaatggaagaaaccaccaaggtccaaagcgagcaagagaatcccaggacagaaagatcttcagggggctagaaatctgttgctatgggcccttcaccaacatgcccacagatcaactggaatggatggtacagctgtgtggtgcttctgtggtgaaggagctttcatcattcacccttggcacaggtgtccacccaattgtggttgtgcagccagatgcctggacagaggacaatggcttccatgcaattgggcagatgtgtgaggcacctgtggtgacccgagagtgggtgttggacagtgtagcactctaccagtgccaggagctggacacctacctgataccccagatcccccacagccactactgactgcagccagccacaggtacagagccacaggaccccaagaatgagcttacaaagtggcctttccaggccctgggagctcctctcactcttcagtccttctactgtcctggctactaaatattttatgtacatcagcctgaaaaggacttctggctatgcaagggtcccttaaagattttctgcttgaagtctcccttggaaatctgccatgagcacaaaattatggtaatttttcacctgagaagattttaaaaccatttaaacgccaccaattgagcaagatgctgattcattatttatcagccctattctttctattcaggctgttgttggcttagggctggaagcacagagtggcttggcctcaagagaatagctggtttccctaagtttacttctctaaaaccctgtgttcacaaaggcagagagtcagacccttcaatggaaggagagtgcttgggatcgattatgtgacttaaagtcagaatagtccttgggcagttctcaaatgttggagtggaacattggggaggaaattctgaggcaggtattagaaatgaaaaggaaacttgaaacctgggcatggtggctcacgcctgtaatcccagcactttgggaggccaaggtgggcagatcactggaggtcaggagttcgaaaccagcctggccaacatggtgaaaccccatctctactaaaaatacagaaattagccggtcatggtggtggacacctgtaatcccagctactcaggtggctaaggcaggagaatcacttcagcccgggaggtggaggttgcagtgagccaagatcataccacggcactccagcctgggtgacagtgagactgtggctcaaaaaaaaaaaaaaaaaaaggaaaatgaaactagaagagatttctaaaagtctgagatatatttgctagatttctaaagaatgtgttctaaaacagcagaagattttcaagaaccggtttccaaagacagtcttctaattcctcattagtaataagtaaaatgtttattgttgtagctctggtatataatccattcctcttaaaatataagacctctggcatgaatatttcatatctataaaatgacagatcccaccaggaaggaagctgttgctttctttgaggtgatttttttcctttgctccctgttgctgaaaccatacagcttcataaataattttgcttgctgaaggaagaaaaagtgtttttcataaacccattatccaggactgtttatagctgttggaaggactaggtcttccctagcccccccagtgtgcaagggcagtgaagacttgattgtacaaaatacgttttgtaaatgttgtgctgttaacactgcaaataaacttggtagcaaacacttcc

SEQ ID NO: 930 - DNA, 3780 bp, Homo sapiens
gtaccttgatttcgtattctgagaggctgctgcttagcggtagccccttggtttccgtggcaacggaaaagcgcgggaattacagataaattaaaactgcgactgcgcggcgtgagctcgctgagacttcctggacgggggacaggctgtggggtttctcagataactgggcccctgcgctcaggaggccttcaccctctgctctgggtaaagttcattggaacagaaagaaatggatttatctgctcttcgcgttgaagaagtacaaaatgtcattaatgctatgcagaaaatcttagagtgtcccatctgtctggagttgatcaaggaacctgtctccacaaagtgtgaccacatattttgcaaattttgcatgctgaaacttctcaaccagaagaaagggccttcacagtgtcctttatgtaagaatgatataaccaaaaggagcctacaagaaagtacgagatttagtcaacttgttgaagagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttgcaggaaaccagtctcagtgtccaactctctaaccttggaactgtgagaactctgaggacaaagcagcggatacaacctcaaaagacgtctgtctacattgaattgggatctgattcttctgaagataccgttaataaggcaacttattgcagtgtgggagatcaagaattgttacaaatcacccctcaaggaaccagggatgaaatcagtttggattctgcaaaaaagggtgaagcagcatctgggtgtgagagtgaaacaagcgtctctgaagactgctcagggctatcctctcagagtgacattttaaccactcagcagagggataccatgcaacataacctgataaagctccagcaggaaatggctgaactagaagctgtgttagaacagcatgggagccagccttctaacagctacccttccatcataagtgactcttctgcccttgaggacctgcgaaatccagaacaaagcacatcagaaaaagcagtattaacttcacagaaaagtagtgaataccctataagccagaatccagaaggcctttctgctgacaagtttgaggtgtctgcagatagttctaccagtaaaaataaagaaccaggagtggaaaggtcatccccttctaaatgcccatcattagatgataggtggtacatgcacagttgctctgggagtcttcagaatagaaactacccatctcaagaggagctcattaaggttgttgatgtggaggagcaacagctggaagagtctgggccacacgatttgacggaaacatcttacttgccaaggcaagatctagagggaaccccttacctggaatctggaatcagcctcttctctgatgaccctgaatctgatccttctgaagacagagccccagagtcagctcgtgttggcaacataccatcttcaacctctgcattgaaagttccccaattgaaagttgcagaatctgcccagagtccagctgctgctcatactactgatactgctgggtataatgcaatggaagaaagtgtgagcagggagaagccagaattgacagcttcaacagaaagggtcaacaaaagaatgtccatggtggtgtctggcctgaccccagaagaatttatgctcgtgtacaagtttgccagaaaacaccacatcactttaactaatctaattactgaagagactactcatgttgttatgaaaacagatgctgagtttgtgtgtgaacggacactgaaatattttctaggaattgcgggaggaaaatgggtagttagctatttctgggtgacccagtctattaaagaaagaaaaatgctgaatgagcatgattttgaagtcagaggagatgtggtcaatggaagaaaccaccaaggtccaaagcgagcaagagaatcccaggacagaaagatcttcagggggctagaaatctgttgctatgggcccttcaccaacatgcccacagatcaactggaatggatggtacagctgtgtggtgcttctgtggtgaaggagctttcatcattcacccttggcacaggtgtccacccaattgtggttgtgcagccagatgcctggacagaggacaatggcttccatgcaattgggcagatgtgtgaggcacctgtggtgacccgagagtgggtgttggacagtgtagcactctaccagtgccaggagctggacacctacctgataccccagatcccccacagccactactgactgcagccagccacaggtacagagccacaggaccccaagaatgagcttacaaagtggcctttccaggccctgggagctcctctcactcttcagtccttctactgtcctggctactaaatattttatgtacatcagcctgaaaaggacttctggctatgcaagggtcccttaaagattttctgcttgaagtctcccttggaaatctgccatgagcacaaaattatggtaatttttcacctgagaagattttaaaaccatttaaacgccaccaattgagcaagatgctgattcattatttatcagccctattctttctattcaggctgttgttggcttagggctggaagcacagagtggcttggcctcaagagaatagctggtttccctaagtttacttctctaaaaccctgtgttcacaaaggcagagagtcagacccttcaatggaaggagagtgcttgggatcgattatgtgacttaaagtcagaatagtccttgggcagttctcaaatgttggagtggaacattggggaggaaattctgaggcaggtattagaaatgaaaaggaaacttgaaacctgggcatggtggctcacgcctgtaatcccagcactttgggaggccaaggtgggcagatcactggaggtcaggagttcgaaaccagcctggccaacatggtgaaaccccatctctactaaaaatacagaaattagccggtcatggtggtggacacctgtaatcccagctactcaggtggctaaggcaggagaatcacttcagcccgggaggtggaggttgcagtgagccaagatcataccacggcactccagcctgggtgacagtgagactgtggctcaaaaaaaaaaaaaaaaaaaggaaaatgaaactagaagagatttctaaaagtctgagatatatttgctagatttctaaagaatgtgttctaaaacagcagaagattttcaagaaccggtttccaaagacagtcttctaattcctcattagtaataagtaaaatgtttattgttgtagctctggtatataatccattcctcttaaaatataagacctctggcatgaatatttcatatctataaaatgacagatcccaccaggaaggaagctgttgctttctttgaggtgatttttttcctttgctccctgttgctgaaaccatacagcttcataaataattttgcttgctgaaggaagaaaaagtgtttttcataaacccattatccaggactgtttatagctgttggaaggactaggtcttccctagcccccccagtgtgcaagggcagtgaagacttgattgtacaaaatacgttttgtaaatgttgtgctgttaacactgcaaataaacttggtagcaaacacttcc

SEQ ID NO: 931 - DNA, 6411 bp, Homo sapiens
gtaccttgatttcgtattctgagaggctgctgcttagcggtagccccttggtttccgtggcaacggaaaagcgcgggaattacagataaattaaaactgcgactgcgcggcgtgagctcgctgagacttcctggacgggggacaggctgtggggtttctcagataactgggcccctgcgctcaggaggccttcaccctctgctctgggtaaagttcattggaacagaaagaaatggatttatctgctcttcgcgttgaagaagtacaaaatgtcattaatgctatgcagaaaatcttagagtgtcccatctgtctggagttgatcaaggaacctgtctccacaaagtgtgaccacatattttgcaaattttgcatgctgaaacttctcaaccagaagaaagggccttcacagtgtcctttatgtaagaatgatataaccaaaaggagcctacaagaaagtacgagatttagtcaacttgttgaagagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttgcaggaaaccagtctcagtgtccaactctctaaccttggaactgtgagaactctgaggacaaagcagcggatacaacctcaaaagacgtctgtctacattgaattgggatctgattcttctgaagataccgttaataaggcaacttattgcagtgtgggagatcaagaattgttacaaatcacccctcaaggaaccagggatgaaatcagtttggattctgcaaaaaaggctgcttgtgaattttctgagacggatgtaacaaatactgaacatcatcaacccagtaataatgatttgaacaccactgagaagcgtgcagctgagaggcatccagaaaagtatcagggtagttctgtttcaaacttgcatgtggagccatgtggcacaaatactcatgccagctcattacagcatgagaacagcagtttattactcactaaagacagaatgaatgtagaaaaggctgaattctgtaataaaagcaaacagcctggcttagcaaggagccaacataacagatgggctggaagtaaggaaacatgtaatgataggcggactcccagcacagaaaaaaaggtagatctgaatgctgatcccctgtgtgagagaaaagaatggaataagcagaaactgccatgctcagagaatcctagagatactgaagatgttccttggataacactaaatagcagcattcagaaagttaatgagtggttttccagaagtgatgaactgttaggttctgatgactcacatgatggggagtctgaatcaaatgccaaagtagctgatgtattggacgttctaaatgaggtagatgaatattctggttcttcagagaaaatagacttactggccagtgatcctcatgaggctttaatatgtaaaagtgaaagagttcactccaaatcagtagagagtaatattgaagacaaaatatttgggaaaacctatcggaagaaggcaagcctccccaacttaagccatgtaactgaaaatctaattataggagcatttgttactgagccacagataatacaagagcgtcccctcacaaataaattaaagcgtaaaaggagacctacatcaggccttcatcctgaggattttatcaagaaagcagatttggcagttcaaaagactcctgaaatgataaatcagggaactaaccaaacggagcagaatggtcaagtgatgaatattactaatagtggtcatgagaataaaacaaaaggtgattctattcagaatgagaaaaatcctaacccaatagaatcactcgaaaaagaatctgctttcaaaacgaaagctgaacctataagcagcagtataagcaatatggaactcgaattaaatatccacaattcaaaagcacctaaaaagaataggctgaggaggaagtcttctaccaggcatattcatgcgcttgaactagtagtcagtagaaatctaagcccacctaattgtactgaattgcaaattgatagttgttctagcagtgaagagataaagaaaaaaaagtacaaccaaatgccagtcaggcacagcagaaacctacaactcatggaaggtaaagaacctgcaactggagccaagaagagtaacaagccaaatgaacagacaagtaaaagacatgacagcgatactttcccagagctgaagttaacaaatgcacctggttcttttactaagtgttcaaataccagtgaacttaaagaatttgtcaatcctagccttccaagagaagaaaaagaagagaaactagaaacagttaaagtgtctaataatgctgaagaccccaaagatctcatgttaagtggagaaagggttttgcaaactgaaagatctgtagagagtagcagtatttcattggtacctggtactgattatggcactcaggaaagtatctcgttactggaagttagcactctagggaaggcaaaaacagaaccaaataaatgtgtgagtcagtgtgcagcatttgaaaaccccaagggactaattcatggttgttccaaagataatagaaatgacacagaaggctttaagtatccattgggacatgaagttaaccacagtcgggaaacaagcatagaaatggaagaaagtgaacttgatgctcagtatttgcagaatacattcaaggtttcaaagcgccagtcatttgctccgttttcaaatccaggaaatgcagaagaggaatgtgcaacattctctgcccactctgggtccttaaagaaacaaagtccaaaagtcacttttgaatgtgaacaaaaggaagaaaatcaaggaaagaatgagtctaatatcaagcctgtacagacagttaatatcactgcaggctttcctgtggttggtcagaaagataagccagttgataatgccaaatgtagtatcaaaggaggctctaggttttgtctatcatctcagttcagaggcaacgaaactggactcattactccaaataaacatggacttttacaaaacccatatcgtataccaccactttttcccatcaagtcatttgttaaaactaaatgtaagaaaaatctgctagaggaaaactttgaggaacattcaatgtcacctgaaagagaaatgggaaatgagaacattccaagtacagtgagcacaattagccgtaataacattagagaaaatgtttttaaagaagccagctcaagcaatattaatgaagtaggttccagtactaatgaagtgggctccagtattaatgaaataggttccagtgatgaaaacattcaagcagaactaggtagaaacagagggccaaaattgaatgctatgcttagattaggggttttgcaacctgaggtctataaacaaagtcttcctggaagtaattgtaagcatcctgaaataaaaaagcaagaatatgaagaagtagttcagactgttaatacagatttctctccatatctgatttcagataacttagaacagcctatgggaagtagtcatgcatctcaggtttgttctgagacacctgatgacctgttagatgatggtgaaataaaggaagatactagttttgctgaaaatgacattaaggaaagttctgctgtttttagcaaaagcgtccagaaaggagagcttagcaggagtcctagccctttcacccatacacatttggctcagggttaccgaagaggggccaagaaattagagtcctcagaagagaacttatctagtgaggatgaagagcttccctgcttccaacacttgttatttggtaaagtaaacaatataccttctcagtctactaggcatagcaccgttgctaccgagtgtctgtctaagaacacagaggagaatttattatcattgaagaatagcttaaatgactgcagtaaccaggtaatattggcaaaggcatctcaggaacatcaccttagtgaggaaacaaaatgttctgctagcttgttttcttcacagtgcagtgaattggaagacttgactgcaaatacaaacacccaggatcctttcttgattggttcttccaaacaaatgaggcatcagtctgaaagccagggagttggtctgagtgacaaggaattggtttcagatgatgaagaaagaggaacgggcttggaagaaaataatcaagaagagcaaagcatggattcaaacttaggtgaagcagcatctgggtgtgagagtgaaacaagcgtctctgaagactgctcagggctatcctctcagagtgacattttaaccactcagcagagggataccatgcaacataacctgataaagctccagcaggaaatggctgaactagaagctgtgttagaacagcatgggagccagccttctaacagctacccttccatcataagtgactcttctgcccttgaggacctgcgaaatccagaacaaagcacatcagaaaaaggggtgacccagtctattaaagaaagaaaaatgctgaatgagcatgattttgaagtcagaggagatgtggtcaatggaagaaaccaccaaggtccaaagcgagcaagagaatcccaggacagaaagatcttcagggggctagaaatctgttgctatgggcccttcaccaacatgcccacagatcaactggaatggatggtacagctgtgtggtgcttctgtggtgaaggagctttcatcattcacccttggcacaggtgtccacccaattgtggttgtgcagccagatgcctggacagaggacaatggcttccatgcaattgggcagatgtgtgaggcacctgtggtgacccgagagtgggtgttggacagtgtagcactctaccagtgccaggagctggacacctacctgataccccagatcccccacagccactactgactgcagccagccacaggtacagagccacaggaccccaagaatgagcttacaaagtggcctttccaggccctgggagctcctctcactcttcagtccttctactgtcctggctactaaatattttatgtacatcagcctgaaaaggacttctggctatgcaagggtcccttaaagattttctgcttgaagtctcccttggaaatctgccatgagcacaaaattatggtaatttttcacctgagaagattttaaaaccatttaaacgccaccaattgagcaagatgctgattcattatttatcagccctattctttctattcaggctgttgttggcttagggctggaagcacagagtggcttggcctcaagagaatagctggtttccctaagtttacttctctaaaaccctgtgttcacaaaggcagagagtcagacccttcaatggaaggagagtgcttgggatcgattatgtgacttaaagtcagaatagtccttgggcagttctcaaatgttggagtggaacattggggaggaaattctgaggcaggtattagaaatgaaaaggaaacttgaaacctgggcatggtggctcacgcctgtaatcccagcactttgggaggccaaggtgggcagatcactggaggtcaggagttcgaaaccagcctggccaacatggtgaaaccccatctctactaaaaatacagaaattagccggtcatggtggtggacacctgtaatcccagctactcaggtggctaaggcaggagaatcacttcagcccgggaggtggaggttgcagtgagccaagatcataccacggcactccagcctgggtgacagtgagactgtggctcaaaaaaaaaaaaaaaaaaaggaaaatgaaactagaagagatttctaaaagtctgagatatatttgctagatttctaaagaatgtgttctaaaacagcagaagattttcaagaaccggtttccaaagacagtcttctaattcctcattagtaataagtaaaatgtttattgttgtagctctggtatataatccattcctcttaaaatataagacctctggcatgaatatttcatatctataaaatgacagatcccaccaggaaggaagctgttgctttctttgaggtgatttttttcctttgctccctgttgctgaaaccatacagcttcataaataattttgcttgctgaaggaagaaaaagtgtttttcataaacccattatccaggactgtttatagctgttggaaggactaggtcttccctagcccccccagtgtgcaagggcagtgaagacttgattgtacaaaatacgttttgtaaatgttgtgctgttaacactgcaaataaacttggtagcaaacacttcc

SEQ ID NO: 932 - DNA, 7094 bp, Homo sapiens
gagctcgctgagacttcctggacgggggacaggctgtggggtttctcagataactgggcccctgcgctcaggaggccttcaccctctgctctgggtaaagttcattggaacagaaagaaatggatttatctgctcttcgcgttgaagaagtacaaaatgtcattaatgctatgcagaaaatcttagagtgtcccatctgtctggagttgatcaaggaacctgtctccacaaagtgtgaccacatattttgcaaattttgcatgctgaaacttctcaaccagaagaaagggccttcacagtgtcctttatgtaagaatgatataaccaaaaggagcctacaagaaagtacgagatttagtcaacttgttgaagagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttgcaggaaaccagtctcagtgtccaactctctaaccttggaactgtgagaactctgaggacaaagcagcggatacaacctcaaaagacgtctgtctacattgaattgggatctgattcttctgaagataccgttaataaggcaacttattgcagtgtgggagatcaagaattgttacaaatcacccctcaaggaaccagggatgaaatcagtttggattctgcaaaaaaggctgcttgtgaattttctgagacggatgtaacaaatactgaacatcatcaacccagtaataatgatttgaacaccactgagaagcgtgcagctgagaggcatccagaaaagtatcagggtagttctgtttcaaacttgcatgtggagccatgtggcacaaatactcatgccagctcattacagcatgagaacagcagtttattactcactaaagacagaatgaatgtagaaaaggctgaattctgtaataaaagcaaacagcctggcttagcaaggagccaacataacagatgggctggaagtaaggaaacatgtaatgataggcggactcccagcacagaaaaaaaggtagatctgaatgctgatcccctgtgtgagagaaaagaatggaataagcagaaactgccatgctcagagaatcctagagatactgaagatgttccttggataacactaaatagcagcattcagaaagttaatgagtggttttccagaagtgatgaactgttaggttctgatgactcacatgatggggagtctgaatcaaatgccaaagtagctgatgtattggacgttctaaatgaggtagatgaatattctggttcttcagagaaaatagacttactggccagtgatcctcatgaggctttaatatgtaaaagtgaaagagttcactccaaatcagtagagagtaatattgaagacaaaatatttgggaaaacctatcggaagaaggcaagcctccccaacttaagccatgtaactgaaaatctaattataggagcatttgttactgagccacagataatacaagagcgtcccctcacaaataaattaaagcgtaaaaggagacctacatcaggccttcatcctgaggattttatcaagaaagcagatttggcagttcaaaagactcctgaaatgataaatcagggaactaaccaaacggagcagaatggtcaagtgatgaatattactaatagtggtcatgagaataaaacaaaaggtgattctattcagaatgagaaaaatcctaacccaatagaatcactcgaaaaagaatctgctttcaaaacgaaagctgaacctataagcagcagtataagcaatatggaactcgaattaaatatccacaattcaaaagcacctaaaaagaataggctgaggaggaagtcttctaccaggcatattcatgcgcttgaactagtagtcagtagaaatctaagcccacctaattgtactgaattgcaaattgatagttgttctagcagtgaagagataaagaaaaaaaagtacaaccaaatgccagtcaggcacagcagaaacctacaactcatggaaggtaaagaacctgcaactggagccaagaagagtaacaagccaaatgaacagacaagtaaaagacatgacagcgatactttcccagagctgaagttaacaaatgcacctggttcttttactaagtgttcaaataccagtgaacttaaagaatttgtcaatcctagccttccaagagaagaaaaagaagagaaactagaaacagttaaagtgtctaataatgctgaagaccccaaagatctcatgttaagtggagaaagggttttgcaaactgaaagatctgtagagagtagcagtatttcattggtacctggtactgattatggcactcaggaaagtatctcgttactggaagttagcactctagggaaggcaaaaacagaaccaaataaatgtgtgagtcagtgtgcagcatttgaaaaccccaagggactaattcatggttgttccaaagataatagaaatgacacagaaggctttaagtatccattgggacatgaagttaaccacagtcgggaaacaagcatagaaatggaagaaagtgaacttgatgctcagtatttgcagaatacattcaaggtttcaaagcgccagtcatttgctccgttttcaaatccaggaaatgcagaagaggaatgtgcaacattctctgcccactctgggtccttaaagaaacaaagtccaaaagtcacttttgaatgtgaacaaaaggaagaaaatcaaggaaagaatgagtctaatatcaagcctgtacagacagttaatatcactgcaggctttcctgtggttggtcagaaagataagccagttgataatgccaaatgtagtatcaaaggaggctctaggttttgtctatcatctcagttcagaggcaacgaaactggactcattactccaaataaacatggacttttacaaaacccatatcgtataccaccactttttcccatcaagtcatttgttaaaactaaatgtaagaaaaatctgctagaggaaaactttgaggaacattcaatgtcacctgaaagagaaatgggaaatgagaacattccaagtacagtgagcacaattagccgtaataacattagagaaaatgtttttaaagaagccagctcaagcaatattaatgaagtaggttccagtactaatgaagtgggctccagtattaatgaaataggttccagtgatgaaaacattcaagcagaactaggtagaaacagagggccaaaattgaatgctatgcttagattaggggttttgcaacctgaggtctataaacaaagtcttcctggaagtaattgtaagcatcctgaaataaaaaagcaagaatatgaagaagtagttcagactgttaatacagatttctctccatatctgatttcagataacttagaacagcctatgggaagtagtcatgcatctcaggtttgttctgagacacctgatgacctgttagatgatggtgaaataaaggaagatactagttttgctgaaaatgacattaaggaaagttctgctgtttttagcaaaagcgtccagaaaggagagcttagcaggagtcctagccctttcacccatacacatttggctcagggttaccgaagaggggccaagaaattagagtcctcagaagagaacttatctagtgaggatgaagagcttccctgcttccaacacttgttatttggtaaagtaaacaatataccttctcagtctactaggcatagcaccgttgctaccgagtgtctgtctaagaacacagaggagaatttattatcattgaagaatagcttaaatgactgcagtaaccaggtaatattggcaaaggcatctcaggaacatcaccttagtgaggaaacaaaatgttctgctagcttgttttcttcacagtgcagtgaattggaagacttgactgcaaatacaaacacccaggatcctttcttgattggttcttccaaacaaatgaggcatcagtctgaaagccagggagttggtctgagtgacaaggaattggtttcagatgatgaagaaagaggaacgggcttggaagaaaataatcaagaagagcaaagcatggattcaaacttaggtgaagcagcatctgggtgtgagagtgaaacaagcgtctctgaagactgctcagggctatcctctcagagtgacattttaaccactcagcagagggataccatgcaacataacctgataaagctccagcaggaaatggctgaactagaagctgtgttagaacagcatgggagccagccttctaacagctacccttccatcataagtgactcttctgcccttgaggacctgcgaaatccagaacaaagcacatcagaaaaagcagtattaacttcacagaaaagtagtgaataccctataagccagaatccagaaggcctttctgctgacaagtttgaggtgtctgcagatagttctaccagtaaaaataaagaaccaggagtggaaaggtcatccccttctaaatgcccatcattagatgataggtggtacatgcacagttgctctgggagtcttcagaatagaaactacccatctcaagaggagctcattaaggttgttgatgtggaggagcaacagctggaagagtctgggccacacgatttgacggaaacatcttacttgccaaggcaagatctagagggaaccccttacctggaatctggaatcagcctcttctctgatgaccctgaatctgatccttctgaagacagagccccagagtcagctcgtgttggcaacataccatcttcaacctctgcattgaaagttccccaattgaaagttgcagaatctgcccagagtccagctgctgctcatactactgatactgctgggtataatgcaatggaagaaagtgtgagcagggagaagccagaattgacagcttcaacagaaagggtcaacaaaagaatgtccatggtggtgtctggcctgaccccagaagaatttatgctcgtgtacaagtttgccagaaaacaccacatcactttaactaatctaattactgaagagactactcatgttgttatgaaaacagatgctgagtttgtgtgtgaacggacactgaaatattttctaggaattgcgggaggaaaatgggtagttagctatttctgggtgacccagtctattaaagaaagaaaaatgctgaatgagcatgattttgaagtcagaggagatgtggtcaatggaagaaaccaccaaggtccaaagcgagcaagagaatcccaggacagaaagatcttcagggggctagaaatctgttgctatgggcccttcaccaacatgcccacagatcaactggaatggatggtacagctgtgtggtgcttctgtggtgaaggagctttcatcattcacccttggcacaggtgtccacccaattgtggttgtgcagccagatgcctggacagaggacaatggcttccatgcaattgggcagatgtgtgaggcacctgtggtgacccgagagtgggtgttggacagtgtagcactctaccagtgccaggagctggacacctacctgataccccagatcccccacagccactactgactgcagccagccacaggtacagagccacaggaccccaagaatgagcttacaaagtggcctttccaggccctgggagctcctctcactcttcagtccttctactgtcctggctactaaatattttatgtacatcagcctgaaaaggacttctggctatgcaagggtcccttaaagattttctgcttgaagtctcccttggaaatctgccatgagcacaaaattatggtaatttttcacctgagaagattttaaaaccatttaaacgccaccaattgagcaagatgctgattcattatttatcagccctattctttctattcaggctgttgttggcttagggctggaagcacagagtggcttggcctcaagagaatagctggtttccctaagtttacttctctaaaaccctgtgttcacaaaggcagagagtcagacccttcaatggaaggagagtgcttgggatcgattatgtgacttaaagtcagaatagtccttgggcagttctcaaatgttggagtggaacattggggaggaaattctgaggcaggtattagaaatgaaaaggaaacttgaaacctgggcatggtggctcacgcctgtaatcccagcactttgggaggccaaggtgggcagatcactggaggtcaggagttcgaaaccagcctggccaacatggtgaaaccccatctctactaaaaatacagaaattagccggtcatggtggtggacacctgtaatcccagctactcaggtggctaaggcaggagaatcacttcagcccgggaggtggaggttgcagtgagccaagatcataccacggcactccagcctgggtgacagtgagactgtggctcaaaaaaaaaaaaaaaaaaaggaaaatgaaactagaagagatttctaaaagtctgagatatatttgctagatttctaaagaatgtgttctaaaacagcagaagattttcaagaaccggtttccaaagacagtcttctaattcctcattagtaataagtaaaatgtttattgttgtagctctggtatataatccattcctcttaaaatataagacctctggcatgaatatttcatatctataaaatgacagatcccaccaggaaggaagctgttgctttctttgaggtgatttttttcctttgctccctgttgctgaaaccatacagcttcataaataattttgcttgctgaaggaagaaaaagtgtttttcataaacccattatccaggactgtttatagctgttggaaggactaggtcttccctagcccccccagtgtgcaagggcagtgaagacttgattgtacaaaatacgttttgtaaatgttgtgctgttaacactgcaaataaacttggtagcaaacacttcca

SEQ ID NO: 933 - DNA, 2420 bp, Homo sapiens
attgctcagcggtttccgtggcaacagtaaagcgtgggaattacagataaattaaaactgtggaacccctttcctcggctgccgccaaggtgttcggtccttccgaggaagctaaggccgcgttggggtgagaccctcacttcatccgtctggagttgatcaaggaacctgtctccacaaagtgtgaccacatattttgcaaattttgcatgctgaaacttctcaaccagaagaaagggccttcacagtgtcctttatgtaagaatgatataaccaaaaggagcctacaagaaagtacgagatttagtcaacttgttgaagagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttgcaggaaaccagtctcagtgtccaactctctaaccttggaactgtgagaactctgaggacaaagcagcggatacaacctcaaaagacgtctgtctacattgaattgggatctgattcttctgaagataccgttaataaggcaacttattgcagtgtgggagatcaagaattgttacaaatcacccctcaaggaaccagggatgaaatcagtttggattctgcaaaaaaggctgcttgtgaattttctgagacggatgtaacaaatactgaacatcatcaacccagtaataatgatttgaacaccactgagaagcgtgcagctgagaggcatccagaaaagtatcagggtgaagcagcatctgggtgtgagagtgaaacaagcgtctctgaagactgctcagggctatcctctcagagtgacattttaaccactcagcagagggataccatgcaacataacctgataaagctccagcaggaaatggctgaactagaagctgtgttagaacagcatgggagccagccttctaacagctacccttccatcataagtgactcttctgcccttgaggacctgcgaaatccagaacaaagcacatcagaaaaagtattaacttcacagaaaagtagtgaataccctataagccagaatccagaaggcctttctgctgacaagtttgaggtgtctgcagatagttctaccagtaaaaataaagaaccaggagtggaaaggtcatccccttctaaatgcccatcattagatgataggtggtacatgcacagttgctctgggagtcttcagaatagaaactacccatctcaagaggagctcattaaggttgttgatgtggaggagcaacagctggaagagtctgggccacacgatttgacggaaacatcttacttgccaaggcaagatctagagggaaccccttacctggaatctggaatcagcctcttctctgatgaccctgaatctgatccttctgaagacagagccccagagtcagctcgtgttggcaacataccatcttcaacctctgcattgaaagttccccaattgaaagttgcagaatctgcccagagtccagctgctgctcatactactgatactgctgggtataatgcaatggaagaaagtgtgagcagggagaagccagaattgacagcttcaacagaaagggtcaacaaaagaatgtccatggtggtgtctggcctgaccccagaagaatttatgctcgtgtacaagtttgccagaaaacaccacatcactttaactaatctaattactgaagagactactcatgttgttatgaaaacagatgctgagtttgtgtgtgaacggacactgaaatattttctaggaattgcgggaggaaaatgggtagttagctatttctgggtgacccagtctattaaagaaagaaaaatgctgaatgagcatgattttgaagtcagaggagatgtggtcaatggaagaaaccaccaaggtccaaagcgagcaagagaatcccaggacagaaagatcttcagggggctagaaatctgttgctatgggcccttcaccaacatgcccacagatcaactggaatggatggtacagctgtgtggtgcttctgtggtgaaggagctttcatcattcacccttggcacaggtgtccacccaattgtggttgtgcagccagatgcctggacagaggacaatggcttccatgcaattgggcagatgtgtgaggcacctgtggtgacccgagagtgggtgttggacagtgtagcactctaccagtgccaggagctggacacctacctgataccccagatcccccacagccactactgactgcagccagccacaggtacagagccacaggaccccaagaatgagcttacaaagtggcctttccaggccctg

SEQ ID NO: 934 - DNA, 7269 bp, Homo sapiens
gtaccttgatttcgtattctgagaggctgctgcttagcggtagccccttggtttccgtggcaacggaaaagcgcgggaattacagataaattaaaactgcgactgcgcggcgtgagctcgctgagacttcctggacgggggacaggctgtggggtttctcagataactgggcccctgcgctcaggaggccttcaccctctgctctgggtaaagttcattggaacagaaagaaatggatttatctgctcttcgcgttgaagaagtacaaaatgtcattaatgctatgcagaaaatcttagagtgtcccatctgtctggagttgatcaaggaacctgtctccacaaagtgtgaccacatattttgcaaattttgcatgctgaaacttctcaaccagaagaaagggccttcacagtgtcctttatgtaagaatgatataaccaaaaggagcctacaagaaagtacgagatttagtcaacttgttgaagagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttgcaggaaaccagtctcagtgtccaactctctaaccttggaactgtgagaactctgaggacaaagcagcggatacaacctcaaaagacgtctgtctacattgaattgggatctgattcttctgaagataccgttaataaggcaacttattgcagtgtgggagatcaagaattgttacaaatcacccctcaaggaaccagggatgaaatcagtttggattctgcaaaaaaggctgcttgtgaattttctgagacggatgtaacaaatactgaacatcatcaacccagtaataatgatttgaacaccactgagaagcgtgcagctgagaggcatccagaaaagtatcagggtagttctgtttcaaacttgcatgtggagccatgtggcacaaatactcatgccagctcattacagcatgagaacagcagtttattactcactaaagacagaatgaatgtagaaaaggctgaattctgtaataaaagcaaacagcctggcttagcaaggagccaacataacagatgggctggaagtaaggaaacatgtaatgataggcggactcccagcacagaaaaaaaggtagatctgaatgctgatcccctgtgtgagagaaaagaatggaataagcagaaactgccatgctcagagaatcctagagatactgaagatgttccttggataacactaaatagcagcattcagaaagttaatgagtggttttccagaagtgatgaactgttaggttctgatgactcacatgatggggagtctgaatcaaatgccaaagtagctgatgtattggacgttctaaatgaggtagatgaatattctggttcttcagagaaaatagacttactggccagtgatcctcatgaggctttaatatgtaaaagtgaaagagttcactccaaatcagtagagagtaatattgaagacaaaatatttgggaaaacctatcggaagaaggcaagcctccccaacttaagccatgtaactgaaaatctaattataggagcatttgttactgagccacagataatacaagagcgtcccctcacaaataaattaaagcgtaaaaggagacctacatcaggccttcatcctgaggattttatcaagaaagcagatttggcagttcaaaagactcctgaaatgataaatcagggaactaaccaaacggagcagaatggtcaagtgatgaatattactaatagtggtcatgagaataaaacaaaaggtgattctattcagaatgagaaaaatcctaacccaatagaatcactcgaaaaagaatctgctttcaaaacgaaagctgaacctataagcagcagtataagcaatatggaactcgaattaaatatccacaattcaaaagcacctaaaaagaataggctgaggaggaagtcttctaccaggcatattcatgcgcttgaactagtagtcagtagaaatctaagcccacctaattgtactgaattgcaaattgatagttgttctagcagtgaagagataaagaaaaaaaagtacaaccaaatgccagtcaggcacagcagaaacctacaactcatggaaggtaaagaacctgcaactggagccaagaagagtaacaagccaaatgaacagacaagtaaaagacatgacagcgatactttcccagagctgaagttaacaaatgcacctggttcttttactaagtgttcaaataccagtgaacttaaagaatttgtcaatcctagccttccaagagaagaaaaagaagagaaactagaaacagttaaagtgtctaataatgctgaagaccccaaagatctcatgttaagtggagaaagggttttgcaaactgaaagatctgtagagagtagcagtatttcattggtacctggtactgattatggcactcaggaaagtatctcgttactggaagttagcactctagggaaggcaaaaacagaaccaaataaatgtgtgagtcagtgtgcagcatttgaaaaccccaagggactaattcatggttgttccaaagataatagaaatgacacagaaggctttaagtatccattgggacatgaagttaaccacagtcgggaaacaagcatagaaatggaagaaagtgaacttgatgctcagtatttgcagaatacattcaaggtttcaaagcgccagtcatttgctccgttttcaaatccaggaaatgcagaagaggaatgtgcaacattctctgcccactctgggtccttaaagaaacaaagtccaaaagtcacttttgaatgtgaacaaaaggaagaaaatcaaggaaagaatgagtctaatatcaagcctgtacagacagttaatatcactgcaggctttcctgtggttggtcagaaagataagccagttgataatgccaaatgtagtatcaaaggaggctctaggttttgtctatcatctcagttcagaggcaacgaaactggactcattactccaaataaacatggacttttacaaaacccatatcgtataccaccactttttcccatcaagtcatttgttaaaactaaatgtaagaaaaatctgctagaggaaaactttgaggaacattcaatgtcacctgaaagagaaatgggaaatgagaacattccaagtacagtgagcacaattagccgtaataacattagagaaaatgtttttaaagaagccagctcaagcaatattaatgaagtaggttccagtactaatgaagtgggctccagtattaatgaaataggttccagtgatgaaaacattcaagcagaactaggtagaaacagagggccaaaattgaatgctatgcttagattaggggttttgcaacctgaggtctataaacaaagtcttcctggaagtaattgtaagcatcctgaaataaaaaagcaagaatatgaagaagtagttcagactgttaatacagatttctctccatatctgatttcagataacttagaacagcctatgggaagtagtcatgcatctcaggtttgttctgagacacctgatgacctgttagatgatggtgaaataaaggaagatactagttttgctgaaaatgacattaaggaaagttctgctgtttttagcaaaagcgtccagaaaggagagcttagcaggagtcctagccctttcacccatacacatttggctcagggttaccgaagaggggccaagaaattagagtcctcagaagagaacttatctagtgaggatgaagagcttccctgcttccaacacttgttatttggtaaagtaaacaatataccttctcagtctactaggcatagcaccgttgctaccgagtgtctgtctaagaacacagaggagaatttattatcattgaagaatagcttaaatgactgcagtaaccaggtaatattggcaaaggcatctcaggaacatcaccttagtgaggaaacaaaatgttctgctagcttgttttcttcacagtgcagtgaattggaagacttgactgcaaatacaaacacccaggatcctttcttgattggttcttccaaacaaatgaggcatcagtctgaaagccagggagttggtctgagtgacaaggaattggtttcagatgatgaagaaagaggaacgggcttggaagaaaataatcaagaagagcaaagcatggattcaaacttaggtgaagcagcatctgggtgtgagagtgaaacaagcgtctctgaagactgctcagggctatcctctcagagtgacattttaaccactcagcagagggataccatgcaacataacctgataaagctccagcaggaaatggctgaactagaagctgtgttagaacagcatgggagccagccttctaacagctacccttccatcataagtgactcttctgcccttgaggacctgcgaaatccagaacaaagcacatcagaaaaagattcgcatatacatggccaaaggaacaactccatgttttctaaaaggcctagagaacatatatcagtattaacttcacagaaaagtagtgaataccctataagccagaatccagaaggcctttctgctgacaagtttgaggtgtctgcagatagttctaccagtaaaaataaagaaccaggagtggaaaggtcatccccttctaaatgcccatcattagatgataggtggtacatgcacagttgctctgggagtcttcagaatagaaactacccatctcaagaggagctcattaaggttgttgatgtggaggagcaacagctggaagagtctgggccacacgatttgacggaaacatcttacttgccaaggcaagatctagagggaaccccttacctggaatctggaatcagcctcttctctgatgaccctgaatctgatccttctgaagacagagccccagagtcagctcgtgttggcaacataccatcttcaacctctgcattgaaagttccccaattgaaagttgcagaatctgcccagagtccagctgctgctcatactactgatactgctgggtataatgcaatggaagaaagtgtgagcagggagaagccagaattgacagcttcaacagaaagggtcaacaaaagaatgtccatggtggtgtctggcctgaccccagaagaatttatgctcgtgtacaagtttgccagaaaacaccacatcactttaactaatctaattactgaagagactactcatgttgttatgaaaacagatgctgagtttgtgtgtgaacggacactgaaatattttctaggaattgcgggaggaaaatgggtagttagctatttctgggtgacccagtctattaaagaaagaaaaatgctgaatgagcatgattttgaagtcagaggagatgtggtcaatggaagaaaccaccaaggtccaaagcgagcaagagaatcccaggacagaaagatcttcagggggctagaaatctgttgctatgggcccttcaccaacatgcccacagatcaactggaatggatggtacagctgtgtggtgcttctgtggtgaaggagctttcatcattcacccttggcacaggtgtccacccaattgtggttgtgcagccagatgcctggacagaggacaatggcttccatgcaattgggcagatgtgtgaggcacctgtggtgacccgagagtgggtgttggacagtgtagcactctaccagtgccaggagctggacacctacctgataccccagatcccccacagccactactgactgcagccagccacaggtacagagccacaggaccccaagaatgagcttacaaagtggcctttccaggccctgggagctcctctcactcttcagtccttctactgtcctggctactaaatattttatgtacatcagcctgaaaaggacttctggctatgcaagggtcccttaaagattttctgcttgaagtctcccttggaaatctgccatgagcacaaaattatggtaatttttcacctgagaagattttaaaaccatttaaacgccaccaattgagcaagatgctgattcattatttatcagccctattctttctattcaggctgttgttggcttagggctggaagcacagagtggcttggcctcaagagaatagctggtttccctaagtttacttctctaaaaccctgtgttcacaaaggcagagagtcagacccttcaatggaaggagagtgcttgggatcgattatgtgacttaaagtcagaatagtccttgggcagttctcaaatgttggagtggaacattggggaggaaattctgaggcaggtattagaaatgaaaaggaaacttgaaacctgggcatggtggctcacgcctgtaatcccagcactttgggaggccaaggtgggcagatcactggaggtcaggagttcgaaaccagcctggccaacatggtgaaaccccatctctactaaaaatacagaaattagccggtcatggtggtggacacctgtaatcccagctactcaggtggctaaggcaggagaatcacttcagcccgggaggtggaggttgcagtgagccaagatcataccacggcactccagcctgggtgacagtgagactgtggctcaaaaaaaaaaaaaaaaaaaggaaaatgaaactagaagagatttctaaaagtctgagatatatttgctagatttctaaagaatgtgttctaaaacagcagaagattttcaagaaccggtttccaaagacagtcttctaattcctcattagtaataagtaaaatgtttattgttgtagctctggtatataatccattcctcttaaaatataagacctctggcatgaatatttcatatctataaaatgacagatcccaccaggaaggaagctgttgctttctttgaggtgatttttttcctttgctccctgttgctgaaaccatacagcttcataaataattttgcttgctgaaggaagaaaaagtgtttttcataaacccattatccaggactgtttatagctgttggaaggactaggtcttccctagcccccccagtgtgcaagggcagtgaagacttgattgtacaaaatacgttttgtaaatgttgtgctgttaacactgcaaataaacttggtagcaaacacttcc

SEQ ID NO: 935 - DNA, 5693 bp, Homo sapiens
cctctgctctgggtaaaggtagtagagtcccgggaaagggacagggggcccaagtgatgctctggggtactggcgtgggagagtggatttccgaagctgacagatggttcattggaacagaaagaaatggatttatctgctcttcgcgttgaagaagtacaaaatgtcattaatgctatgcagaaaatcttagagtgtcccatctgtctggagttgatcaaggaacctgtctccacaaagtgtgaccacatattttgcaaattttgcatgctgaaacttctcaaccagaagaaagggccttcacagtgtcctttatgagcctacaagaaagtacgagatttagtcaacttgttgaagagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttggaaaccagtctcagtgtccaactctctaaccttggaactgtgagaactctgaggacaaagcagcggatacaacctcaaaagacgtctgtctacattgaattgggatctgattcttctgaagataccgttaataaggcaacttattgcagtgtgggagatcaagaattgttacaaatcacccctcaaggaaccagggatgaaatcagtttggattctgcaaaaaaggctgcttgtgaattttctgagacggatgtaacaaatactgaacatcatcaacccagtaataatgatttgaacaccactgagaagcgtgcagctgagaggcatccagaaaagtatcagggtagttctgtttcaaacttgcatgtggagccatgtggcacaaatactcatgccagctcattacagcatgagaacagcagtttattactcactaaagacagaatgaatgtagaaaaggctgaattctgtaataaaagcaaacagcctggcttagcaaggagccaacataacagatgggctggaagtaaggaaacatgtaatgataggcggactcccagcacagaaaaaaaggtagatctgaatgctgatcccctgtgtgagagaaaagaatggaataagcagaaactgccatgctcagagaatcctagagatactgaagatgttccttggataacactaaatagcagcattcagaaagttaatgagtggttttccagaagtgatgaactgttaggttctgatgactcacatgatggggagtctgaatcaaatgccaaagtagctgatgtattggacgttctaaatgaggtagatgaatattctggttcttcagagaaaatagacttactggccagtgatcctcatgaggctttaatatgtaaaagtgaaagagttcactccaaatcagtagagagtaatattgaagacaaaatatttgggaaaacctatcggaagaaggcaagcctccccaacttaagccatgtaactgaaaatctaattataggagcatttgttactgagccacagataatacaagagcgtcccctcacaaataaattaaagcgtaaaaggagacctacatcaggccttcatcctgaggattttatcaagaaagcagatttggcagttcaaaagactcctgaaatgataaatcagggaactaaccaaacggagcagaatggtcaagtgatgaatattactaatagtggtcatgagaataaaacaaaaggtgattctattcagaatgagaaaaatcctaacccaatagaatcactcgaaaaagaatctgctttcaaaacgaaagctgaacctataagcagcagtataagcaatatggaactcgaattaaatatccacaattcaaaagcacctaaaaagaataggctgaggaggaagtcttctaccaggcatattcatgcgcttgaactagtagtcagtagaaatctaagcccacctaattgtactgaattgcaaattgatagttgttctagcagtgaagagataaagaaaaaaaagtacaaccaaatgccagtcaggcacagcagaaacctacaactcatggaaggtaaagaacctgcaactggagccaagaagagtaacaagccaaatgaacagacaagtaaaagacatgacagcgatactttcccagagctgaagttaacaaatgcacctggttcttttactaagtgttcaaataccagtgaacttaaagaatttgtcaatcctagccttccaagagaagaaaaagaagagaaactagaaacagttaaagtgtctaataatgctgaagaccccaaagatctcatgttaagtggagaaagggttttgcaaactgaaagatctgtagagagtagcagtatttcattggtacctggtactgattatggcactcaggaaagtatctcgttactggaagttagcactctagggaaggcaaaaacagaaccaaataaatgtgtgagtcagtgtgcagcatttgaaaaccccaagggactaattcatggttgttccaaagataatagaaatgacacagaaggctttaagtatccattgggacatgaagttaaccacagtcgggaaacaagcatagaaatggaagaaagtgaacttgatgctcagtatttgcagaatacattcaaggtttcaaagcgccagtcatttgctccgttttcaaatccaggaaatgcagaagaggaatgtgcaacattctctgcccactctgggtccttaaagaaacaaagtccaaaagtcacttttgaatgtgaacaaaaggaagaaaatcaaggaaagaatgagtctaatatcaagcctgtacagacagttaatatcactgcaggctttcctgtggttggtcagaaagataagccagttgataatgccaaatgtagtatcaaaggaggctctaggttttgtctatcatctcagttcagaggcaacgaaactggactcattactccaaataaacatggacttttacaaaacccatatcgtataccaccactttttcccatcaagtcatttgttaaaactaaatgtaagaaaaatctgctagaggaaaactttgaggaacattcaatgtcacctgaaagagaaatgggaaatgagaacattccaagtacagtgagcacaattagccgtaataacattagagaaaatgtttttaaagaagccagctcaagcaatattaatgaagtaggttccagtactaatgaagtgggctccagtattaatgaaataggttccagtgatgaaaacattcaagcagaactaggtagaaacagagggccaaaattgaatgctatgcttagattaggggttttgcaacctgaggtctataaacaaagtcttcctggaagtaattgtaagcatcctgaaataaaaaagcaagaatatgaagaagtagttcagactgttaatacagatttctctccatatctgatttcagataacttagaacagcctatgggaagtagtcatgcatctcaggtttgttctgagacacctgatgacctgttagatgatggtgaaataaaggaagatactagttttgctgaaaatgacattaaggaaagttctgctgtttttagcaaaagcgtccagaaaggagagcttagcaggagtcctagccctttcacccatacacatttggctcagggttaccgaagaggggccaagaaattagagtcctcagaagagaacttatctagtgaggatgaagagcttccctgcttccaacacttgttatttggtaaagtaaacaatataccttctcagtctactaggcatagcaccgttgctaccgagtgtctgtctaagaacacagaggagaatttattatcattgaagaatagcttaaatgactgcagtaaccaggtaatattggcaaaggcatctcaggaacatcaccttagtgaggaaacaaaatgttctgctagcttgttttcttcacagtgcagtgaattggaagacttgactgcaaatacaaacacccaggatcctttcttgattggttcttccaaacaaatgaggcatcagtctgaaagccagggagttggtctgagtgacaaggaattggtttcagatgatgaagaaagaggaacgggcttggaagaaaataatcaagaagagcaaagcatggattcaaacttaggtgaagcagcatctgggtgtgagagtgaaacaagcgtctctgaagactgctcagggctatcctctcagagtgacattttaaccactcagcagagggataccatgcaacataacctgataaagctccagcaggaaatggctgaactagaagctgtgttagaacagcatgggagccagccttctaacagctacccttccatcataagtgactcttctgcccttgaggacctgcgaaatccagaacaaagcacatcagaaaaagcagtattaacttcacagaaaagtagtgaataccctataagccagaatccagaaggcctttctgctgacaagtttgaggtgtctgcagatagttctaccagtaaaaataaagaaccaggagtggaaaggtcatccccttctaaatgcccatcattagatgataggtggtacatgcacagttgctctgggagtcttcagaatagaaactacccatctcaagaggagctcattaaggttgttgatgtggaggagcaacagctggaagagtctgggccacacgatttgacggaaacatcttacttgccaaggcaagatctagagggaaccccttacctggaatctggaatcagcctcttctctgatgaccctgaatctgatccttctgaagacagagccccagagtcagctcgtgttggcaacataccatcttcaacctctgcattgaaagttccccaattgaaagttgcagaatctgcccagagtccagctgctgctcatactactgatactgctgggtataatgcaatggaagaaagtgtgagcagggagaagccagaattgacagcttcaacagaaagggtcaacaaaagaatgtccatggtggtgtctggcctgaccccagaagaatttatgctcgtgtacaagtttgccagaaaacaccacatcactttaactaatctaattactgaagagactactcatgttgttatgaaaacagatgctgagtttgtgtgtgaacggacactgaaatattttctaggaattgcgggaggaaaatgggtagttagctatttctgggtgacccagtctattaaagaaagaaaaatgctgaatgagcatgattttgaagtcagaggagatgtggtcaatggaagaaaccaccaaggtccaaagcgagcaagagaatcccaggacagaaagatcttcagggggctagaaatctgttgctatgggcccttcaccaacatgcccacagatcaactggaatggatggtacagctgtgtggtgcttctgtggtgaaggagctttcatcattcacccttggcacaggtgtccacccaattgtggttgtgcagccagatgcctggacagaggacaatggcttccatgcaattgggcagatgtgtgaggcacctgtggtgacccgagagtgggtgttggacagtgtagcactctaccagtgccaggagctggacacctacctgataccccagatcccccacagccactactga

SEQ ID NO: 936 - DNA, 582 bp, Homo sapiens
gagctcgctgagacttcctggacgggggacaggctgtggggtttctcagataactgggcccctgcgctcaggaggccttcaccctctgctctggttcattggaacagaaagaaatggatttatctgctcttcgcgttgaagaagtacaaaatgtcattaatgctatgcagaaaatcttagagtgtcccatctgtctggagttgatcaaggaacctgtctccacaaagtgtgaccacatattttgcaaattttgcatgctgaaacttctcaaccagaagaaagggccttcacagtgtcctttatgagcctacaagaaagtacgagatttagtcaacttgttgaagagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttgcaggaaaccagtctcagtgtccaactctctaaccttggaactgtgagaac

SEQ ID NO: 937 - DNA, 3273 bp, Homo sapiens
cttagcggtagccccttggtttccgtggcaacggaaaagcgcgggaattacagataaattaaaactgcgactgcgcggcgtgagctcgctgagacttcctggacgggggacaggctgtggggtttctcagataactgggcccctgcgctcaggaggccttcaccctctgctctggttcattggaacagaaagaaatggatttatctgctcttcgcgttgaagaagtacaaaatgtcattaatgctatgcagaaaatcttagagtgtcccatctgtctggagttgatcaaggaacctgtctccacaaagtgtgaccacatattttgcaaattttgcatgctgaaacttctcaaccagaagaaagggccttcacagtgtcctttatgtaagaatgatataaccaaaaggagcctacaagaaagtacgagatttagtcaacttgttgaagagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttgcaggaaaccagtctcagtgtccaactctctaaccttggaactgtgagaactctgaggacaaagcagcggatacaacctcaaaagacgtctgtctacattgaattgggatctgattcttctgaagataccgttaataaggcaacttattgcagtgtgggagatcaagaattgttacaaatcacccctcaaggaaccagggatgaaatcagtttggattctgcaaaaaaggctgcttgtgaattttctgagacggatgtaacaaatactgaacatcatcaacccagtaataatgatttgaacaccactgagaagcgtgcagctgagaggcatccagaaaagtatcagggtgaagcagcatctgggtgtgagagtgaaacaagcgtctctgaagactgctcagggctatcctctcagagtgacattttaaccactcagcagagggataccatgcaacataacctgataaagctccagcaggaaatggctgaactagaagctgtgttagaacagcatgggagccagccttctaacagctacccttccatcataagtgactcttctgcccttgaggacctgcgaaatccagaacaaagcacatcagaaaaagtattaacttcacagaaaagtagtgaataccctataagccagaatccagaaggcctttctgctgacaagtttgaggtgtctgcagatagttctaccagtaaaaataaagaaccaggagtggaaaggtcatccccttctaaatgcccatcattagatgataggtggtacatgcacagttgctctgggagtcttcagaatagaaactacccatctcaagaggagctcattaaggttgttgatgtggaggagcaacagctggaagagtctgggccacacgatttgacggaaacatcttacttgccaaggcaagatctagagggaaccccttacctggaatctggaatcagcctcttctctgatgaccctgaatctgatccttctgaagacagagccccagagtcagctcgtgttggcaacataccatcttcaacctctgcattgaaagttccccaattgaaagttgcagaatctgcccagagtccagctgctgctcatactactgatactgctgggtataatgcaatggaagaaagtgtgagcagggagaagccagaattgacagcttcaacagaaagggtcaacaaaagaatgtccatggtggtgtctggcctgaccccagaagaatttatgctcgtgtacaagtttgccagaaaacaccacatcactttaactaatctaattactgaagagactactcatgttgttatgaaaacagatgctgagtttgtgtgtgaacggacactgaaatattttctaggaattgcgggaggaaaatgggtagttagctatttctgggtgacccagtctattaaagaaagaaaaatgctgaatgagcatgattttgaagtcagaggagatgtggtcaatggaagaaaccaccaaggtccaaagcgagcaagagaatcccaggacagaaagatcttcagggggctagaaatctgttgctatgggcccttcaccaacatgcccacagggtgtccacccaattgtggttgtgcagccagatgcctggacagaggacaatggcttccatgcaattgggcagatgtgtgaggcacctgtggtgacccgagagtgggtgttggacagtgtagcactctaccagtgccaggagctggacacctacctgataccccagatcccccacagccactactgactgcagccagccacaggtacagagccacaggaccccaagaatgagcttacaaagtggcctttccaggccctgggagctcctctcactcttcagtccttctactgtcctggctactaaatattttatgtacatcagcctgaaaaggacttctggctatgcaagggtcccttaaagattttctgcttgaagtctcccttggaaatctgccatgagcacaaaattatggtaatttttcacctgagaagattttaaaaccatttaaacgccaccaattgagcaagatgctgattcattatttatcagccctattctttctattcaggctgttgttggcttagggctggaagcacagagtggcttggcctcaagagaatagctggtttccctaagtttacttctctaaaaccctgtgttcacaaaggcagagagtcagacccttcaatggaaggagagtgcttgggatcgattatgtgacttaaagtcagaatagtccttgggcagttctcaaatgttggagtggaacattggggaggaaattctgaggcaggtattagaaatgaaaaggaaacttgaaacctgggcatggtggctcacgcctgtaatcccagcactttgggaggccaaggtgggcagatcactggaggtcaggagttcgaaaccagcctggccaacatggtgaaaccccatctctactaaaaatacagaaattagccggtcatggtggtggacacctgtaatcccagctactcaggtggctaaggcaggagaatcacttcagcccgggaggtggaggttgcagtgagccaagatcataccacggcactccagcctgggtgacagtgagactgtggctcaaaaaaaaaaaaaaaaaaa

SEQ ID NO: 938 - DNA, 2108 bp, Homo sapiens
agataactgggcccctgcgctcaggaggccttcaccctctgctctgggtaaaggtagtagagtcccgggaaagggacagggggcccaagtgatgctctggggtactggcgtgggagagtggatttccgaagctgacagatggttcattggaacagaaagaaatggatttatctgctcttcgcgttgaagaagtacaaaatgtcattaatgctatgcagaaaatcttagagtgtcccatctgtctggagttgatcaaggaacctgtctccacaaagtgtgaccacatattttgcaaattttgcatgctgaaacttctcaaccagaagaaagggccttcacagtgtcctttatgtaagaatgatataaccaaaaggagcctacaagaaagtacgagatttagtcaacttgttgaagagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttgcaggaaaccagtctcagtgtccaactctctaaccttggaactgtgagaactctgaggacaaagcagcggatacaacctcaaaagacgtctgtctacattgaattgggatctgattcttctgaagataccgttaataaggcaacttattgcagtgtgggagatcaagaattgttacaaatcacccctcaaggaaccagggatgaaatcagtttggattctgcaaaaaaggctgcttgtgaattttctgagacggatgtaacaaatactgaacatcatcaacccagtaataatgatttgaacaccactgagaagcgtgcagctgagaggcatccagaaaagtatcagggtagttctgtttcaaacttgcatgtggagccatgtggcacaaatactcatgccagctcattacagcatgagaacagcagtttattactcactaaagacagaatgaatgtagaaaaggctgaattctgtaataaaagcaaacagcctggcttagcaaggagccaacataacagatgggctggaagtaaggaaacatgtaatgataggcggactcccagcacagaaaaaaaggtagatctgaatgctgatcccctgtgtgagagaaaagaatggaataagcagaaactgccatgctcagagaatcctagagatactgaagatgttccttggataacactaaatagcagcattcagaaagttaatgagtggttttccagaagtgatgaactgttaggttctgatgactcacatgatggggagtctgaatcaaatgccaaagtagctgatgtattggacgttctaaatgaggtagatgaatattctggttcttcagagaaaatagacttactggccagtgatcctcatgaggctttaatatgtaaaagtgaaagagttcactccaaatcagtagagagtaatattgaagacaaaatatttgggaaaacctatcggaagaaggcaagcctccccaacttaagccatgtaactgaaaatctaattataggagcatttgttactgagccacagataatacaagagcgtcccctcacaaataaattaaagcgtaaaaggagacctacatcaggccttcatcctgaggattttatcaagaaagcagatttggcagttcaaaagactcctgaaatgataaatcagggaactaaccaaacggagcagaatggtcaagtgatgaatattactaatagtggtcatgagaataaaacaaaaggtgattctattcagaatgagaaaaatcctaacccaatagaatcactcgaaaaagaatctgctttcaaaacgaaagctgaacctataagcagcagtataagcaatatggaactcgaattaaatatccacaattcaaaagcacctaaaaagaataggctgaggaggaagtcttctaccaggcatattcatgcgcttgaactagtagtcagtagaaatctaagcccacctaattgtactgaattgcaaattgatagttgttctagcagtgaagag

SEQ ID NO: 939 - DNA, 5939 bp, Homo sapiens
gtaccttgatttcgtattctgagaggctgctgcttagcggtagccccttggtttccgtggcaacggaaaagcgcgggaattacagataaattaaaactgcgactgcgcggcgtgagctcgctgagacttcctggacgggggacaggctgtggggtttctcagataactgggcccctgcgctcaggaggccttcaccctctgctctgggtaaagttcattggaacagaaagaaatggatttatctgctcttcgcgttgaagaagtacaaaatgtcattaatgctatgcagaaaatcttagagtgtcccatctgtctggagttgatcaaggaacctgtctccacaaagtgtgaccacatattttgcaaattttgcatgctgaaacttctcaaccagaagaaagggccttcacagtgtcctttatgtaagaatgatataaccaaaaggagcctacaagaaagtacgagatttagtcaacttgttgaagagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttgcaggaaaccagtctcagtgtccaactctctaaccttggaactgtgagaactctgaggacaaagcagcggatacaacctcaaaagacgtctgtctacattgaattgggatctgattcttctgaagataccgttaataaggcaacttattgcagtgtgggagatcaagaattgttacaaatcacccctcaaggaaccagggatgaaatcagtttggattctgcaaaaaaggctgcttgtgaattttctgagacggatgtaacaaatactgaacatcatcaacccagtaataatgatttgaacaccactgagaagcgtgcagctgagaggcatccagaaaagtatcagggtagttctgtttcaaacttgcatgtggagccatgtggcacaaatactcatgccagctcattacagcatgagaacagcagtttattactcactaaagacagaatgaatgtagaaaaggctgaattctgtaataaaagcaaacagcctggcttagcaaggagccaacataacagatgggctggaagtaaggaaacatgtaatgataggcggactcccagcacagaaaaaaaggtagatctgaatgctgatcccctgtgtgagagaaaagaatggaataagcagaaactgccatgctcagagaatcctagagatactgaagatgttccttggataacactaaatagcagcattcagaaagttaatgagtggttttccagaagtgatgaactgttaggttctgatgactcacatgatggggagtctgaatcaaatgccaaagtagctgatgtattggacgttctaaatgaggtagatgaatattctggttcttcagagaaaatagacttactggccagtgatcctcatgaggctttaatatgtaaaagtgaaagagttcactccaaatcagtagagagtaatattgaagacaaaatatttgggaaaacctatcggaagaaggcaagcctccccaacttaagccatgtaactgaaaatctaattataggagcatttgttactgagccacagataatacaagagcgtcccctcacaaataaattaaagcgtaaaaggagacctacatcaggccttcatcctgaggattttatcaagaaagcagatttggcagttcaaaagactcctgaaatgataaatcagggaactaaccaaacggagcagaatggtcaagtgatgaatattactaatagtggtcatgagaataaaacaaaaggtgattctattcagaatgagaaaaatcctaacccaatagaatcactcgaaaaagaatctgctttcaaaacgaaagctgaacctataagcagcagtataagcaatatggaactcgaattaaatatccacaattcaaaagcacctaaaaagaataggctgaggaggaagtcttctaccaggcatattcatgcgcttgaactagtagtcagtagaaatctaagcccacctaattgtactgaattgcaaattgatagttgttctagcagtgaagagataaagaaaaaaaagtacaaccaaatgccagtcaggcacagcagaaacctacaactcatggaaggtaaagaacctgcaactggagccaagaagagtaacaagccaaatgaacagacaagtaaaagacatgacagcgatactttcccagagctgaagttaacaaatgcacctggttcttttactaagtgttcaaataccagtgaacttaaagaatttgtcaatcctagccttccaagagaagaaaaagaagagaaactagaaacagttaaagtgtctaataatgctgaagaccccaaagatctcatgttaagtggagaaagggttttgcaaactgaaagatctgtagagagtagcagtatttcattggtacctggtactgattatggcactcaggaaagtatctcgttactggaagttagcactctagggaaggcaaaaacagaaccaaataaatgtgtgagtcagtgtgcagcatttgaaaaccccaagggactaattcatggttgttccaaagataatagaaatgacacagaaggctttaagtatccattgggacatgaagttaaccacagtcgggaaacaagcatagaaatggaagaaagtgaacttgatgctcagtatttgcagaatacattcaaggtttcaaagcgccagtcatttgctccgttttcaaatccaggaaatgcagaagaggaatgtgcaacattctctgcccactctgggtccttaaagaaacaaagtccaaaagtcacttttgaatgtgaacaaaaggaagaaaatcaaggaaagaatgagtctaatatcaagcctgtacagacagttaatatcactgcaggctttcctgtggttggtcagaaagataagccagttgataatgccaaatgtagtatcaaaggaggctctaggttttgtctatcatctcagttcagaggcaacgaaactggactcattactccaaataaacatggacttttacaaaacccatatcgtataccaccactttttcccatcaagtcatttgttaaaactaaatgtaagaaaaatctgctagaggaaaactttgaggaacattcaatgtcacctgaaagagaaatgggaaatgagaacattccaagtacagtgagcacaattagccgtaataacattagagaaaatgtttttaaagaagccagctcaagcaatattaatgaagtaggttccagtactaatgaagtgggctccagtattaatgaaataggttccagtgatgaaaacattcaagcagaactaggtagaaacagagggccaaaattgaatgctatgcttagattaggggttttgcaacctgaggtctataaacaaagtcttcctggaagtaattgtaagcatcctgaaataaaaaagcaagaatatgaagaagtagttcagactgttaatacagatttctctccatatctgatttcagataacttagaacagcctatgggaagtagtcatgcatctcaggtttgttctgagacacctgatgacctgttagatgatggtgaaataaaggaagatactagttttgctgaaaatgacattaaggaaagttctgctgtttttagcaaaagcgtccagaaaggagagcttagcaggagtcctagccctttcacccatacacatttggctcagggttaccgaagaggggccaagaaattagagtcctcagaagagaacttatctagtgaggatgaagagcttccctgcttccaacacttgttatttggtaaagtaaacaatataccttctcagtctactaggcatagcaccgttgctaccgagtgtctgtctaagaacacagaggagaatttattatcattgaagaatagcttaaatgactgcagtaaccaggtaatattggcaaaggcatctcaggaacatcaccttagtgaggaaacaaaatgttctgctagcttgttttcttcacagtgcagtgaattggaagacttgactgcaaatacaaacacccaggatcctttcttgattggttcttccaaacaaatgaggcatcagtctgaaagccagggagttggtctgagtgacaaggaattggtttcagatgatgaagaaagaggaacgggcttggaagaaaataatcaagaagagcaaagcatggattcaaacttaggtgaagcagcatctgggtgtgagagtgaaacaagcgtctctgaagactgctcagggctatcctctcagagtgacattttaaccactcagcagagggataccatgcaacataacctgataaagctccagcaggaaatggctgaactagaagctgtgttagaacagcatgggagccagccttctaacagctacccttccatcataagtgactcttctgcccttgaggacctgcgaaatccagaacaaagcacatcagaaaaagattcgcatatacatggccaaaggaacaactccatgttttctaaaaggcctagagaacatatatcagcagtattaacttcacagaaaagtagtgaataccctataagccagaatccagaaggcctttctgctgacaagtttgaggtgtctgcagatagttctaccagtaaaaataaagaaccaggagtggaaaggtcatccccttctaaatgcccatcattagatgataggtggtacatgcacagttgctctgggagtcttcagaatagaaactacccatctcaagaggagctcattaaggttgttgatgtggaggagcaacagctggaagagtctgggccacacgatttgacggaaacatcttacttgccaaggcaagatctagagggaaccccttacctggaatctggaatcagcctcttctctgatgaccctgaatctgatccttctgaagacagagccccagagtcagctcgtgttggcaacataccatcttcaacctctgcattgaaagttccccaattgaaagttgcagaatctgcccagagtccagctgctgctcatactactgatactgctgggtataatgcaatggaagaaagtgtgagcagggagaagccagaattgacagcttcaacagaaagggtcaacaaaagaatgtccatggtggtgtctggcctgaccccagaagaatttatgctcgtgtacaagtttgccagaaaacaccacatcactttaactaatctaattactgaagagactactcatgttgttatgaaaacagatgctgagtttgtgtgtgaacggacactgaaatattttctaggaattgcgggaggaaaatgggtagttagctatttctgggtgacccagtctattaaagaaagaaaaatgctgaatgagcatgattttgaagtcagaggagatgtggtcaatggaagaaaccaccaaggtccaaagcgagcaagagaatcccaggacagaaagatcttcagggggctagaaatctgttgctatgggcccttcaccaacatgcccacagatcaactggaatggatggtacagctgtgtggtgcttctgtggtgaaggagctttcatcattcacccttggcacaggtgtccacccaattgtggttgtgcagccagatgcctggacagaggacaatggcttccatgcaattgggcagatgtgtgaggcacctgtggtgacccgagagtgggtgttggacagtgtagcactctaccagtgccaggagctggacacctacctgataccccagatcccccacagccactactgactgcagccagccacaggtacagagccacaggaccccaagaatgagctta

SEQ ID NO: 940 - DNA, 769 bp, Homo sapiens
ctggacgggggacaggctgtggggtttctcagataactgggcccctgcgctcaggaggccttcaccctctgctctgggtaaagttcattggaacagaaagaaatggatttatctgctcttcgcgttgaagaagtacaaaatgtcattaatgctatgcagaaaatcttagagtgtcccatctgtctggagttgatcaaggaacctgtctccacaaagtgtgaccacatattttgcaaattttgcatgctgaaacttctcaaccagaagaaagggccttcacagtgtcctttatgtaagaatgatataaccaaaaggagcctacaagaaagtacgagatttagtcaacttgttgaagagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttggaaaccagtctcagtgtccaactctctaaccttggaactgtgagaactctgaggacaaagcagcggatacaacctcaaaagacgtctgtctacattgaattgggatctgattcttctgaagataccgttaataaggcaacttattgcagtgtgggagatcaagaattgttacaaatcacccctcaaggaaccagggatgaaatcagtttggattctgcaaaaaagg

SEQ ID NO: 941 - DNA, 1980 bp, Homo sapiens
gctgagacttcctggacgggggacaggctgtggggtttctcagataactgggcccctgcgctcaggaggccttcaccctctgctctgggtaaagttcattggaacagaaagaaatggatttatctgctcttcgcgttgaagaagtacaaaatgtcattaatgctatgcagaaaatcttagagtgtcccatctgtctggagttgatcaaggaacctgtctccacaaagtgtgaccacatattttgcaagagcctacaagaaagtacgagatttagtcaacttgttgaagagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttgcaggaaaccagtctcagtgtccaactctctaaccttggaactgtgagaactctgaggacaaagcagcggatacaacctcaaaagacgtctgtctacattgaattgggatctgattcttctgaagataccgttaataaggcaacttattgcagtgtgggagatcaagaattgttacaaatcacccctcaaggaaccagggatgaaatcagtttggattctgcaaaaaaggctgcttgtgaattttctgagacggatgtaacaaatactgaacatcatcaacccagtaataatgatttgaacaccactgagaagcgtgcagctgagaggcatccagaaaagtatcagggtagttctgtttcaaacttgcatgtggagccatgtggcacaaatactcatgccagctcattacagcatgagaacagcagtttattactcactaaagacagaatgaatgtagaaaaggctgaattctgtaataaaagcaaacagcctggcttagcaaggagccaacataacagatgggctggaagtaaggaaacatgtaatgataggcggactcccagcacagaaaaaaaggtagatctgaatgctgatcccctgtgtgagagaaaagaatggaataagcagaaactgccatgctcagagaatcctagagatactgaagatgttccttggataacactaaatagcagcattcagaaagttaatgagtggttttccagaagtgatgaactgttaggttctgatgactcacatgatggggagtctgaatcaaatgccaaagtagctgatgtattggacgttctaaatgaggtagatgaatattctggttcttcagagaaaatagacttactggccagtgatcctcatgaggctttaatatgtaaaagtgaaagagttcactccaaatcagtagagagtaatattgaagacaaaatatttgggaaaacctatcggaagaaggcaagcctccccaacttaagccatgtaactgaaaatctaattataggagcatttgttactgagccacagataatacaagagcgtcccctcacaaataaattaaagcgtaaaaggagacctacatcaggccttcatcctgaggattttatcaagaaagcagatttggcagttcaaaagactcctgaaatgataaatcagggaactaaccaaacggagcagaatggtcaagtgatgaatattactaatagtggtcatgagaataaaacaaaaggtgattctattcagaatgagaaaaatcctaacccaatagaatcactcgaaaaagaatctgctttcaaaacgaaagctgaacctataagcagcagtataagcaatatggaactcgaattaaatatccacaattcaaaagcacctaaaaagaataggctgaggaggaagtcttctaccaggcatattcatgcgcttgaactagtagtcagtagaaatctaagcccacctaattgtactgaattgcaaattgatagttgttctagcagtgaag

SEQ ID NO: 942 - DNA, 1972 bp, Homo sapiens
gacttcctggacgggggacaggctgtggggtttctcagataactgggcccctgcgctcaggaggccttcaccctctgctctggttcattggaacagaaagaaatggatttatctgctcttcgcgttgaagaagtacaaaatgtcattaatgctatgcagaaaatcttagagtgtcccatctgtctggagttgatcaaggaacctgtctccacaaagtgtgaccacatattttgcaaattttgcatgctgaaacttctcaaccagaagaaagggccttcacagtgtcctttatgtaagaatgatataaccaaaaggagcctacaagaaagtacgagatttagtcaacttgttgaagagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttggaaaccagtctcagtgtccaactctctaaccttggaactgtgagaactctgaggacaaagcagcggatacaacctcaaaagacgtctgtctacattgaattgggatctgattcttctgaagataccgttaataaggcaacttattgcagtgtgggagatcaagaattgttacaaatcacccctcaaggaaccagggatgaaatcagtttggattctgcaaaaaaggctgcttgtgaattttctgagacggatgtaacaaatactgaacatcatcaacccagtaataatgatttgaacaccactgagaagcgtgcagctgagaggcatccagaaaagtatcagggtgaagcagcatctgggtgtgagagtgaaacaagcgtctctgaagactgctcagggctatcctctcagagtgacattttaaccactcagcagagggataccatgcaacataacctgataaagctccagcaggaaatggctgaactagaagctgtgttagaacagcatgggagccagccttctaacagctacccttccatcataagtgactcttctgcccttgaggacctgcgaaatccagaacaaagcacatcagaaaaagcagtattaacttcacagaaaagtagtgaataccctataagccagaatccagaaggcctttctgctgacaagtttgaggtgtctgcagatagttctaccagtaaaaataaagaaccaggagtggaaaggtcatccccttctaaatgcccatcattagatgataggtggtacatgcacagttgctctgggagtcttcagaatagaaactacccatctcaagaggagctcattaaggttgttgatgtggaggagcaacagctggaagagtctgggccacacgatttgacggaaacatcttacttgccaaggcaagatctagagggaaccccttacctggaatctggaatcagcctcttctctgatgaccctgaatctgatccttctgaagacagagccccagagtcagctcgtgttggcaacataccatcttcaacctctgcattgaaagttccccaattgaaagttgcagaatctgcccagagtccagctgctgctcatactactgatactgctgggtataatgcaatggaagaaagtgtgagcagggagaagccagaattgacagcttcaacagaaagggtcaacaaaagaatgtccatggtggtgtctggcctgaccccagaagaatttatgctcgtgtacaagtttgccagaaaacaccacatcactttaactaatctaattactgaagagactactcatgttgttatgaaaacagatgctgagtttgtgtgtgaacggacactgaaatattttctaggaattgcgggaggaaaatgggtagttagctatttctgggtgacccagtctattaaagaaagaaaaa

SEQ ID NO: 943 - DNA, 1495 bp, Homo sapiens
gagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttggaaaccagtctcagtgtccaactctctaaccttggaactgtgagaactctgaggacaaagcagcggatacaacctcaaaagacgtctgtctacattgaattggctgcttgtgaattttctgagacggatgtaacaaatactgaacatcatcaacccagtaataatgatttgaacaccactgagaagcgtgcagctgagaggcatccagaaaagtatcagggtgaagcagcatctgggtgtgagagtgaaacaagcgtctctgaagactgctcagggctatcctctcagagtgacattttaaccactcagcagagggataccatgcaacataacctgataaagctccagcaggaaatggctgaactagaagctgtgttagaacagcatgggagccagccttctaacagctacccttccatcataagtgactcttctgcccttgaggacctgcgaaatccagaacaaagcacatcagaaaaagcagtattaacttcacagaaaagtagtgaataccctataagccagaatccagaaggcctttctgctgacaagtttgaggtgtctgcagatagttctaccagtaaaaataaagaaccaggagtggaaaggtcatccccttctaaatgcccatcattagatgataggtggtacatgcacagttgctctgggagtcttcagaatagaaactacccatctcaagaggagctcattaaggttgttgatgtggaggagcaacagctggaagagtctgggccacacgatttgacggaaacatcttacttgccaaggcaagatctagagggaaccccttacctggaatctggaatcagcctcttctctgatgaccctgaatctgatccttctgaagacagagccccagagtcagctcgtgttggcaacataccatcttcaacctctgcattgaaagttccccaattgaaagttgcagaatctgcccagagtccagctgctgctcatactactgatactgctgggtataatgcaatggaagaaagtgtgagcagggagaagccagaattgacagcttcaacagaaagggtcaacaaaagaatgtccatggtggtgtctggcctgaccccagaagaatttatgctcgtgtacaagtttgccagaaaacaccacatcactttaactaatctaattactgaagagactactcatgttgttatgaaaacagatgctgagtttgtgtgtgaacggacactgaaatattttctaggaattgcgggaggaaaatgggtagttagctatttctgggtgacccagtctattaaagaaagaaaaa

SEQ ID NO: 944 - DNA, 455 bp, Homo sapiens
ataactgggcccctgcgctcaggaggccttcaccctctgctctgggtaaaggtagtagagtcccgggaaagggacagggggcccaagtgatgctctggggtactggcgtgggagagtggatttccgaagctgacagatggttcattggaacagaaagaaatggatttatctgctcttcgcgttgaagaagtacaaaatgtcattaatgctatgcagaaaatcttagagtgtcccatctgtctggagttgatcaaggaacctgtctccacaaagtgtgaccacatattttgcaagagcctacaagaaagtacgagatttagtcaacttgttgaagagctattgaaaatcatttgtgcttttcagcttgacacaggtttggagtatgcaaacagctataattttgcaaaaaaggaaaataactctcctgaacatctaaaagatgaagtttctatcat

SEQ ID NO: 945 - DNA, 2379 bp, Homo sapiens
ttcctggacgggggacaggctgtggggtttctcagataactgggcccctgcgctcaggaggccttcaccctctgctctggttcattggaacagaaagaaatggatttatctgctcttcgcgttgaagaagtacaaaatgtcattaatgctatgcagaaaatcttagagtgtcccatctgtctggagttgatcaaggaacctgtctccacaaagtgtgaccacatattttgcaaattttgcatgctgaaacttctcaaccagaagaaagggccttcacagtgtcctttatgtaagaatgatataaccaaaaggagcctacaagaaagtacgagatttagtcaacttgttgaagagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttgcaggaaaccagtctcagtgtccaactctctaaccttggaactgtgagaactctgaggacaaagcagcggatacaacctcaaaagacgtctgtctacattgaattgggatctgattcttctgaagataccgttaataaggcaacttattgcagtgtgggagatcaagaattgttacaaatcacccctcaaggaaccagggatgaaatcagtttggattctgcaaaaaaggctgcttgtgaattttctgagacggatgtaacaaatactgaacatcatcaacccagtaataatgatttgaacaccactgagaagcgtgcagctgagaggcatccagaaaagtatcagggtgaagcagcatctgggtgtgagagtgaaacaagcgtctctgaagactgctcagggctatcctctcagagtgacattttaaccactcagcagagggataccatgcaacataacctgataaagctccagcaggaaatggctgaactagaagctgtgttagaacagcatgggagccagccttctaacagctacccttccatcataagtgactcttctgcccttgaggacctgcgaaatccagaacaaagcacatcagaaaaagtattaacttcacagaaaagtagtgaataccctataagccagaatccagaaggcctttctgctgacaagtttgaggtgtctgcagatagttctaccagtaaaaataaagaaccaggagtggaaaggtcatccccttctaaatgcccatcattagatgataggtggtacatgcacagttgctctgggagtcttcagaatagaaactacccatctcaagaggagctcattaaggttgttgatgtggaggagcaacagctggaagagtctgggccacacgatttgacggaaacatcttacttgccaaggcaagatctagagggaaccccttacctggaatctggaatcagcctcttctctgatgaccctgaatctgatccttctgaagacagagccccagagtcagctcgtgttggcaacataccatcttcaacctctgcattgaaagttccccaattgaaagttgcagaatctgcccagagtccagctgctgctcatactactgatactgctgggtataatgcaatggaagaaagtgtgagcagggagaagccagaattgacagcttcaacagaaagggtcaacaaaagaatgtccatggtggtgtctggcctgaccccagaagaatttatgctcgtgtacaagtttgccagaaaacaccacatcactttaactaatctaattactgaagagactactcatgttgttatgaaaacagatgctgagtttgtgtgtgaacggacactgaaatattttctaggaattgcgggaggaaaatgggtagttagctatttctgggtgacccagtctattaaagaaagaaaaatgctgaatgagcatgattttgaagtcagaggagatgtggtcaatggaagaaaccaccaaggtccaaagcgagcaagagaatcccaggacagaaagatcttcagggggctagaaatctgttgctatgggcccttcaccaacatgcccacagatcaactggaatggatggtacagctgtgtggtgcttctgtggtgaaggagctttcatcattcacccttggcacaggtgtccacccaattgtggttgtgcagccagatgcctggacagaggacaatggcttccatgcaattgggcagatgtgtgaggcacctgtggtgacccgagagtgggtgttggacagtgtagcactctaccagtgccaggagctggacacctacctgataccccagatcccccacagccactactga

SEQ ID NO: 946 - DNA, 1584 bp, Homo sapiens
ggaggccttcaccctctgctctgggtaaagttcattggaacagaaagaaatggatttatctgctcttcgcgttgaagaagtacaaaatgtcattaatgctatgcagaaaatcttagagtgtcccatctgtctggagttgatcaaggaacctgtctccacaaagtgtgaccacatattttgcaaggtcttactctgttgtcccagctggagtacagtggtgcgatcatgaggcttactgttgccttgacctcctaggctcaagcgatcctatcacctcagtctcccaagtagctgggactattttgcatgctgaaacttctcaaccagaagaaagggccttcacagtgtcctttatgtaagaatgatataaccaaaaggagcctacaagaaagtacgagatttagtcaacttgttgaagagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttgcaggaaaccagtctcagtgtccaactctctaaccttggaactgtgagaactctgaggacaaagcagcggatacaacctcaaaagacgtctgtctacattgaattgggatctgattcttctgaagataccgttaataaggcaacttattgcagtgtgggagatcaagaattgttacaaatcacccctcaaggaaccagggatgaaatcagtttggattctgcaaaaaaggctgcttgtgaattttctgagacggatgtaacaaatactgaacatcatcaacccagtaataatgatttgaacaccactgagaagcgtgcagctgagaggcatccagaaaagtatcagggtagttctgtttcaaacttgcatgtggagccatgtggcacaaatactcatgccagctcattacagcatgagaacagcagtttattactcactaaagacagaatgaatgtagaaaaggctgaattctgtaataaaagcaaacagcctggcttagcaaggagccaacataacagatgggctggaagtaaggaaacatgtaatgataggcggactcccagcacagaaaaaaaggtagatctgaatgctgatcccctgtgtgagagaaaagaatggaataagcagaaactgccatgctcagagaatcctagagatactgaagatgttccttggataacactaaatagcagcattcagaaagttaatgagtggttttccagaagtgatgaactgttaggttctgatgactcacatgatggggagtctgaatcaaatgccaaagtagctgatgtattggacgttctaaatgaggtagatgaatattctggttcttcagagaaaatagacttactggccagtgatcctcatgaggctttaatatgtaaaagtgaaagagttcactccaaatcagtagagagtaatattgaagacaaaatatttgggaaaacctatcggaagaaggcaagcctccccaac

SEQ ID NO: 947 - DNA, 5732 bp, Homo sapiens
acagataaattaaaactgcgactgcgcggcgtgagctcgctgagacttcctggacgggggacaggctgtggggtttctcagataactgggcccctgcgctcaggaggccttcaccctctgctctggttcattggaacagaaagaaatggatttatctgctcttcgcgttgaagaagtacaaaatgtcattaatgctatgcagaaaatcttagagtgtcccatctgattttgcatgctgaaacttctcaaccagaagaaagggccttcacagtgtcctttatgtaagaatgatataaccaaaaggagcctacaagaaagtacgagatttagtcaacttgttgaagagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttgcaggaaaccagtctcagtgtccaactctctaaccttggaactgtgagaactctgaggacaaagcagcggatacaacctcaaaagacgtctgtctacattgaattgggatctgattcttctgaagataccgttaataaggcaacttattgcagtgtgggagatcaagaattgttacaaatcacccctcaaggaaccagggatgaaatcagtttggattctgcaaaaaaggctgcttgtgaattttctgagacggatgtaacaaatactgaacatcatcaacccagtaataatgatttgaacaccactgagaagcgtgcagctgagaggcatccagaaaagtatcagggtagttctgtttcaaacttgcatgtggagccatgtggcacaaatactcatgccagctcattacagcatgagaacagcagtttattactcactaaagacagaatgaatgtagaaaaggctgaattctgtaataaaagcaaacagcctggcttagcaaggagccaacataacagatgggctggaagtaaggaaacatgtaatgataggcggactcccagcacagaaaaaaaggtagatctgaatgctgatcccctgtgtgagagaaaagaatggaataagcagaaactgccatgctcagagaatcctagagatactgaagatgttccttggataacactaaatagcagcattcagaaagttaatgagtggttttccagaagtgatgaactgttaggttctgatgactcacatgatggggagtctgaatcaaatgccaaagtagctgatgtattggacgttctaaatgaggtagatgaatattctggttcttcagagaaaatagacttactggccagtgatcctcatgaggctttaatatgtaaaagtgaaagagttcactccaaatcagtagagagtaatattgaagacaaaatatttgggaaaacctatcggaagaaggcaagcctccccaacttaagccatgtaactgaaaatctaattataggagcatttgttactgagccacagataatacaagagcgtcccctcacaaataaattaaagcgtaaaaggagacctacatcaggccttcatcctgaggattttatcaagaaagcagatttggcagttcaaaagactcctgaaatgataaatcagggaactaaccaaacggagcagaatggtcaagtgatgaatattactaatagtggtcatgagaataaaacaaaaggtgattctattcagaatgagaaaaatcctaacccaatagaatcactcgaaaaagaatctgctttcaaaacgaaagctgaacctataagcagcagtataagcaatatggaactcgaattaaatatccacaattcaaaagcacctaaaaagaataggctgaggaggaagtcttctaccaggcatattcatgcgcttgaactagtagtcagtagaaatctaagcccacctaattgtactgaattgcaaattgatagttgttctagcagtgaagagataaagaaaaaaaagtacaaccaaatgccagtcaggcacagcagaaacctacaactcatggaaggtaaagaacctgcaactggagccaagaagagtaacaagccaaatgaacagacaagtaaaagacatgacagcgatactttcccagagctgaagttaacaaatgcacctggttcttttactaagtgttcaaataccagtgaacttaaagaatttgtcaatcctagccttccaagagaagaaaaagaagagaaactagaaacagttaaagtgtctaataatgctgaagaccccaaagatctcatgttaagtggagaaagggttttgcaaactgaaagatctgtagagagtagcagtatttcattggtacctggtactgattatggcactcaggaaagtatctcgttactggaagttagcactctagggaaggcaaaaacagaaccaaataaatgtgtgagtcagtgtgcagcatttgaaaaccccaagggactaattcatggttgttccaaagataatagaaatgacacagaaggctttaagtatccattgggacatgaagttaaccacagtcgggaaacaagcatagaaatggaagaaagtgaacttgatgctcagtatttgcagaatacattcaaggtttcaaagcgccagtcatttgctccgttttcaaatccaggaaatgcagaagaggaatgtgcaacattctctgcccactctgggtccttaaagaaacaaagtccaaaagtcacttttgaatgtgaacaaaaggaagaaaatcaaggaaagaatgagtctaatatcaagcctgtacagacagttaatatcactgcaggctttcctgtggttggtcagaaagataagccagttgataatgccaaatgtagtatcaaaggaggctctaggttttgtctatcatctcagttcagaggcaacgaaactggactcattactccaaataaacatggacttttacaaaacccatatcgtataccaccactttttcccatcaagtcatttgttaaaactaaatgtaagaaaaatctgctagaggaaaactttgaggaacattcaatgtcacctgaaagagaaatgggaaatgagaacattccaagtacagtgagcacaattagccgtaataacattagagaaaatgtttttaaagaagccagctcaagcaatattaatgaagtaggttccagtactaatgaagtgggctccagtattaatgaaataggttccagtgatgaaaacattcaagcagaactaggtagaaacagagggccaaaattgaatgctatgcttagattaggggttttgcaacctgaggtctataaacaaagtcttcctggaagtaattgtaagcatcctgaaataaaaaagcaagaatatgaagaagtagttcagactgttaatacagatttctctccatatctgatttcagataacttagaacagcctatgggaagtagtcatgcatctcaggtttgttctgagacacctgatgacctgttagatgatggtgaaataaaggaagatactagttttgctgaaaatgacattaaggaaagttctgctgtttttagcaaaagcgtccagaaaggagagcttagcaggagtcctagccctttcacccatacacatttggctcagggttaccgaagaggggccaagaaattagagtcctcagaagagaacttatctagtgaggatgaagagcttccctgcttccaacacttgttatttggtaaagtaaacaatataccttctcagtctactaggcatagcaccgttgctaccgagtgtctgtctaagaacacagaggagaatttattatcattgaagaatagcttaaatgactgcagtaaccaggtaatattggcaaaggcatctcaggaacatcaccttagtgaggaaacaaaatgttctgctagcttgttttcttcacagtgcagtgaattggaagacttgactgcaaatacaaacacccaggatcctttcttgattggttcttccaaacaaatgaggcatcagtctgaaagccagggagttggtctgagtgacaaggaattggtttcagatgatgaagaaagaggaacgggcttggaagaaaataatcaagaagagcaaagcatggattcaaacttaggtgaagcagcatctgggtgtgagagtgaaacaagcgtctctgaagactgctcagggctatcctctcagagtgacattttaaccactcagcagagggataccatgcaacataacctgataaagctccagcaggaaatggctgaactagaagctgtgttagaacagcatgggagccagccttctaacagctacccttccatcataagtgactcttctgcccttgaggacctgcgaaatccagaacaaagcacatcagaaaaagcagtattaacttcacagaaaagtagtgaataccctataagccagaatccagaaggcctttctgctgacaagtttgaggtgtctgcagatagttctaccagtaaaaataaagaaccaggagtggaaaggtcatccccttctaaatgcccatcattagatgataggtggtacatgcacagttgctctgggagtcttcagaatagaaactacccatctcaagaggagctcattaaggttgttgatgtggaggagcaacagctggaagagtctgggccacacgatttgacggaaacatcttacttgccaaggcaagatctagagggaaccccttacctggaatctggaatcagcctcttctctgatgaccctgaatctgatccttctgaagacagagccccagagtcagctcgtgttggcaacataccatcttcaacctctgcattgaaagttccccaattgaaagttgcagaatctgcccagagtccagctgctgctcatactactgatactgctgggtataatgcaatggaagaaagtgtgagcagggagaagccagaattgacagcttcaacagaaagggtcaacaaaagaatgtccatggtggtgtctggcctgaccccagaagaatttatgctcgtgtacaagtttgccagaaaacaccacatcactttaactaatctaattactgaagagactactcatgttgttatgaaaacagatgctgagtttgtgtgtgaacggacactgaaatattttctaggaattgcgggaggaaaatgggtagttagctatttctgggtgacccagtctattaaagaaagaaaaatgctgaatgagcatgattttgaagtcagaggagatgtggtcaatggaagaaaccaccaaggtccaaagcgagcaagagaatcccaggacagaaagatcttcagggggctagaaatctgttgctatgggcccttcaccaacatgcccacagatcaactggaatggatggtacagctgtgtggtgcttctgtggtgaaggagctttcatcattcacccttggcacaggtgtccacccaattgtggttgtgcagccagatgcctggacagaggacaatggcttccatgcaattgggcagatgtgtgaggcacctgtggtgacccgagagtgggtgttggacagtgtagcactctaccagtgccaggagctggacacctacctgataccccagatcccccacagccactactgactgcagccagccacaggtacagagccacaggaccccaagaatgagctta

SEQ ID NO: 948 - DNA, 1948 bp, Homo sapiens
acagataaattaaaactgcgactgcgcggcgtgagctcgctgagacttcctggacgggggacaggctgtggggtttctcagataactgggcccctgcgctcaggaggccttcaccctctgctctggttcattggaacagaaagaaatggatttatctgctcttcgcgttgaagaagtacaaaatgtcattaatgctatgcagaaaatcttagagtgtcccatctgattttgcatgctgaaacttctcaaccagaagaaagggccttcacagtgtcctttatgtaagaatgatataaccaaaaggagcctacaagaaagtacgagatttagtcaacttgttgaagagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttgcaggaaaccagtctcagtgtccaactctctaaccttggaactgtgagaactctgaggacaaagcagcggatacaacctcaaaagacgtctgtctacattgaattgggatctgattcttctgaagataccgttaataaggcaacttattgcagtgtgggagatcaagaattgttacaaatcacccctcaaggaaccagggatgaaatcagtttggattctgcaaaaaaggctgcttgtgaattttctgagacggatgtaacaaatactgaacatcatcaacccagtaataatgatttgaacaccactgagaagcgtgcagctgagaggcatccagaaaagtatcagggtgaagcagcatctgggtgtgagagtgaaacaagcgtctctgaagactgctcagggctatcctctcagagtgacattttaaccactcagcagagggataccatgcaacataacctgataaagctccagcaggaaatggctgaactagaagctgtgttagaacagcatgggagccagccttctaacagctacccttccatcataagtgactcttctgcccttgaggacctgcgaaatccagaacaaagcacatcagaaaaagcagtattaacttcacagaaaagtagtgaataccctataagccagaatccagaaggcctttctgctgacaagtttgaggtgtctgcagatagttctaccagtaaaaataaagaaccaggagtggaaaggtcatccccttctaaatgcccatcattagatgataggtggtacatgcacagttgctctgggagtcttcagaatagaaactacccatctcaagaggagctcattaaggttgttgatgtggaggagcaacagctggaagagtctgggccacacgatttgacggaaacatcttacttgccaaggcaagatctagagggaaccccttacctggaatctggaatcagcctcttctctgatgaccctgaatctgatccttctgaagacagagccccagagtcagctcgtgttggcaacataccatcttcaacctctgcattgaaagttccccaattgaaagttgcagaatctgcccagagtccagctgctgctcatactactgatactgctgggtataatgcaatggaagaaagtgtgagcagggagaagccagaattgacagcttcaacagaaagggtcaacaaaagaatgtccatggtggtgtctggcctgaccccagaagaatttatgctcgtgtacaagtttgccagaaaacaccacatcactttaactaatctaattactgaagagactactcatgttgttatgaaaacagatgctgagtttgtgtgtgaacggacactgaaatattttctaggaattgcgggaggaaaatgggtagttagctatttctgggtgacccagtct

SEQ ID NO: 949 - DNA, 1612 bp, Homo sapiens
ttagcggtagccccttggtttccgtggcaacggaaaagcgcgggaattacagataaattaaaactgcgactgcgcggcgtgagctcgctgagacttcctggacgggggacaggctgtggggtttctcagataactgggcccctgcgctcaggaggccttcaccctctgctctggttcattggaacagaaagaaatggatttatctgctcttcgcgttgaagaagtacaaaatgtcattaatgctatgcagaaaatcttagagtgtcccatctgtctggagttgatcaaggaacctgtctccacaaagtgtgaccacatattttgcaaattttgcatgctgaaacttctcaaccagaagaaagggccttcacagtgtcctttatgtaagaatgatataaccaaaaggagcctacaagaaagtacgagatttagtcaacttgttgaagagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttgcaggaaaccagtctcagtgtccaactctctaaccttggaactgtgagaactctgaggacaaagcagcggatacaacctcaaaagacgtctgtctacattgaattgggatctgattcttctgaagataccgttaataaggcaacttattgcagtgtgggagatcaagaattgttacaaatcacccctcaaggaaccagggatgaaatcagtttggattctgcaaaaaaggctgcttgtgaattttctgagacggatgtaacaaatactgaacatcatcaacccagtaataatgatttgaacaccactgagaagcgtgcagctgagaggcatccagaaaagtatcagggtagttctgtttcaaacttgcatgtggagccatgtggcacaaatactcatgccagctcattacagcatgagaacagcagtttattactcactaaagacagaatgaatgtagaaaaggctgaattctgtaataaaagcaaacagcctggcttagcaaggagccaacataacagatgggctggaagtaaggaaacatgtaatgataggcggactcccagcacagaaaaaaaggtagatctgaatgctgatcccctgtgtgagagaaaagaatggaataagcagaaactgccatgctcagagaatcctagagatactgaagatgttccttggataacactaaatagcagcattcagaaagttaatgagtggttttccagaagtgatgaactgttaggttctgatgactcacatgatggggagtctgaatcaaatgccaaagtagctgatgtattggacgttctaaatgaggtagatgaatattctggttcttcagagaaaatagacttactggccagtgatcctcatgaggctttaatatgtaaaagtgaaagagttcactccaaatcagtagagagtaatattgaagacaaaatatttgggaaaacctatcggaagaaggcaagcctccccaac

SEQ ID NO: 950 - DNA, 779 bp, Homo sapiens
ggaggccttcaccctctgctctgggtaaagctgcttgtgaattttctgagacggatgtaacaaatactgaacatcatcaacccagtaataatgatttgaacaccactgagaagcgtgcagctgagaggcatccagaaaagtatcagggtagttctgtttcaaacttgcatgtggagccatgtggcacaaatactcatgccagctcattacagcatgagaacagcagtttattactcactaaagacagaatgaatgtagaaaaggctgaattctgtaataaaagcaaacagcctggcttagcaaggagccaacataacagatgggctggaagtaaggaaacatgtaatgataggcggactcccagcacagaaaaaaaggtagatctgaatgctgatcccctgtgtgagagaaaagaatggaataagcagaaactgccatgctcagagaatcctagagatactgaagatgttccttggataacactaaatagcagcattcagaaagttaatgagtggttttccagaagtgatgaactgttaggttctgatgactcacatgatggggagtctgaatcaaatgccaaagtagctgatgtattggacgttctaaatgaggtagatgaatattctggttcttcagagaaaatagacttactggccagtgatcctcatgaggctttaatatgtaaaagtgaaagagttcactccaaatcagtagagagtaatattgaagacaaaatatttgggaaaacctatcggaagaaggcaagcctccccaac

SEQ ID NO: 951 - DNA, 5766 bp, Homo sapiens
ggccttccccctgcgaggatcgccattggcccgggttggctttggaaagcggcggtggctttgggccgggctcggcctcgggaacgccaggggcccctgggtgcggacgggcgcggccaggagggggttaaggcgcaggcggcggcggggcgggggcgggcctggcgggcgccctctccgggccctttgttaacaggcgcgtcccggccaggcggagacgcggccgcggccatgggcgggcgcgggcgcgcggggcggcggtgagggcggctggcggggccgggggcgccgggggggcgcgcgggccgagccgggcctgagccgggcccgcggaccgagctgggagaggggttccggcccccgacgtgctggcgcgggaaaatgttggagatctgcctgaagctggtgggctgcaaatccaagaaggggctgtcctcgtcctccagctgttatctggaagaagcccttcagcggccagtagcatctgactttgagcctcagggtctgagtgaagccgctcgttggaactccaaggaaaaccttctcgctggacccagtgaaaatgaccccaaccttttcgttgcactgtatgattttgtggccagtggagataacactctaagcataactaaaggtgaaaagctccgggtcttaggctataatcacaatggggaatggtgtgaagcccaaaccaaaaatggccaaggctgggtcccaagcaactacatcacgccagtcaacagtctggagaaacactcctggtaccatgggcctgtgtcccgcaatgccgctgagtatctgctgagcagcgggatcaatggcagcttcttggtgcgtgagagtgagagcagtcctggccagaggtccatctcgctgagatacgaagggagggtgtaccattacaggatcaacactgcttctgatggcaagctctacgtctcctccgagagccgcttcaacaccctggccgagttggttcatcatcattcaacggtggccgacgggctcatcaccacgctccattatccagccccaaagcgcaacaagcccactgtctatggtgtgtcccccaactacgacaagtgggagatggaacgcacggacatcaccatgaagcacaagctgggcgggggccagtacggggaggtgtacgagggcgtgtggaagaaatacagcctgacggtggccgtgaagaccttgaaggaggacaccatggaggtggaagagttcttgaaagaagctgcagtcatgaaagagatcaaacaccctaacctggtgcagctccttggggtctgcacccgggagcccccgttctatatcatcactgagttcatgacctacgggaacctcctggactacctgagggagtgcaaccggcaggaggtgaacgccgtggtgctgctgtacatggccactcagatctcgtcagccatggagtacctggagaagaaaaacttcatccacagagatcttgctgcccgaaactgcctggtaggggagaaccacttggtgaaggtagctgattttggcctgagcaggttgatgacaggggacacctacacagcccatgctggagccaagttccccatcaaatggactgcacccgagagcctggcctacaacaagttctccatcaagtccgacgtctgggcatttggagtattgctttgggaaattgctacctatggcatgtccccttacccgggaattgacctgtcccaggtgtatgagctgctagagaaggactaccgcatggagcgcccagaaggctgcccagagaaggtctatgaactcatgcgagcatgttggcagtggaatccctctgaccggccctcctttgctgaaatccaccaagcctttgaaacaatgttccaggaatccagtatctcagacgaagtggaaaaggagctggggaaacaaggcgtccgtggggctgtgagtaccttgctgcaggccccagagctgcccaccaagacgaggacctccaggagagctgcagagcacagagacaccactgacgtgcctgagatgcctcactccaagggccagggagagagcgatcctctggaccatgagcctgccgtgtctccattgctccctcgaaaagagcgaggtcccccggagggcggcctgaatgaagatgagcgccttctccccaaagacaaaaagaccaacttgttcagcgccttgatcaagaagaagaagaagacagccccaacccctcccaaacgcagcagctccttccgggagatggacggccagccggagcgcagaggggccggcgaggaagagggccgagacatcagcaacggggcactggctttcacccccttggacacagctgacccagccaagtccccaaagcccagcaatggggctggggtccccaatggagccctccgggagtccgggggctcaggcttccggtctccccacctgtggaagaagtccagcacgctgaccagcagccgcctagccaccggcgaggaggagggcggtggcagctccagcaagcgcttcctgcgctcttgctccgcctcctgcgttccccatggggccaaggacacggagtggaggtcagtcacgctgcctcgggacttgcagtccacgggaagacagtttgactcgtccacatttggagggcacaaaagtgagaagccggctctgcctcggaagagggcaggggagaacaggtctgaccaggtgacccgaggcacagtaacgcctccccccaggctggtgaaaaagaatgaggaagctgctgatgaggtcttcaaagacatcatggagtccagcccgggctccagcccgcccaacctgactccaaaacccctccggcggcaggtcaccgtggcccctgcctcgggcctcccccacaaggaagaagctggaaagggcagtgccttagggacccctgctgcagctgagccagtgacccccaccagcaaagcaggctcaggtgcaccagggggcaccagcaagggccccgccgaggagtccagagtgaggaggcacaagcactcctctgagtcgccagggagggacaaggggaaattgtccaggctcaaacctgccccgccgcccccaccagcagcctctgcagggaaggctggaggaaagccctcgcagagcccgagccaggaggcggccggggaggcagtcctgggcgcaaagacaaaagccacgagtctggttgatgctgtgaacagtgacgctgccaagcccagccagccgggagagggcctcaaaaagcccgtgctcccggccactccaaagccacagtccgccaagccgtcggggacccccatcagcccagcccccgttccctccacgttgccatcagcatcctcggccctggcaggggaccagccgtcttccaccgccttcatccctctcatatcaacccgagtgtctcttcggaaaacccgccagcctccagagcggatcgccagcggcgccatcaccaagggcgtggtcctggacagcaccgaggcgctgtgcctcgccatctctaggaactccgagcagatggccagccacagcgcagtgctggaggccggcaaaaacctctacacgttctgcgtgagctatgtggattccatccagcaaatgaggaacaagtttgccttccgagaggccatcaacaaactggagaataatctccgggagcttcagatctgcccggcgacagcaggcagtggtccagcggccactcaggacttcagcaagctcctcagttcggtgaaggaaatcagtgacatagtgcagaggtagcagcagtcaggggtcaggtgtcaggcccgtcggagctgcctgcagcacatgcgggctcgcccatacccgtgacagtggctgacaagggactagtgagtcagcaccttggcccaggagctctgcgccaggcagagctgagggccctgtggagtccagctctactacctacgtttgcaccgcctgccctcccgcaccttcctcctccccgctccgtctctgtcctcgaattttatctgtggagttcctgctccgtggactgcagtcggcatgccaggacccgccagccccgctcccacctagtgccccagactgagctctccaggccaggtgggaacggctgatgtggactgtctttttcatttttttctctctggagcccctcctcccccggctgggcctccttcttccacttctccaagaatggaagcctgaactgaggccttgtgtgtcaggccctctgcctgcactccctggccttgcccgtcgtgtgctgaagacatgtttcaagaaccgcatttcgggaagggcatgcacgggcatgcacacggctggtcactctgccctctgctgctgcccggggtggggtgcactcgccatttcctcacgtgcaggacagctcttgatttgggtggaaaacagggtgctaaagccaaccagcctttgggtcctgggcaggtgggagctgaaaaggatcgaggcatggggcatgtcctttccatctgtccacatccccagagcccagctcttgctctcttgtgacgtgcactgtgaatcctggcaagaaagcttgagtctcaagggtggcaggtcactgtcactgccgacatccctcccccagcagaatggaggcaggggacaagggaggcagtggctagtggggtgaacagctggtgccaaatagccccagactgggcccaggcaggtctgcaagggcccagagtgaaccgtcctttcacacatctgggtgccctgaaagggcccttcccctcccccactcctctaagacaaagtagattcttacaaggccctttcctttggaacaagacagccttcacttttctgagttcttgaagcatttcaaagccctgcctctgtgtagccgccctgagagagaatagagctgccactgggcacctgcgcacaggtgggaggaaagggcctggccagtcctggtcctggctgcactcttgaactgggcgaatgtcttatttaattaccgtgagtgacatagcctcatgttctgtgggggtcatcagggagggttaggaaaaccacaaacggagcccctgaaagcctcacgtatttcacagagcacgcctgccatcttctccccgaggctgccccaggccggagcccagatacgggggctgtgactctgggcagggacccggggtctcctggaccttgacagagcagctaactccgagagcagtgggcaggtggccgcccctgaggcttcacgccgggagaagccaccttcccaccccttcataccgcctcgtgccagcagcctcgcacaggccctagctttacgctcatcacctaaacttgtactttatttttctgatagaaatggtttcctctggatcgttttatgcggttcttacagcacatcacctctttgcccccgacggctgtgacgcagccggagggaggcactagtcaccgacagcggccttgaagacagagcaaagcgcccacccaggtcccccgactgcctgtctccatgaggtactggtcccttccttttgttaacgtgatgtgccactatattttacacgtatctcttggtatgcatcttttatagacgctcttttctaagtggcgtgtgcatagcgtcctgccctgccccctcgggggcctgtggtggctccccctctgcttctcggggtccagtgcattttgtttctgtatatgattctctgtggttttttttgaatccaaatctgtcctctgtagtattttttaaataaatcagtgtttacattagaa

SEQ ID NO: 952 - DNA, 3824 bp, Homo sapiens
tgtgagaattgaaatgactagcattattgacccttttcagcatcccctgtgaatatttctgtttaggtttttcttcttgaaaagaaattgttattcagcccgtttaaaacaaatcaagaaacttttgggtaacattgcaattacatgaaattgataaccgcgaaaataattggaactcctgcttgcaagtgtcaacctaaaaaaagtgcttccttttgttatggaagatgtctttctgtgattgacttcaattgctgacttgtggagatgcagcgaatgtgaaatcccacgtatatgccatttccctctacgctcgctgaccgttctggaagatcttgaaccctcttctggaaaggggtacctattattactttatggggcagcagcctggaaaagtacttggggaccaaagaaggccaagcttgcctgccctgcattttatcaaaggagcagggaagaaggaatcatcgaggcatgggggtccacactgcaatgtttttgtggaacatgaagcccttcagcggccagtagcatctgactttgagcctcagggtctgagtgaagccgctcgttggaactccaaggaaaaccttctcgctggacccagtgaaaatgaccccaaccttttcgttgcactgtatgattttgtggccagtggagataacactctaagcataactaaaggtgaaaagctccgggtcttaggctataatcacaatggggaatggtgtgaagcccaaaccaaaaatggccaaggctgggtcccaagcaactacatcacgccagtcaacagtctggagaaacactcctggtaccatgggcctgtgtcccgcaatgccgctgagtatctgctgagcagcgggatcaatggcagcttcttggtgcgtgagagtgagagcagtcctggccagaggtccatctcgctgagatacgaagggagggtgtaccattacaggatcaacactgcttctgatggcaagctctacgtctcctccgagagccgcttcaacaccctggccgagttggttcatcatcattcaacggtggccgacgggctcatcaccacgctccattatccagccccaaagcgcaacaagcccactgtctatggtgtgtcccccaactacgacaagtgggagatggaacgcacggacatcaccatgaagcacaagctgggcgggggccagtacggggaggtgtacgagggcgtgtggaagaaatacagcctgacggtggccgtgaagaccttgaaggaggacaccatggaggtggaagagttcttgaaagaagctgcagtcatgaaagagatcaaacaccctaacctggtgcagctccttggggtctgcacccgggagcccccgttctatatcatcactgagttcatgacctacgggaacctcctggactacctgagggagtgcaaccggcaggaggtgaacgccgtggtgctgctgtacatggccactcagatctcgtcagccatggagtacctggagaagaaaaacttcatccacagagatcttgctgcccgaaactgcctggtaggggagaaccacttggtgaaggtagctgattttggcctgagcaggttgatgacaggggacacctacacagcccatgctggagccaagttccccatcaaatggactgcacccgagagcctggcctacaacaagttctccatcaagtccgacgtctgggcatttggagtattgctttgggaaattgctacctatggcatgtccccttacccgggaattgacctgtcccaggtgtatgagctgctagagaaggactaccgcatggagcgcccagaaggctgcccagagaaggtctatgaactcatgcgagcatgttggcagtggaatccctctgaccggccctcctttgctgaaatccaccaagcctttgaaacaatgttccaggaatccagtatctcagacgaagtggaaaaggagctggggaaacaaggcgtccgtggggctgtgagtaccttgctgcaggccccagagctgcccaccaagacgaggacctccaggagagctgcagagcacagagacaccactgacgtgcctgagatgcctcactccaagggccagggagagagcgatcctctggaccatgagcctgccgtgtctccattgctccctcgaaaagagcgaggtcccccggagggcggcctgaatgaagatgagcgccttctccccaaagacaaaaagaccaacttgttcagcgccttgatcaagaagaagaagaagacagccccaacccctcccaaacgcagcagctccttccgggagatggacggccagccggagcgcagaggggccggcgaggaagagggccgagacatcagcaacggggcactggctttcacccccttggacacagctgacccagccaagtccccaaagcccagcaatggggctggggtccccaatggagccctccgggagtccgggggctcaggcttccggtctccccacctgtggaagaagtccagcacgctgaccagcagccgcctagccaccggcgaggaggagggcggtggcagctccagcaagcgcttcctgcgctcttgctccgcctcctgcgttccccatggggccaaggacacggagtggaggtcagtcacgctgcctcgggacttgcagtccacgggaagacagtttgactcgtccacatttggagggcacaaaagtgagaagccggctctgcctcggaagagggcaggggagaacaggtctgaccaggtgacccgaggcacagtaacgcctccccccaggctggtgaaaaagaatgaggaagctgctgatgaggtcttcaaagacatcatggagtccagcccgggctccagcccgcccaacctgactccaaaacccctccggcggcaggtcaccgtggcccctgcctcgggcctcccccacaaggaagaagctggaaagggcagtgccttagggacccctgctgcagctgagccagtgacccccaccagcaaagcaggctcaggtgcaccagggggcaccagcaagggccccgccgaggagtccagagtgaggaggcacaagcactcctctgagtcgccagggagggacaaggggaaattgtccaggctcaaacctgccccgccgcccccaccagcagcctctgcagggaaggctggaggaaagccctcgcagagcccgagccaggaggcggccggggaggcagtcctgggcgcaaagacaaaagccacgagtctggttgatgctgtgaacagtgacgctgccaagcccagccagccgggagagggcctcaaaaagcccgtgctcccggccactccaaagccacagtccgccaagccgtcggggacccccatcagcccagcccccgttccctccacgttgccatcagcatcctcggccctggcaggggaccagccgtcttccaccgccttcatccctctcatatcaacccgagtgtctcttcggaaaacccgccagcctccagagcggatcgccagcggcgccatcaccaagggcgtggtcctggacagcaccgaggcgctgtgcctcgccatctctaggaactccgagcagatggccagccacagcgcagtgctggaggccggcaaaaacctctacacgttctgcgtgagctatgtggattccatccagcaaatgaggaacaagtttgccttccgagaggccatcaacaaactggagaataatctccgggagcttcagatctgcccggcgacagcaggcagtggtccagcggccactcaggacttcagcaagctcctcagttcggtgaaggaaatcagtgacatagtgcagaggtag

SEQ ID NO: 953 - DNA, 532 bp, Homo sapiens
tttcagcatcccctgtgaatatttctgtttaggtttttcttcttgaaaagaaattgttattcagcccgtttaaaacaaatcaagaaacttttgggtaacattgcaattacatgaaattgataaccgcgaaaataattggaactcctgcttgcaagtgtcaacctaaaaaaagtgcttccttttgttatggaagatgtctttctgtgattgacttcaattgctgacttgtggagatgcagcgaatgtgaaatcccacgtatatgccatttccctctacgctcgctgaccgttctggaagatcttgaaccctcttctggaaaggggtacctattattactttatggggcagcagcctggaaaagtacttggggaccaaagaaggccaagcttgcctgccctgcattttatcaaaggagcagggaagaaggaatcatcgaggcatgggggtccacactgcaatgtttttgtggaacaagcccttcagcggccagtagcatctgactttgagcctcagggtctgagtgaagccgct

SEQ ID NO: 954 - DNA, 3559 bp, Homo sapiens
ggcagacctgggcgttctcgggcgcggggcggcggtgagggcggctggcggggcggggggcgcgcgggccgagccgggcctgagccgggcccgcgagctgggagaggggttccggcccccgactgctggcgcgggaaaatgttggagatctgcctgaagctggtgggctgcaaatccaagaaggggctgtcctcgtcctccagctgttatctggaagaagcccttcagcggccagtagcatctgactttgagcctcagggtctgagtgaagccgctcgttggaactccaaggaaaaccttctcgctggacccagtgaaaatgaccccaaccttttcgttgcactgtatgattttgtggccagtggagataacactctaagcataactaaaggtgaaaagctccgggtcttaggctataatcacaatggggaatggtgtgaagcccaaaccaaaaatggccaaggctgggtcccaagcaactacatcacgccagtcaacagtctggagaaacactcctggtaccatgggcctgtgtcccgcaatgccgctgagtatctgctgagcagcgggatcaatggcagcttcttggtgcgtgagagtgagagcagtcctggccagaggtccatctcgctgagatacgaagggagggtgtaccattacaggatcaacactgcttctgatggcaagctctacgtctcctccgagagccgcttcaacaccctggccgagttggttcatcatcattcaacggtggccgacgggctcatcaccacgctccattatccagccccaaagcgcaacaagcccactgtctatggtgtgtcccccaactacgacaagtgggagatggaacgcacggacatcaccatgaagcacaagctgggcgggggccagtacggggaggtgtacgagggcgtgtggaagaaatacagcctgacggtggccgtgaagaccttgaaggaggacaccatggaggtggaagagttcttgaaagaagctgcagtcatgaaagagatcaaacaccctaacctggtgcagctccttggggtctgcacccgggagcccccgttctatatcatcactgagttcatgacctacgggaacctcctggactacctgagggagtgcaaccggcaggaggtgaacgccgtggtgctgctgtacatggccactcagatctcgtcagccatggagtacctggagaagaaaaacttcatccacagagatcttgctgcccgaaactgcctggtaggggagaaccacttggtgaaggtagctgattttggcctgagcaggttgatgacaggggacacctacacagcccatgctggagccaagttccccatcaaatggactgcacccgagagcctggcctacaacaagttctccatcaagtccgacgtctgggcatttggagtattgctttgggaaattgctacctatggcatgtccccttacccgggaattgacctgtcccaggtgtatgagctgctagagaaggactaccgcatggagcgcccagaaggctgcccagagaaggtctatgaactcatgcgagcatgttggcagtggaatccctctgaccggccctcctttgctgaaatccaccaagcctttgaaacaatgttccaggaatccagtatctcagacgaagtggaaaaggagctggggaaacaaggcgtccgtggggctgtgagtaccttgctgcaggccccagagctgcccaccaagacgaggacctccaggagagctgcagagcacagagacaccactgacgtgcctgagatgcctcactccaagggccagggagagagcgatcctctggaccatgagcctgccgtgtctccattgctccctcgaaaagagcgaggtcccccggagggcggcctgaatgaagatgagcgccttctccccaaagacaaaaagaccaacttgttcagcgccttgatcaagaagaagaagaagacagccccaacccctcccaaacgcagcagctccttccgggagatggacggccagccggagcgcagaggggccggcgaggaagagggccgagacatcagcaacggggcactggctttcacccccttggacacagctgacccagccaagtccccaaagcccagcaatggggctggggtccccaatggagccctccgggagtccgggggctcaggcttccggtctccccacctgtggaagaagtccagcacgctgaccagcagccgcctagccaccggcgaggaggagggcggtggcagctccagcaagcgcttcctgcgctcttgctccgcctcctgcgttccccatggggccaaggacacggagtggaggtcagtcacgctgcctcgggacttgcagtccacgggaagacagtttgactcgtccacatttggagggcacaaaagtgagaagccggctctgcctcggaagagggcaggggagaacaggtctgaccaggtgacccgaggcacagtaacgcctccccccaggctggtgaaaaagaatgaggaagctgctgatgaggtcttcaaagacatcatggagtccagcccgggctccagcccgcccaacctgactccaaaacccctccggcggcaggtcaccgtggcccctgcctcgggcctcccccacaaggaagaagctggaaagggcagtgccttagggacccctgctgcagctgagccagtgacccccaccagcaaagcaggctcaggtgcaccagggggcaccagcaagggccccgccgaggagtccagagtgaggaggcacaagcactcctctgagtcgccagggagggacaaggggaaattgtccaggctcaaacctgccccgccgcccccaccagcagcctctgcagggaaggctggaggaaagccctcgcagagcccgagccaggaggcggccggggaggcagtcctgggcgcaaagacaaaagccacgagtctggttgatgctgtgaacagtgacgctgccaagcccagccagccgggagagggcctcaaaaagcccgtgctcccggccactccaaagccacagtccgccaagccgtcggggacccccatcagcccagcccccgttccctccacgttgccatcagcatcctcggccctggcaggggaccagccgtcttccaccgccttcatccctctcatatcaacccgagtgtctcttcggaaaacccgccagcctccagagcggatcgccagcggcgccatcaccaagggcgtggtcctggacagcaccgaggcgctgtgcctcgccatctctaggaactccgagcagatggccagccacagcgcagtgctggaggccggcaaaaacctctacacgttctgcgtgagctatgtggattccatccagcaaatgaggaacaagtttgccttccgagaggccatcaacaaactggagaataatctccgggagcttcagatctgcccggcgacagcaggcagtggtccagcggccactcaggacttcagcaagctcctcagttcggtgaaggaaatcagtgacatagtgcagaggtagcagcagtcaggggtcaggtgtcaggccc

SEQ ID NO: 955 - DNA, 5877 bp, Homo sapiens
ggttggtgacttccacaggaaaagttctggaggagtagccaaagaccatcagcgtttcctttatgtgtgagaattgaaatgactagcattattgacccttttcagcatcccctgtgaatatttctgtttaggtttttcttcttgaaaagaaattgttattcagcccgtttaaaacaaatcaagaaacttttgggtaacattgcaattacatgaaattgataaccgcgaaaataattggaactcctgcttgcaagtgtcaacctaaaaaaagtgcttccttttgttatggaagatgtctttctgtgattgacttcaattgctgacttgtggagatgcagcgaatgtgaaatcccacgtatatgccatttccctctacgctcgctgaccgttctggaagatcttgaaccctcttctggaaaggggtacctattattactttatggggcagcagcctggaaaagtacttggggaccaaagaaggccaagcttgcctgccctgcattttatcaaaggagcagggaagaaggaatcatcgaggcatgggggtccacactgcaatgtttttgtggaacatgaagcccttcagcggccagtagcatctgactttgagcctcagggtctgagtgaagccgctcgttggaactccaaggaaaaccttctcgctggacccagtgaaaatgaccccaaccttttcgttgcactgtatgattttgtggccagtggagataacactctaagcataactaaaggtgaaaagctccgggtcttaggctataatcacaatggggaatggtgtgaagcccaaaccaaaaatggccaaggctgggtcccaagcaactacatcacgccagtcaacagtctggagaaacactcctggtaccatgggcctgtgtcccgcaatgccgctgagtatctgctgagcagcgggatcaatggcagcttcttggtgcgtgagagtgagagcagtcctggccagaggtccatctcgctgagatacgaagggagggtgtaccattacaggatcaacactgcttctgatggcaagctctacgtctcctccgagagccgcttcaacaccctggccgagttggttcatcatcattcaacggtggccgacgggctcatcaccacgctccattatccagccccaaagcgcaacaagcccactgtctatggtgtgtcccccaactacgacaagtgggagatggaacgcacggacatcaccatgaagcacaaggcgggggccagtacggggaggtgtacgagggcgtgtggaagaaatacagcctgacggtggccgtgaagaccttgaaggaggacaccatggaggtggaagagttcttgaaagaagctgcagtcatgaaagagatcaaacaccctaacctggtgcagctccttggggtctgcacccgggagcccccgttctatatcatcactgagttcatgacctacgggaacctcctggactacctgagggagtgcaaccggcaggaggtgaacgccgtggtgctgctgtacatggccactcagatctcgtcagccatggagtacctggagaagaaaaacttcatccacagagatcttgctgcccgaaactgcctggtaggggagaaccacttggtgaaggtagctgattttggcctgagcaggttgatgacaggggacacctacacagcccatgctggagccaagttccccatcaaatggactgcacccgagagcctggcctacaacaagttctccatcaagtccgacgtctgggcatttggagtattgctttgggaaattgctacctatggcatgtccccttacccgggaattgacctgtcccaggtgtatgagctgctagagaaggactaccgcatggagcgcccagaaggctgcccagagaaggtctatgaactcatgcgagcatgttggcagtggaatccctctgaccggccctcctttgctgaaatccaccaagcctttgaaacaatgttccaggaatccagtatctcagacgaagtggaaaaggagctggggaaacaaggcgtccgtggggctgtgagtaccttgctgcaggccccagagctgcccaccaagacgaggacctccaggagagctgcagagcacagagacaccactgacgtgcctgagatgcctcactccaagggccagggagagagcgatcctctggaccatgagcctgccgtgtctccattgctccctcgaaaagagcgaggtcccccggagggcggcctgaatgaagatgagcgccttctccccaaagacaaaaagaccaacttgttcagcgccttgatcaagaagaagaagaagacagccccaacccctcccaaacgcagcagctccttccgggagatggacggccagccggagcgcagaggggccggcgaggaagagggccgagacatcagcaacggggcactggctttcacccccttggacacagctgacccagccaagtccccaaagcccagcaatggggctggggtccccaatggagccctccgggagtccgggggctcaggcttccggtctccccacctgtggaagaagtccagcacgctgaccagcagccgcctagccaccggcgaggaggagggcggtggcagctccagcaagcgcttcctgcgctcttgctccgcctcctgcgttccccatggggccaaggacacggagtggaggtcagtcacgctgcctcgggacttgcagtccacgggaagacagtttgactcgtccacatttggagggcacaaaagtgagaagccggctctgcctcggaagagggcaggggagaacaggtctgaccaggtgacccgaggcacagtaacgcctccccccaggctggtgaaaaagaatgaggaagctgctgatgaggtcttcaaagacatcatggagtccagcccgggctccagcccgcccaacctgactccaaaacccctccggcggcaggtcaccgtggcccctgcctcgggcctcccccacaaggaagaagctggaaagggcagtgccttagggacccctgctgcagctgagccagtgacccccaccagcaaagcaggctcaggtgcaccagggggcaccagcaagggccccgccgaggagtccagagtgaggaggcacaagcactcctctgagtcgccagggagggacaaggggaaattgtccaggctcaaacctgccccgccgcccccaccagcagcctctgcagggaaggctggaggaaagccctcgcagagcccgagccaggaggcggccggggaggcagtcctgggcgcaaagacaaaagccacgagtctggttgatgctgtgaacagtgacgctgccaagcccagccagccgggagagggcctcaaaaagcccgtgctcccggccactccaaagccacagtccgccaagccgtcggggacccccatcagcccagcccccgttccctccacgttgccatcagcatcctcggccctggcaggggaccagccgtcttccaccgccttcatccctctcatatcaacccgagtgtctcttcggaaaacccgccagcctccagagcggatcgccagcggcgccatcaccaagggcgtggtcctggacagcaccgaggcgctgtgcctcgccatctctaggaactccgagcagatggccagccacagcgcagtgctggaggccggcaaaaacctctacacgttctgcgtgagctatgtggattccatccagcaaatgaggaacaagtttgccttccgagaggccatcaacaaactggagaataatctccgggagcttcagatctgcccggcgacagcaggcagtggtccagcggccactcaggacttcagcaagctcctcagttcggtgaaggaaatcagtgacatagtgcagaggtagcagcagtcaggggtcaggtgtcaggcccgtcggagctgcctgcagcacatgcgggctcgcccatacccgtgacagtggctgacaagggactagtgagtcagcaccttggcccaggagctctgcgccaggcagagctgagggccctgtggagtccagctctactacctacgtttgcaccgcctgccctcccgcaccttcctcctccccgctccgtctctgtcctcgaattttatctgtggagttcctgctccgtggactgcagtcggcatgccaggacccgccagccccgctcccacctagtgccccagactgagctctccaggccaggtgggaacggctgatgtggactgtctttttcatttttttctctctggagcccctcctcccccggctgggcctccttcttccacttctccaagaatggaagcctgaactgaggccttgtgtgtcaggccctctgcctgcactccctggccttgcccgtcgtgtgctgaagacatgtttcaagaaccgcatttcgggaagggcatgcacgggcatgcacacggctggtcactctgccctctgctgctgcccggggtggggtgcactcgccatttcctcacgtgcaggacagctcttgatttgggtggaaaacagggtgctaaagccaaccagcctttgggtcctgggcaggtgggagctgaaaaggatcgaggcatggggcatgtcctttccatctgtccacatccccagagcccagctcttgctctcttgtgacgtgcactgtgaatcctggcaagaaagcttgagtctcaagggtggcaggtcactgtcactgccgacatccctcccccagcagaatggaggcaggggacaagggaggcagtggctagtggggtgaacagctggtgccaaatagccccagactgggcccaggcaggtctgcaagggcccagagtgaaccgtcctttcacacatctgggtgccctgaaagggcccttcccctcccccactcctctaagacaaagtagattcttacaaggccctttcctttggaacaagacagccttcacttttctgagttcttgaagcatttcaaagccctgcctctgtgtagccgccctgagagagaatagagctgccactgggcacctgcgcacaggtgggaggaaagggcctggccagtcctggtcctggctgcactcttgaactgggcgaatgtcttatttaattaccgtgagtgacatagcctcatgttctgtgggggtcatcagggagggttaggaaaaccacaaacggagcccctgaaagcctcacgtatttcacagagcacgcctgccatcttctccccgaggctgccccaggccggagcccagatacgggggctgtgactctgggcagggacccggggtctcctggaccttgacagagcagctaactccgagagcagtgggcaggtggccgcccctgaggcttcacgccgggagaagccaccttcccaccccttcataccgcctcgtgccagcagcctcgcacaggccctagctttacgctcatcacctaaacttgtactttatttttctgatagaaatggtttcctctggatcgttttatgcggttcttacagcacatcacctctttgcccccgacggctgtgacgcagccggagggaggcactagtcaccgacagcggccttgaagacagagcaaagcgcccacccaggtcccccgactgcctgtctccatgaggtactggtcccttccttttgttaacgtgatgtgccactatattttacacgtatctcttggtatgcatcttttatagacgctcttttctaagtggcgtgtgcatagcgtcctgccctgccccctcgggggcctgtggtggctccccctctgcttctcggggtccagtgcattttgtttctgtatatgattctctgtggttttttttgaatccaaatctgtcctctgtagtattttttaaataaatcagtgtttacattagaa

SEQ ID NO: 956 - DNA, 3783 bp, Homo sapiens
gtcggcttggttttctgctacccggagctgggcaagcgggtgggagaacagcgaagacagcgtgagcctgggccgttgcctcgaggctctcgcccggcttctcttgccgacccgccacgtttgtttggatttaatcttcaggttgccggcgcccgcccgcccgctggcctcgcggtgtgagagggaagcacccgtgcctgtggctggtggctggcgcctggagggtccgcacacccgcccggccgcgccgcttgcccgcggcagccgcgtccctgaaccgcggagtcgtgtttgtgtttgacccgcgggcgccggtggcgcgcggccgaggccggtgtcggcggggcggggcggtcgcggcggaggcagaggaagagggagcgggagctctgcgaggccgggcgccgccatggaactgggcccggagcccccgcaccgccgccgcctgctcttcgcctgcagcccccctcccgcgtcgcagcccgtcgtgaaggcgctatttggcgcttcagccgccgggggactgtcgcctgtcaccaacctgaccgtcactatggaccagctgcagggtctgggcagtgattatgagcaaccactggaggtgaagaacaacagtaatctgcagagaatgggctcctccgagtcaacagattcaggtttctgtctagattctcctgggccattggacagtaaagaaaaccttgaaaatcctatgagaagaatacattccctacctcagaagctgttgggatgtagtccagctctgaagaggagccattctgattctcttgaccatgacatctttcagctcatcgacccagatgagaacaaggaaaatgaagcctttgagtttaagaagccagtaagacctgtatctcgtggctgcctgcactctcatggactccaggagggtaaagatctcttcacacagaggcagaactctgccccagctcggatgctttcctcaaatgaaagagatagcagtgaaccagggaatttcattcctctttttacaccccagtcacctgtgacagccactttgtctgatgaggatgatggcttcgtggaccttctcgatggagagaatctgaagaatgaggaggagaccccctcgtgcatggcaagcctctggacagctcctctcgtcatgagaactacaaaccttgacaaccgatgcaagctgtttgactccccttccctgtgtagctccagcactcggtcagtgttgaagagaccagaacgatctcaagaggagtctccacctggaagtacaaagaggaggaagagcatgtctggggccagccccaaagagtcaactaatccagagaaggcccatgagactcttcatcagtctttatccctggcatcttcccccaaaggaaccattgagaacattttggacaatgacccaagggaccttataggagacttctccaagggttatctctttcatacagttgctgggaaacatcaggatttaaaatacatctctccagaaattatggcatctgttttgaatggcaagtttgccaacctcattaaagagtttgttatcatcgactgtcgatacccatatgaatacgagggaggccacatcaagggtgcagtgaacttgcacatggaagaagaggttgaagacttcttattgaagaagcccattgtacctactgatggcaagcgtgtcattgttgtgtttcactgcgagttttcttctgagagaggtccccgcatgtgccggtatgtgagagagagagatcgcctgggtaatgaataccccaaactccactaccctgagctgtatgtcctgaaggggggatacaaggagttctttatgaaatgccagtcttactgtgagccccctagctaccggcccatgcaccacgaggactttaaagaagacctgaagaagttccgcaccaagagccggacctgggcaggggagaagagcaagagggagatgtacagtcgtctgaagaagctctgagggcggcaggaccagccagcagcagcccaagcttccctccatccccctttaccctctttgctgcagagaaacttaagcaaaggggacagctgtgtgacatttggagagggggcctgggacttccatgccttaaacctacctcccacactcccaaggttggagcccagggcatcttgctggctacgcctcttctgtccctgttagacgtcctccgtccatatcagaactgtgccacaatgcagttctgagcaccgtgtcaagctgctctgagccacagtgggatgaaccagccggggccttatcgggctccagccatctcatgaggggagaggagacggaggggagtagagaagttacacagaaatgctgctggccaaatagcaaagacaacctgggaaggaaaggtctttgtgggataatccatatgtttaatttattcaacttcatcaatcactttattttatttttttttctaactcctggagacttattttactgcttcattaggttgaaatactgccattctaggtagggttttattatcccagggactacctcggcttttaatttaaaaaaaaaaaagaagtgggtaagaaaatgcaaacctgttataagttatcggacagaaagctaggtgctctgtcacccccaggaggcgctgtggtactggggctgctgctatttaagccaagaactgaggtcctggtgagagcgttggacccaggcttggctgcctgacataagctaaatctcccagacccaccactggctaccgatatctatttggtgggaggtgtggccctgttcttcctcaccccagttccatgacattggctggtataggagccacagtcaggaaagcacttgaggcagcatctgttgggccacccccggctcagtgctggaatgttgcagtgtaggtttcccagggaaggggggtgggggtaggtgggctccacaggatgggggaggagcatgtccactgagtatcttccttatgttgctgtgatattgatagcttttattttctaatttttaaaaaatggtcatattatgagtcaaagagtatcaaatcagtgttggatggaccacccaagggtgaggagaggggctggaagccctgggcattaggagaagggagtgggtgctggcatggacatgactggatagaattttctcaggagggagcttggtggattttgaaggtaaaactttctgggtttatcatgttttaattttagagacagggagtgatgaatcatcaccggttgtccccttatctaactccataaaagtgggaatttcaaaagaacacctcatccaaggagctggggcagacttcattgattctagagagacctgtttcagtgcctactcatccctgccctctggtgccagcctccttaccatcacggcttcactgaggtgtaggtgggtttttcttaaacaggagacagtctctcccctcttacctcaacttcttggggtgggaatcagtgatactggagatggctagttgctgtgttacgggtttgagttacatttggctataaaacaatcttgttgggaaaaatgtgggggagaggacttcttcctacacgcgcattgagacagattccaactggttaatgatattgtttgtaagaaagagattctgttggttgactgcctaaagagaaaggtgggatggccttcagattataccagcttagctagcattactaaccaactgttggaagctctgaaaataaaagatcttgaacccatgctctctgcctagttcttgatggatttaagga

SEQ ID NO: 957 - DNA, 3663 bp, Homo sapiens
gtcggcttggttttctgctacccggagctgggcaagcgggtgggagaacagcgaagacagcgtgagcctgggccgttgcctcgaggctctcgcccggcttctcttgccgacccgccacgtttgtttggatttaatcttcaggttgccggcgcccgcccgcccgctggcctcgcggtgtgagagggaagcacccgtgcctgtggctggtggctggcgcctggagggtccgcacacccgcccggccgcgccgcttgcccgcggcagccgcgtccctgaaccgcggagtcgtgtttgtgtttgacccgcgggcgccggtggcgcgcggccgaggccggtgtcggcggggcggggcggtcgcggcggaggcagaggaagagggagcgggagctctgcgaggccgggcgccgccatggaactgggcccggagcccccgcaccgccgccgcctgctcttcgcctgcagcccccctcccgcgtcgcagcccgtcgtgaaggcgctatttggcgcttcagccgccgggggactgtcgcctgtcaccaacctgaccgtcactatggaccagctgcagggtctgggcagtgattatgagcaaccactggaggtgaagaacaacagtaatctgcagagaatgggctcctccgagtcaacagattcaggtttctgtctagattctcctgggccattggacagtaaagaaaaccttgaaaatcctatgagaagaatacattccctacctcagaagctgttgggatgtagtccagctctgaagaggagccattctgattctcttgaccatgacatctttcagctcatcgacccagatgagaacaaggaaaatctttcctcaaatgaaagagatagcagtgaaccagggaatttcattcctctttttacaccccagtcacctgtgacagccactttgtctgatgaggatgatggcttcgtggaccttctcgatggagagaatctgaagaatgaggaggagaccccctcgtgcatggcaagcctctggacagctcctctcgtcatgagaactacaaaccttgacaaccgatgcaagctgtttgactccccttccctgtgtagctccagcactcggtcagtgttgaagagaccagaacgatctcaagaggagtctccacctggaagtacaaagaggaggaagagcatgtctggggccagccccaaagagtcaactaatccagagaaggcccatgagactcttcatcagtctttatccctggcatcttcccccaaaggaaccattgagaacattttggacaatgacccaagggaccttataggagacttctccaagggttatctctttcatacagttgctgggaaacatcaggatttaaaatacatctctccagaaattatggcatctgttttgaatggcaagtttgccaacctcattaaagagtttgttatcatcgactgtcgatacccatatgaatacgagggaggccacatcaagggtgcagtgaacttgcacatggaagaagaggttgaagacttcttattgaagaagcccattgtacctactgatggcaagcgtgtcattgttgtgtttcactgcgagttttcttctgagagaggtccccgcatgtgccggtatgtgagagagagagatcgcctgggtaatgaataccccaaactccactaccctgagctgtatgtcctgaaggggggatacaaggagttctttatgaaatgccagtcttactgtgagccccctagctaccggcccatgcaccacgaggactttaaagaagacctgaagaagttccgcaccaagagccggacctgggcaggggagaagagcaagagggagatgtacagtcgtctgaagaagctctgagggcggcaggaccagccagcagcagcccaagcttccctccatccccctttaccctctttgctgcagagaaacttaagcaaaggggacagctgtgtgacatttggagagggggcctgggacttccatgccttaaacctacctcccacactcccaaggttggagcccagggcatcttgctggctacgcctcttctgtccctgttagacgtcctccgtccatatcagaactgtgccacaatgcagttctgagcaccgtgtcaagctgctctgagccacagtgggatgaaccagccggggccttatcgggctccagccatctcatgaggggagaggagacggaggggagtagagaagttacacagaaatgctgctggccaaatagcaaagacaacctgggaaggaaaggtctttgtgggataatccatatgtttaatttattcaacttcatcaatcactttattttatttttttttctaactcctggagacttattttactgcttcattaggttgaaatactgccattctaggtagggttttattatcccagggactacctcggcttttaatttaaaaaaaaaaaagaagtgggtaagaaaatgcaaacctgttataagttatcggacagaaagctaggtgctctgtcacccccaggaggcgctgtggtactggggctgctgctatttaagccaagaactgaggtcctggtgagagcgttggacccaggcttggctgcctgacataagctaaatctcccagacccaccactggctaccgatatctatttggtgggaggtgtggccctgttcttcctcaccccagttccatgacattggctggtataggagccacagtcaggaaagcacttgaggcagcatctgttgggccacccccggctcagtgctggaatgttgcagtgtaggtttcccagggaaggggggtgggggtaggtgggctccacaggatgggggaggagcatgtccactgagtatcttccttatgttgctgtgatattgatagcttttattttctaatttttaaaaaatggtcatattatgagtcaaagagtatcaaatcagtgttggatggaccacccaagggtgaggagaggggctggaagccctgggcattaggagaagggagtgggtgctggcatggacatgactggatagaattttctcaggagggagcttggtggattttgaaggtaaaactttctgggtttatcatgttttaattttagagacagggagtgatgaatcatcaccggttgtccccttatctaactccataaaagtgggaatttcaaaagaacacctcatccaaggagctggggcagacttcattgattctagagagacctgtttcagtgcctactcatccctgccctctggtgccagcctccttaccatcacggcttcactgaggtgtaggtgggtttttcttaaacaggagacagtctctcccctcttacctcaacttcttggggtgggaatcagtgatactggagatggctagttgctgtgttacgggtttgagttacatttggctataaaacaatcttgttgggaaaaatgtgggggagaggacttcttcctacacgcgcattgagacagattccaactggttaatgatattgtttgtaagaaagagattctgttggttgactgcctaaagagaaaggtgggatggccttcagattataccagcttagctagcattactaaccaactgttggaagctctgaaaataaaagatcttgaacccatgctctctgcctagttcttgatggatttaagga

SEQ ID NO: 958 - DNA, 730 bp, Homo sapiens
ccgcgaaaggccggcctggctgcgacagcctgggttgccggcgcccgcccgcccgctggcctcgcggtgtgagagggaagcacccgtgcctgtggctggtggctggcgcctggagggtccgcacacccgcccggccgcgccgcttgcccgcggcagccgcgtccctgaaccgcggagtcgtgtttgtgtttgacccgcgggcgccggtggcgcgcggccgaggccggtgtcggcggggcggggcggtcgcggcggaggcagaggaagagggagcgggagctctgcgaggccgggcgccgccatggaactgggcccggagcccccgcaccgccgccgcctgctcttcgcctgcagcccccctcccgcgtcgcagcccgtcgtgaaggcgctatttggcgcttcagccgccgggggactgtcgcctgtcaccaacctgaccgtcactatggaccagctgcagggtctgggcagtgattatgagcaaccactggaggtgaagaacaacagtaatctgcagagaatgggctcctccgagtcaacagattcaggtttctgtctagattctcctgggccattggacagtaaagaaaaccttgaaaatcctatgagaagaatacattccctacctcagaagctgttgggatgtagtccagctctgaagaggagccattctgattctcttgaccatgacatctttcagctcatcgacccagatgagaacaaggaaaat

SEQ ID NO: 959 - DNA, 3594 bp, Homo sapiens
gcgtgaccttgattgagttaatgaacttcacgcctcagcgtccaggtctgtaaaatggggtgtctaacgcagaccgtacagcccagctgggtttagcaaacttccgggagccagttggagcctctccccatccctagcggtgatcccaggtgacgacatgccgcggggggtcctgcggaggccaccctagggcgttgctgctgcctttgggagtgtggagctccaaaccatgtcgcgagaggcggattttgggaggccgggatcctcgcgccagggggatgtgcgagggtgtgggataaatcttaattcctccggcccacccaaagcctggaaatccagcctccgcgcctcttgccctgcgggccccgccctcagtcccgccctcatctaacccgctaccccattggtggcgtccggcggcgcggctgctgttatttttcgaatatataaggaggtggaagtggcagctgcaactagaggcttccctggctggtgcctgagcccggcgtccctcgccccccgccctccccgcatccctctcctccctcgcgcctggccctgtggctcttcctccctccctccttccccccccccccacccctcgcccgctgcctccctcggcccagccagctgtgccggcgtttgttggctgccctgcgcccggccctccagccagccttctgccggccccgccgcgatggaggtgccccagccggagcccgcgccaggctcggctctcagtccagcaggcgtgtgcggtggcgcccagcgtccgggccacctcccgggcctcctgctgggatctcatggcctcctggggtccccggtgcgggcggccgcttcctcgccggtcaccaccctcacccagaccatgcacgacctcgccgggctcggcagcgaaaccccaaagagtcaggtagggaccctgctcttccgcagccgcagccgcctgacgcacctatccctgtctcgacgggcatccgaatcctccctgtcgtctgaatcctccgaatcttctgatgcaggtctctgcatggattcccccagccctatggacccccacatggcggagcagacgtttgaacaggccatccaggcagccagccggatcattcgaaacgagcagtttgccatcagacgcttccagtctatgccggtgaggctgctgggccacagccccgtgcttcggaacatcaccaactcccaggcgcccgacggccggaggaagagcgaggcgggcagtggagctgccagcagctctggggaagacaaggagaatgatggatttgtcttcaagatgccatggaagcccacacatcccagctccacccatgctctggcagagtgggccagccgcagggaagcctttgcccagagacccagctcggcccccgacctgatgtgtctcagtcctgaccggaagatggaagtggaggagctcagccccctggccctaggtcgcttctctctgacccctgcagagggggatactgaggaagatgatggatttgtggacatcctagagagtgacttaaaggatgatgatgcagttcccccaggcatggagagtctcattagtgccccactggtcaagaccttggaaaaggaagaggaaaaggacctcgtcatgtacagcaagtgccagcggctcttccgctctccgtccatgccctgcagcgtgatccggcccatcctcaagaggctggagcggccccaggacagggacacgcccgtgcagaataagcggaggcggagcgtgacccctcctgaggagcagcaggaggctgaggaacctaaagcccgcgtcctccgctcaaaatcactgtgtcacgatgagatcgagaacctcctggacagtgaccaccgagagctgattggagattactctaaggccttcctcctacagacagtagacggaaagcaccaagacctcaagtacatctcaccagaaacgatggtggccctattgacgggcaagttcagcaacatcgtggataagtttgtgattgtagactgcagatacccctatgaatatgaaggcgggcacatcaagactgcggtgaacttgcccctggaacgcgacgccgagagcttcctactgaagagccccatcgcgccctgtagcctggacaagagagtcatcctcattttccactgtgaattctcatctgagcgtgggccccgcatgtgccgtttcatcagggaacgagaccgtgctgtcaacgactaccccagcctctactaccctgagatgtatatcctgaaaggcggctacaaggagttcttccctcagcacccgaacttctgtgaaccccaggactaccggcccatgaaccacgaggccttcaaggatgagctaaagaccttccgcctcaagactcgcagctgggctggggagcggagccggcgggagctctgtagccggctgcaggaccagtgaggggcctgcgccagtcctgctacctcccttgcctttcgaggcctgaagccagctgccctatgggcctgccgggctgagggcctgctggaggcctcaggtgctgtccatgggaaagatggtgtgggtgtcctgcctgtctgccccagcccagattcccctgtgtcatcccatcattttccatatcctggtgccccccacccctggaagagcccagtctgttgagttagttaagttgggttaataccagcttaaaggcagtattttgtgtcctccaggagcttcttgtttccttgttagggttaacccttcatcttcctgtgtcctgaaacgctcctttgtgtgtgtgtcagctgaggctgggggagagccgtggtccctgaggatgggtcagagctaaactccttcctggcctgagagtcagctctctgccctgtgtacttcccgggccagggctgcccctaatctctgtaggaaccgtggtatgtctgccatgttgcccctttctcttttcccctttcctgtcccaccatacgagcacctccagcctgaacagaagctcttactctttcctatttcagtgttacctgtgtgcttggtctgtttgactttacgcccatctcaggacacttccgtagactgtttaggttcccctgtcaaatatcagttacccactcggtcccagttttgttgccccagaaagggatgttattatccttgggggctcccagggcaagggttaaggcctgaatcatgagcctgctggaagcccagcccctactgctgtgaaccctggggcctgactgctcagaacttgctgctgtcttgttgcggatggatggaaggttggatggatgggtggatggccgtggatggccgtggatgcgcagtgccttgcatacccaaaccaggtgggagcgttttgttgagcatgacagcctgcagcaggaatatatgtgtgcctatttgtgtggacaaaaatatttacacttagggtttggagctattcaagaggaaatgtcacagaagcagctaaaccaaggactgagcaccctctggattctgaatctcaagatgggggcagggctgtgcttgaaggccctgctgagtcatctgttagggccttggttcaataaagcactgagcaagttgagaaa

SEQ ID NO: 960 - DNA, 1978 bp, Homo sapiens
acccctcgcccgctgcctccctcggcccagccagctgtgccggcgtttgttggctgccctgcgcccggccctccagccagccttctgccggccccgccgcgatggaggtgccccagccggagcccgcgccaggctcggctctcagtccagcaggcgtgtgcggtggcgcccagcgtccgggccacctcccgggcctcctgctgggatctcatggcctcctggggtccccggtgcgggcggccgcttcctcgccggtcaccaccctcacccagaccatgcacgacctcgccgggctcggcagcgaaaccccaaagagtcaggtagggaccctgctcttccgcagccgcagccgcctgacgcacctatccctgtctcgacgggcatccgaatcctccctgtcgtctgaatcctccgaatcttctgatgcaggtctctgcatggattcccccagccctatggacccccacatggcggagcagacgtttgaacaggccatccaggcagccagccggatcattcgaaacgagcagtttgccatcagacgcttccagtctatgccggatggatttgtcttcaagatgccatggaagcccacacatcccagctccacccatgctctggcagagtgggccagccgcagggaagcctttgcccagagacccagctcggcccccgacctgatgtgtctcagtcctgaccggaagatggaagtggaggagctcagccccctggccctaggtcgcttctctctgacccctgcagagggggatactgaggaagatgatggatttgtggacatcctagagagtgacttaaaggatgatgatgcagttcccccaggcatggagagtctcattagtgccccactggtcaagaccttggaaaaggaagaggaaaaggacctcgtcatgtacagcaagtgccagcggctcttccgctctccgtccatgccctgcagcgtgatccggcccatcctcaagaggctggagcggccccaggacagggacacgcccgtgcagaataagcggaggcggagcgtgacccctcctgaggagcagcaggaggctgaggaacctaaagcccgcgtcctccgctcaaaatcactgtgtcacgatgagatcgagaacctcctggacagtgaccaccgagagctgattggagattactctaaggccttcctcctacagacagtagacggaaagcaccaagacctcaagtacatctcaccagaaacgatggtggccctattgacgggcaagttcagcaacatcgtggataagtttgtgattgtagactgcagatacccctatgaatatgaaggcgggcacatcaagactgcggtgaacttgcccctggaacgcgacgccgagagcttcctactgaagagccccatcgcgccctgtagcctggacaagagagtcatcctcattttccactgtgaattctcatctgagcgtgggccccgcatgtgccgtttcatcagggaacgagaccgtgctgtcaacgactaccccagcctctactaccctgagatgtatatcctgaaaggcggctacaaggagttcttccctcagcacccgaacttctgtgaaccccaggactaccggcccatgaaccacgaggccttcaaggatgagctaaagaccttccgcctcaagactcgcagctgggctggggagcggagccggcgggagctctgtagccggctgcaggaccagtgaggggcctgcgccagtcctgctacctcccttgcctttcgaggcctgaagccagctgccctatgggcctgccgggctgagggcctgctggaggcctcaggtgctgtccatgggaaagatggtgtgggtgtcctgcctgtctgccccagcccagattcccctgtgtcatcccatcattttccatatcctggtgccccccacccctggaagagcccagtctgttgagttagttaagttgggttaataccagcttaaaggca

SEQ ID NO: 961 - DNA, 2291 bp, Homo sapiens
gacccggcagcgacgcgggcggggacgcggtgcatcgctactgcgcccggcggacagcgacttgctgctcaaaaagaataagaaccagggtttttgtttgttttttttttttttaattaaggtaaaaataacgcacttttttttttgcggaacctgaaaaattcaagaagttgaaaaacgcttttcacgtcacctggagagatgcacagcgaaaccccaaagagtcaggtagggaccctgctcttccgcagccgcagccgcctgacgcacctatccctgtctcgacgggcatccgaatcctccctgtcgtctgaatcctccgaatcttctgatgcaggtctctgcatggattcccccagccctatggacccccacatggcggagcagacgtttgaacaggccatccaggcagccagccggatcattcgaaacgagcagtttgccatcagacgcttccagtctatgccggtgaggctgctgggccacagccccgtgcttcggaacatcaccaactcccaggcgcccgacggccggaggaagagcgaggcgggcagtggagctgccagcagctctggggaagacaaggagaatgatggatttgtcttcaagatgccatggaagcccacacatcccagctccacccatgctctggcagagtgggccagccgcagggaagcctttgcccagagacccagctcggcccccgacctgatgtgtctcagtcctgaccggaagatggaagtggaggagctcagccccctggccctaggtcgcttctctctgacccctgcagagggggatactgaggaagatgatggatttgtggacatcctagagagtgacttaaaggatgatgatgcagttcccccaggcatggagagtctcattagtgccccactggtcaagaccttggaaaaggaagaggaaaaggacctcgtcatgtacagcaagtgccagcggctcttccgctctccgtccatgccctgcagcgtgatccggcccatcctcaagaggctggagcggccccaggacagggacacgcccgtgcagaataagcggaggcggagcgtgacccctcctgaggagcagcaggaggctgaggaacctaaagcccgcgtcctccgctcaaaatcactgtgtcacgatgagatcgagaacctcctggacagtgaccaccgagagctgattggagattactctaaggccttcctcctacagacagtagacggaaagcaccaagacctcaagtacatctcaccagaaacgatggtggccctattgacgggcaagttcagcaacatcgtggataagtttgtgattgtagactgcagatacccctatgaatatgaaggcgggcacatcaagactgcggtgaacttgcccctggaacgcgacgccgagagcttcctactgaagagccccatcgcgccctgtagcctggacaagagagtcatcctcattttccactgtgaattctcatctgagcgtgggccccgcatgtgccgtttcatcagggaacgagaccgtgctgtcaacgactaccccagcctctactaccctgagatgtatatcctgaaaggcggctacaaggagttcttccctcagcacccgaacttctgtgaaccccaggactaccggcccatgaaccacgaggccttcaaggatgagctaaagaccttccgcctcaagactcgcagctgggctggggagcggagccggcgggagctctgtagccggctgcaggaccagtgaggggcctgcgccagtcctgctacctcccttgcctttcgaggcctgaagccagctgccctatgggcctgccgggctgagggcctgctggaggcctcaggtgctgtccatgggaaagatggtgtgggtgtcctgcctgtctgccccagcccagattcccctgtgtcatcccatcattttccatatcctggtgccccccacccctggaagagcccagtctgttgagttagttaagttgggttaataccagcttaaaggcagtattttgtgtcctccaggagcttcttgtttccttgttagggttaacccttcatcttcctgtgtcctgaaacgctcctttgtgtgtgtgtcagctgaggctgggggagagccgtggtccctgaggatgggtcagagctaaactccttcctggcctgagagtcagctctctgccctgtgtacttcccgggccagggctgcccctaatctctgtaggaaccgtggtatgtctgccatgttgcccctttctcttttcccctttcctgtcccaccatacgagcacc

SEQ ID NO: 962 - DNA, 1756 bp, Homo sapiens
gctactgcgcccggcggacagcgacttgctgctcaaaaagaataagaaccagggtttttgtttgttttttttttttttaattaaggtaaaaataacgcacttttttttttgcggaacctgaaaaattcaagaagttgaaaaacgcttttcacgtcacctggagagatgcacagcgaaaccccaaagagtcaggtagggaccctgctcttccgcagccgcagccgcctgacgcacctatccctgtctcgacgggcatccgaatcctccctgtcgtctgaatcctccgaatcttctgatgcaggtctctgcatggattcccccagccctatggacccccacatggcggagcagacgtttgaacaggccatccaggcagccagccggatcattcgaaacgagcagtttgccatcagacgcttccagtctatgccggtgaggctgctgggccacagccccgtgcttcggaacatcaccaactcccaggcgcccgacggccggaggaagagcgaggcgggcagtggagctgccagcagctctggggaagacaaggagaatgatggatttgtcttcaagatgccatggaagcccacacatcccagctccacccatgctctggcagagtgggccagccgcagggaagcctttgcccagagacccagctcggcccccgacctgatgtgtctcagtcctgaccggaagatggaagtggaggagctcagccccctggccctaggtcgcttctctctgacccctgcagagggggatactgaggaagatgatggatttgtggacatcctagagagtgacttaaaggacctcgtcatgtacagcaagtgccagcggctcttccgctctccgtccatgccctgcagcgtgatccggcccatcctcaagaggctggagcggccccaggacagggacacgcccgtgcagaataagcggaggcggagcgtgacccctcctgaggagcagcaggaggctgaggaacctaaagcccgcgtcctccgctcaaaatcactgtgtcacgatgagatcgagaacctcctggacagtgaccaccgagagctgattggagattactctaaggccttcctcctacagacagtagacggaaagcaccaagacctcaagtacatctcaccagaaacgatggtggccctattgacgggcaagttcagcaacatcgtggataagtttgtgattgtagactgcagatacccctatgaatatgaaggcgggcacatcaagactgcggtgaacttgcccctggaacgcgacgccgagagcttcctactgaagagccccatcgcgccctgtagcctggacaagagagtcatcctcattttccactgtgaattctcatctgagcgtgggccccgcatgtgccgtttcatcagggaacgagaccgtgctgtcaacgactaccccagcctctactaccctgagatgtatatcctgaaaggcggctacaaggagttcttccctcagcacccgaacttctgtgaaccccaggactaccggcccatgaaccacgaggccttcaaggatgagctaaagaccttccgcctcaagactcgcagctgggctggggagcggagccggcgggagctctgtagccggctgcaggaccagtgaggggcctgcgccagtcctgctacctcccttgcctttcgaggcctgaagccagctgccctatgggcctgccgggctgagggcctgctggaggcctcaggtgctgtccatgggaaagatggtg

SEQ ID NO: 963 - DNA, 3096 bp, Homo sapiens
ggaagtggcagctgcaactagaggcttccctggctggtgcctgagcccggcgtccctcgccccccgccctccccgcatccctctcctccctcgcgcctggccctgtggctcttcctccctccctccttccccccccccccacccctcgcccgctgcctccctcggcccagccagctgtgccggcgtttgttggctgccctgcgcccggccctccagccagccttctgccggccccgccgcgatggaggtgccccagccggagcccgcgccaggctcggctctcagtccagcaggcgtgtgcggtggcgcccagcgtccgggccacctcccgggcctcctgctgggatctcatggcctcctggggtccccggtgcgggcggccgcttcctcgccggtcaccaccctcacccagaccatgcacgacctcgccgggctcggcagccgcagccgcctgacgcacctatccctgtctcgacgggcatccgaatcctccctgtcgtctgaatcctccgaatcttctgatgcaggtctctgcatggattcccccagccctatggacccccacatggcggagcagacgtttgaacaggccatccaggcagccagccggatcattcgaaacgagcagtttgccatcagacgcttccagtctatgccggtgaggctgctgggccacagccccgtgcttcggaacatcaccaactcccaggcgcccgacggccggaggaagagcgaggcgggcagtggagctgccagcagctctggggaagacaaggagaatgatggatttgtcttcaagatgccatggaagcccacacatcccagctccacccatgctctggcagagtgggccagccgcagggaagcctttgcccagagacccagctcggcccccgacctgatgtgtctcagtcctgaccggaagatggaagtggaggagctcagccccctggccctaggtcgcttctctctgacccctgcagagggggatactgaggaagatgatggatttgtggacatcctagagagtgacttaaaggatgatgatgcagttcccccaggcatggagagtctcattagtgccccactggtcaagaccttggaaaaggaagaggaaaaggacctcgtcatgtacagcaagtgccagcggctcttccgctctccgtccatgccctgcagcgtgatccggcccatcctcaagaggctggagcggccccaggacagggacacgcccgtgcagaataagcggaggcggagcgtgacccctcctgaggagcagcaggaggctgaggaacctaaagcccgcgtcctccgctcaaaatcactgtgtcacgatgagatcgagaacctcctggacagtgaccaccgagagctgattggagattactctaaggccttcctcctacagacagtagacggaaagcaccaagacctcaagtacatctcaccagaaacgatggtggccctattgacgggcaagttcagcaacatcgtggataagtttgtgattgtagactgcagatacccctatgaatatgaaggcgggcacatcaagactgcggtgaacttgcccctggaacgcgacgccgagagcttcctactgaagagccccatcgcgccctgtagcctggacaagagagtcatcctcattttccactgtgaattctcatctgagcgtgggccccgcatgtgccgtttcatcagggaacgagaccgtgctgtcaacgactaccccagcctctactaccctgagatgtatatcctgaaaggcggctacaaggagttcttccctcagcacccgaacttctgtgaaccccaggactaccggcccatgaaccacgaggccttcaaggatgagctaaagaccttccgcctcaagactcgcagctgggctggggagcggagccggcgggagctctgtagccggctgcaggaccagtgaggggcctgcgccagtcctgctacctcccttgcctttcgaggcctgaagccagctgccctatgggcctgccgggctgagggcctgctggaggcctcaggtgctgtccatgggaaagatggtgtgggtgtcctgcctgtctgccccagcccagattcccctgtgtcatcccatcattttccatatcctggtgccccccacccctggaagagcccagtctgttgagttagttaagttgggttaataccagcttaaaggcagtattttgtgtcctccaggagcttcttgtttccttgttagggttaacccttcatcttcctgtgtcctgaaacgctcctttgtgtgtgtgtcagctgaggctgggggagagccgtggtccctgaggatgggtcagagctaaactccttcctggcctgagagtcagctctctgccctgtgtacttcccgggccagggctgcccctaatctctgtaggaaccgtggtatgtctgccatgttgcccctttctcttttcccctttcctgtcccaccatacgagcacctccagcctgaacagaagctcttactctttcctatttcagtgttacctgtgtgcttggtctgtttgactttacgcccatctcaggacacttccgtagactgtttaggttcccctgtcaaatatcagttacccactcggtcccagttttgttgccccagaaagggatgttattatccttgggggctcccagggcaagggttaaggcctgaatcatgagcctgctggaagcccagcccctactgctgtgaaccctggggcctgactgctcagaacttgctgctgtcttgttgcggatggatggaaggttggatggatgggtggatggccgtggatggccgtggatgcgcagtgccttgcatacccaaaccaggtgggagcgttttgttgagcatgacagcctgcagcaggaatatatgtgtgcctatttgtgtggacaaaaatatttacacttagggtttggagctattcaagaggaaatgtcacagaagcagctaaaccaaggactgagcaccctctggattctgaatctcaagatgggggcagggctgtgcttgaaggccctgctgagtcatctgttagggccttggttcaataaagcactgagcaagttgagaaa

SEQ ID NO: 964 - DNA, 2128 bp, Homo sapiens
gtttgaatggtcaacgcctgcggctgttgatattcttgctcagaggccgtaactttggccttctgctcagggaagactctgagtccgacgttggcctacccagtcggaaggcagagctgcaatctagttaactacctcctttcccctagatttcctttcattctgctcaagtcttcgcctgtgtccgatccctatctactttctctcctcttgtaggcaagcctcagactccaggcttgagctaggttttgtttttctcctggtgagaattcgaagaccatgtctacggaactcttctcatccacaagagaggaaggaagctctggctcaggacccagttttaggtctaatcaaaggaaaatgttaaacctgctcctggagagagacacttcctttaccgtctgtccagatgtccctagaactccagtgggcaaatttcttggtgattctgcaaacctaagcattttgtctggaggaaccccaaaacgttgcctcgatctttcgaatcttagcagtggggagataactgccactcagcttaccacttctgcagaccttgatgaaactggtcacctggattcttcaggacttcaggaagtgcatttagctgggatgaatcatgaccagcacctaatgaaatgtagcccagcacagcttctttgtagcactccgaatggtttggaccgtggccatagaaagagagatgcaatgtgtagttcatctgcaaataaagaaaatgacaatggaaacttggtggacagtgaaatgaaatatttgggcagtcccattactactgttccaaaattggataaaaatccaaacctaggagaagaccaggcagaagagatttcagatgaattaatggagttttccctgaaagatcaagaagcaaaggtgagcagaagtggcctatatcgctccccgtcgatgccagagaacttgaacaggccaagactgaagcaggtggaaaaattcaaggacaacacaataccagataaagttaaaaaaaagtatttttctggccaaggaaagctcaggaagggcttatgtttaaagaagacagtctctctgtgtgacattactatcactcagatgctggaggaagattctaaccaggggcacctgattggtgatttttccaaggtatgtgcgctgccaaccgtgtcagggaaacaccaagatctgaagtatgtcaacccagaaacagtggctgccttactgtcggggaagttccagggtctgattgagaagttttatgtcattgattgtcgctatccatatgagtatctgggaggacacatccagggagccttaaacttatatagtcaggaagaactgtttaacttctttctgaagaagcccatcgtccctttggacacccagaagagaataatcatcgtgttccactgtgaattctcctcagagaggggcccccgaatgtgccgctgtctgcgtgaagaggacaggtctctgaaccagtatcctgcattgtactacccagagctatatatccttaaaggcggctacagagacttctttccagaatatatggaactgtgtgaaccacagagctactgccctatgcatcatcaggaccacaagactgagttgctgaggtgtcgaagccagagcaaagtgcaggaaggggagcggcagctgcgggagcagattgcccttctggtgaaggacatgagcccatgataacattccagccactggctgctaacaagtcaccaaaagacactgcagaaaccctgagcagaaagaggccttctggatggccaaacccaagattattaaaagatgtctctgcaaaccaacaggctaccaacttgtatccaggcctgggaatggattaggtttcagcagagctgaaagctggtggcagagtcctggagctggctctataaggcagccttgagttgcatagagatttgtattggttcagggaactctggcattccttttcccaactcctcatgtcttctcacaagccagccaactctttctctctgggcttcgggctatgcaagagcgttgtctaccttctttctttgtattttccttctttgtttccccctctttcttttttaaaaatggaaaaataaacactacagaatgagaggtg

SEQ ID NO: 965 - DNA, 1896 bp, Homo sapiens
ggtcaacgcctgcggctgttgatattcttgctcagaggccgtaactttggccttctgctcagggaagactctgagtccgacgttggcctacccagtcggaaggcagagctgcaatctagttaactacctcctttcccctagatttcctttcattctgctcaagtcttcgcctgtgtccgatccctatctactttctctcctcttgtaggcaagcctcagactccaggcttgagctaggttttgtttttctcctggtgagaattcgaagaccatgtctacggaactcttctcatccacaagagaggaaggaagctctggctcaggacccagttttaggtctaatcaaaggaaaatgttaaacctgctcctggagagagacacttcctttaccgtctgtccagatgtccctagaactccagtgggcaaatttcttggtgattctgcaaacctaagcattttgtctgggtcacctggattcttcaggacttcaggaagtgcatttagctgggatgacaatggaaacttggtggacagtgaaatgaaatatttgggcagtcccattactactgttccaaaattggataaaaatccaaacctaggagaagaccaggcagaagagatttcagatgaattaatggagttttccctgaaagatcaagaagcaaaggtgagcagaagtggcctatatcgctccccgtcgatgccagagaacttgaacaggccaagactgaagcaggtggaaaaattcaaggacaacacaataccagataaagttaaaaaaaagtatttttctggccaaggaaagctcaggaagggcttatgtttaaagaagacagtctctctgtgtgacattactatcactcagatgctggaggaagattctaaccaggggcacctgattggtgatttttccaaggtatgtgcgctgccaaccgtgtcagggaaacaccaagatctgaagtatgtcaacccagaaacagtggctgccttactgtcggggaagttccagggtctgattgagaagttttatgtcattgattgtcgctatccatatgagtatctgggaggacacatccagggagccttaaacttatatagtcaggaagaactgtttaacttctttctgaagaagcccatcgtccctttggacacccagaagagaataatcatcgtgttccactgtgaattctcctcagagaggggcccccgaatgtgccgctgtctgcgtgaagaggacaggtctctgaaccagtatcctgcattgtactacccagagctatatatccttaaaggcggctacagagacttctttccagaatatatggaactgtgtgaaccacagagctactgccctatgcatcatcaggaccacaagactgagttgctgaggtgtcgaagccagagcaaagtgcaggaaggggagcggcagctgcgggagcagattgcccttctggtgaaggacatgagcccatgataacattccagccactggctgctaacaagtcaccaaaagacactgcagaaaccctgagcagaaagaggccttctggatggccaaacccaagattattaaaagatgtctctgcaaaccaacaggctaccaacttgtatccaggcctgggaatggattaggtttcagcagagctgaaagctggtggcagagtcctggagctggctctataaggcagccttgagttgcatagagatttgtattggttcagggaactctggcattccttttcccaactcctcatgtcttctcacaagccagccaactctttctctctgggcttcgggctatgcaagagcgttgtctaccttctttctttgtattttccttctttgtttccccctctttcttttttaaaaatggaaaaataaacactacagaatgag

SEQ ID NO: 966 - DNA, 2025 bp, Homo sapiens
ggtcaacgcctgcggctgttgatattcttgctcagaggccgtaactttggccttctgctcagggaagactctgagtccgacgttggcctacccagtcggaaggcagagctgcaatctagttaactacctcctttcccctagatttcctttcattctgctcaagtcttcgcctgtgtccgatccctatctactttctctcctcttgtaggcaagcctcagactccaggcttgagctaggttttgtttttctcctggtgagaattcgaagaccatgtctacggaactcttctcatccacaagagaggaaggaagctctggctcaggacccagttttaggtctaatcaaaggaaaatgttaaacctgctcctggagagagacacttcctttaccgtctgtccagatgtccctagaactccagtgggcaaatttcttggtgattctgcaaacctaagcattttgtctggaggaaccccaaaacgttgcctcgatctttcgaatcttagcagtggggagataactgccactcagcttaccacttctgcagaccttgatgaaactggtcacctggattcttcaggacttcaggaagtgcatttagctgggatgaatcatgaccagcacctaatgaaatgtagcccagacaatggaaacttggtggacagtgaaatgaaatatttgggcagtcccattactactgttccaaaattggataaaaatccaaacctaggagaagaccaggcagaagagatttcagatgaattaatggagttttccctgaaagatcaagaagcaaaggtgagcagaagtggcctatatcgctccccgtcgatgccagagaacttgaacaggccaagactgaagcaggtggaaaaattcaaggacaacacaataccagataaagttaaaaaaaagtatttttctggccaaggaaagctcaggaagggcttatgtttaaagaagacagtctctctgtgtgacattactatcactcagatgctggaggaagattctaaccaggggcacctgattggtgatttttccaaggtatgtgcgctgccaaccgtgtcagggaaacaccaagatctgaagtatgtcaacccagaaacagtggctgccttactgtcggggaagttccagggtctgattgagaagttttatgtcattgattgtcgctatccatatgagtatctgggaggacacatccagggagccttaaacttatatagtcaggaagaactgtttaacttctttctgaagaagcccatcgtccctttggacacccagaagagaataatcatcgtgttccactgtgaattctcctcagagaggggcccccgaatgtgccgctgtctgcgtgaagaggacaggtctctgaaccagtatcctgcattgtactacccagagctatatatccttaaaggcggctacagagacttctttccagaatatatggaactgtgtgaaccacagagctactgccctatgcatcatcaggaccacaagactgagttgctgaggtgtcgaagccagagcaaagtgcaggaaggggagcggcagctgcgggagcagattgcccttctggtgaaggacatgagcccatgataacattccagccactggctgctaacaagtcaccaaaagacactgcagaaaccctgagcagaaagaggccttctggatggccaaacccaagattattaaaagatgtctctgcaaaccaacaggctaccaacttgtatccaggcctgggaatggattaggtttcagcagagctgaaagctggtggcagagtcctggagctggctctataaggcagccttgagttgcatagagatttgtattggttcagggaactctggcattccttttcccaactcctcatgtcttctcacaagccagccaactctttctctctgggcttcgggctatgcaagagcgttgtctaccttctttctttgtattttccttctttgtttccccctctttcttttttaaaaatggaaaaataaacactacagaatgag

SEQ ID NO: 967 - DNA, 1986 bp, Homo sapiens
ggtcaacgcctgcggctgttgatattcttgctcagaggccgtaactttggccttctgctcagggaagactctgagtccgacgttggcctacccagtcggaaggcagagctgcaatctagttaactacctcctttcccctagatttcctttcattctgctcaagtcttcgcctgtgtccgatccctatctactttctctcctcttgtaggcaagcctcagactccaggcttgagctaggttttgtttttctcctggtgagaattcgaagaccatgtctacggaactcttctcatccacaagagaggaaggaagctctggctcaggacccagttttaggtctaatcaaaggaaaatgttaaacctgctcctggagagagacacttcctttaccgtctgtccagatgtccctagaactccagtgggcaaatttcttggtgattctgcaaacctaagcattttgtctgggtcacctggattcttcaggacttcaggaagtgcatttagctgggatgcacagcttctttgtagcactccgaatggtttggaccgtggccatagaaagagagatgcaatgtgtagttcatctgcaaataaagaaaatgacaatggaaacttggtggacagtgaaatgaaatatttgggcagtcccattactactgttccaaaattggataaaaatccaaacctaggagaagaccaggcagaagagatttcagatgaattaatggagttttccctgaaagatcaagaagcaaaggtgagcagaagtggcctatatcgctccccgtcgatgccagagaacttgaacaggccaagactgaagcaggtggaaaaattcaaggacaacacaataccagataaagttaaaaaaaagtatttttctggccaaggaaagctcaggaagggcttatgtttaaagaagacagtctctctgtgtgacattactatcactcagatgctggaggaagattctaaccaggggcacctgattggtgatttttccaaggtatgtgcgctgccaaccgtgtcagggaaacaccaagatctgaagtatgtcaacccagaaacagtggctgccttactgtcggggaagttccagggtctgattgagaagttttatgtcattgattgtcgctatccatatgagtatctgggaggacacatccagggagccttaaacttatatagtcaggaagaactgtttaacttctttctgaagaagcccatcgtccctttggacacccagaagagaataatcatcgtgttccactgtgaattctcctcagagaggggcccccgaatgtgccgctgtctgcgtgaagaggacaggtctctgaaccagtatcctgcattgtactacccagagctatatatccttaaaggcggctacagagacttctttccagaatatatggaactgtgtgaaccacagagctactgccctatgcatcatcaggaccacaagactgagttgctgaggtgtcgaagccagagcaaagtgcaggaaggggagcggcagctgcgggagcagattgcccttctggtgaaggacatgagcccatgataacattccagccactggctgctaacaagtcaccaaaagacactgcagaaaccctgagcagaaagaggccttctggatggccaaacccaagattattaaaagatgtctctgcaaaccaacaggctaccaacttgtatccaggcctgggaatggattaggtttcagcagagctgaaagctggtggcagagtcctggagctggctctataaggcagccttgagttgcatagagatttgtattggttcagggaactctggcattccttttcccaactcctcatgtcttctcacaagccagccaactctttctctctgggcttcgggctatgcaagagcgttgtctaccttctttctttgtattttccttctttgtttccccctctttcttttttaaaaatggaaaaataaacactacagaatgag

SEQ ID NO: 968 - DNA, 1556 bp, Homo sapiens
agaggccgtaactttggccttctgctcagggaagactctgagtccgacgttggcctacccagtcggaaggcagagctgcaatctagttaactacctcctttcccctagatttcctttcattctgctcaagtcttcgcctgtgtccgatccctatctactttctctcctcttgtaggcaagcctcagactccaggcttgaggttttgtttttctcctggtgagaattcgaagaccatgtctacggaactcttctcatccacaagagaggaaggaagctctggctcaggacccagttttaggtctaatcaaaggaaaatgttaaacctgctcctggagagagacacttcctttaccgtctgtccagatgtccctagaactccagtgggcaaatttcttggtgattctgcaaacctaagcattttgtctgggtcacctggattcttcaggacttcaggaagtgcatttagctgggatgacaatggaaacttggtggacagtgaaatgaaatatttgggcagtcccattactactgttccaaaattggataaaaatccaaacctaggagaagaccaggcagaagagatttcagatgaattaatggagttttccctgaaagatcaagaagcaaaggtgagcagaagtggcctatatcgctccccgtcgatgccagagaacttgaacaggccaagactgaagcaggtggaaaaattcaaggacaacacaataccagataaagttaaaaaaaagtatttttctggccaaggaaagctcaggaagggcttatgtttaaagaagacagtctctctgtgtgacattactatcactcagatgctggaggaagattctaaccaggggcacctgattggtgatttttccaaggtatgtgcgctgccaaccgtgtcagggaaacaccaagatctgaagtatgtcaacccagaaacagtggctgccttactgtcggggaagttccagggtctgattgagaagttttatgtcattgattgtcgctatccatatgagtatctgggaggacacatccagggagccttaaacttatatagtcaggaagaactgtttaacttctttctgaagaagcccatcgtccctttggacacccagaagagaataatcatcgtgttccactgtgaattctcctcagagaggggcccccgaatgtgccgctgtctgcgtgaagaggacaggtctctgaaccagtatcctgcattgtactacccagagctatatatccttaaaggcggctacagagacttctttccagaatatatggaactgtgtgaaccacagagctactgccctatgcatcatcaggaccacaagactgagttgctgaggtgtcgaagccagagcaaagtgcaggaaggggagcggcagctgcgggagcagattgcccttctggtgaaggacatgagcccatgataacattccagccactggctgctaacaagtcaccaaaagacactgcagaaaccctgagcagaaagaggccttctggatggccaaacccaagattattaaaagatgtctctgcaaaccaa

SEQ ID NO: 969 - DNA, 1059 bp, Homo sapiens
agaggcgagcggggataggttactgggctggcggaaggtttgaatggtcaacgcctgcggctgttgatattcttgctcagaggccgtaactttggccttctgctcagggaagactctgagtccgacgttggcctacccagtcggaaggcagagctgcaatctagttaactacctcctttcccctagatttcctttcattctgctcaagtcttcgcctgtgtccgatccctatctactttctctcctcttgtaggcaagcctcagactccaggcttgaggttttgtttttctcctggtgagaattcgaagaccatgtctacggaactcttctcatccacaagagaggaaggaagctctggctcaggacccagttttaggtctaatcaaaggaaaatgttaaacctgctcctggagagagacacttcctttaccgtctgtccagatgtccctagaactccagtgggcaaatttcttggtgattctgcaaacctaagcattttgtctggaggaaccccaaaacgttgcctcgatctttcgaatcttagcagtggggagataactgccactcagcttaccacttctgcagaccttgatgaaactggtcacctggattcttcaggacttcaggaagtgcatttagctgggatgaatcatgaccagcacctaatgaaatgtagcccagcacagcttctttgtagcactccgaatggtttggaccgtggccatagaaagagagatgcaatgtgtagttcatctgcaaataaagaaaatgacaatggaaacttggtggacagtgaaatgaaatatttgggcagtcccattactactgttccaaaattggataaaaatccaaacctaggagaagaccaggcagaagagatttcagatgaattaatggagttttccctgaaagatcaagaagcaaaggtgagcagaagtggcctatatcgctccccgtcgatgccagagaacttgaacaggccaagactgaagcaggtggaaaaattcaaggacaacacaataccagataaagttaaaaaaaagtatttttctggccaa

SEQ ID NO: 970 - DNA, 1968 bp, Homo sapiens
gaggtgcccgccccgaggccccagcgccacctgccctccaccacctaccgcggttcctccagctcccagggccgcggccggagcagctctgagcgctcggttcgccccacggtgcccttaaaaggcgctggcgcgaaccaacgagtccctgaggagagtagggggacagctccggctcgcagaatccccccaagccacccatggagggcgcagctccgtgtcgtgtctctctcaaagtgtctctcggacagcgctgttgggaacgagcctggcgctttgatttagggatgggggtggtttcctcactaacgagtcaccccctccaaaatatcgcagaaagtggacggccccagttggaggcacatcttgaaacccgcgggggaggccatgtcggaagaaggttttgtttttctcctggtgagaattcgaagaccatgtctacggaactcttctcatccacaagagaggaaggaagctctggctcaggacccagttttaggtctaatcaaaggaaaatgttaaacctgctcctggagagagacacttcctttaccgtctgtccagatgtccctagaactccagtgggcaaatttcttggtgattctgcaaacctaagcattttgtctggaggaaccccaaaacgttgcctcgatctttcgaatcttagcagtggggagataactgccactcagcttaccacttctgcagaccttgatgaaactggtcacctggattcttcaggacttcaggaagtgcatttagctgggatgaatcatgaccagcacctaatgaaatgtagcccagcacagcttctttgtagcactccgaatggtttggaccgtggccatagaaagagagatgcaatgtgtagttcatctgcaaataaagaaaatgacaatggaaacttggtggacagtgaaatgaaatatttgggcagtcccattactactgttccaaaattggataaaaatccaaacctaggagaagaccaggcagaagagatttcagatgaattaatggagttttccctgaaagatcaagaagcaaaggtgagcagaagtggcctatatcgctccccgtcgatgccagagaacttgaacaggccaagactgaagcaggtggaaaaattcaaggacaacacaataccagataaagttaaaaaaaagtatttttctggccaaggaaagctcaggaagggcttatgtttaaagaagacagtctctctgtgtgacattactatcactcagatgctggaggaagattctaaccaggggcacctgattggtgatttttccaaggtatgtgcgctgccaaccgtgtcagggaaacaccaagatctgaagtatgtcaacccagaaacagtggctgccttactgtcggggaagttccagggtctgattgagaagttttatgtcattgattgtcgctatccatatgagtatctgggaggacacatccagggagccttaaacttatatagtcaggaagaactgtttaacttctttctgaagaagcccatcgtccctttggacacccagaagagaataatcatcgtgttccactgtgaattctcctcagagaggggcccccgaatgtgccgctgtctgcgtgaagaggacaggtctctgaaccagtatcctgcattgtactacccagagctatatatccttaaaggcggctacagagacttctttccagaatatatggaactgtgtgaaccacagagctactgccctatgcatcatcaggaccacaagactgagttgctgaggtgtcgaagccagagcaaagtgcaggaaggggagcggcagctgcgggagcagattgcccttctggtgaaggacatgagcccatgataacattccagccactggctgctaacaagtcaccaaaagacactgcagaaaccctgagcagaaagaggccttctggatggccaaacccaagattattaaaagatgtctctgc

SEQ ID NO: 971 - DNA, 1919 bp, Homo sapiens
agcgccacctgccctccaccacctaccgcggttcctccagctcccagggccgcggccggagcagctctgagcgctcggttcgccccacggtgcccttaaaaggcgctggcgcgaaccaacgagtccctgaggagagtagggggacagctccggctcgcagctccgtgtcgtgtctctctcaaagtgtctctcggacagcgctgttgggaacgagcctggcgctttgatttagggatgggggtggtttcctcactaacgagtcaccccctccaaaatatcgcagaaagtggacggccccagttggaggcacatcttgaaacccgcgggggaggccatgtcggaagaagctaggttttgtttttctcctggtgagaattcgaagaccatgtctacggaactcttctcatccacaagagaggaaggaagctctggctcaggacccagttttaggtctaatcaaaggaaaatgttaaacctgctcctggagagagacacttcctttaccgtctgtccagatgtccctagaactccagtgggcaaatttcttggtgattctgcaaacctaagcattttgtctggaggaaccccaaaacgttgcctcgatctttcgaatcttagcagtggggagataactgccactcagcttaccacttctgcagaccttgatgaaactggtcacctggattcttcaggacttcaggaagtgcatttagctgggatgaatcatgaccagcacctaatgaaatgtagcccagcacagcttctttgtagcactccgaatggtttggaccgtggccatagaaagagagatgcaatgtgtagttcatctgcaaataaagaaaatgacaatggaaacttggtggacagtgaaatgaaatatttgggcagtcccattactactgttccaaaattggataaaaatccaaacctaggagaagaccaggcagaagagatttcagatgaattaatggagttttccctgaaagatcaagaagcaaaggtgagcagaagtggcctatatcgctccccgtcgatgccagagaacttgaacaggccaagactgaagcaggtggaaaaattcaaggacaacacaataccagataaagttaaaaaaaagtatttttctggccaaggaaagctcaggaagggcttatgtttaaagaagacagtctctctgtgtgacattactatcactcagatgctggaggaagattctaaccaggggcacctgattggtgatttttccaaggtatgtgcgctgccaaccgtgtcagggaaacaccaagatctgaagtatgtcaacccagaaacagtggctgccttactgtcggggaagttccagggtctgattgagaagttttatgtcattgattgtcgctatccatatgagtatctgggaggacacatccagggagccttaaacttatatagtcaggaagaactgtttaacttctttctgaagaagcccatcgtccctttggacacccagaagagaataatcatcgtgttccactgtgaattctcctcagagaggggcccccgaatgtgccgctgtctgcgtgaagaggacaggtctctgaaccagtatcctgcattgtactacccagagctatatatccttaaaggcggctacagagacttctttccagaatatatggaactgtgtgaaccacagagctactgccctatgcatcatcaggaccacaagactgagttgctgaggtgtcgaagccagagcaaagtgcaggaaggggagcggcagctgcgggagcagattgcccttctggtgaaggacatgagcccatgataacattccagccactggctgctaacaagtcaccaaaagacactgcagaaaccctgagcagaaagaggccttctggatggccaaacccaagattattaaaagatgtctctgc

SEQ ID NO: 972 - DNA, 2296 bp, Homo sapiens
aacgcgggaagcaggggcggggcctctggtggcggtcgggaactcggtgggaggcggcaacattgtttcaagttggccaaattgacaagagcgagaggtatactgcgttccatcccgacccggggccacggtactgggccctgtttccccctcctcggcccccgagagccagggtccgccttctgcagggttcccaggcccccgctccagggccgggctgacccgactcgctggcgcttcatggagaacttccaaaaggtggaaaagatcggagagggcacgtacggagttgtgtacaaagccagaaacaagttgacgggagaggtggtggcgcttaagaaaatccgcctggacactgagactgagggtgtgcccagtactgccatccgagagatctctctgcttaaggagcttaaccatcctaatattgtcaagctgctggatgtcattcacacagaaaataaactctacctggtttttgaatttctgcaccaagatctcaagaaattcatggatgcctctgctctcactggcattcctcttcccctcatcaagagctatctgttccagctgctccagggcctagctttctgccattctcatcgggtcctccaccgagaccttaaacctcagaatctgcttattaacacagagggggccatcaagctagcagactttggactagccagagcttttggagtccctgttcgtacttacacccatgaggtggtgaccctgtggtaccgagctcctgaaatcctcctgggctgcaaatattattccacagctgtggacatctggagcctgggctgcatctttgctgagatggtgactcgccgggccctattccctggagattctgagattgaccagctcttccggatctttcggactctggggaccccagatgaggtggtgtggccaggagttacttctatgcctgattacaagccaagtttccccaagtgggcccggcaagattttagtaaagttgtacctcccctggatgaagatggacggagcttgttatcgcaaatgctgcactacgaccctaacaagcggatttcggccaaggcagccctggctcaccctttcttccaggatgtgaccaagccagtaccccatcttcgactctgatagccttcttgaagcccccagccctaatctcaccctctcctccagtgtgggcttgaccaggcttggccttgggctatttggactcaggtgggccctctgaacttgccttaaacactcaccttctagtcttggccagccaactctgggaatacaggggtgaaaggggggaaccagtgaaaatgaaaggaagtttcagtattagatgcacttaagttagcctccaccaccctttcccccttctcttagttattgctgaagagggttggtataaaaataattttaaaaaagccttcctacacgttagatttgccgtaccaatctctgaatgccccataattattatttccagtgtttgggatgaccaggatcccaagcctcctgctgccacaatgtttataaaggccaaatgatagcgggggctaagttggtgcttttgagaaccaagtaaaacaaaaccactgggaggagtctattttaaagaattcggttgaaaaaatagatccaatcagtttataccctagttagtgttttgcctcacctaataggctgggagactgaagactcagcccgggtggggctgcagaaaaatgattggccccagtccccttgtttgtcccttctacaggcatgaggaatctgggaggccctgagacagggattgtgcttcattccaatctattgcttcaccatggccttatgaggcaggtgagagatgtttgaatttttctcttccttttagtattcttagttgttcagttgccaaggatccctgatcccattttcctctgacgtccacctcctaccccataggagttagaagttagggtttaggcatcattttgagaatgctgacactttttcagggctgtgattgagtgagggcatgggtaaaaatatttctttaaaagaaggatgaacaattatatttatatttcaggttatatccaatagtagagttggctttttttttttttttttggtcatagtgggtggatttgttgccatgtgcaccttggggttttgtaatgacagtgctaaaaaaaaaaagcattttttttttatgatttgtctctgtcacccttgtccttgagtgctcttgctattaacgttatttgtaatttagtttgtagctcattaaaaaaatgtgcctagttttata

SEQ ID NO: 973 - DNA, 1260 bp, Homo sapiens
ttgtttcaagttggccaaattgacaagagcgagaggtatactgcgttccatcccgacccggggccacggtactgggccctgtttccccctcctcggcccccgagagccagggtccgccttctgcagggttcccaggcccccgctccagggccgggctgacccgactcgctggcgcttcatggagaacttccaaaaggtggaaaagatcggagagggcacgtacggagttgtgtacaaagccagaaacaagttgacgggagaggtggtggcgcttaagaaaatccgcctggacactgagactgagggtgtgcccagtactgccatccgagagatctctctgcttaaggagcttaaccatcctaatattgtcaagctgctggatgtcattcacacagaaaataaactctacctggtttttgaatttctgcaccaagatctcaagaaattcatggatgcctctgctctcactggcattcctcttcccctcatcaagagctatctgttccagctgctccagggcctagctttctgccattctcatcgggtcctccaccgagaccttaaacctcagaatctgcttattaacacagagggggccatcaagctagcagactttggactagccagagcttttggagtccctgttcgtacttacacccatgaggtgactcgccgggccctattccctggagattctgagattgaccagctcttccggatctttcggactctggggaccccagatgaggtggtgtggccaggagttacttctatgcctgattacaagccaagtttccccaagtgggcccggcaagattttagtaaagttgtacctcccctggatgaagatggacggagcttgttatcgcaaatgctgcactacgaccctaacaagcggatttcggccaaggcagccctggctcaccctttcttccaggatgtgaccaagccagtaccccatcttcgactctgatagccttcttgaagcccccagccctaatctcaccctctcctccagtgtgggcttgaccaggcttggccttgggctatttggactcaggtgggccctctgaacttgccttaaacactcaccttctagtcttggccagccaactctgggaatacaggggtgaaaggggggaaccagtgaaaatgaaaggaagtttcagtattagatgcacttaagttagcctccaccaccctttcccccttctcttagttattgctgaagagggttggtataaaaataattttaaaaaa

SEQ ID NO: 974 - DNA, 1552 bp, Homo sapiens
gtgatagcaacagatcacgtggctgccatcgcccctccgcccccttacactcttcgccctcctcccagtcgaagcacctcctgtccgcccctcagcgcatgggtggcggtcacgtgcccagaacgtccggcgttcgccccgccctcccagtttccgcgcgcctctttggcagctggtcacatggtgagggtgggggtgagggggcctctctagcttgcggcctgtgtctatggtcgggccctctgcgtccagctgctccggaccgagctcgggtgtatggggccgtaggaaccggctccggggccccgataacgggccgcccccacagcaccccgggctggcgtgagggtctcccttgatctgagaatggctacctctcgatatgagccagtggctgaaattggtgtcggtgcctatgggacagtgtacaaggcccgtgatccccacagtggccactttgtggccctcaagagtgtgagagtccccaatggaggaggaggtggaggaggccttcccatcagcacagttcgtgaggtggctttactgaggcgactggaggcttttgagcatcccaatgttgtccggctgatggacgtctgtgccacatcccgaactgaccgggagatcaaggtaaccctggtgtttgagcatgtagaccaggacctaaggacatatctggacaaggcacccccaccaggcttgccagccgaaacgatcaaggatctgatgcgccagtttctaagaggcctagatttccttcatgccaattgcatcgttcaccgagatctgaagccagagaacattctggtgacaagtggtggaacagtcaagctggctgactttggcctggccagaatctacagctaccagatggcacttacacccgtggttgttacactctggtaccgagctcccgaagttcttctgcagtccacatatgcaacacctgtggacatgtggagtgttggctgtatctttgcagagatgtttcgtcgaaagcctctcttctgtggaaactctgaagccgaccagttgggcaaaatctttgacctgattgggctgcctccagaggatgactggcctcgagatgtatccctgccccgtggagcctttccccccagagggccccgcccagtgcagtcggtggtacctgagatggaggagtcgggagcacagctgctgctggaaatgctgacttttaacccacacaagcgaatctctgcctttcgagctctgcagcactcttatctacataaggatgaaggtaatccggagtgagcaatggagtggctgccatggaaggaagaaaagctgccatttcccttctggacactgagagggcaatctttgcctttatctctgaggctatggagggtcctcctccatctttctacagagattactttgctgccttaatgacattcccctcccacctctccttttgaggcttctccttctccttcccatttctctacactaaggggtatgttccctcttgtccctttccctacctttatatttggggtccttttttatacaggaaaaacaaaac

SEQ ID NO: 975 - DNA, 1000 bp, Homo sapiens
gtgggggtgagggggcctctctagcttgcggcctgtgtctatggtcgggccctctgcgtccagctgctccggaccgagctcgggtgtatggggccgtaggaaccggctccggggccccgataacgggccgcccccacagcaccccgggctggcgtgagggtctcccttgatctgagaatggctacctctcgatatgagccagtggctgaaattggtgtcggtgcctatgggacagtgtacaaggcccgtgatccccacagtggccactttgtggccctcaagagtgtgagagtccccaatggaggaggaggtggaggaggccttcccatcagcacagttcgtgaggtggctttactgaggcgactggaggcttttgagcatcccaatgttgtccggctgatggacgtctgtgccacatcccgaactgaccgggagatcaagagatgtttcgtcgaaagcctctcttctgtggaaactctgaagccgaccagttgggcaaaatctttgacctgattgggctgcctccagaggatgactggcctcgagatgtatccctgccccgtggagcctttccccccagagggccccgcccagtgcagtcggtggtacctgagatggaggagtcgggagcacagctgctgctggaaatgctgacttttaacccacacaagcgaatctctgcctttcgagctctgcagcactcttatctacataaggatgaaggtaatccggagtgagcaatggagtggctgccatggaaggaagaaaagctgccatttcccttctggacactgagagggcaatctttgcctttatctctgaggctatggagggtcctcctccatctttctacagagattactttgctgccttaatgacattcccctcccacctctccttttgaggcttctccttctccttcccatttctctacactaaggggtatgttccctcttgtccctttccctacctttatatttggggtccttttttatacagg

SEQ ID NO: 976 - DNA, 952 bp, Homo sapiens
gtgagggggcctctctagcttgcggcctgtgtctatggtcgggccctctgcgtccagctgctccggaccgagctcgggtgtatggggccgtaggaaccggctccggggccccgataacgggccgcccccacagcaccccgggctggcgtgagggtctcccttgatctgagaatggctacctctcgatatgagccagtggctgaaattggtgtcggtgcctatgggacagtgtacaaggcccgtgatccccacagtggccactttgtggccctcaagagtgtgagagtccccaatggaggaggaggtggaggaggccttcccatcagcacagttcgtgaggtggctttactgaggcgactggaggcttttgagcatcccaatgttgtccggatctgatgcgccagtttctaagaggcctagatttccttcatgccaattgcatcgttcaccgagatctgaagccagagaacattctggtgacaagtggtggaacagtcaagctggctgactttggcctggccagaatctacagctaccagatggcacttacacccgtggttgttacactctggtaccgagctcccgaagttcttctgcagtccacatatgcaacacctgtggacatgtggagtgttggctgtatctttgcagagatgtttcgtcgaaagcctctcttctgtggaaactctgaagccgaccagttgggcaaaatctttgacctgattgggctgcctccagaggatgactggcctcgagatgtatccctgccccgtggagcctttccccccagagggccccgcccagtgcagtcggtggtacctgagatggaggagtcgggagcacagctgctgctggaaatgctgacttttaacccacacaagcgaatctctgcctttcgagctctgcagcactcttatctacataaggatgaaggtaatccggagtgagcaat

SEQ ID NO: 977 - DNA, 769 bp, Homo sapiens
gccccaaggaagactgggagcgggggatgggatgctggtggtgttctttgcgctttttttttgggagtccctttgttgctgcaggctcataccatcctaactctgtaagcgacttttggtgataggagtctgtgattgtagggtctcccttgatctgagaatggctacctctcgatatgagccagtggctgaaattggtgtcggtgcctatgggacagtgtacaaggcccgtgatccccacagtggccactttgtggccctcaagagtgtgagagtccccaatggaggaggaggtggaggaggccttcccatcagcacagttcgtgaggtggctttactgaggcgactggaggcttttgagcatcccaatgttgtccggctgatggacgtctgtgccacatcccgaactgaccgggagatcaaggtaaccctggtgtttgagcatgtagaccaggacctaaggacatatctggacaaggcacccccaccaggcttgccagccgaaacgatcaaggatctgatgcgccagtttctaagaggcctagatttccttcatgccaattgcatcgttcaccgagatctgaagccagagaacattctggtgacaagtggtggaacagtcaagctggctgactttggcctggccagaatctacagctaccagatggcacttacacccgtggttgttacactctggtaccgagctcccgaagttcttctgcagtccacatatgcaacacctgtggacatgtggagtgttggctgtatc

SEQ ID NO: 978 - DNA, 694 bp, Homo sapiens
gggggcctctctagcttgcggcctgtgtctatggtcgggccctctgcgtccagctgctccggaccgagctcgggtgtatggggccgtaggaaccggctccggggccccgataacgggccgcccccacagcaccccgggctggcgtgaggagtctgtgattgtagggtctcccttgatctgagaatggctacctctcgatatgagccagtggctgaaattggtgtcggtgcctatgggacagtgtacaaggcccgtgatccccacagtggccactttgtggccctcaagagtgtgagagtccccaatggaggaggaggtggaggaggccttcccatcagcacagttcgtgaggtggctttactgaggcgactggaggcttttgagcatcccaatgttgtccggctgatggacgtctgtgccacatcccgaactgaccgggagatcaaggtaaccctggtgtttgagcatgtagaccaggacctaaggacatatctggacaaggcacccccaccaggcttgccagccgaaacgatcaaggatctgatgcgccagtttctaagaggcctagatttccttcatgccaattgcatcgttcaccgagatctgaagccagagaacattctggtgacaagtggtggaacagtcaagctggctgactttggcctggccagaatctacagctaccagatggcac

SEQ ID NO: 979 - DNA, 447 bp, Homo sapiens
accccattcccactccgtgtcctggggcccgcccagcctccttaggcgccgcgcctgctcgcggtctccgctgacaccccagggtctcccttgatctgagaatggctacctctcgatatgagccagtggctgaaattggtgtcggtgcctatgggacagtgtacaaggcccgtgatccccacagtggccactttgtggccctcaagagtgtgagagtccccaatggaggaggaggtggaggaggccttcccatcagcacagttcgtgaggtggctttactgaggcgactggaggcttttgagcatcccaatgttgtccggctgatggacgtctgtgccacatcccgaactgaccgggagatcaaggtaaccctggtgtttgagcatgtagaccaggacctaaggacatatctggacaaggcacccccaccaggcttgccagccgaaa

SEQ ID NO: 980 - DNA, 11612 bp, Homo sapiens
aacctctccgcgcgaagacggcttcagccctgcagggaaagaaaagtgcaatgattctggactgagacgcgcttgggcagaggctatgtaatcgtgtctgtgttgaggacttcgcttcgaggagggaagaggagggatcggctcgctcctccggcggcggcggcggcggcgactctgcaggcggagtttcgcggcggcggcaccagggttacgccagccccgcggggaggtctctccatccagcttctgcagcggcgaaagccccagcgcccgagcgcctgagccggcggggagcaagtaaagctagaccgatctccggggagccccggagtaggcgagcggcggccgccagctagttgagcgcaccccccgcccgccccagcggcgccgcggcgggcggcgtccaggcggcatggagaaggacggcctgtgccgcgctgaccagcagtacgaatgcgtggcggagatcggggagggcgcctatgggaaggtgttcaaggcccgcgacttgaagaacggaggccgtttcgtggcgttgaagcgcgtgcgggtgcagaccggcgaggagggcatgccgctctccaccatccgcgaggtggcggtgctgaggcacctggagaccttcgagcaccccaacgtggtcaggttgtttgatgtgtgcacagtgtcacgaacagacagagaaaccaaactaactttagtgtttgaacatgtcgatcaagacttgaccacttacttggataaagttccagagcctggagtgcccactgaaaccataaaggatatgatgtttcagcttctccgaggtctggactttcttcattcacaccgagtagtgcatcgcgatctaaaaccacagaacattctggtgaccagcagcggacaaataaaactcgctgacttcggccttgcccgcatctatagtttccagatggctctaacctcagtggtcgtcacgctgtggtacagagcacccgaagtcttgctccagtccagctacgccacccccgtggatctctggagtgttggctgcatatttgcagaaatgtttcgtagaaagcctctttttcgtggaagttcagatgttgatcaactaggaaaaatcttggacgtgattggactcccaggagaagaagactggcctagagatgttgcccttcccaggcaggcttttcattcaaaatctgcccaaccaattgagaagtttgtaacagatatcgatgaactaggcaaagacctacttctgaagtgtttgacatttaacccagccaaaagaatatctgcctacagtgccctgtctcacccatacttccaggacctggaaaggtgcaaagaaaacctggattcccacctgccgcccagccagaacacctcggagctgaatacagcctgaggcctcagcagccgccttaagctgatcctgcggagaacacccttggtggcttatgggtccccctcagcaagccctacagagctgtggaggattgctatctggaggccttccagctgctgtcttctggacaggctctgcttctccaaggaaaccgcctagtttactgttttgaaatcaatgcaagagtgattgcagctttatgttcatttgtttgtttgtttgtctgtttgtttcaagaacctggaaaaattccagaagaagagaagctgctgaccaattgtgctgccatttgatttttctaaccttgaatgctgccagtgtggagtgggtaatccaggcacagctgagttatgatgtaatctctctgcagctgccgggcctgatttggtacttttgagtgtgtgtgtgcatgtgtgtgtgtgtgtgtgtgtgtgtgtgtgtgtatgtgagagattctgtgatcttttaaagtgttactttttgtaaacgacaagaataattcaattttaaagactcaaggtggtcagtaaataacaggcatttgttcactgaaggtgattcaccaaaatagtcttctcaaattagaaagttaaccccatgtcctcagcatttcttttctggccaaaagcagtaaatttgctagcagtaaaagatgaagttttatacacacagcaaaaaggagaaaaaattctagtatattttaagagatgtgcatgcattctatttagtcttcagaatgctgaatttacttgttgtaagtctattttaaccttctgtatgacatcatgctttatcatttcttttggaaaatagcctgtaagctttttattacttgctataggtttagggagtgtacctcagatagattttaaaaaaaagaatagaaagcctttatttcctggtttgaaattcctttcttccctttttttgttgttgttattgttgtttgttgttgttattttgtttttgtttttaggaatttgtcagaaactctttcctgttttggtttggagagtagttctctctaactagagacaggagtggccttgaaattttcctcatctattacactgtactttctgccacacactgccttgttggcaaagtatccatcttgtctatctcccggcacttctgaaatatattgctaccattgtataactaataacagattgcttaagctgttcccatgcaccacctgtttgcttgctttcaatgaacctttcataaattcgcagtctcagcttatggtttatggcctcgattctgcaaacctaacagggtcacatatgttctctaatgcagtccttctacctggtgtttacttttgttacctaaataatgagtaggatcttgttttgttttatcaccagcacacagattgctataaactgttactttgtgaattacatttttatagaagatattttcagtgtctttacctgagggtatgtctttagctatgttttagggccatacatttactctatcaaatgatcttttctccatcccccaggctgtgcttatttctagtgccttgtgctcactcctgctctctacagagccagcctggcctgggcattgtaaacagcttttcctttttctcttactgttttctctacagtcctttatatttcataccatctctgccttataagtggtttagtgctcagttggctctagtaaccagaggacacagaaagtatcttttggaaagtttagccacctgtgctttctgactcagagtgcatgcaacagttagatcatgcaacagttagattatgtttagggttaggattttcaaagaatggaggttgctgcactcagaaaataattcagatcatgtttatgcattattaagttgtactgaattctttgcagcttaatgtgatatatgactatcttgaacaagagaaaaaactaggagatgtttctcctgaagagcttttggggttgggaactattcttttttaattgctgtactacttaacattgttctaattcagtagcttgaggaacaggaacattgttttctagagcaagataataaaggagatgggccatacaaatgttttctactttcgttgtgacaacattgattaggtgttgtcagtactataaatgcttgagatataatgaatccacagcattcaaggtcaggtctactcaaagtctcacatggaaaagtgagttctgcctttcctttgatcgagggtcaaaatacaaagacatttttgctagggcctacaaattgaatttaaaaactcactgcactgattcatctgagctttttggttagtattcatggctagagtgaacatagctttagtttttgctgttgtaaaagtgttttcataagttcactcaagaaaaatgcagctgttctgaactggaatttttcagcattctttagaattttaaatgagtagagagctcaacttttattcctagcatctgcttttgactcatttctaggcagtgcttatgaagaaaaattaaagcacaaacattctggcattcaatcgttggcagattatcttctgatgacacagaatgaaagggcatctcagcctctctgaactttgtaaaaatctgtccccagttcttccatcggtgtagttgttgcatttgagtgaatactctcttgatttatgtattttatgtccagattcgccatttctgaaatccagatccaacacaagcagtcttgccgttagggcattttgaagcagatagtagagtaagaacttagtgactacagcttattcttctgtaacatatggtttcaaacatctttgccaaaagctaagcagtggtgaactgaaaagggcatattgccccaaggttacactgaagcagctcatagcaagttaaaatattgtgacagatttgaaatcatgtttgaatttcatagtaggaccagtacaagaatgtccctgctagtttctgtttgatgtttggttctggcggctcaggcattttgggaactgttgcacagggtggagtcaaaacaacctacatataaaaagagaaaaagagaaacttgtccatttagctttcataagaaatcccatggcaaagggtaataaaaaggacctaatcttaaaaatacaatttctaagcacttgtaagaacccagtgggttggagcctcccactttgtccctcctttgaagtggatgggaactcaaggtgcaaagaacctgttttggaagaaagcttggggccatttcagccccctgtattctcatgattttctctcaggaagcacacactgtgaatggcagacttttcatttagccccaggtgacttactaaaaatagttgaaaattattcacctaagaatagaatctcagcattgtgttaaataaaaatgaaagctttagaaggcatgagatgttcctatcttaaataaagcatgtttcttttctatagagaaatgtatagtttgactctccagaatgtactatccatcttgatgagaaaactcttaaatagtaccaaacattttgaactttaaattatgtatttaaagtgagtgtttaagaaactgtagctgcttcttttacaagtggtgcctattaaagtcagtaatggccattattgttccattgtggaaattaaattatgtaagcttcctaatatcataaacatattaaaattcttctaaaatattgcttttcttttaagtgacaatttgactattcttatgataagcacatgagagtgtcttacattttccaaaagcaggctttaattgcatagttgagtctaggaaaaaataatgttaaaagtgaatatgccaccataattacttaattatgttagtatagaaactacagaatatttaccctggaaagaaaatattggaatgttattataaactcttagatatttatataattcaaaagaatgcatgtttcacattgtgacagataaagatgtatgatttctaaggctttaaaaattattcataaaacagtgggcaatagataaaggaaattctggagaaaatgaaggtatttaaagggtagtttcaaagctatatatattttgaaggatatattctttatgaacaaatatattgtaaaaatttatactaaggtcatctggtaactgtgggattaatatggtcgaaaacaaatgttatggagaagctgtcccaagcaaactaaattacctgtacttttttcccatttcaagggaagaggcaaccacatgaagcaatacttcttacacatgcctaagaacgttcattgaaaaaataaatttttaaaaggcatgtgtttcctatgccaccaatacttttgaaaaattgtgaaccttacccaaaaccatttatcatgtccattaagtatatttgggtatataattaggaagatatttacatgttccatctccacagtggaaaaacttattgaggctaccaaagtgtgccaagaaatgtaagtccttagagtaattagaaatgctgttttcctcaaaagcatgagaaactagcattttcatttcttatttactccctttctatatcaatgcaattcacaacccaattttaatacatccctatatctcaagcatttctatcttgtactttttcagaaaataaaccaaaaataatcctttggtctctctatcttctgacctttgtaagcaacagaaatgtaaaaacagaaggggtccaatttttacacgtttttttctcaagtagcctttctggggatttttattttcttaatgaagtgccaatcagcttttcaaaatgttttctatttctcagcatttccaggaagtgataacgtttagctaaatgagtagaagtggacttccttcaacatattgttaccttgtctagccttaggaagaaaacaagagccacctgaaaataaatacaggctcttttcgagcatctgctgaaatactgttacagcaatttgaagttgatgtggtaggaaaggaaggtgacttttcttgcaaaagtctttctaaacattcacactgtcctaagagatgagctttcttgttttattccggtatattccacaaggtggcacttttagagaaaaacaaatctgatgaagactaaagaggtacttctaaaagagatttcattctaactttatttttctgcgcatatttaactctttcctagcacttgttttttgggatgattaatagtctctataatgttctgtaacttcaatattttacttgttacctaggttctgaacaattgtctgcaaataaattgttcttaaggatggataatacacccattttgatcatttaagtaaagaaagcctagtcattcattcagtcaagaaaaaatttttgaagtacccagttaccttacttttctagattaaaacaggcttagttactaaaaaggcagtcctcatctgtgaacaggatagtttcgttagaagtataaaactcctttagtggccccagttaaaacacacataccctctctgctgctttcaaattccctagcatggtggcctttcaacattgattaaattttaaaatcctaatttaaagatcaggtgagcaaaatgagtagcacatcagtaattcagtagacaaaacttttgtctgaaaaattgctgtattgaaacagagccctaaaataccaaaagaccaggtaattttaacatttgtggaatcacaaatgtaaattcataagaagctctaattaaaaaaaaaaagtctgaagtatatgagcataacaacttaggagtgtgtctacatacttaacttttgaagttttttggcaactttatatactttttttaaatttacaagtctacttaaagacttcttataccccaaatgattaagttaattttagaggtcacctttctcacagcagtgtcacttgaaatttagtagggaaggatattgcagtatttttcagtttccttagcacagcaccacagaaagcagcttattccttttgagtggcagacactcgacggtgcctgcccaactttcctcctgagtggcaagcagatgagtctcagtaattcatactgaaccaaaatgccacatacactaggggcagtcagaaactggctgagaaatcccccgcctcattcgcccctctgctcccaggaactagagtccagttaaagcccctatgcgaaaggccgaattccaccccagggtttgttataacagtggccagtctgaaccccatttgctcgtgctcaaaacttgattcccacttgaaagccttccgggcgcgctgcctcgttgccccgcccctttggcaggagagaggcagtgggcgaggccgggctggggccccgcctcccactcacctgccggtgcctgaaattatgtgcggccccgcgggctgctttccgaggtcagagtgccctgctgctgtctcagaggcatctgttctgcaaatcttaggaagaaaaatgtccctagtagcaaacgggtgtcttctgtgcataaataagtacaacacaattctccgaaagttcgggtaaaaagagatgcggtagcagctgccctgtgtgaagctgtctaccccgcatctctcaggcgctaagctcagtttttgtttttgtttttgtttttttaaagaaaagatgtataattgcaggaatttttttttatttttttattttccatcattctatatatgtgatggtgaaagatatgcctggaaaagttttgttttgaaaagtttattttctgcttcgtcttcagttggcaaaagctctcaattctttagcttccagtttcttttctctctttttctttgttaggtaattaaaggtatgtaaacaaattatctcatgtagcaggggattttcatgttgagaggaatcttccgtgtgagttgtttggtcacacaaataaccctttctcaattttaggagtttggattgtcaaatgtaggtttttctcaaagggggcatataactacatattgactgccaagaactatgactgtagcactaatcagcacacatagagccacacaattatttaatttctaactctctgtggtccctagaaaaattccgttgatgtgcttaggttaaagttctgaagatacccgttgtacccttacttgaaagtttctaatcttaagttttatgaaatgcaataatatgtatcagctagcaatatttctgtgatcaccaacaactctcagtttgatcttaaagtctgaataataaaacaaatcccagcagtaatacatttcttaaacctcacagtgcatgatatatcttttcattctgatcctgtgtttgcaaaaatatacacatgtatatcatagttcctcactttttattcatttgttttcctattacctgtagtaaatatattagttagtacatggaatttatagcatcagctacccccaggaacagcacctgacaggcgggggattttttttcaagttgttctacatttgcataaattatttctattattattcatgtatgttatttatttctgaatcacactagtcctgtgaaagtacaactgaaggcagaaagtgttaggattttgcatctaatgttcattatcatggtattgatggacctaagaaaataaaaattagactaagcccccaaataagctgcatgcatttgtaacatgattagtagatttgaatatatagatgtagtattttgggtatctaggtgttttatcattatgtaaaggaattaaagtaaaggactttgtagttgtttttattaaatatgcatatagtagagtgcaaaaatatagcaaaaataaaaactaaaggtagaaaagcattttagatatgccttaatttagaaactgtgccaggtggccctcggaatagatgccaggcagagaccagtgcctgggtggtgcctcctcttgtctgccctcatgaagaagcttccctcacgtgatgtagtgccctcgtaggtgtcatgtggagtagtgggaacaggcagtactgttgagaggagagcagtgtgagagtttttctgtagaagcagaactgtcagcttgtgccttgaggcttccagaacgtgtcagatggagaagtccaagtttccatgcttcaggcaacttagctgtgtacagaagcaatccagtgtggtaataaaaagcaaggattgcctgtataatttattataaaataaaagggattttaacaaccaacaattcccaacacctcaaaagcttgttgcattttttggtatttgaggtttttatctgaaggttaaagggcaagtgtttggtatagaagagcagtatgtgttaagaaaagaaaaatattggttcacgtagagtgcaaattagaactagaaagttttatacgattatcattttgagatgtgttaaagtaggttttcactgtaaaatgtattagtgtttctgcattgccatagggcctggttaaaactttctcttaggtttcaggaagactgtcacatacagtaagcttttttccttctgacttataatagaaaatgttttgaaagtaaaaaaaaaaaatctaatttggaaatttgacttgttagtttctgtgtttgaaatcatggttctagaaatgtagaaattgtgtatatcagatactcatctaggctgtgtgaaccagcccaagatgaccaacatccccacacctctacatctctgtcccctgtatctcttcctttctaccactaaagtgttccctgctaccatcctggcttgtccacatggtgctctccatcttcctccacatcatggaccacaggtgtgcctgtctaggcctggccaccactcccaacttgacctagccacattcatctagagatggttcctgatgctgggcacagactgtgctcatggcacccattagaaatgcctctagcatctttgtatgcatcttgatttttaaaccaagtcattgtacagagcattcagttttggctgtggtaccaagagaaaaactaatcaagaatataaaccacattccaggctgctgttttctctccatctacaggccacacttttactgtatttcttcatacttgaaattcattctgctattttcatatcagggtacagacttataagggtgcatgttccttaaaggtgcataattattcttattccgtttgcttatattgctacagaatgctctgttttggtgctttgagttctgcagacccaagaagcagtgtggaaattcactgcctgggacacagtcttataagaatgttggcaggtgactttgtatcagatgttgcttctcttttctctgtacacagattgagagttaccacagtggcctgtcgggtccaccctgtgggtgcagcacagctctctgaaagcaagaaccttcctacctattctaacgtttttgccctctaagaaaaatggcctcaggtatggtatagacatagcaagaggggaagggctgtctcactctagcaaccatccctccattacacacagaaagccctcttgaagcaaaagaagaagaaagaaagaaagcttatctctaaggctactgtcttcagaatgctctgagctgaatgctcttgctcctttcccaagaggcagatgaaaatatagccagtttatctatacccttcctatctgaggaggagaatagaaaagtagggtaaatatgtaacgtaaaatatgtcattcaaggaccaccaaaactttaagtaccctatcattaaaaatctggttttaaaagtagctcaagtaagggatgctttgtgacccagggtttctgaagtcagatagccattcttacctgccccttactctgacttattgggaaagggagaactgcagtggtgtttctgttgcagtggcaaaggtaacatgtcagaaaattcagagggttgcataccaataatcctttggaaactggatgtcttactgggtgctagaatgaaaatgtaggtatttattgtcagatgatgaagttcattgtttttttcaaaattggtgttgaaatatcactgtccaatgtgttcacttatgtgaaagctaaattgaatgaggcaaaaagagcaaatagtttgtatatttgtaataccttttgtatttcttacaataaaaatattggtagcaaataaaaataataaaaacaataactttaaactgctttctggagatgaattactctcctggctattttcttttttactttaatgtaaaatgagtataactgtagtgagtaaaattcattaaattccaagttttagcagaa

SEQ ID NO: 981 - DNA, 1465 bp, Homo sapiens
gctggtaactccttccccagagtctgattacctgctccgcgaggccgcggacacgtgcggagagccgactgacactcgcagccccctcgggaggcccgacgcgactgggcccctcaggtgcaatgattctggactgagacgcgcttgggcagaggctatgtaatcgtgtctgtgttgaggacttcgcttcgaggagggaagaggagggatcggctcgctcctccggcggcggcggcggcggcgactctgcaggcggagtttcgcggcggcggcaccagggttacgccagccccgcggggaggtctctccatccagcttctgcagcggcgaaagccccagcgcccgagcgcctgagccggcggggagcaagtaaagctagaccgatctccggggagccccggagtaggcgagcggcggccgccagctagttgagcgcaccccccgcccgccccagcggcgccgcggcgggcggcgtccaggcggcatggagaaggacggcctgtgccgcgctgaccagcagtacgaatgcgtggcggagatcggggagggcgcctatgggaaggtgttcaaggcccgcgacttgaagaacggaggccgtttcgtggcgttgaagcgcgtgcgggtgcagaccggcgaggagggcatgccgctctccaccatccgcgaggtggcggtgctgaggcacctggagaccttcgagcaccccaacgtggtcaggttgtttgatgtgtgcacagtgtcacgaacagacagagaaaccaaactaactttagtgtttgaacatgtcgatcaagacttgaccacttacttggataaagttccagagcctggagtgcccactgaaaccataaaggatatgatgtttcagcttctccgaggtctggactttcttcattcacaccgagtagtgcatcgcgatctaaaaccacagaacattctggtgaccagcagcggacaaataaaactcgctgacttcggccttgcccgcatctatagtttccagatggctctaacctcagtggtcgtcacgctgtggtacagagcacccgaagtcttgctccagtccagctacgccacccccgtggatctctggagtgttggctgcatatttgcagaaatgtttcgtagaaagcctctttttcgtggaagttcagatgttgatcaactaggaaaaatcttggacgtgattggactcccaggagaagaagactggcctagagatgttgcccttcccaggcaggcttttcattcaaaatctgcccaaccaattgagaagtttgtaacagatatcgatgaactaggcaaagacctacttctgaagtgtttgacatttaacccagccaaaagaatatctgcctacagtgccctgtctcacccatacttccaggacctggaaaggtgcaaagaaaacctggattcccacctgccgcccagccagaacacctcggagctgaatacagcctga

SEQ ID NO: 982 - DNA, 1713 bp, Homo sapiens
gccgaggtgctcggtggagtcatggcagtgccctttgtggaagactgggacttggtgcaaaccctgggagaaggtgcctatggagaagttcaacttgctgtgaatagagtaactgaagaagcagtcgcagtgaagattgtagatatgaagcgtgccgtagactgtccagaaaatattaagaaagagatctgtatcaataaaatgctaaatcatgaaaatgtagtaaaattctatggtcacaggagagaaggcaatatccaatatttatttctggagtactgtagtggaggagagctttttgacagaatagagccagacataggcatgcctgaaccagatgctcagagattcttccatcaactcatggcaggggtggtttatctgcatggtattggaataactcacagggatattaaaccagaaaatcttctgttggatgaaagggataacctcaaaatctcagactttggcttggcaacagtatttcggtataataatcgtgagcgtttgttgaacaagatgtgtggtactttaccatatgttgctccagaacttctgaagagaagagaatttcatgcagaaccagttgatgtttggtcctgtggaatagtacttactgcaatgctcgctggagaattgccatgggaccaacccagtgacagctgtcaggagtattctgactggaaagaaaaaaaaacatacctcaacccttggaaaaaaatcgattctgctcctctagctctgctgcataaaatcttagttgagaatccatcagcaagaattaccattccagacatcaaaaaagatagatggtacaacaaacccctcaagaaaggggcaaaaaggccccgagtcacttcaggtggtgtgtcagagtctcccagtggattttctaagcacattcaatccaatttggacttctctccagtaaacagtgcttctagtgaagaaaatgtgaagtactccagttctcagccagaaccccgcacaggtctttccttatgggataccagcccctcatacattgataaattggtacaagggatcagcttttcccagcccacatgtcctgatcatatgcttttgaatagtcagttacttggcaccccaggatcctcacaggttactatatcaacaactgataggagaaacaataaactcattttcaaagtgaatttgttagaaatggatgataaaatattggttgacttccggctttctaagggtgatggattggagttcaagagacacttcctgaagattaaagggaagctgattgatattgtgagcagccagaagatttggcttcctgccacatgatcggaccatcggctctggggaatcctggtgaatatagtgctgctatgttgacattattcttcctagagaagattatcctgtcctgcaaactgcaaatagtagttcctgaagtgttcacttccctgtttatccaaacatcttccaatttattttgtttgttcggcatacaaataatacctatatcttaattgtaagcaaaactttggggaaaggatgaatagaattcatttgattatttcttcatgtgtgtttagtatctgaatttgaaactcatctggtggaaaccaagtttcaggggacatgagttttccagcttttatacacacgtatctcatttttatcaaaacattttgtttaattcaaaaagtacatattccatgttgatttaattct

SEQ ID NO: 983 - DNA, 1845 bp, Homo sapiens
gcatttggattcctgcagtggtgggcaaaggacagtccgccgaggtgctcggtggagtcatggcagtgccctttgtggaagactgggacttggtgcaaaccctgggagaaggtgcctatggagaagttcaacttgctgtgaatagagtaactgaagaagcagtcgcagtgaagattgtagatatgaagcgtgccgtagactgtccagaaaatattaagaaagagatctgtatcaataaaatgctaaatcatgaaaatgtagtaaaattctatggtcacaggagagaaggcaatatccaatatttatttctggagtactgtagtggaggagagctttttgacagaatagagccagacataggcatgcctgaaccagatgctcagagattcttccatcaactcatggcaggggtggtttatctgcatggtattggaataactcacagggatattaaaccagaaaatcttctgttggatgaaagggataacctcaaaatctcagactttggcttggcaacagtatttcggtataataatcgtgagcgtttgttgaacaagatgtgtggtactttaccatatgttgctccagaacttctgaagagaagagaatttcatgcagaaccagttgatgtttggtcctgtggaatagtacttactgcaatgctcgctggagaattgccatgggaccaacccagtgacagctgtcaggagtattctgactggaaagaaaaaaaaacatacctcaacccttggaaaaaaatcgattctgctcctctagctctgctgcataaaatcttagttgagaatccatcagcaagaattaccattccagacatcaaaaaagatagatggtacaacaaacccctcaagaaaggggcaaaaaggccccgagtcacttcaggtggtgtgtcagagtctcccagtggattttctaagcacattcaatccaatttggacttctctccagtaaacagtgcttctagtgaagaaaatgtgaagtactccagttctcagccagaaccccgcacaggtctttccttatgggataccagcccctcatacattgataaattggtacaagggatcagcttttcccagcccacatgtcctgatcatatgcttttgaatagtcagttacttggcaccccaggatcctcacagaacccctggcagcggttggtcaaaagaatgacacgattctttaccaaattggatgcagacaaatcttatcaatgcctgaaagagacttgtgagaagttgggctatcaatggaagaaaagttgtatgaatcaggttactatatcaacaactgataggagaaacaataaactcattttcaaagtgaatttgttagaaatggatgataaaatattggttgacttccggctttctaagggtgatggattggagttcaagagacacttcctgaagattaaagggaagctgattgatattgtgagcagccagaagatttggcttcctgccacatgatcggaccatcggctctggggaatcctgatggagtttcactcttgtctcccaggctggagtacaatggcatgatctcagcttactgcaacctccgtctcctgggttcaagcgattctcctgcctcagccttccaagtagctgggattacaggtgcccaccaccacacctggctaggttttgtatttttagtagagatggggttttttcatgttggccaggctgatctggaactcctgacctcaagtgatccacctgccttggcctcccaaagtgctgggattttaggtgtgagccacctcgcctggcaagggattctgttcttagtccttgaaaaaataaagttctgaatcttcaa

SEQ ID NO: 984 - DNA, 2748 bp, Homo sapiens
aaatttgcgttgtaagatttattttggctctccccgcctgttctttgcacattaaaaatgaaaaagtttgtagaactaagctaagcagatggtcttcctgcaaaaagaccgggctgaagtaaagcattgttttggagctggttcacagaaaaaaggcaaaactggttatcctgacttcaagctccaacataaactgctcgctttctccgggaaacttgccccgccacacacacttgactgcgtggccagttctttcgaagcctctcgctcccaacacggagttcctcccatttcttcacagtcggctctcagcagctgctgctggtttctcggctccagcaccacgagtaccgcactctgaggtttacaaagcactctgcttcaccgactgtgatcctcacagtcctgtccggtggcctcacgcaggtggcggtgcagcctttcaggcccagagcggccaggagcgaagcccgcagccccgcctggaagcgcagcgcggtcggtcgcgcgcccctgaggcttggaggcctgggcttcccccagcagcgctcgagcaccgcccagtcgagcctcacaccggatgccacttcatatttgggcccagagctcaattcgcgccgatgcggtccgccgtccttaaatctcttcagccaggatctctccccgactgcaaagcagccctgggcgggagcggcaacatctccacgtcacccttttggagccgccgacattcagaggggcaggacacgggaacgcgcgctgtcttgctttacggcgcgggtgcgcgagtttgcggcagcgtgacgccctcaagttttggcgggaaaagcgctgcatttggattcctgcagtggtgggcaaaggacagtccgccgaggtgctcggtggagtcatggcagtgccctttgtggaagactgggacttggtgcaaaccctgggagaaggtgcctatggagaagttcaacttgctgtgaatagagtaactgaagaagcagtcgcagtgaagattgtagatatgaagcgtgccgtagactgtccagaaaatattaagaaagagatctgtatcaataaaatgctaaatcatgaaaatgtagtaaaattctatggtcacaggagagaaggcaatatccaatatttatttctggagtactgtagtggaggagagctttttgacagaatagagccagacataggcatgcctgaaccagatgctcagagattcttccatcaactcatggcaggggtggtttatctgcatggtattggaataactcacagggatattaaaccagaaaatcttctgttggatgaaagggataacctcaaaatctcagactttggcttggcaacagtatttcggtataataatcgtgagcgtttgttgaacaagatgtgtggtactttaccatatgttgctccagaacttctgaagagaagagaatttcatgcagaaccagttgatgtttggtcctgtggaatagtacttactgcaatgctcgctggagaattgccatgggaccaacccagtgacagctgtcaggagtattctgactggaaagaaaaaaaaacatacctcaacccttggaaaaaaatcgattctgctcctctagctctgctgcataaaatcttagttgagaatccatcagcaagaattaccattccagacatcaaaaaagatagatggtacaacaaacccctcaagaaaggggcaaaaaggccccgagtcacttcaggtggtgtgtcagagtctcccagtggattttctaagcacattcaatccaatttggacttctctccagtaaacagtgcttctagtgaagaaaatgtgaagtactccagttctcagccagaaccccgcacaggtctttccttatgggataccagcccctcatacattgataaattggtacaagggatcagcttttcccagcccacatgtcctgatcatatgcttttgaatagtcagttacttggcaccccaggatcctcacagaacccctggcagcggttggtcaaaagaatgacacgattctttaccaaattggatgcagacaaatcttatcaatgcctgaaagagacttgtgagaagttgggctatcaatggaagaaaagttgtatgaatcaggttactatatcaacaactgataggagaaacaataaactcattttcaaagtgaatttgttagaaatggatgataaaatattggttgacttccggctttctaagggtgatggattggagttcaagagacacttcctgaagattaaagggaagctgattgatattgtgagcagccagaagatttggcttcctgccacatgatcggaccatcggctctggggaatcctggtgaatatagtgctgctatgttgacattattcttcctagagaagattatcctgtcctgcaaactgcaaatagtagttcctgaagtgttcacttccctgtttatccaaacatcttccaatttattttgtttgttcggcatacaaataatacctatatcttaattgtaagcaaaactttggggaaaggatgaatagaattcatttgattatttcttcatgtgtgtttagtatctgaatttgaaactcatctggtggaaaccaagtttcaggggacatgagttttccagcttttatacacacgtatctcatttttatcaaaacattttgtttaattcaaaaagtacatattccatgttgatttaattctaagatgaaccaataaagacataattcttgtga

SEQ ID NO: 985 - DNA, 1799 bp, Homo sapiens
gatttacacgacaaaatggtcaggtttagaatagttgttcgtggttgaaagacttggataaatgtggatgagatagaaggggaaggcaagagctgttaattttcgtgggcaatcctggggagaggcggggctcagtggcttcactggtgatcttacactctacatcttttctggattcctgccttttacagccgaggtgctcggtggagtcatggcagtgccctttgtggaagactgggacttggtgcaaaccctgggagaaggtgcctatggagaagttcaacttgctgtgaatagagtaactgaagaagcagtcgcagtgaagattgtagatatgaagcgtgccgtagactgtccagaaaatattaagaaagagatctgtatcaataaaatgctaaatcatgaaaatgtagtaaaattctatggtcacaggagagaaggcaatatccaatatttatttctggagtactgtagtggaggagagctttttgacagaatagagccagacataggcatgcctgaaccagatgctcagagattcttccatcaactcatggcaggggtggtttatctgcatggtattggaataactcacagggatattaaaccagaaaatcttctgttggatgaaagggataacctcaaaatctcagactttggcttggcaacagtatttcggtataataatcgtgagcgtttgttgaacaagatgtgtggtactttaccatatgttgctccagaacttctgaagagaagagaatttcatgcagaaccagttgatgtttggtcctgtggaatagtacttactgcaatgctcgctggagaattgccatgggaccaacccagtgacagctgtcaggagtattctgactggaaagaaaaaaaaacatacctcaacccttggaaaaaaatcgattctgctcctctagctctgctgcataaaatcttagttgagaatccatcagcaagaattaccattccagacatcaaaaaagatagatggtacaacaaacccctcaagaaaggggcaaaaaggccccgagtcacttcaggtggtgtgtcagagtctcccagtggattttctaagcacattcaatccaatttggacttctctccagtaaacagtgcttctagtgaagaaaatgtgaagtactccagttctcagccagaaccccgcacaggtctttccttatgggataccagcccctcatacattgataaattggtacaagggatcagcttttcccagcccacatgtcctgatcatatgcttttgaatagtcagttacttggcaccccaggatcctcacagaacccctggcagcggttggtcaaaagaatgacacgattctttaccaaattggatgcagacaaatcttatcaatgcctgaaagagacttgtgagaagttgggctatcaatggaagaaaagttgtatgaatcaggttactatatcaacaactgataggagaaacaataaactcattttcaaagtgaatttgttagaaatggatgataaaatattggttgacttccggctttctaagggtgatggattggagttcaagagacacttcctgaagattaaagggaagctgattgatattgtgagcagccagaagatttggcttcctgccacatgatcggaccatcggctctggggaatcctggttgaggccttggctcctgcctgtagtcccagctacttaggaggctgagagaggaggatcgcgtgaacctggaagtttgaggctgtagtgagctatgattgcaccagtgcactccagcttggatgacaga

SEQ ID NO: 986 - DNA, 769 bp, Homo sapiens
aggcctgggcttcccccagcagcgctcgagcaccgcccagtcgagcctcacaccggatgccacttcatatttgggcccagagctcaattcgcgccgatgcggtccgccgtccttaaatctcttcagccaggatctctccccgactgcaaagcagccctgggcgggagcggcaacatctccacgtcacccttttggagccgccgacattcagaggggcaggacacgggaacgcgcgctgtcttgctttacggcgcgggtgcgcgagtttgcggcagcgtgacgccctcaagttttggcgggaaaagcgctgcatttggattcctgcagtggtgggcaaaggacagtccgccgaggtgctcggtggagtcatggcagtgccctttgtggaagactgggacttggtgcaaaccctgggagaaggtgcctatggagaagttcaacttgctgtgaatagagtaactgaagaagcagtcgcagtgaagattgtagatatgaagcgtgccgtagactgtccagaaaatattaagaaagagatctgtatcaataaaatgctaaatcatgaaaatgtagtaaaattctatggtcacaggagagaaggcaatatccaatatttatttctggagtactgtagtggaggagagctttttgacagaatagagccagacataggcatgcctgaaccagatgctcagagattcttccatcaactcatggcaggggtggtttatctgcatggtattggaataactcacagggatattaaaccaga

SEQ ID NO: 987 - DNA, 562 bp, Homo sapiens
acagtccggtgaggaagggcggccggtagaccgaggtgctcggtggagtcatggcagtgccctttgtggaagactgggacttggtgcaaaccctgggagaaggtgcctatggagaagttcaacttgctgtgaatagagtaactgaagaagcagtcgcagtgaagattgtagatatgaagcgtgccgtagactgtccagaaaatattaagaaagagatctgtatcaataaaatgctaaatcatgaaaatgtagtaaaattctatggtcacaggagagaaggcaatatccaatatttatttctggagtactgtagtggaggagagctttttgacagaatagagccagacataggcatgcctgaaccagatgctcagagattcttccatcaactcatggcaggggtggtttatctgcatggtattggaataactcacagggatattaaaccagaaaatcttctgttggatgaaagggataacctcaaaatctcagactttggcttggcaacagtatttcggtataataatcgtgagcgtttgttgaacaagatgtgtggtacttt

SEQ ID NO: 988 - DNA, 661 bp, Homo sapiens
aggacagtccggtgaggaagggcggccgccgaggtgctcggtggagtcatggcagtgccctttgtggaagactgggacttggtgcaaaccctgggagaaggtgcctatggagaagttcaacttgctgtgaatagagtaactgaagaagcagtcgcagtgaagattgtagatatgaagcgtgccgtagactgtccagaaaatattaagaaagagatctgtatcaataaaatgctaaatcatgaaaatgtagtaaaattctatggtcacaggagagaaggcaatatccaatatttatttctggagtactgtagtggaggagagctttttgacagaatagagccagacataggcatgcctgaaccagatgctcagagattcttccatcaactcatggcaggggtggtttatctgcatggtattggaataactcacagggatattaaaccagaaaatcttctgttggatgaaagggataacctcaaaatctcagactttggcttggcaacagtatttcggtataataatcgtgagcgtttgttgaacaagatgtgtggtactttaccatatgttgctccagaacttctgaagagaagagaatttcatgcagaaccagttgatgtttggtcctgtggaatagtacttactgcaatgctcgctggag

SEQ ID NO: 989 - DNA, 3502 bp, Homo sapiens
gcaattgggaggaggcgctgccgcaggcgttttctgccccataccgctccctatatcctcttcctctcttccccagacccccacctctccctcctccttccccagtcgttcgccggaaagcatttgtctcccacctcttcataacaacaattaatttcctctggggcctgaggagggcagaatttcaaccttcggtgtgcttgggagtggcgattgtgatttacacgacaaaatgccgaggtgctcggtggagtcatggcagtgccctttgtggaagactgggacttggtgcaaaccctgggagaaggtgcctatggagaagttcaacttgctgtgaatagagtaactgaagaagcagtcgcagtgaagattgtagatatgaagcgtgccgtagactgtccagaaaatattaagaaagagatctgtatcaataaaatgctaaatcatgaaaatgtagtaaaattctatggtcacaggagagaaggcaatatccaatatttatttctggagtactgtagtggaggagagctttttgacagaatagagccagacataggcatgcctgaaccagatgctcagagattcttccatcaactcatggcaggggtggtttatctgcatggtattggaataactcacagggatattaaaccagaaaatcttctgttggatgaaagggataacctcaaaatctcagactttggcttggcaacagtatttcggtataataatcgtgagcgtttgttgaacaagatgtgtggtactttaccatatgttgctccagaacttctgaagagaagagaatttcatgcagaaccagttgatgtttggtcctgtggaatagtacttactgcaatgctcgctggagaattgccatgggaccaacccagtgacagctgtcaggagtattctgactggaaagaaaaaaaaacatacctcaacccttggaaaaaaatcgattctgctcctctagctctgctgcataaaatcttagttgagaatccatcagcaagaattaccattccagacatcaaaaaagatagatggtacaacaaacccctcaagaaaggggcaaaaaggccccgagtcacttcaggtggtgtgtcagagtctcccagtggattttctaagcacattcaatccaatttggacttctctccagtaaacagtgcttctagtgaagaaaatgtgaagtactccagttctcagccagaaccccgcacaggtctttccttatgggataccagcccctcatacattgataaattggtacaagggatcagcttttcccagcccacatgtcctgatcatatgcttttgaatagtcagttacttggcaccccaggatcctcacagaacccctggcagcggttggtcaaaagaatgacacgattctttaccaaattggatgcagacaaatcttatcaatgcctgaaagagacttgtgagaagttgggctatcaatggaagaaaagttgtatgaatcaggttactatatcaacaactgataggagaaacaataaactcattttcaaagtgaatttgttagaaatggatgataaaatattggttgacttccggctttctaagggtgatggattggagttcaagagacacttcctgaagattaaagggaagctgattgatattgtgagcagccagaagatttggcttcctgccacatgatcggaccatcggctctggggaatcctggtgaatatagtgctgctatgttgacattattcttcctagagaagattatcctgtcctgcaaactgcaaatagtagttcctgaagtgttcacttccctgtttatccaaacatcttccaatttattttgtttgttcggcatacaaataatacctatatcttaattgtaagcaaaactttggggaaaggatgaatagaattcatttgattatttcttcatgtgtgtttagtatctgaatttgaaactcatctggtggaaaccaagtttcaggggacatgagttttccagcttttatacacacgtatctcatttttatcaaaacattttgtttaattcaaaaagtacatattccatgttgatttaattctaagatgaaccaataaagacataattcttgtgacttttggacagtagatttatcagtctgtgaagcgaagccagcttcaaaacatatccccaagatttgtacttatattttcaaaagggcctggccagttatataaacctgtttttgaattataatgattaattaaaattgcaagtaggtgttttttccagtgtagttagtaaaatacttgtattttacagtgttgcataaactctagtgcttaactaactttactctaaaaattactgttgaacatcttaaatatttttctatattttctactttcatagccatattttaaccttttcaacttactggtgaccaagcttttaggtgataaagaataaaagagggaagggaagagtaaggaagctataagaaaaatagatctgattctttgttcctttacctgttagacttacaaaaagtttgtttttctaataaaatttgtatcaactttggggcatattaggttgaggccttggctcctgcctgtagtcccagctacttaggaggctgagagaggaggatcgcgtgaacctggaagtttgaggctgtagtgagctatgattgcaccagtgcactccagcttggatgacagagtaagaccctacctctaataaaaatttttaaaattgtaaaacattataaaattaatcagttattttaatctgaagccaagaacatgtagaatgttatgattagagtttatcacatattaatgtatactggcaaattgtgttactggagtatacccataggaggaataaattcaaacctgttttatttatttgaacctatttacggtatgcttaagaattgaatcagtataaattctcaaatatgggagaaattttgttcttgagaattatctgagtcattaatatttttcaaaaacagctctcactgacttgaacctcttctgtaagctctaaccttttacctgctttacatttccacttgaatgtctagtaggcatctcttgaccaaaaacagcttttgattcctgttctccaacctgttcctctcctagttttctccatctcagaaatgttacttcctctgcaaagtctttccctgacttatctaaaataataacctcctctgtttgctgtgggaatttgtatagaatggtgggaaaatttcaagtttcatatttggattagctctgacatttatttatctgaacactggtaattgcctcagtaaagacactgataataagtaccttttagagttattttaatctttaatgctttaatgtgtaggaagagtatagtgtcctgttttgcacagaaaggcattctgtaaataataagttgccttaattttcctgtaatgttcattatattgttgtgggaaggtatttactcctattattaaaaataaaaatgtgtaaaatt

SEQ ID NO: 990 - DNA, 583 bp, Homo sapiens
agtccggtgaggaagggcggccgacccccacctctccctcctccttccccagtcgttcgccggaaagcatttgtctcccacctcttcataacaacaattaatttcctctggggcctgaggagggcagaatttcaaccttcggtgtgcttgggagtggcgattgtgatttacacgacaaaatgccgaggtgctcggtggagtcatggcagtgccctttgtggaagactgggacttggtgcaaaccctgggagaaggtgcctatggagaagttcaacttgctgtgaatagagtaactgaagaagcagtcgcagtgaagattgtagatatgaagcgtgccgtagactgtccagaaaatattaagaaagagatctgtatcaataaaatgctaaatcatgaaaatgtagtaaaattctatggtcacaggagagaaggcaatatccaatatttatttctggagtactgtagtggaggagagctttttgacagaatagagccagacataggcatgcctgaaccagatgctcagagattcttccatcaactcatggcaggggtggtttatctgcatggtattggaataact

SEQ ID NO: 991 - DNA, 1568 bp, Homo sapiens
ggattcctgcagtggtgggcaaaggacagtccgccgaggtgctcggtggagtcatggcagtgccctttgtggaagactgggacttggtgcaaaccctgggagaaggtgcctatggagaagttcaacttgctgtgaatagagtaactgaagaagcagtcgcagtgaagattgtagatatgaagcgtgccgtagactgtccagaaaatattaagaaagagatctgtatcaataaaatgctaaatcatgaaaatgtagtaaaattctatggtcacaggagagaaggcaatatccaatatttatttctggagtactgtagtggaggagagctttttgacagaatagagccagacataggcatgcctgaaccagatgctcagagattcttccatcaactcatggcaggggtggtttatctgcatggtattggaataactcacagggatattaaaccagaaaatcttctgttggatgaaagggataacctcaaaatctcagactttggcttggcaacagtatttcggtataataatcgtgagcgtttgttgaacaagatgtgtggtactttaccatatgttgctccagaacttctgaagagaagagaatttcatgcagaaccagttgatgtttggtcctgtggaatagtacttactgcaatgctcgctggagaattgccatgggaccaacccagtgacagctgtcaggagtattctgactggaaagaaaaaaaaacatacctcaacccttggaaaaaaatcgattctgctcctctagctctgctgcataaaatcttagttgagaatccatcagcaagaattaccattccagacatcaaaaaagatagatggtacaacaaacccctcaagaaaggggcaaaaaggccccgagtcacttcaggtggtgtgtcagagtctcccagtggattttctaagcacattcaatccaatttggacttctctccagtaaacagtgcttctagtgaagaaaatgtgaagtactccagttctcagccagaaccccgcacaggtctttccttatgggataccagcccctcatacattgataaattggtacaagggatcagcttttcccagcccacatgtcctgatcatatgcttttgaatagtcagttacttggcaccccaggatcctcacagaacccctggcagcggttggtcaaaagaatgacacgattctttaccaaattggatgcagacaaatcttatcaatgcctgaaagagacttgtgagaagttgggctatcaatggaagaaaagttgtatgaatcagggtgatggattggagttcaagagacacttcctgaagattaaagggaagctgattgatattgtgagcagccagaagatttggcttcctgccacatgatcggaccatcggctctggggaatcctggtgaatatagtgctgctatgttgacattattcttcctagagaagattatcctgtcctgcaaactgcaaatagtagttcctgaagtgttcacttccctgtttatccaaacatcttccaatttattttgtttgttcggcatacaaataatacctatatctt

SEQ ID NO: 992 - DNA, 1867 bp, Homo sapiens
gtttgtatctgcaggtttagcgccactctgctggctgaggctgcggagagtgtgcggctccaggtgggctcacgcggtcgtgatgtctcgggagtcggatgttgaggctcagcagtctcatggcagcagtgcctgttcacagccccatggcagcgttacccagtcccaaggctcctcctcacagtcccagggcatatccagctcctctaccagcacgatgccaaactccagccagtcctctcactccagctctgggacactgagctccttagagacagtgtccactcaggaactctattctattcctgaggaccaagaacctgaggaccaagaacctgaggagcctacccctgccccctgggctcgattatgggcccttcaggatggatttgccaatcttgaatgtgtgaatgacaactactggtttgggagggacaaaagctgtgaatattgctttgatgaaccactgctgaaaagaacagataaataccgaacatacagcaagaaacactttcggattttcagggaagtgggtcctaaaaactcttacattgcatacatagaagatcacagtggcaatggaacctttgtaaatacagagcttgtagggaaaggaaaacgccgtcctttgaataacaattctgaaattgcactgtcactaagcagaaataaagtttttgtcttttttgatctgactgtagatgatcagtcagtttatcctaaggcattaagagatgaatacatcatgtcaaaaactcttggaagtggtgcctgtggagaggtaaagctggctttcgagaggaaaacatgtaagaaagtagccataaagatcatcagcaaaaggaagtttgctattggttcagcaagagaggcagacccagctctcaatgttgaaacagaaatagaaattttgaaaaagctaaatcatccttgcatcatcaagattaaaaacttttttgatgcagaagattattatattgttttggaattgatggaagggggagagctgtttgacaaagtggtggggaataaacgcctgaaagaagctacctgcaagctctatttttaccagatgctcttggctgtgcagtaccttcatgaaaacggtattatacaccgtgacttaaagccagagaatgttttactgtcatctcaagaagaggactgtcttataaagattactgattttgggcactccaagattttgggagagacctctctcatgagaaccttatgtggaacccccacctacttggcgcctgaagttcttgtttctgttgggactgctgggtataaccgtgctgtggactgctggagtttaggagttattctttttatctgccttagtgggtatccacctttctctgagcataggactcaagtgtcactgaaggatcagatcaccagtggaaaatacaacttcattcctgaagtctgggcagaagtctcagagaaagctctggaccttgtcaagaagttgttggtagtggatccaaaggcacgttttacgacagaagaagccttaagacacccgtggcttcaggatgaagacatgaagagaaagtttcaagatcttctgtctgaggaaaatgaatccacagctctaccccaggttctagcccagccttctactagtcgaaagcggccccgtgaaggggaagccgagggtgccgagaccacaaagcgcccagctgtgtgtgctgctgtgttgtgaactccgtggtttgaacacgaaagaaatgtaccttctttcactctgtcatctttcttttctttgagtctgtttttttatagtttgtattttaattatgggaataattgctttttcacagtcactgatgtacaattaaaaacctgatggaacctg

SEQ ID NO: 993 - DNA, 1771 bp, Homo sapiens
gcaggtttagcgccactctgctggctgaggctgcggagagtgtgcggctccaggtgggctcacgcggtcgtgatgtctcgggagtcggatgttgaggctcagcagtctcatggcagcagtgcctgttcacagccccatggcagcgttacccagtcccaaggctcctcctcacagtcccagggcatatccagctcctctaccagcacgatgccaaactccagccagtcctctcactccagctctgggacactgagctccttagagacagtgtccactcaggaactctattctattcctgaggaccaagaacctgaggaccaagaacctgaggagcctacccctgccccctgggctcgattatgggcccttcaggatggatttgccaatcttgaatgtgtgaatgacaactactggtttgggagggacaaaagctgtgaatattgctttgatgaaccactgctgaaaagaacagataaataccgaacatacagcaagaaacactttcggattttcagggaagtgggtcctaaaaactcttacattgcatacatagaagatcacagtggcaatggaacctttgtaaatacagagcttgtagggaaaggaaaacgccgtcctttgaataacaattctgaaattgcactgtcactaagcagaaataaagtttttgtcttttttgatctgactgtagatgatcagtcagtttatcctaaggcattaagagatgaatacatcatgtcaaaaactcttggaagtggtgcctgtggagaggtaaagctggctttcgagaggaaaacatgtaagaaagtagccataaagatcatcagcaaaaggaagtttgctattggttcagcaagagaggcagacccagctctcaatgttgaaacagaaatagaaattttgaaaaagctaaatcatccttgcatcatcaagattaaaaacttttttgatgcagaagattattatattgttttggaattgatggaagggggagagctgtttgacaaagtggtggggaataaacgcctgaaagaagctacctgcaagctctatttttaccagatgctcttggctgtgcagattactgattttgggcactccaagattttgggagagacctctctcatgagaaccttatgtggaacccccacctacttggcgcctgaagttcttgtttctgttgggactgctgggtataaccgtgctgtggactgctggagtttaggagttattctttttatctgccttagtgggtatccacctttctctgagcataggactcaagtgtcactgaaggatcagatcaccagtggaaaatacaacttcattcctgaagtctgggcagaagtctcagagaaagctctggaccttgtcaagaagttgttggtagtggatccaaaggcacgttttacgacagaagaagccttaagacacccgtggcttcaggatgaagacatgaagagaaagtttcaagatcttctgtctgaggaaaatgaatccacagctctaccccaggttctagcccagccttctactagtcgaaagcggccccgtgaaggggaagccgagggtgccgagaccacaaagcgcccagctgtgtgtgctgctgtgttgtgaactccgtggtttgaacacgaaagaaatgtaccttctttcactctgtcatctttcttttctttgagtctgtttttttatagtttgtattttaattatgggaataattgctttttcacagtcactgatgtacaattaaaaacctgatggaacctgg

SEQ ID NO: 994 - DNA, 835 bp, Homo sapiens
atgtctcgggagtcggatgttgaggctcagcagtctcatggcagcagtgcctgttcacagccccatggcagcgttacccagtcccaaggctcctcctcacagtcccagggcatatccagctcctctaccagcacgatgccaaactccagccagtcctctcactccagctctgggacactgagctccttagagacagtgtccactcaggaactctattctattcctcctgaagttcttgtttctgttgggactgctgggtataaccgtgctgtggactgctggagtttaggagttattctttttatctgccttagtgggtatccacctttctctgagcataggactcaagtgtcactgaaggatcagatcaccagtggaaaatacaacttcattcctgaagtctgggcagaagtctcagagaaagctctggaccttgtcaagaagttgttggtagtggatccaaaggcacgttttacgacagaagaagccttaagacacccgtggcttcaggatgaagacatgaagagaaagtttcaagatcttctgtctgaggaaaatgaatccacagctctaccccaggttctagcccagccttctactagtcgaaagcggccccgtgaaggggaagccgagggtgccgagaccacaaagcgcccagctgtgtgtgctgctgtgttgtgaactccgtggtttgaacacgaaagaaatgtaccttctttcactctgtcatctttcttttctttgagtctgtttttttatagtttgtattttaattatgggaataattgctttttcacagtcactgatgtacaattaaaaacctgatggaacctgg

SEQ ID NO: 995 - DNA, 718 bp, Homo sapiens
gcaggtttagcgccactctgctggctgaggctgcggagagtgtgcggctccaggtgggctcacgcggtcgtgatgtctcgggagtcggatgttgaggctcagcagtctcatggcagcagtgcctgttcacagccccatggcagcgttacccagtcccaaggctcctcctcacagtcccagggcatatccagctcctctaccagcacgatgccaaactccagccagtcctctcactccagctctgggacactgagctccttagagacagtgtccactcaggaactctattctattcctgaggaccaagaacctgaggaccaagaacctgaggagcctacccctgccccctgggctcgattatgggcccttcaggatggatttgccaatcttggagatgaagacatgaagagaaagtttcaagatcttctgtctgaggaaaatgaatccacagctctaccccaggttctagcccagccttctactagtcgaaagcggccccgtgaaggggaagccgagggtgccgagaccacaaagcgcccagctgtgtgtgctgctgtgttgtgaactccgtggtttgaacacgaaagaaatgtaccttctttcactctgtcatctttcttttctttgagtctgtttttttatagtttgtattttaattatgggaataattgctttttcacagtcactgatgtacaattaaaaacctgatggaacctgg

SEQ ID NO: 996 - DNA, 1796 bp, Homo sapiens
gcaggtttagcgccactctgctggctgaggctgcggagagtgtgcggctccaggtgggctcacgcggtcgtgatgtctcgggagtcggatgttgaggctcagcagtctcatggcagcagtgcctgttcacagccccatggcagcgttacccagtcccaaggctcctcctcacagtcccagggcatatccagctcctctaccagcacgatgccaaactccagccagtcctctcactccagctctgggacactgagctccttagagacagtgtccactcaggaactctattctattcctgaggaccaagaacctgaggaccaagaacctgaggagcctacccctgccccctgggctcgattatgggcccttcaggatggatttgccaatcttgaatgtgtgaatgacaactactggtttgggagggacaaaagctgtgaatattgctttgatgaaccactgctgaaaagaacagataaataccgaacatacagcaagaaacactttcggattttcagggaagtgggtcctaaaaactcttacattgcatacatagaagatcacagtggcaatggaacctttgtaaatacagagcttgtagggaaaggaaaacgccgtcctttgaataacaattctgaaattgcactgtcactaagcagaaataaagtttttgtcttttttgatctgactgtagatgatcagtcagtttatcctaaggcattaagagatgaatacatcatgtcaaaaactcttggaagtggtgcctgtggagaggtaaagctggctttcgagaggaaaacatgtaagaaagtagccataaagatcatcagcaaaaggaagtttgctattggttcagcaagagaggcagacccagctctcaatgttgaaacagaaatagaaattttgaaaaagctaaatcatgatggaagggggagagctgtttgacaaagtggtggggaataaacgcctgaaagaagctacctgcaagctctatttttaccagatgctcttggctgtgcagtaccttcatgaaaacggtattatacaccgtgacttaaagccagagaatgttttactgtcatctcaagaagaggactgtcttataaagattactgattttgggcactccaagattttgggagagacctctctcatgagaaccttatgtggaacccccacctacttggcgcctgaagttcttgtttctgttgggactgctgggtataaccgtgctgtggactgctggagtttaggagttattctttttatctgccttagtgggtatccacctttctctgagcataggactcaagtgtcactgaaggatcagatcaccagtggaaaatacaacttcattcctgaagtctgggcagaagtctcagagaaagctctggaccttgtcaagaagttgttggtagtggatccaaaggcacgttttacgacagaagaagccttaagacacccgtggcttcaggatgaagacatgaagagaaagtttcaagatcttctgtctgaggaaaatgaatccacagctctaccccaggttctagcccagccttctactagtcgaaagcggccccgtgaaggggaagccgagggtgccgagaccacaaagcgcccagctgtgtgtgctgctgtgttgtgaactccgtggtttgaacacgaaagaaatgtaccttctttcactctgtcatctttcttttctttgagtctgtttttttatagtttgtattttaattatgggaataattgctttttcacagtcactgatgtacaattaaaaacctgatggaacctgg

SEQ ID NO: 997 - DNA, 1585 bp, Homo sapiens
gcaggtttagcgccactctgctggctgaggctgcggagagtgtgcggctccaggtgggctcacgcggtcgtgatgtctcgggagtcggatgttgaggctcagcagtctcatggcagcagtgcctgttcacagccccatggcagcgttacccagtcccaaggctcctcctcacagtcccagggcatatccagctcctctaccagcacgatgccaaactccagccagtcctctcactccagctctgggacactgagctccttagagacagtgtccactcaggaactctattctattcctgaggaccaagaacctgaggaccaagaacctgaggagcctacccctgccccctgggctcgattatgggcccttcaggatggatttgccaatcttgtttttgtcttttttgatctgactgtagatgatcagtcagtttatcctaaggcattaagagatgaatacatcatgtcaaaaactcttggaagtggtgcctgtggagaggtaaagctggctttcgagaggaaaacatgtaagaaagtagccataaagatcatcagcaaaaggaagtttgctattggttcagcaagagaggcagacccagctctcaatgttgaaacagaaatagaaattttgaaaaagctaaatcatccttgcatcatcaagattaaaaacttttttgatgcagaagattattatattgttttggaattgatggaagggggagagctgtttgacaaagtggtggggaataaacgcctgaaagaagctacctgcaagctctatttttaccagatgctcttggctgtgcagtaccttcatgaaaacggtattatacaccgtgacttaaagccagagaatgttttactgtcatctcaagaagaggactgtcttataaagattactgattttgggcactccaagattttgggagagacctctctcatgagaaccttatgtggaacccccacctacttggcgcctgaagttcttgtttctgttgggactgctgggtataaccgtgctgtggactgctggagtttaggagttattctttttatctgccttagtgggtatccacctttctctgagcataggactcaagtgtcactgaaggatcagatcaccagtggaaaatacaacttcattcctgaagtctgggcagaagtctcagagaaagctctggaccttgtcaagaagttgttggtagtggatccaaaggcacgttttacgacagaagaagccttaagacacccgtggcttcaggatgaagacatgaagagaaagtttcaagatcttctgtctgaggaaaatgaatccacagctctaccccaggttctagcccagccttctactagtcgaaagcggccccgtgaaggggaagccgagggtgccgagaccacaaagcgcccagctgtgtgtgctgctgtgttgtgaactccgtggtttgaacacgaaagaaatgtaccttctttcactctgtcatctttcttttctttgagtctgtttttttatagtttgtattttaattatgggaataattgctttttcacagtcactgatgtacaattaaaaacctgatggaacctgg

SEQ ID NO: 998 - DNA, 1971 bp, Homo sapiens
atctgcaggtttagcgccactctgctggctgaggctgcggagagtgtgcggctccaggtgggctcacgcggtcgtgatgtctcgggagtcggatgttgaggctcagcagtctcatggcagcagtgcctgttcacagccccatggcagcgttacccagtcccaaggctcctcctcacagtcccagggcatatccagctcctctaccagcacgatgccaaactccagccagtcctctcactccagctctgggacactgagctccttagagacagtgtccactcaggaactctattctattcctgaggaccaagaacctgaggaccaagaacctgaggagcctacccctgccccctgggctcgattatgggcccttcaggatggatttgccaatcttgagacagagtctggccatgttacccaatctgatcttgaactcctgctgtcatctgatcctcctgcctcagcctcccaaagtgctgggataagaggtgtgaggcaccatccccggccagtttgcagtctaaaatgtgtgaatgacaactactggtttgggagggacaaaagctgtgaatattgctttgatgaaccactgctgaaaagaacagataaataccgaacatacagcaagaaacactttcggattttcagggaagtgggtcctaaaaactcttacattgcatacatagaagatcacagtggcaatggaacctttgtaaatacagagcttgtagggaaaggaaaacgccgtcctttgaataacaattctgaaattgcactgtcactaagcagaaataaagtttttgtcttttttgatctgactgtagatgatcagtcagtttatcctaaggcattaagagatgaatacatcatgtcaaaaactcttggaagtggtgcctgtggagaggtaaagctggctttcgagaggaaaacatgtaagaaagtagccataaagatcatcagcaaaaggaagtttgctattggttcagcaagagaggcagacccagctctcaatgttgaaacagaaatagaaattttgaaaaagctaaatcatccttgcatcatcaagattaaaaacttttttgatgcagaagattattatattgttttggaattgatggaagggggagagctgtttgacaaagtggtggggaataaacgcctgaaagaagctacctgcaagctctatttttaccagatgctcttggctgtgcagtaccttcatgaaaacggtattatacaccgtgacttaaagccagagaatgttttactgtcatctcaagaagaggactgtcttataaagattactgattttgggcactccaagattttgggagagacctctctcatgagaaccttatgtggaacccccacctacttggcgcctgaagttcttgtttctgttgggactgctgggtataaccgtgctgtggactgctggagtttaggagttattctttttatctgccttagtgggtatccacctttctctgagcataggactcaagtgtcactgaaggatcagatcaccagtggaaaatacaacttcattcctgaagtctgggcagaagtctcagagaaagctctggaccttgtcaagaagttgttggtagtggatccaaaggcacgttttacgacagaagaagccttaagacacccgtggcttcaggatgaagacatgaagagaaagtttcaagatcttctgtctgaggaaaatgaatccacagctctaccccaggttctagcccagccttctactagtcgaaagcggccccgtgaaggggaagccgagggtgccgagaccacaaagcgcccagctgtgtgtgctgctgtgttgtgaactccgtggtttgaacacgaaagaaatgtaccttctttcactctgtcatctttcttttctttgagtctgtttttttatagtttgtattttaattatgggaataattgctttttcacagtcactgatgtacaatt

(The sequence listing continues in the following parts.)

We claim:

1. A lipid nanoparticle (LNP) comprising a messenger RNA (mRNA) comprising:
   (i) a 5' cap structure;
   (ii) a 5' untranslated region (5'UTR);
   (iii) an open reading frame (ORF) encoding a human OX40L polypeptide comprising the amino acid sequence of SEQ ID NO: 1800 or 1801; and
   (iv) a 3' untranslated region (3'UTR),
wherein each uridine is a 1-methylpseudouridine.

2. The LNP of claim 1, wherein the 3'UTR comprises at least one microRNA (miR)-122-3p binding site or at least one miR-122-5p binding site.

3. The LNP of claim 2, wherein the 3'UTR comprises at least one miR-122-3p binding site.

4. The LNP of claim 2, wherein the 3'UTR comprises at least 2, 3, or 4 miR-122-3p binding sites.

5. The LNP of claim 2, wherein the miR-122-3p binding site comprises the sequence set forth in SEQ ID NO: 3587.

6. The LNP of claim 2, wherein the mRNA comprises at least one miR-122-5p binding site.

7. The LNP of claim 2, wherein the mRNA comprises at least 2, 3, or 4 miR-122-5p binding sites.

8. The LNP of claim 2, wherein the miR-122-5p binding site comprises the sequence set forth in SEQ ID NO: 3592.

9. The LNP of claim 1, wherein the ORF comprises a nucleotide sequence at least 80%, 85%, 90%, 91%, 92%, 93%, 94%, 95%, 96%, 97%, 98%, 99% or 100% identical to the nucleotide sequence of SEQ ID NO: 640.

10. The LNP of claim 1, wherein the mRNA comprises a poly A tail.

11. The LNP of claim 10, wherein the poly A tail comprises at least 100, at least 120, or at least 140 nucleosides.

12. The LNP of claim 1, wherein the OX40L polypeptide comprises the amino acid sequence of SEQ ID NO: 1800.

13. The LNP of claim 1, wherein the OX40L polypeptide comprises the amino acid sequence of SEQ ID NO: 1801.

14. The LNP of claim 1, wherein the mRNA comprises at least one modified cytidine.

15. The LNP of claim 14, wherein the at least one modified cytidine is 5-methylcytidine.

16. A LNP comprising a mRNA comprising:
(i) a 5' cap structure;
(ii) a 5'UTR;
(iii) an ORF encoding a human OX40L polypeptide comprising the amino acid sequence of SEQ ID NO: 1800; and
(iv) a 3'UTR comprising at least one miR-122-5p binding site or at least one miR-122-3p binding site,
wherein each uridine is a chemically modified uridine.

17. The LNP of claim 16, wherein the ORF comprises a nucleotide sequence at least 80%, 85%, 90%, 91%, 92%, 93%, 94%, 95%, 96%, 97%, 98%, 99% or 100% identical to the nucleotide sequence of SEQ ID NO: 640.

18. The LNP of claim 16, wherein the mRNA comprises a poly A tail.

19. The LNP of claim 18, wherein the poly A tail comprises at least 100, at least 120, or at least 140 nucleosides.

20. The LNP of claim 16, wherein the chemically-modified uridine is selected from 1-methylpseudouridine, 2-thiouridine, pseudouridine, and any combination thereof.

21. The LNP of claim 16, wherein the chemically modified uridine is 1-methylpseudouridines.

22. The LNP of claim 17, wherein the chemically-modified uridine is selected from 1-methylpseudouridine, 2-thiouridine, pseudouridine, and any combination thereof.

23. The LNP of claim 17, wherein the chemically modified uridine is 1-methylpseudouridine.

24. The LNP of claim 16, wherein the mRNA comprises at least one modified cytidine.

25. The LNP of claim 24, wherein the at least one modified cytidine is 5-methylcytidine.

26. The LNP of claim 17, wherein the mRNA comprises at least one modified cytidine.

27. The LNP of claim 26, wherein the at least one modified cytidine is 5-methylcytidine.

28. The LNP of claim 16, wherein the mRNA comprises at least one miR-122-5p binding site.

29. The LNP of claim 28, wherein the mRNA comprises at least 2, 3, or 4 miR-122-5p binding sites.

30. The LNP of claim 28, wherein the miR-122-5p binding site comprises the sequence set forth in SEQ ID NO: 3592.

31. The LNP of claim 16, wherein the mRNA comprises at least one miR-122-3p binding site.

32. The LNP of claim 31, wherein the mRNA comprises at least 2, 3, or 4 miR-122-3p binding sites.

33. The LNP of claim 31, wherein the miR-122-3p binding site comprises the sequence set forth in SEQ ID NO: 3587.

* * * * *